United States Patent 9,012,723 (ISOLATED NOVEL ACID AND PROTEIN MOLECULES FROM SOY AND METHODS OF USING THOSE MOLECULES TO GENERATE TRANSGENE PLANTS WITH ENHANCED AGRONOMIC TRAITS) - sequence listing, part 16

SEQ ID NO: 77415 - DNA, 594 bp, Glycine max
  Peptide Sequence Number=SeqID_169100
atggtttttgttgattctgagggtgatcaaattcatgctatttgtaaatcggacaacctcaagtcttggaaagctgatttgaaagagaattgcacttatgttatgcataatttcaaagttgtcaagaataatggtcaatttagagtgtgcgaacatgagtacaagttattttttattggagtgacggttgttagagaagctgatttgcatgaactgccttttaaggaatttagatttgttgaatttgcaaatgtcgttgctggcaattttgtgtctagcctgttggttggaagttatccagcttcagtgagcaattccttcaaggcgtcaaaactattgattaatgatcctatattggaaattcaggaatttaaagataggcttttagatttaggtgttgaggtgagtcgagtttcgctacctggcgatcaagcaagctcacaagttccagggggaagtcagctatcatcaaaggattcgtttctttcaaaggccgaagccaaaactattttagaaatcaatgccatttctgaggtggacctgttatctgtgtttattttatattcattgcagttggaagtcgaatttggctag

SEQ ID NO: 77416 - DNA, 174 bp, Glycine max
  Peptide Sequence Number=SeqID_169101
atgacgtgcgaccattctttggtcctcgtgagctgcgtggcacccatcattaggcaatttgtgaaatttcgggacatgccggaaatccaaaaaaatattgatgcacaatccggttcagtaacattacggaaagaaaacaagtatcgttacgaaattggaaatcctcaattttga

SEQ ID NO: 77417 - DNA, 171 bp, Glycine max
  Peptide Sequence Number=SeqID_169102
atggagaattggcgaacaccgttacgcaataccttcgcggggctccagactcgaaggtggaggacacatgaaaagcgctgggcaatgacattcaaggcactaggcaatgacattcatgggtctccgaaaaaagtagagaatggagaattggcgaacagcgctacgcaataa

SEQ ID NO: 77418 - DNA, 336 bp, Glycine max
  Peptide Sequence Number=SeqID_169103
atgtcgtcacgcacacgttgtatgtttttctcgtcttttgtcatgggaagtcagaaggtccatatcaccttcttaactgcacacatggagcactgcacccccaaatgcgcaagtactgttgcaacctacccttcggcgggagggcgatgcggggctcacgggtgcgtcttccatgagaggaaaatgcgcgaagtcaccaccaacgttaattcaaggaaaacgtcggaaaaaccggaaaggtgtggtctacgaactttaagtgtgaaaggttcgggagttgtatttacgcatggggaagggtctttcccttgctcctatgtattcctcaatttgtga

SEQ ID NO: 77419 - DNA, 802 bp, Glycine max
  Peptide Sequence Number=SeqID_169104
gaggactacacgttcacgccttcagaggactacgcctcctcgccttcagaggactacacgtcctccccatcagagaactgcacgtcctcgccatcagagaactacacgccctcgcctacagaggactacacgtcctcgcattcatagggctgcacaccctcgccctcaaaggactacacgtcctcgccttctgaggactacacctcctcaccttcacaggactacacatcctcaccttccgacggctacacgcccttgccttcagaggactacacgtcctcacattaagaggactacacgcctttgccttcagaggactaaacggctacttgccctaaccatcagagggctacttgccctaaccatcagagggctacacgtcctcaccttcagagggctacacgtcctcgccttcatagggctgcacgccctcgcctttagaggactacacgtccacgccttcagaggactacacgtcctcgcctttagaggactacacgtcctcaccttcagagggctacttgccctcaccatcagagggctacacgtcctcatgttcagaggactacacgtcctcgccttcatagggctgcacgccctcgccctcagaggactacacgtccacgccttcagaggactacgcctcctcgccttcagaggactacacgtcctccccatcagagaactgcacgtcctcgccatcagagaactacacgccctcgcctacagaggactacacgtcctcgcattcatagggctgcacgccctcgccctcaaaggactacacgtcctcgccttctga

SEQ ID NO: 77420 - DNA, 141 bp, Glycine max
  Peptide Sequence Number=SeqID_169105
atggataccttagagccctacactggggcaatgaagggcaccgtgcacgagcctcaagttcccagctacaaggtcatgacaaaagataacaattggtacctcaaagccttacactggggcaatgaggggcatcgtgcatga

SEQ ID NO: 77421 - DNA, 305 bp, Glycine max
  Peptide Sequence Number=SeqID_169106
ctataagcctgtttggaaaattattaatgagaggtgggatcatcagcttcacatgcctttgcatgtagctgcatattatcttatcctcatctgcattatgaacctacttttagacatgatgaccctcagaaaaagtattgctcttccatttgatgagattgagtctgacgatgaatggataactgaagagggatataatgatgaggatgagcaacctcaaggtgaaggtgatggtggcaatgttgaattagtgggagatgttggaggaagttcaaatgatctagttctagatgtttttgatctag

SEQ ID NO: 77422 - DNA, 252 bp, Glycine max
  Peptide Sequence Number=SeqID_169107
atgattgtggctgaatacgcaaccaagtttgaggagctggagagatactttccccattatcaaggaagagatggcgaaaaatcaaaatgtgtgaagtttctgaacggcttgatttgggatgaagactcccaagactgggtggcctattataggagtacaggcccaatgaaaaacaaaaagaatggagctccacataggggaaaaccatactcaacccctcctaagcaatatggtaattgccctaacaattag

SEQ ID NO: 77423 - DNA, 654 bp, Glycine max
  Peptide Sequence Number=SeqID_169108
atggccaagttcgacccagacatagtcctcgagttttatgccaatgcttggcctacagtggagggtgtacgagatatgcgatcctggggccaggagtgcgagtatggccagaggaggaaccgggccgatgggtttgatgaggaggccatcgcccagttgctatgtataccggggcaggattttgcccagactgctgctggaagacggggtatggcacctaccaggcaccctctggacccggataagtccaacagggccctgggatttcccgctttgatcacagggactctgccagtcgccgcagacgcgccgccacctcatcaggctggtccagccaaatcgtttgatacggagcagtatttgcggcatttggttcgccagcaggcggccaaccaccgagcacatgtacagacccatgattgtctttatcagatgagtctcagcctgcagagccagcgctttacttcttttccgtgccctactccagaccagttcagggcagaggtcgcatggcctggagattggcctgaggcctgggcaggagaggcaccagcagaggcacccgcagaggctcccgacgaggcagatgaggcccgcgaggacgaggagatgaccgatttactggatttcttaggagggagcgggaccacatga

SEQ ID NO: 77424 - DNA, 231 bp, Glycine max
  Peptide Sequence Number=SeqID_169109
atggcagcagaatggaaaaggaagagagagaggagacgccacttcaaggagaagatgagtctagaagaagctcaccaccataggaggccatggataagagtttggaggaagaaggagatgaatgaagggagagggagagaagagcacgaaattttgtgctctaaaagagctttgaaatctgaacccactaatccaagatcaattccaagattctccattaagtgtgcatag

SEQ ID NO: 77425 - DNA, 303 bp, Glycine max
  Peptide Sequence Number=SeqID_169110
atggtggcccaggtgatgttggggcacggctacgagcccggaatgggtttgggcaagaacaacggcggtaggaccagcctggctgacataaggaaaaacatctcagaaaggaagaacaaaggccaaggcccgcggtcgggacaacgagccaaagagactccgtcgtgccacatcagtaggagtttcgtaagtgtgggtttaagacgcgaaggacaagtcgccgcgatatgcgatgaggactccccgaggagatcggatttggtacaggcatgctctcccggtttccaactaggaaattggcag

SEQ ID NO: 77426 - DNA, 243 bp, Glycine max
  Peptide Sequence Number=SeqID_169111
atggcgacaaaaggcggtgtggtcgacaaaagcgaggctcttgctcctacgtatcctccaatgaggaactcagacctacgtagttctggacacttggggtcactgaatgacgaggtgcggataaccgtaaggtgtctccgcgggctaccagctcttgagttatggcgacaaaggcggtgtggtcgacaaaagcgaggctcttgctcctacgtatcctccaatgaggaactcagacctacgtag

SEQ ID NO: 77427 - DNA, 426 bp, Glycine max
  Peptide Sequence Number=SeqID_169112
atgtctcctaaaaaagagttaatttttgagctgcagggaaaagatgtaaatggtggtgagcaaccactatctgacaaagatttactaactctcgagcaattcaaaaaagagaatcgtgagttgaaggagagattgcaaaggaaggaggaggacattttaggggaagtgttgcatgctctgcagcatgagaaagacaggtgtaaatctcttgaaactcagctcattgatgctgaaaaaaagcttgaagagttgaacaacgagcaagaaactctcattgatgtattcgctgaagagagggacagacgtgatgctgaagagaaaaaattgagaaataagctcgaggaggcatcaaatactatcaaagagttgcttgaaaagatacggaagcttgaaaggaagtcttcaagcggcaaactagatcgataa

SEQ ID NO: 77428 - DNA, 315 bp, Glycine max
  Peptide Sequence Number=SeqID_169113
atgcaattagcaggagatttggaggcagagaaagttgatttaacagcaggtgttgggcgaaatgaggcattggagcattgggctaggagtttggtaactactacagggaggcagaatttgacttgtgttgctgtgctgggcaaaattggagtgcagagaaaacaagtagagcacattttcaatgaccagttactacccattgtcgatgttgacatccatgaagtcaaggaagctcgtaagcgttttgataaagcttcccttgtatatgaccaggttaaaatgaagtataggatcagggatgaaatccatgcataa

SEQ ID NO: 77429 - DNA, 945 bp, Glycine max
  Peptide Sequence Number=SeqID_169114
atggcagctttttcatcccaatactaccattcctttgtggttgactccgcatgcttctcaattactcctcccattataaacacttctagtaactttcttccttctcctcattatcttcacaataataatattcaggaaacgtcttatagtgtcactgataataaggaaacaagctgttttgaacaaagctccaaggttaccatcagtgacattgaactttctgtggtaaaaaaccatagtcctgagacttccatggtagtggacaagcttgaaaaaggtgaacaggtcactcagaaggtggtgacccgcatggagaagaagagaagagcaagaaatggatcttcctcgagtgaccctttatcaaaggagtcaacagaagggggaaagaagaaacaaaagaagccaaaagaagtgacgaaggacaagaaaataggtgctgaagatcctccaactgggtatatccacgttagagcaagaaggggtcaagcaaccgatagccacagccttgctgaaagggtgagaagagagaaaataagtaaaaggatgacgacgttgcagcgacttgtgccaggctgtgataaggtaaccggaaaggcccttgtgttggacgaaataatcaattatgttcagtccttacagaatcaagtggagttcttgtcaatgaaacttgcatccgtgaatcccatgttctttgactcggccatggacttagacaccctcatggttagacccgatcagaaattgagtaatatagcatcaccatcaccactaccatgtgtagcacaattcagaccccaccaggccattgcttttgctgacacaattaccaccccgaccaccactaccaatagcttccccacagctaataatgatggctatcttttggattattcatcctcactttttcttcaaggccatagaccaaatatctttgaggtatgttaa

SEQ ID NO: 77430 - DNA, 2598 bp, Glycine max
  Peptide Sequence Number=SeqID_169115
atggcgacgtcggaggtatccatcaagggaaattcggtgaacggaaaaggagataatagttctggtggctacaccaacgatgttaggaacggttctggtggaggcgaggctcggaattcttcttcttcgtcttcatccgcgagagacgcggaagctgcgctttacagggagctgtggcacgcgtgtgcaggtcctctggtgacggtgcccagagaaggagagcgcgtgttctactttcctcaaggacacatcgagcaggttgaagcgtccacaaatcaggtagcggaacagcatatgccggtttacgatctaccacccaagatcctttgtcgggttatcaacgtcatgctcaaggcggagccagacacggatgaggtgtttgctcaagtgactttacttcctgagccaaatcaagatgagaatgcggtggagaaagagggtcctccggcggcgcctcctcggtttcacgtgcattcgttttgtaaaacgctgacggcgtctgatacgagcactcacggtgggttttcggtgctgaggcgacatgccgatgaatgcctccctccgctggacatgacgaagcagccacctacccaggagttggtggccaaggatctgcacgggaacgagtggcgattcaggcatatttttcggggtcaaccgcgtagacacttgctgcaaagtggttggagtgtttttgttagctccaagaggctagttgctggggatgcgtttatatttttaagactaattttagaaactttcaggggtgagaatggggaacttcgagttggtgttaggcgtgcaatgagacaacagggtaatgttccatcatcggttatctcaagccacagtatgcatctcggtgttcttgcaactgcttggcatgccatattgactgggaccatgttcactgtgtattacaagcctaggactagtccagcagagtttattgttccctatgatcaatacatggagtctctcaaaaataattataccattggcatgcggttcaaaatgaggttcgaaggtgaagaggctccggagcaaaggtttactggtaccattgttggaattgaagatgctgataccaaaaggtggccaaagtccaaatggagaagtcttaaggttagatgggatgaaacatcaaacataccacgtcctgagagagtttcacaatggaagatagagcctgctcttgcacctcctgctctgaatcctctaccaatgcccaggcctaaaaggcctcgatctaatgtggttccatcatccccggattcctctgttcttactcgtgaagcttcatctaaagtcagcgtagatcctttgccaacaagtgggtttcaaagggtcttgcaaggtcaagaactgtcgaccttgagaggtaattttgctgaaagcaacgaatctgatacggtcgagaagtctgctgtgtggccacctgttgcagatgatgaaaagattgatgtttctacctcaagaaggtatgggtcagacagctggatgtcaatgggaaggcatgaactaacatatccagatctgctttcaggctttgggacccatggagatcattcatcccatccatcctttgttgatcaaaatggtcctgtagctaatgttggtagaaaacatttgttggattgtgaaggcaaacataatgttctgagtccttggtctggagtgccatctagcctgtcactgaatcttttggactcaaatacaaaaggctctgctcaaggtggtgatacaacttaccaagttcgagggaatttgaggtatagtagtgcatttggtgagtaccccatgcttcatggacataaagttgagcattcacatggaaactttttgatgccaccaccaccatcaactccatatgagagtcctcgttcaagagaactgttgcccaaaccaatatcagggaaaccttgtgaggtttcaaaaccgaaagacagtgactgtaagctatttggcatctcacttcttagtagccccattgcaccagagccttctgtatcacaaagaaatgtcccaagtgagccagttggtcacatgcatacaacatcacaccaacagcgtgcatttgacaacgatcagaagtctgagcattcaagggggggatcaaaaccagctgatggtctgctgattgacgaccatgaaaaggtgttacaaacttctcagacacatctgaaagatattcaagcaaaatctcatagtggttctgctagaagttgcactaaagttcacaagaaggggattgcgctcggtaggtcagtggacctcacaaaattcagtgattatggggaattaattgctgaattagatcaactattcgaatttggaggtttattaacttctccacaaaaggattggcttattgtctacactgataatgagggagatatgatgcttgttggtgatgatccgtggcaggaatttgttgcaatggttcgcaaaatttatatctaccccaaagaggagattcagaaaatgagcccgggtaccttgagttcaaagaatgaagagaatcaatctgctagtgaaggtgccacagacacacaagaaatcaagtgtcagctcaataattcagcttcagatacctga

SEQ ID NO: 77431 - DNA, 273 bp, Glycine max
  Peptide Sequence Number=SeqID_169116
atgacgacatcaacggcgacaatgattgtggtaattacaatggcagtgatagtagtaacgacaatgacgacagtagcaataacagtggtggtggcaatggtgacgacggcattgataggttgcagtgacggcagtgggagtgatagtgacagcggtagtggcgattgccacaatagtggcaatgacaacaacaggagtggtggtggtggcagcagtggcaggggtggcgatgacaatgacaaaagtggtggtggcaatggggagagggagtaa

SEQ ID NO: 77432 - DNA, 219 bp, Glycine max
  Peptide Sequence Number=SeqID_169117
atgacctcaacactcctctcaagctctgcactcccttgctttacgacaattgttggggaaggagaagacgacgtagagcacgatgacaacttgttgatgtggaggacaacgaggctggttatgagggcgggagagttgaagaggcaacgtcggaagaggaagttggagtgggagaggtgcgtagagtttggagggaagaggaaaagaagggaattgtag

SEQ ID NO: 77433 - DNA, 1637 bp, Glycine max
  Peptide Sequence Number=SeqID_169118
ataatttcaaagaggaacttcaattgctaggtgttgtagttggattcagcagaaaagttgttactgaacatttaaaatcacggtcttatttgaaatccttgacagctgaggctgttgtgttgatgctggaatgtatacattttgctgatgtctctcataaacttgttaacgcccttaaaagaaccaactgtttaaagacgtatattggtttcgaaattcccagtgaatgtttcttgctggaccctgtatggggctgcatactaaatgtattcaatgatttcccggtgattgatcacaaattctatggagacaagatactcacttacaaaattgagttgaggaaaactggagtagtgattgattttgaggaggcaatcaaagcattcggccatactcgggttggtgattataggtcttccaaaaaatgcattctatttggtccagattgggaatctttctctgcaattactcgtctcccttttattggtgacagtgacaattgttatggcaagtttgtacatgagtacaaagaggagttaaagagtacgggagtaatcactgaaatcaaacatggtttgaattttgttactacttttcttaggttcccttcagatccatcctctataacccgtgagagtgtgttttcattgttggaatgcatccggtgtttgaataaaaatgattggaaaccagaaaataaagctaccaaaaggatttggattcctaaggcagttgataatggagagtgggttagtcctgaacaacgtgtcaatcatgacatgggtgatctttttggttcaagaagcatgccctcacttgatgattatattgagatatggaaggaatgggagagttctggggaacaactgtcacacgataaatgctgtaacttctgggcttatgttttgcaacatgaaagcaagaggacagtgaaaaacattgctgagagcttgacaaaactacccattacatcagggtctgatttaatcttattgttggacaaacgtgatgtttttgttgctgacaaccttcatttgcagaatctttttgagcaagagagagtatttgtctggtatcccgagtcaagcttagcatcactgccaaggtctgaattattagacttatacaagaaaattggtgtaagcattatatccgagtctgtgcttaaggaagaatcatccttactagatggtgttgaagtcaggcaagtggatccaagcaatattttcattggcaaggggttggttaaacttgtcctcagctttcttgcttgttctagcatcaaaatagaagcagagaagagacatgaagctgtccaaggtcttattgagcttactgtccatgagacgattgaacctgtcactgtttgctatagtttatctctatcatcagggaagaccattactaagaaatggagatataagcatgctaaaaatatgccacatatttctcaagcaatctctgcgggtgtattgcgtgagaatgttgacaatgttcttgcgctctctgagctgatcaagttaggcttcctggtgaagtttaatgaggaagcagttgatttcttgatggaatccaaggatttgcagattttcttagaagacgaggagttcctccgttctgccttcccatttgtctag

SEQ ID NO: 77434 - DNA, 855 bp, Glycine max
  Peptide Sequence Number=SeqID_169119
atggggattggcaattcaaagtcaaatgcagccgaaggagagaggttacctcccaaaatccgccctatgctcgttagccgatttgaggagttcagaaaacgtaggaatggagaaaccaccctctccaagaagaatctgttgaatgaagaggatgacaattctcaatcttcacacagaactgaagaagaaaataaggtttcttcttcaaaggagattgaaccacctaaagaggaaacggttgagcgagtaataaccgcagaaaaactgtccagagtggttccagtgcccaactctgaatgtgaaaatgtggaggagactcaccccaacaaagataacatagagcaggttatcaaatacatggatcccagccaagatgtatttaatcgtgctgttgagatggccgaggcagaggttaaaacagaggaggaaaagactgcagagctagtggaagagacaaaggaagaaaagaagcaaaaagtggatgcaaaaggtgatgatcatcatgaggatagtggtgatgaagatgaaagtgaaaaagttggcaggtttctatgtcctggatcgccaagtttcagaatttattgcattgaggctgagaaaagaaacgaggaagaatgtaatggtccaaccattgtgctccaaaagtcgcgcagtgtagacagtgttgaaacagctgaatcaacaaattcaaacgaggtacttcaggaattagaatcaacttcgaagagaaaaggacataagaagaaatttggtgctatgaagactctactcaaggttaagtcgctctatcacccaatgtgtacctgtactggcgatgacaaaagccatatttttactgcaaaggcaacgaaatga

SEQ ID NO: 77435 - DNA, 843 bp, Glycine max
  Peptide Sequence Number=SeqID_169120
atggctcacgccaatcctatgatttttgttgttggaattctagcaccagtaccaacattttatcgagtttgtaagaagaaaaccacggaaggtttccaatcacttccttacgtggctgcactcttcacttcaatgctttggattttttatgcgtacataaagacgggcgaaatacttcttatcaccattaacgcattcggttgtttcatagagacagtttaccttgtcatttatatcatttattgccccaagaaagctaggttctttaccttcaagatgattttcttgttcaacgttggggtgattttcttggtggttcttcttacccacgttctagcaaaagaacgaacagcccgtatcgagcttcttggatggatttgtgttgtcctttcgaccagtgtgtttgcagcacctttaagcattatcaaagtggttattcgtaccaaaagtgtagagttcatgcctattactctgtcactcctcctcacagtaagtgcaacgatgtggatggcatacggtattctcctcagggacatctatgttacacttccgaactttgtgggtatcacatttggaacgattcagatagtgctctacttaatatatagaaagagcaagcccgttaaggatcaaaagctgccagaacacaaaaaccatgttgttaacgatgaaaacgccagcacagctgtgagtggtgagaatcagggaccaaacactactggattcgttgatattgagattggagagaagaagcaagttcaggaacaagcagagaaaaaacaggaccagcagtttgttaatgctcgtgaccaaacagaacacaacaaaacaagggaaagttga

SEQ ID NO: 77436 - DNA, 342 bp, Glycine max
  Peptide Sequence Number=SeqID_169121
atggaaaatggtgggttacgcaccttcaagctttgcggatttggtcttcgccgacgaaatgatcgaagtgggtctaaaaagaggcaaatccgatcatcttgctttgataaatgtaaaaaaaaaaaaaaaactggggcaagtgaagaggataagaaggagggagaaacctatgctgtgactgccattcttatacgaccaagtttcctaccaacccaacaatgtcattactcagccaataacaacccttctcattacccaccacctagtcatccacaaaggccatccctaaaatcaaccacaaagcctacctatctcacttccaatgacaaacaccacctttag

SEQ ID NO: 77437 - DNA, 179 bp, Glycine max
  Peptide Sequence Number=SeqID_169122
tctcgcaacattctggaaatcaaaaaaagcattattgcggaatccctaaagatctgcaacattccggaagtgaaaaagagcattgttgcataatccgtaaagtcccgcaacattccagagggcaaaaagagtatcattgcataatccgtgaagtttcgagatgtttcgagaagaaaccg

SEQ ID NO: 77438 - DNA, 1496 bp, Glycine max
  Peptide Sequence Number=SeqID_169123
atgattgaacaaccgggagcaatttacttacgatatttagttgacattcataaaaagtatctaatgatttatgaattcaatacatcctgtttagcagaaagacgtatattccttgctaattatcagacaattacttattcacaaaccttgcggggggctaatagttttcatttcccatctcatggaaaacccttttcgctccgcttagccctacctccccctagtaggggtattttagtgataggttctataggaactggacgatcctatttggtcaaatacctagcgacaaactcctatgttcctttcattacagtatttctgaacaagttcctggataacaagcctaagggttttcttattgatgatagtgacgatattgatgatagttacgatagtgacgatatcgaccgtgaccttgatatggagctggagcttctaactatgatgaatacgctaactatggatatgatgccagaaatagaccgattttatatcacctttcaattcgaattagcaaaagcaatgtctccttgcataatatggattccaaacatccatgatctggatgtgaatgagtcgaattacttatccctcggtcttttagtgaactatctctccagggattgtgaaagatgttctactagaaatattcttgttattgcttcgactcatattccccaaaaagggattcacttggaaaagaaaatgtcccatactaatggattcgggtccacaacgatgggttcaaatgtaagatcggttcaggatcatgggatccttttctatcagataggaagggctgtttcacaaaatgtacttctaagtaattgctccatagatcctatatctatctatatgaagaagaaatcatgtgacgggggggattcttatttgtacaaatggtacttcgaacttggaacgagtatgaagaaattaacgatacttctttaccttttgagttgttctgccggatcggtcgctcaagacctttggtctctacccggacctgatgaaaaaaatgggatcacatcttatggactcgttgagaataattctgatctagttcatggcctattagaagtagaaggcgctctggtgggatcctcacgtacagaaaaagattgcagtcagtttgataaggatcgagtgacattgcttcttcggtccgaaccaaggaatcccttaaatatgattcaaaatggatcttattctatcgttgatcagagatttctctatgaaaaatatgaatcggagtttgaagaaggggggggagtcctcgacccacaacagatagaggaggattttttcaatcacatcgtttgggctcctagaatatggagcccttggggctttctattttattgtattgaaaggcccaatgaattgggatttccctattgggccaggtcatttcgggacaagcggatcatttatgatgaagaggatgagcttcaagagaatgattcagagttcttgcagggtggaaccatgca

SEQ ID NO: 77439 - DNA, 378 bp, Glycine max
  Peptide Sequence Number=SeqID_169124
atgtcaaaatatggaggctggtcagatcttagtaatggaagggacaaagcttggcattctcaatggtggaaggacctccgaaagctatatcagcagcctgagttcactcttattcatcagcagatggtatggaaggtaggggaggggaaaaaaattaaatgttggaaagataaatggttaggggatgattgtcaacttgaacaacaatataatcagttgctcttgattagtggtcagcagaatagtaccatctcgaacatgggaagcttctctcaaggcaattggtgttggggcttaaagtggagaaggaatctatttgattatgagcaacatatagttgtggcatttatggaagcaattactgatatacaaatctag

SEQ ID NO: 77440 - DNA, 342 bp, Glycine max
  Peptide Sequence Number=SeqID_169125
atggaagcgcagacacgaactcaacaatgtggttgcagtcacggaagcgcagcccagtttgcgacaaacacgaactcaggcagaaggagaaacaacaataacgccctgggagtacccttttcgggactctttcctttcctacttttcttcgacctgcgaaatcacggaagcgcgggccagtttgacacaaagacgatctcaggtaaaaggagaaagaagaagaacgatagggttcaagcgcgcgggttgtgcaatttcagaagtttaatatataatgataacaacatcggttttttaaaaataaccgatgttaacatcaactcgataacatcggttttgtaa

SEQ ID NO: 77441 - DNA, 288 bp, Glycine max
  Peptide Sequence Number=SeqID_169126
atgtcaaagaatcaagagttaagcaaattcaaaagattcaagaatctagtttcaagaatcaagattcaagaatcaagattcaagaataatcgagctcaagattcaagactcaagattcaagaatcaagagaagactcaatcaagataattcaagtggagggtacatccacttggtttttcaaagagaacaagggagggtacatcccttgtggatctttggcttgtaaaggattttacaaggttgaaagaaatctcaagaaccgcaggttgcttggggactggatgtag

SEQ ID NO: 77442 - DNA, 196 bp, Glycine max
  Peptide Sequence Number=SeqID_169127
ccttcgcatgaccgcttcgaggaacttgacacccatcgttaggcaatccgtgaagttccatgacatgccgggagtcgaaaggaaacattattgcgcaatccgtaaacaattcaagtctaggcccttccagaacattttggaagttgggttccttaaggaggaagcaactgggtggcaagctcctccacgtttttga

SEQ ID NO: 77443 - DNA, 309 bp, Glycine max
  Peptide Sequence Number=SeqID_169128
atgactgaacatgatgtttatgggagagattgtggaagcaatgacttccgagattattttgatgatgccaaagaatcaagagttaagcaggttccaaagaaccaagagtcaaaaagcttccagaatcaagtttcaaagaatcaagattcaagaataatcaagtttcaagattcaatcaagtttcaagaatcaagattcaagaacaatcaaaatccagattcaagactcaagattcaagaacaatcaagatcaagattcaagactcaagattcaagaatcaagagaagactcaatcaagataagtactaa

SEQ ID NO: 77444 - DNA, 216 bp, Glycine max
  Peptide Sequence Number=SeqID_169129
atgccaatctccccctgcagatgtatcagttgggatcgcgcccacaagacgcccagtggacccgaagaagttcaacagggccctggggtttccagctctggttacgggcctttgtcagtcctacagggtgcccgtccccccagcgagggatcgtgcccacaagacgcccagtggacccgaagaagtccaacagggccctggggtttccaactctga

SEQ ID NO: 77445 - DNA, 290 bp, Glycine max
  Peptide Sequence Number=SeqID_169130
atgacattgctacttagcaacattctgcccagcgaccgcaatgccaatctccccctacaaaagtgtcagttgggatcgcacccacaaagacacccagtggacctgaagaagtccaacagggccctggggtctccagctctggttacgggcctctgtcggccctacagggcgcccgttccccccagcaagttcatgtcgtcgtggcatagggattgtgcccgcaagaaacctggtggacccgaagaaggccaacagggtcttggaggtcctagctctaaatacgggtctct

SEQ ID NO: 77446 - DNA, 204 bp, Glycine max
  Peptide Sequence Number=SeqID_169131
atggcgaaaatgccactgccattggcagaatgcagtggtgtcgccagtgccattagcgatttggccatgcaagggcaggctagggcacggctttccaaacttttcagatttcagatggcagtgcttttttcaaatggccgtgctttagacggtgtcaatggatatagcaagtggtgttggcgagatcatgcaatatggatatag

SEQ ID NO: 77447 - DNA, 498 bp, Glycine max
  Peptide Sequence Number=SeqID_169132
atgaagctaacggacctcaatgaaaaagcccccatcacagactgccatgcagacgcgagtcagtggtttaacacccatggggaaatttcgggcaatacagaaaaaggaatagagggggagcacgaaaaagcattgcctcttgaggtatctatgcctcacaacaacattttgaatatcacgaatcccagcatggtctatgctgcctctggtcaacacgacttaaaagtggcatctgaggaaatgggccagcagacatgtggcccaactctttttgccccaaagcttgagaaatcaattgtggacttcaacccaacctctaaaactgacccttcgccttcattacacgaggactctatagagctgcaatgtgccctttttaaggaaatgggcttgacttatggggaagatgataacaaggttaaggggctgttgctggatatggagaataagtataatatgatggcagcagagaagggaattaaaattcaacaattatga

SEQ ID NO: 77448 - DNA, 468 bp, Glycine max
  Peptide Sequence Number=SeqID_169133
gtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttccccagtcacgacgttgtaaaacgacggccagtgaattgtaatacgactcactatagggcgaattggagctccaccgcggtggcggccgctctagaactagtggatcccccgggctgcaggaattcgatggctagaaatctccacttgcaaattccgcaaaaagagtgtttcaaatctgctctgtctaaagggacgttccactctgtgagttga

SEQ ID NO: 77449 - DNA, 768 bp, Glycine max
  Peptide Sequence Number=SeqID_169134
atggcgaaaccatcaaagaagcgaaagggcacttcgatcaaagctttctattcaaactttgaaatccaagaaggcacccttatgcctgaagtttatgggattaagatggtcattgaccaatccctattctatgatttaacccaattgccaagtgaaggtgtaccatttgaaggtgcactgattgacgattggaagtttgatttttctgtgcataatgcccgccggttggtttgcaccaaccaagcggatatgaccggaaggcttcttgcctgttcattggcttttgaaagctacatccttcattatctaattgttcgcatcttgcttccgagatcttcaaaccttgcacaggtttctgaagaagatctcattgttatgtgggcctttcataaaggtctacaaattgattgggcacttcttgttagatatcgcaggcataaggcattgcgattgaatgctcctttgccatatcctcatctagtcactcttttccttcaacactttaacatccctcttgattctgaaccctatgttccaatcaagagatccttccttataggcgcttcagtcattgcatcctttggttatcaaaaagagcatgatggctcttggttgaaaaagggtgctcgacatattggtgaagaaggacatgatggagaagattcatctcttctttcaaagattttggacaggtttgatggtcttcaaacctttgttggtgaaaggtttgacactttggaattacaagtggacatgcacttccattag

SEQ ID NO: 77450 - DNA, 339 bp, Glycine max
  Peptide Sequence Number=SeqID_169135
atgaggaccttggacaccctaaagttcgttatgctgatggagaaaaccacgaggtcatcttggttgacgaggttgatgcccttgaagtccctgtccgtaaaggtgccatttttgggactagctggactatcctccataggaaaagccgccaacgatggtgtttattacacctctaatatgctcgacaggttccagatctggtggaggttgttgctcatgccattgttgttggtgtctttgtctgcctcagtcttctgctcttcttctgtctgcttactggttcctatgttgctcctcttgatgtcctctgggtcttggtcctgcttggtggttgtctag

SEQ ID NO: 77451 - DNA, 228 bp, Glycine max
  Peptide Sequence Number=SeqID_169136
gtgctggaagcaaccatcaaagccaccacagagaagaagatggagctggaacggctgatcaaaaggctctcagaaagtggcattgatgatggagaagcagctgagcaagaagatgaagcagctgaggaagaggtagaagcagccgaggaagaagaagaagctgctgaggaagaggaagatacagcagaggatactgaatcagatgatgattctgaagccaccccatga

SEQ ID NO: 77452 - DNA, 343 bp, Glycine max
  Peptide Sequence Number=SeqID_169137
ggcgaattggagctccaccgcggtggcggccgctctagaactagtggatcccccgggctgcaggaattcgattgtttatcaagcttatcgataccgtcgacctcgagggggggcccggtaccagcttttgttccctttagtgagggttaatttcgagcttggcgtaatcatggagaaaaaaggctgcaccggtgcgtcagcagaatatgtgatacaggatatattccggctttcctcgctcactgactcgcttacgctcggcgttcgactgcggcggcggaaatggctttacaacgggggcggagatttcctggagatgccaggaagatacttaaacagggaa

SEQ ID NO: 77453 - DNA, 423 bp, Glycine max
  Peptide Sequence Number=SeqID_169138
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccggtccgaccgctgcgccttatccggtaactatcgtcttgagtccaacccggaaagacatgcaaaagcaccactggcagcagccactggtaattgatttagaggagttagtcttgaagtcatgcgcccggtaa

SEQ ID NO: 77454 - DNA, 486 bp, Glycine max
  Peptide Sequence Number=SeqID_169139
caagccatatgttcctcctccaatacagcagcaacaacaacaacaaagacaacaaccaactgaggcccctcctcaaccttccttagaagagttagtgaggcaaatgaccatccagaatatgcaatttcagcaagagacaagagcctccattcagagtctgacaaatcagatggggcagatggctactcagttgaaccaaactcagccccaaaattctgacaaattgccttcacaaactgtgcagaatccgaaaaatttgagtgacatcaccctaaggtctagcaagaaaactgaagtgcctccaccaatagcagcacctacacctgaacctgtcaagcttcattctacacctggaaaaagggacaagatagttgcacaaaagagaaagcttcctaacaaattttcatacaggaaagtaaaggtgaacatacctctgctagatgccatcaagcagattccaagatatgccaagtttctaaaggagct

SEQ ID NO: 77455 - DNA, 300 bp, Glycine max
  Peptide Sequence Number=SeqID_169140
atgtttgctaacagtcctttcgctaagcgcaagcctcgcgctaagcacatctttggtcatgcgctaagcctagagtctctggcgagcgaggcgaggctcacgggtgcgtcttccaaaggaggaaaatgcacggagtcgccaccaacgtttatttgtggaaaacatcggaaaaaccgaaggaaaccggtcataaagaatattccagattcgggagttgtatttacgtttgaggaaggtcgaaaaaagcgggactcttgctcctacgtaccctccatcgaagaggaaatcagacctacgtag

SEQ ID NO: 77456 - DNA, 117 bp, Glycine max
  Peptide Sequence Number=SeqID_169141
atggccccctacaggatattgggctgccttgcagcgacgttttccgcttgttcagcgccgggaaggaatgacgatctgtcggtcgtgaccctatcctccatttgcatccgtccctaa

SEQ ID NO: 77457 - DNA, 258 bp, Glycine max
  Peptide Sequence Number=SeqID_169142
atggtttataataatggcataaacttgaaaatcccgacgagtcataacaacagcttccagaattgccccatggttatacagtgctcaatgaaatgccccagggttcctccacgatatgcacatgttgcgttcgagtcgtatcctcagaaaatggaggctttctcgctgcaaaattcatttttggttggtgtttttggttttgctagaggtggtgttcgtcattggaagtgcggtagacagactttgtggttgatttag

SEQ ID NO: 77458 - DNA, 168 bp, Glycine max
  Peptide Sequence Number=SeqID_169143
atgacaacaggtgtagaagacgatgtcggtctctttgcgtcaacgggcacgtttgccccctggttgacgaaaggtgcgggtaaccacaagataaccacttggggtatttctccatgccctctaacctcacgggttagtgctgacagaggtagtctgcgtggaagatga

SEQ ID NO: 77459 - DNA, 672 bp, Glycine max
  Peptide Sequence Number=SeqID_169144
atgcccaaaactacattggataagctgccttttaacgcgtcacacatgaggctgagctccatagtggtgtgggcttttaatggtagccgccgggatgtaaagggagagatcgatctcccaattcaaattgggccccacttgcttgttaggccgaccttagatccattcggttggggtggttctgtcaacgctgcactagaaattaaagtttatggtggaggggcaactggttatagtgtcaagagaggaagacatattgaggctgcagaggagtcattggaaacatcattccaagcactagaaattatgagcagtgcttatgtggaatctccttcggtgatgccacgcttatctggtgccactttgatggtggctcgggttatgttaaggaacagatatgagcccgaaatgggtttaggccgaagcggggatggcacgacaagcttggtggtgttcgctgagaatcgtggaagattcatgttgggttacgagcctacacatgccgacaagaggaggatcgccttagaaaggaaggagagaagcctggcccatctacaagggcgaagactacaagcggaaagggtccctatttgtcacatcgacaaaagcttcgtcagtgcaggatggatgtgcgagggtcaatctacgatgatagacaaagaaaccccttaa

SEQ ID NO: 77460 - DNA, 231 bp, Glycine max
  Peptide Sequence Number=SeqID_169145
atggagaaaaaggaatcttatgaagataatacaaatggaggcttcaatcccttctccgtctctccgacgtttgggaactctatcggagcagtcgaaggaaaaaactggaggaatctcaaggaaccgctagagatgctgctatcgctggccgaagacactgaattatatttttttgatgaatcagttgatgtcccaatgagaaatgctgtgagattgattgttcttatgtga

SEQ ID NO: 77461 - DNA, 357 bp, Glycine max
  Peptide Sequence Number=SeqID_169146
atgttttccaagaaggagggaatgatgagaatcatgaaactggccaaatacaggctaaaggcccaagtggagaaggacaaaggcctaagtggagaaggacaaagcccccgagtggagaaggatgaaggcccaagtaatcattgtggcgtctaccctgacttatcttccttcactggaagtggcgtctacccagacttatcttccttcaccggaagtggcgtctaccctgacttatcttccttcaccggaagtggcgtcatccaaaaactctacagcctgtatcaagtgatccgccccgtaaggttcacatcaccattgatcataatcaccttgaaaattcaagcactacaactttag

SEQ ID NO: 77462 - DNA, 1263 bp, Glycine max
  Peptide Sequence Number=SeqID_169147
atgatgagagctgagatggatgaattggatagagtccaatttgtagtagaacttacaattgagatcctgtctatagatgatgctaaaagacaagaaaagatggaagccatcattgttcttgaagacatggatcttgcagagaagggagatcttgaagaggcaatgcttcagtctgttattgaagcctctcttgcaaaaataaaagatgacattgttgaaacagacactggaactgtactagttcgcccaaggctagtgtttgatgctaatgaacaactcattgatgttgttcagtctaataaaatagatggcaacatacatagacacttagaggagatatatagagcaccaaaatctgtctctatagaggtcatgattgagcatttggagcaaaggaagatcatgccatctattcagaaggaaccagatgtcactattcaccccagtcttaacataagactgtataatgggttaagaggctacatagtcttaaagtggcaaacttgcaacaaagtttggaaggagaaagatgatattggctctcatattcttcacccagagatgcaacaattggagcttgataagctcaatctcaccaagctatggaaggaaggattccttcaactatccttcattggaaaccatagacccaccgaaaggaagatctatcctccttgtgttgtagtctggagaagcaaacaagcagagcttttttgggatgcccttctccactccactagatcttcaacaactcttaggtctaatgtggatgatgaatatggtgtttccacgggatcgtacatcctcatgttgttcaaacataagcttgaatctcttaagcagaaaattgagcacactagtatggattgcgtttatcacgcagtaaggcgttattatcatactctaaaccatttatgctttactgaggagatttctttcaacatggtttgcccatggactagggagtttcatgttgtttctgatcgctccttctcctttgtgatgttctatccttactccagattcactttcactcatcatgtgaaacccatcattcaagaagtggattttgatgttgacactacaattgatcctgatgctttagctattgaagtatatgatcctccacccttaagggagtatgttcatttggtagaggttgagctattaaataagagggaagcactttctcaagctttggaagatcgtgcttatgttgagaaagaggctagaaagtggtttcttattggggattacttttag

SEQ ID NO: 77463 - DNA, 832 bp, Glycine max
  Peptide Sequence Number=SeqID_169148
gaccatacgtaactgccttaagcagttattgcagaataaattctggagtaacagcaggggggtgctaagaagactattggatgctggcacgagtcttccttatcccgatgctcttctcataaatggccaacaagatgcggttgtatttattggggaagcagggaagacatacaagttcagtgtgtccaatgttgggttatcaacctcatttaacttcaggattcaggcccatgcattgaagctcattgaagttgaagtgactgttttggtcacactcagtgcgccaatcagtgactatacaattgttgcatctagccgttttaccgaccctattgttctcacaaccacagcaactcttcgctattctggctccaacagtaaggctccaattccattaccctcaggcccagcaactaacgatgtagaatggtccataaagcaagctagaaccatcagactgaatttgacagcaaatgcagctcggccaaatcctcagggctcattccactacggaaccatccctattctaaggacacttgtgttggcaaattccaaagccataataaatggaaagctacgatatgccgtgaatggaatttcccacatcaacccaaacaccccattgaagcttgctgattggttcaacattcctggtgtctttgacctcaacacaatcaaagatgttcctccccctccaggcacccctgccaaactaggcacatctgtcataggattcaccttccatgactttgcagaaataatcttccagaacaatgagaattacattcagtcatggcacatggatggatctagcttctatgttgttgggtag

SEQ ID NO: 77464 - DNA, 597 bp, Glycine max
  Peptide Sequence Number=SeqID_169149
atgaaaataacgattttatccgaagagcaagagagaatcattgagcctgtgtcacatggtccagcatcagagcgtcaatttccaatacaagagtttcacattcttcagtcaagtattgaaactcagggcataggcagacgaagggaggctgttgaagcggaagaatattcccaacaaatggcggagcgtggctatggaatgtattacatgccacaaacatttgctcagtatccgacacagatgtatcaatatccttttcagggtcatcacattgatacttctacaagcgaacatttgttcggtggtgttgcggaaacacatcctcatttttcatggctgactatgaccccttcacaacaatatcatggcccaattccaacacctaatgccccattaggtacacaatggaatgtaccgggaccaatacctaatgtgggtgacttattaggtgttgatttgcgtcatgaattttctgctgaggctaaccaagtagaagcagggagacatcagggcagaagaaatcctgatcgccaagcacgaagatgggatcgaccatgtggcacatcctcacggcatcacggacatcaaaatgaatga

SEQ ID NO: 77465 - DNA, 297 bp, Glycine max
  Peptide Sequence Number=SeqID_169150
atgggcccaaaatctaccctaaggctcataagaaccttagggtcttctcttgcatctctggcccttggagggacgcttggtgactatgcttatcaacaaggatcaaagcattacaacaacatattcattcctccttttagcaacaagggtgttgggaatgttcatgatgtaagctccattggagcttgtaggcctaggatcttcttcatcaatggattcctttgcttcttggaagatgaatggcagcggaatggaaaaggaagagagagaggagatgccacttcaaggagaagatga

SEQ ID NO: 77466 - DNA, 182 bp, Glycine max
  Peptide Sequence Number=SeqID_169151
ggattgctagacagctcactgttaggaacactcctcagcaaaatggagttgctaaaagaatgatgcaatcctaccccgcaatggcattggatagaagactccaagaacattgggccaaagatgcaagagaaggccttagggttctcatgagccttcgggtagatttcgggcccatgggctaa

SEQ ID NO: 77467 - DNA, 195 bp, Glycine max
  Peptide Sequence Number=SeqID_169152
atgaagatgctcttgataccacatgatatgaatggcagcggaatggagaagggagagaggagacgccacttcaaggagaagatgagtctagaagaagctcaccaccataggaggccatggataagaacttggaggaagaaagagatgaatgaagggagagggagagaagagcacggaagtttgtgctcccaatga

SEQ ID NO: 77468 - DNA, 240 bp, Glycine max
  Peptide Sequence Number=SeqID_169153
atggattgggaaaaggcccacattaggcacatgcacatttggggatgtgtaactgaagcaaggtgttcgaacccgacaagtgcaccagatcacgcaagtagtataaaacgcctaatcctgatcaagaatcgtcctcagattcctcttgttggactaaactcgaccagaaccacattaagacaaacatacaaacatctaggttatcgtaccctgatccctcgtgataatatgataaactag

SEQ ID NO: 77469 - DNA, 258 bp, Glycine max
  Peptide Sequence Number=SeqID_169154
atgatttggaatgtacttccagtctacatgaagttcatggaatttctagctaaaaggcgaaactgcaaggaagatgtgttctatgtcattcctttcgctaagcgcaagcctcgtgctaagcgcatctttgttcatgcgctaagccgcgagtctcaagcgcttagcacccaacccttgcatctgaggctgatttggtctgctgagctggccaaagctgagctaagccaacttcaatttgatctggatttggctaagtga

SEQ ID NO: 77470 - DNA, 1053 bp, Glycine max
  Peptide Sequence Number=SeqID_169155
gatgtgcaaaaaaaggcacaggccatccagaagcaaaacactgccccctacgtgttgtctcgtgggggttatgaatatttagaacaaaagctcatggctgcccagtccggaagcactgagggcgtcattgaccctccatctctcatcagacgccacgtgaagtggaagctagcccgcaccaagaaaactgggcagatgacatctgaggcagcaaaggaaatagctgagaagattggatcgttcgtcccccatagacgccaggatgtcctaactattgccattgggcgactagagcaccatggctgtgtccgtgctgctggagccagtgtcaccataaagcaatacttcggatcggctccacgaacatcctacagttcttcctccatgcctcctgaagacctacagcagctgacccaacaaatcagggaccagctggaggagttgatcacaaaaaaaggacttgcattgcctccggagccagaggttggtccctcaggtgcttgtgtcagcacaaatgaaagttgtgttgctccctcagggaacgatccagagacgggtgactcagacaaatacgggctatacattgaagaaaatccttcccgcctggttgccctaggaagactttatgagggatccacagcaattcacaacatccctttgttgcatggccaagccaaggttggtgttgaggaggttaaagatgcggaggctctcgttcctgtacccactgacgaggttacctcggtggggcagacacttaacaccttccttgcttggccgacacatcttgtgaagcgtatatcagagcatgcagctgtatctccagcaaaacctccaaaaagcccggatcatgaggtcgatgatctcctgtacctgatgacattgaccatcccacaactgtttctgaagcatctccaggttatgtgggatgctaccatgttcgaggtgtttaatcaaaacttcccgttgtacataaagcacaaagatctctctgaaattgcacacggtggtcaatgtctcagcatatctattatacagttgtggattttgtaa

SEQ ID NO: 77471 - DNA, 126 bp, Glycine max
  Peptide Sequence Number=SeqID_169156
atgcataggaaaggaataactgatgaatatagaagaatgataaacgcttcagcaggaggatactatgccaatggaaccacgaccaaagtaaagaaacctatagaagatgtagcaatgaaagaatga

SEQ ID NO: 77472 - DNA, 864 bp, Glycine max
  Peptide Sequence Number=SeqID_169157
atggaaatgggagcagaatataagcctgattggaactctgattgcactctcttaatgatcaatattggtcctcaaatctctaaggatagccggcttaacgacactagcctgactggtcttattcccatgccactaagtaatattacaactctccaaatgctggatttgtctaacaaccaactatcaggtgtggttcccgatagtggctccttctcattattcactcctatcagttttaacaacaacttggacctatgtggcccagtcactgggcatccttgtcccgggtctcctccattttctcctcctcccccttttgtcccaccatccccaatctcaactccagaaggaaatagtgccactagtgcaatagctggaggagtagctgcaggtgttgctctgttatttgctgctcctgcaattgtgtttgcttggtggcgtcgaaggaaaccacaggagtttttctttgatgtgcccaatactttcaacaataagaacattcttggaagggtaggatttggtaaggtttacaaaggatgtttgactgatggttcactggttggtgtgaaaagattgaaagaggagcgcatgcctggtggggagcttcagtttcagactgaagtagagatgattagcatggttgtgcaccgaaatctcctccatttacagaagaaaccatctgtacccaaaaaatcatcgaagcacattgaaagagaacagccttcaacatcaactgcctctataaaatcaaagggaaaagacactgatgttgctaggaaatgctttgagccttcggaagtgaaaaagtgggccattgatgatttgaataaaataattcagtggctgcaaagtcaagaagaaaag

SEQ ID NO: 77473 - DNA, 249 bp, Glycine max
  Peptide Sequence Number=SeqID_169158
atggtagttaaaaagggagtaaaaaagttatttagtcacaagtttgaagagaaaaagccaaatgaggatgaggctagatggggtaatgttcaaggagatagtcacaagtttgaagagaaaaagccaaatgaggatgaggctagatggggtaatgttcaaggagataggcaattcacgtttctgggagataggaacatgttagatggagtggtcattaccaatgaagtgattcaagaggaaaatcgttaa

SEQ ID NO: 77474 - DNA, 180 bp, Glycine max
  Peptide Sequence Number=SeqID_169159
atgggtcgccaatatcatgccggtctcgaaaaagggtgggaagataaagatggcaccggaggatatggaaaggacaaccttcatcactctatggggaaccttctgctacaaggtgatgtcatttgcgctgaagaacgctggggcaagataccagtgggccatggtggtgctattccatga

SEQ ID NO: 77475 - DNA, 243 bp, Glycine max
  Peptide Sequence Number=SeqID_169160
atggttttcaaaagtgatagtgatccaccttcccctagatccactaagctaatggcttcattggctaatcaaatggataagttgcaaagaaataagcactcaagagttgagtgggagaatggaagacatggagaggaggaggacataggtcaccttattcttctcaaggaagtgatgatggctatgaagaaggtagaaggcataggcataggaggaatagggatggaatggatagggagatga

SEQ ID NO: 77476 - DNA, 297 bp, Glycine max
  Peptide Sequence Number=SeqID_169161
atgtgccctttatcattcaggagtagcgagtcgagtggtaaacgcgcagagacgaattttgcaccctttatcattcaggaacagcaagttgggtggttctactggaagggaggttcactggccgaatggtgtttcgctcgaacgaaaatagtgtcttatctttacttcccttttatctcccataaaagacaagtaaagaggggcgactgtcataccctaattttgtccgggggaccatccattgttgggattcgactctcgtttgaccacttcgaggtatttggcacccatcgttag

SEQ ID NO: 77477 - DNA, 372 bp, Glycine max
  Peptide Sequence Number=SeqID_169162
atggaagaccaatgtggtggtaatggtaaacacatgaacacgaacacgaacagcaatggttacgtggacacgtcgaaggcggagagagcagtgtggctgatgaagtgccctcccctcgtctctcgctccctccgcgctcctccctccgacccctctcgccccgttgccaaggtcgtcgtctccatcgaccccctcaactccaacgacgacgattctccccctcagtttttgctagctgttgtttattttccatcatctaccaaaaaaagggcattggcacgggttcaggtcttgttgatgggaaaaaaaagtgattgggagaagagatcctctgaggggccagacagttcaccggcagagattaatcattga

SEQ ID NO: 77478 - DNA, 309 bp, Glycine max
  Peptide Sequence Number=SeqID_169163
atggaagatctttttaagaggtggactgagcatcttgacaatatacactcaagagtcaaccaaacacccctgataacttgtgatttttgtggacgagagcatactaatagtctttgtcatctctatttcacaaataactctaggtggggacaggagtcaagtccttatgatcaacatgaagaaagaggaactcctaatcttgaaagtgtgtttgaagaattcatggcatataatgctagctctaatgaaaatcaaaatgtaatgaacaatcaagaaattgatgtggcaaagagctactccatcaattga

SEQ ID NO: 77479 - DNA, 657 bp, Glycine max
  Peptide Sequence Number=SeqID_169164
atgtcggatccacaaggacaaatgattgatttacctattcaaagcaatttgcgcgaagggctttctttaacagaatatataatttcttgctacggagctcgtaaaggggttgtagatactgctgtacgaacatcagatgctggatatcttacacgcagacttgttgaagtggttcaacacattgttgtacgtcgaacggattgtggtaccattcaaggaatttcggtgaatacccagaatggaatgatgccggaaagaatatggatacaaacattaattggtcgtgtattagcagacgatatatacagaggttcacgatgcattgccgttagaaatcaagatattggaattggacttatcaatcgatttaaaacccttcaaacccaaccaatatctatccgaactccctttacctgtaggaatacatcttggatctgtcgattgtgttatggccaaagtcctactcatggtcacttggtggaattaggagaagctgtaggtattattgcgggccaatccattggagaaccgggcactcaactaacattaagaacttttcatactggcggagtcttcactggaggtactgcagaacaggaaaatcatacaggtccggttcagtctctttttcaatccgaaaagatcaagatcaaatga

SEQ ID NO: 77480 - DNA, 1455 bp, Glycine max
  Peptide Sequence Number=SeqID_169165
atgacattctccatctacatgaccgtgatttcctggttttatgctatcggggccattattgcgctatttcaggagtccgccttaaagcaggccctgaaaacagcgatctttcagcgcgatgtgcgcaacctgatggagccgttttacctgatttgcggctatggggaaacaggcggcgaactggtgcgtgctctggataggaacgagttgcgtgtggtggtgctggagattgcgccagagcgcattaatgaactggaaatgacagattaccagttcaatatcccgcacctgtgcgcggatgccaaattgtcagaagtgttattgtttgccgggatcaaaaacccgatgtgccgtggggtagccgccctgacagatgatgatcatgcgaatttggcgatttcagtggcagtgaaactgatcaagccggatttaccggtgttggcacgtgtgcaggacgatgtgattgccgccaatatggcctcatttgggactaaccgcattatcaacccttatcatatttttggcgaacacttggccatgcgactcaatgcgctgggaacgtatttgttgcacgaatggctgacccgagcaccgggtgatgccattgccacgcctgctgccattccgcaagggcaatggattgcctgtggttatggccggtttggcaaatcggttgtcagtagcctgcagaatgaaaatatgcaagtgaccattattgaggctgatcctgaaggcacgcaatgcgatgactgtattattggtagcggtgtggaagcgcatgtgttgcaacaagcgggtgtagagcatgcggtcgggattgtggctggcactgataacgacattaataacctgtctatcgtcatgactgcgcttgaattgaacccggatttgtttgtgattatccgcaaaaacaaacgacacaatgatcccttgttccagcacttcaatgccgatatcaccatgcagcccagtgatgtgattgcccatacttgcctggcatatatggtttcgccgatgctggcggaatttttaaccatcgccaggcataaaggtaaccaatgggctaacgcagtcattgctcagctggtatccaaactgggtgagcaggtgccggatacctgggatatcaccattgcagatgatatggcgattgcggtgtgtgcgatgatggaacaaggcttgcagcctgcgctcaagcatttgatgatgagtcctgccgggcagcagcgtcgagaaatgcctgtggtgccattgatgctggttcggggtgatcaggagatgctattgccggagttgtccacgccattgcaaattggtgaccgcatcctgtgttgcgggttagaccaagctaaatctatccagcggtttgtcatgcatgatgtgaaaaccatgcattacctggtgactggcagcgagatgccggaaacctggattgggcgctggctcaagcaataa

SEQ ID NO: 77481 - DNA, 174 bp, Glycine max
  Peptide Sequence Number=SeqID_169166
atgcacgcgctaagcgcgactgtcgcgctaagcatatggcttcccgtaagagaaaagcaccagcttcagtgtcctaggcacgatatggcagatcaagattcacatcacaagatgcctgggacaaatacgcagacaatgtcattagccaaaagatccttccgaaaaggaatgtga

SEQ ID NO: 77482 - DNA, 433 bp, Glycine max
  Peptide Sequence Number=SeqID_169167
atggcctctaggaaaaggaaatcaaccgcctctcgacctcaggaaccagtatgatgagttctgctgggagctcgagaggacgcggtggcataaagccttgaccaggcagcctgacggtcgcattgatgtggccctggtcaaggatttttatgctaatttatttgatccagaggacaagtccccgaggcaagttcgagtgcgaaggaagctgattaaatttgatagggagaagcttaatgcatttttggagacctcggtggttttggagccaagggagcggtactccacttactccaggttctgccattcgcaaccagaccctcaagagctcgttgtcagattgtgtattccagggcgaggttttgtactgaatgttgagggagcaccctggaagctccagaggaaggatctcaccacattggtgcagacctag

SEQ ID NO: 77483 - DNA, 465 bp, Glycine max
  Peptide Sequence Number=SeqID_169168
atgagcaacagccaccggtgcgtgcggcagcggcggctggacaaagagtcaacatgcccgcaggcggggcgaaaggcagatttagcgcagctcatcgcagcacagcgcgtggccgtaaacagagaaaccggcggccagcgtgagcagaaactgcgtgagacggcgatggcgaaggctgttcatcagtgcgatatcctgtcgtatgagaggctcaaccggcaggcgcgtgcggcaataaaaaacccgccgcagcgggtttattgcaggccaggacgggcctcaaaaacggccgccgtcgcgccgccaggcgtcggcggtcagcgcctcgccgaagtggctggcgataaggcgcttggtcaattcgtgcagcggcgccgccaacacctcggcggtgctgccgcgttcgacgatttctccttcgtgcatcaccaacacctggtcgctgatatgcttcatcatgccgag

SEQ ID NO: 77484 - DNA, 282 bp, Glycine max
  Peptide Sequence Number=SeqID_169169
atggccttttggataacggggtggaaggaagaagaagggttgttattggctaagaaatacatgtggggtggtggggaatttgccgtaccgcactggcagtcacagcatgcgtttctccctccttctcattctcttcatttgccccattttctcatccgtccaagcaggaggattaaatttgcctctttagcagatccgcttcgaccctttccccggcgaagaccaaatccgcaaagcttgatggtgcgtaccccaccatttttcatagtagaacattgttag

SEQ ID NO: 77485 - DNA, 538 bp, Glycine max
  Peptide Sequence Number=SeqID_169170
atggcagcgcgcgcccttggcgtgcctcggcacctgcgcgctcctggcgtcggcctgtgggctccccattcggcccgtcttgaaacacggaccaaggagtctgacatgtgtgcgagtcaacgggcgagtaaacccgtaaggcgcaaggaagctgattggtgggatccccctgtggttgcaccgccgaccgaccctgatcttctgaaactctggtggaggcccgcagcgatactgacgatagctggagcccgcgggcgagttctatcgggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaccccgatgagtaggaggtcgcggcggtcgctgcaaaacccagggcgcgagcccggcggagcggtcgtcg

SEQ ID NO: 77486 - DNA, 267 bp, Glycine max
  Peptide Sequence Number=SeqID_169171
atgatgataacaaaagatgatgacaaaggagatgacaaaaagctcaaagatcaatcaaagaacaactcaagtgaatcaaagatcaatcaaagaacaattcatgagttcaagataagaatcaagaagaattcaagactcaagaaaaaagtttatagtcaagaatcaagattcaaggttcaagatctcaagaatcaagatcaagattcaagaatcaagagaaggcttaatcaagataagtatgaaaagtttttctcaaaaattgagtag

SEQ ID NO: 77487 - DNA, 445 bp, Glycine max
  Peptide Sequence Number=SeqID_169172
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagcagttcgctccaagctggactgtatgcacgaaccccccgttcagtccgaccgctgcgccttatccgggtaactatcgtcttgagtccaacccggaaagacatgcaaaagcaccacttggcagcagccactg

SEQ ID NO: 77488 - DNA, 300 bp, Glycine max
  Peptide Sequence Number=SeqID_169173
atggaagagggattttcccatggttcagttccaattattttaggcgggtcatttatgaaaacagcccgaaccaagatagatgtttatgttggcacattgtctatggaatttggtgatattgttgttcattttaacattcttgatgccatgaaacatccatttgaggatcattctgtttttcgtgttgagataattgatcagattgttgatgattatatgtttgatttagattttgttcttcatgagttagaatgctctaaccatgttgcaggaattacatacacttctaacttgctttga

SEQ ID NO: 77489 - DNA, 460 bp, Glycine max
  Peptide Sequence Number=SeqID_169174
agggctacacgccctcgccttcagaggactacacgtcctcaccttcagagggctgcacgccctcaccttcagagggctacacgtcctcgccttcagagggatacacgccctcgccttcaaaggactacacgtcctcgccttcagagggctgcacgccctcgccttcagagggctgcacgccctcaccttcagagggctacacgccctcaccttcagaggactacatgtcctcacctttagagggatgcacgtcctcactttcagagggctccacatctgtgccttcaaagaacttaagggtgaccaaatgtgcgagcacaacctaagaggaggaggctatcacacaactattatgcataccggggcaagatttcacccgtgtcgctgcaaagagacaagtgcggatcgtgcgcaccaacatgaccactcttacacagatatggatgacattgctacttag

SEQ ID NO: 77490 - DNA, 396 bp, Glycine max
  Peptide Sequence Number=SeqID_169175
atggccgaactgatcgaagccgaggcgctggaaacgtcatcgctcgttggtgcgccgctgcgcgatctcgacttgccggaaggcttgcgaatcggggcgatctatcgcgacgggcaggtgatccgccccaatggcgatgtgcggatcaagcctaaggatcgtgtcgtcattttcgcaacgtctgacgccgtaaagcatgtggagcagatgttccgcaaaatttccctgacgatttttcttatcaatggcgtgaaactgaccggcattgtaacgtcgtttgataatttctgcgtgcttctgcgccgtgacggtcattcgcagcttgtctacaagcatgcgatttcgacgatcatgccaagccagcctgtgcagatgttcgaaggcgaagaagcctga

SEQ ID NO: 77491 - DNA, 288 bp, Glycine max
  Peptide Sequence Number=SeqID_169176
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtggctgcgcaactgttgggaagggcgatcggtgcgggcctcttcgctattacgccagctggcgaaagggggatgtgctgcaaggcgattaagttgggcaacgccagggttttcccagtcacgacgttgtaa

SEQ ID NO: 77492 - DNA, 219 bp, Glycine max
  Peptide Sequence Number=SeqID_169177
atggatgaatattttagagtatcaaactacaagaatgcaaaagaaatgtgggataccttacaagaacacaaaatggaactcatgagactaaatcagcatgaagaaaatgacaagaaaaagaaaggaatgacacttaaagttttatcttcatttcaagaagaaagtgataaagaagacttgaatgaagtagaagagatgatgatttcagtttcttcgtaa

SEQ ID NO: 77493 - DNA, 1787 bp, Glycine max
  Peptide Sequence Number=SeqID_169178
agaaatgataatgaaaagagtgactttaacgatgctgttactggccagcggcagcgtcgcggcgcacggcgttaccctgcgcattgccgatcaaaagggcaacatgcgcgccgagctggaagcagcgcagaagctcaacgatctctcctaccgtatcgaatgggcggaatttccggccgccgctccgctggccgaagccctgaatgccggggcggttgatgccggtattattggtgatgcgccgctgctgttctcgctggccgcaggttcgcaggttaaagcggtggccgtcagcaaatccaccccggccgggctggcggtgctggttgcgccggactcacccatcaaaatgccgcgggatctgcgcggtaaacgtatcgccaccgggcgcggatcgatcggtcattttatcgcgctgaaagcgctggaaagtgccgggctgagcgataaagccgtcagctggcgctttctcacgcctgccgatgcgcgcattgcgctggcaagtggttccgtcgatgcgtgggcaacctgggatccttacaccgcgctggcagaagtaacgcataccggccgcgtgctgatcaacggcgtggggctctccagcggcaacagcttcctcgccgccaccgatgcggcactgagtgacgccagtaaacgtgcggcgctgcaggattatattaaccggctggcggccgctgatcgctgggccaatcgccacgttgaggcgtattccgccaggctggcaaagatcatcggctttcctcaggaggctgccgccaaatcttttgcccgacgtcagtcacactggcagagcattgacgaccacaccgtacaacagcagcaggaaaccgccgacttttatcaaaagtacggcctgattgctcagccactcgatcatggcggcatcaaatccgtggcggataacccaatgttaatcaaaacctttgatggtcataatgacctgttgctcaacctgtggttgcatcatcgcgacgatccggccgctgccttcttcaccggtatcgaaaaaggacacctcgattttccgcgcatgcagcagggcggctttgccggcggattgtttgcgctgtttgtgccgccgcagcgctacgtcagcgaagtggcgccgcagctggccggtgaagcctggcagccgctggagatcctgtggcagcagctggagattctgaaaacactggttgcccgttctgacggccgggcgcgtctgtgcctcagcaccgccgatatcgccgcctgccggcgcgacggcgtgctggcgatggtggcgcacattgagggcgcggacggttttgacggcgacggcgccgatcttgccgccttctggcaggcgggcgtgcgtagcatcggtccgttctggatctggaaaatcgctttggcgctggcgtcaccggcgcatttcccggttcgccggatagcgcgcatgatgatcgacgtgtcgcacatgaatgaaaaagcgttctgggacacagcccggctctcatccgcgccgctggtcgccagccactcgaatgcgcacgcgctgtgcgcgcagccgcgcaacctcaccgacgaccagctgcgggcgattcgcgatagcggtggcgtggtcggcattaatttcggcaacgcctttctgcgcgccgacggtaagcgcgaccatgatggcggcttgatcgaaatggttaaacactgtgagcatctgatgactattatgggaagcgatcacgtcgcgctggggtcggattttgacggcatcatcgtgcccgcagagcttaaagatgtcaccg

SEQ ID NO: 77494 - DNA, 800 bp, Glycine max
  Peptide Sequence Number=SeqID_169179
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatctgtgcctaagaaactgctgcttaaggccagtatctatgaatgctacatgttggccaggggctacactgccacatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 77495 - DNA, 1119 bp, Glycine max
  Peptide Sequence Number=SeqID_169180
atggcgaatcaagatgagtgggtcccattcatggatgcattagcattgttaatctttggggttgtcctctttccaaacgtggatggtttggtggacctagccgcaattgatgctttccttgcatatcaccatagcaaagaaagcccggtggtagctgtcttggcagacttatttgacacatttgaccgaagagtagattgggaccaacacttggctgggataggaggcagaacagtcaattggtttccacgatggaaagaaggaaataagggtgttctattctcatgtgggggctacccaagcatcccgttgataggaacgaggggttgcattagctacaatccctcacttgctataagacagttagggtaccccatgaggggagcactgacggaagaaagcctgtctcctttccttgtgagagattttggtgcgcaaaatttcaaaggaaagataaaagaacttaggggcattcgtaatggcatcattggtggttatcatgaatggctgaaagttcatacacgagggttagattggctctccaagttgaaaatgatcaatgaggagaactttgaagctctggaagaggatgaagaagtccgagctctaaaaaccgaactgggaaaagcaagacttgtcaaagaaaaattcaagttggtcgctacagacgtctggaaagagtgtgccgagttacgagaagaaaatgcagctaccgcaagagcccttgaacaagaaaccaagagggctcgcaaggaagagcatggccgagacaaattccaaggagctttgtggggcagcaacagtgagctcaagcttcgaagggaagagagagaccaatcacgagcacatagcatggtcttgaaagaggagttagctgcttgctcaaggtccaaaagaaacttgtctcagcgtttatgcgagacagagaccaacatgttagccatcgtcagcaagtaccaagaagaactaaatctagccacggcccacgagcataaagtggtggacgagtatgcccaagtgtacgtgcaaaaggaggccagaggaagggtgatcgactcgttacatcaagaggcaacaatatggattgaccgatttgctcttaccttgaatgggagttaa

SEQ ID NO: 77496 - DNA, 357 bp, Glycine max
  Peptide Sequence Number=SeqID_169181
atggtaggtataaggcgtttttcttgtagtgcctatggtggttcaaggaatccgcgcgcactcgaaaaccttgccctccctcttctctttgtcaccgtgaaatcactcttctctttctcctcccgcctgaaaactgccggaaatcgctccctcgacacccacattgtcctcgctcaaacccacagaacccccaacactgccggaaaacccacattctcctcgcttgaacccacagaaccccctacactgttcttggaagtttggctcaaagaaaacccaacatacactgttgctactagggtgctgaaacagtcgtgggtgctcaaagctcaaagctttctccgcgagtattgctga

SEQ ID NO: 77497 - DNA, 426 bp, Glycine max
  Peptide Sequence Number=SeqID_169182
atggctaaggttgacccagatatagtcctggagttttatgctaatgcttggcccacagaagagggagtgcgggacatgcggtcatgggtgagggatatgccacccaccaggcaccctctagacccggataagtctaacaaggccctggggtttccagcattgatcacgagcctctgccagtcattcggggttcccgtcacacctagtaaggtgatccgaccgccgatcacccgggccttcattgagaagtattgcatgcctaggcaggcgcagggtgatgcaccgcaggccgcaagcgcaccgccaccacctcatcaggctgaccccgctgggtcatttggcatggagcagtatctacagcacttggttcgccagcaggcggccaaccaccgggggcaggtgcagatacatgagtgtctctactag

SEQ ID NO: 77498 - DNA, 93 bp, Glycine max
  Peptide Sequence Number=SeqID_169183
atggctggtatgccacctaccaggcaccctctagacccagataagtctaacagggccctggggtttccagcgttgatcatgggtctctgctag

SEQ ID NO: 77499 - DNA, 307 bp, Glycine max
  Peptide Sequence Number=SeqID_169184
atgggttgtatccattacaatcttgtcctctccataagacagcttagctaccccatgaggagagtgccatcggaggaaagcatcacgcctttcatcacacggggtttcggtgaccccaatgtgaaaatacttcaaggagtttggaaggcatgtggtgcaatgcaaaggaatgataaggagcttagggaaagcagcaacgggatcaccaacggctatcacaagtggctgagagtccaaacgaaagagttggattggctcccaaagctaaaagctgcaagagaggaacaggctgaaactccagagaaga

SEQ ID NO: 77500 - DNA, 129 bp, Glycine max
  Peptide Sequence Number=SeqID_169185
atggaagttcatctatgtatttcagcagagtctcgggctgcagccaagccaatggtgacagattacaggacagcttctaagagcttctacaacaagctagaaaacactacaacttctacagcaagctag

SEQ ID NO: 77501 - DNA, 327 bp, Glycine max
  Peptide Sequence Number=SeqID_169186
atggaagaggatcagagaggtctcgtctttgggaatggaaagagaagtgttgttgccatcgatgggggcttatatgaaaattatcctcaatacagggcttatttgcaagattcagtcatagagctgctaggaacagaaaagtcattctgtaatgtggtgatagagcatactaaagatggatctggaataggagctgttgtattggctacttcaaactccatgaaaaggcaagctaacctgatttctcccgtgaaagccccatcttttcccacccaagaattctgggcagaaatttcaatcctatctgaaattgagtttttcacctga

SEQ ID NO: 77502 - DNA, 1224 bp, Glycine max
  Peptide Sequence Number=SeqID_169187
atgagtgtgaacagtgtgattgaagagacaaggaagaggccaaggttgaattggggtgaaggacttgctaagcttgagaaaaagaaaactaagggtgatggtgtaagtgctactactattgctactacagattctggtgcattcagttccttcacaggtagcttgctgtcatgccaacaacttgtgacacctggcattactcatcgggatattgaagatggaacttatgagtggacaaatgagaagacagcctttcttcaggttgtattgtcttttggcgagaattttaggatgactgcatggcatgtaggaataaagtccaaagatcagtgcaagaaattttccatcaagggtcaaaaatcccataggttggatctcatgcgccacagacttgaaaatattggatccctactgaatgaaataaatcatggcaggagtactaacaataatgatgcatgcattgaggaggcagattcaatcattgataatgataagttgggcataaaaacaaatgatgaccagccttcatctgccgtgaacttaagccatgataaatccaaacctatggaagctagaaatctttcagttgactttaaggaaattgatagagaatttgatcatcaagataaaaacatgatttctaacacatataactgggagtctaaactggtggacactaatggttgtggggttgtcttgttcaattttgataagtcaagttcagtcaaggacaagagagatacaactatgacggatatcatggaagtcagaaaagataaagtgggagatgcatttacaaaattggtgttgtctgcttccgagataattgaaccatgttactcttattctgttgctgaggatagactatctgtgatgttgacgtcatttcctacatggctagatgataaagatggtaaaaatggaggtgatattgatgatgatgcggttgaattgaaaaaccaaagccatgattcaaacaccaaagtaaatacttgcctatcatcagtggtagtttcttgctcaacattgacttttggtgttgaaaatcaacccaaactattcttgaaaaattcaagttattcaggaccatccatggaggatcctctcccaacttcaaattcaatgttgcaaaataccgctagtgttgtgcatgctattcaaaaagagaaatcaactacccgaaatggactgtctttgaaagagcctgttaaaaaacaagtgtga

SEQ ID NO: 77503 - DNA, 195 bp, Glycine max
  Peptide Sequence Number=SeqID_169188
atgtcaacgttcatcatgcctacactttttttgctgttgttcattgtgtttaacatcggacccagaacaccgggtggtggtggtggtggtggtggtggtgctacacaccaatttccaagggaacttggccaaggctcttgctctggctattgcataacctttcaatccccaagagaccccagacacaagttctag

SEQ ID NO: 77504 - DNA, 243 bp, Glycine max
  Peptide Sequence Number=SeqID_169189
atgagcttcctagagtcaaatcccgtggacaacaaggaaaagatagaacctcgcccaacagctgattcaatagcagatggtcttggattttcatttgatgcttctgattcaactccaatacaaccaaggaatggaatcaaagcccttccgcctttgactagactctcgaagaagcagatggtgaagtcaaggccaaccaaggcttacggaaataccaacagtagaatagcggatattgattaa

SEQ ID NO: 77505 - DNA, 120 bp, Glycine max
  Peptide Sequence Number=SeqID_169190
atgtacaaggataagtgggctcctccttgtggaggttgtaggccttggatattcgtcatcaatggagtccttagcttcttgaagatgaatggcagcataatggagaaggaagaaagatga

SEQ ID NO: 77506 - DNA, 708 bp, Glycine max
  Peptide Sequence Number=SeqID_169191
aagaagaagaagaagaagaagaagaagaagaagaactatgaaagggagagttcttcctcaaagaggcacattgatgatgtgctaagtactccctctcatgccaattttatgaacactagggagaagcttaactccaaagaacaatgccatgataataataagaagaagaactatgagagggaggaatcttttggctggaaaccacttaataaagggaatgatacttctgaaaggttctattctcaaagcatgggaaagggacttgctaagtttgacaaaaagaaatctgagggtgatggtgcaagtactgttactgctgctactccatcttttggtgcatgcaattccttctcagagttgttcacgcacgaggaaggtattgcaacctgccctctggcaggggcacgaaaaagggctctcgtgtgggccaagggtgcgtcttccattgaaggaacacgcatggagtcgccaccaatttttattcgaggaaaacgtcgaaaaaaccaaaaagacgatagtctgcgtattttgaaaatgaggtcgacaaggggtgtttccctcgctcatatgtatcctcagattgattttaaccgaacaaaagtcgttggacctttaaacaatcttttgattcttgaaaaaggagaatcattcgttaaggcgttgtaccctttgaatgatctcttgattttggaaggagagaaacgttaa

SEQ ID NO: 77507 - DNA, 183 bp, Glycine max
  Peptide Sequence Number=SeqID_169192
atgatgataacaaaagatgatgacaaaggtaatgacaaaaagctcaaaggtcaatcaaagaatgagttcaagatgttcaagatagaatcaagaacaccaagaggaaagttgaattcaagaatcaagattcaagagatcaaggttcaagactcaaggctattcaagaatcaagaaaaagattaa

SEQ ID NO: 77508 - DNA, 189 bp, Glycine max
  Peptide Sequence Number=SeqID_169193
atgaggtgtctccgcatgtcatcgggcttgccgtctccagatgacgaaagggtggtgcggataaccatgaggtgtctccgtgtgtcatcagacttggcgtctctggatgacgaaagggtggcggatgaccatgattggtctccgcgtgtcaatgggctcgctttcctctggttggtgaaggtgtggtga

SEQ ID NO: 77509 - DNA, 366 bp, Glycine max
  Peptide Sequence Number=SeqID_169194
atgttgcatgcatgcctcgatatcaaagctatcatgttaggaaaataccactatgttctctacttcctcgttttggcaatgcagccaagaatgttgtggattgtggatgagaacttaaagccgctatcactgcctgtttgtgttggccaagcagtaaatgttgtaggacaagcaggtcatcctaaaacaatcactggctttcagacccactacacccctattctgctctgtgttggggacagggcaaagctggcaatggaaaaataccttcccctgtcaccaattcttgaagatgcagagaaagggagaggttacctattgagagtggcagcaacgggaagcacgcagagtgaagggaagccgtga

SEQ ID NO: 77510 - DNA, 747 bp, Glycine max
  Peptide Sequence Number=SeqID_169195
atgttaagaaatgagttggagcttatgaataaatcacttgaggaatctgaggctcagttacagggtagaacagtggaaagcaatgagctggtgagtcaaattgctttattgaagaaggaagcaaaaaggtcacttgatgagctaaataggatgaagaatctcaagtatgaaaaagagttggcgggtagagtgttgcagtcagagttagaagcacttagaactcaatataatgacttgaaaagttatcttcttggggatgaggctgagaaagaaaatgtaagaaagcaagttttccagctaaaggactataacaagttttatgaagccttctctaacaaccttaaacttggtcttgatgaggattctcagaacaagacaaaactagctgaattgctgaggataagggatgcaaacaaagtcttgaatgagatgactgaaagtaaaattgaagctcagaatatcacatgcaacacactaattaatgcttactacaagtttggagagttgaaatcagctttgaaatttaagaacaagctgttagaagctggtctaaaacgtgatccatttacatataaagcattaattcatgggttctacaagatgaatgaactagaaagggcaaatgagttaatgttcagcatggttgatgctggatttacacccagttattgcacattctcatggattggagatggctacaataagaaagacaatatggatgcagttttagcacttccagatgagtaa

SEQ ID NO: 77511 - DNA, 399 bp, Glycine max
  Peptide Sequence Number=SeqID_169196
atgtggatagtatttagattccaacagaatggcaatcagcccattctaaaacgtggaaggatgtatcatggacaaaaaagcaatttcaggtgtgatctttcagatttagtggaaatcattcacaaggttgtaaagctgatggataatcttcagtctcgaggagcattgagggaagtcctaccaaatgcaaattccactggggaagatgttatccctgatgataatgaacatgaaaatcatgttgaggaagttgggaactcccaagttgggttagaaccaatgggagccacaaattctgaacatgttaatgaggatatgttggatggtactaatgatttttctgaagatgagcaactacatgcatataatgaagttgatttcaaggtttcaacgctataa

SEQ ID NO: 77512 - DNA, 450 bp, Glycine max
  Peptide Sequence Number=SeqID_169197
atggagacgacgaccttagaaacggggcgagaatggtcggagggaggggcgcggagggagcgagaaatgaggggagggcacttcatcggccacattgctctctccgcaatatccacgggttccggtgaactcttgaaccataggtctgaagttgttggtgtcggtggtgagaacggtgcaagtattgatttgttgttgttggtgttgctaatgaagatgggaggctttcatggaaggtgcaattgggttcagatctttggccttgatagtctaagtttaagaaggaattatggggatttgggtgggattctgagagagagtggaggcgatgtagaaagtcaggcatcctgcaacgacgattgtcagaccgatgtagaatatgtcatttacgaagacgggtgtcttataaaacccgtctttgaaaagagaacattctgcatcggttattag

SEQ ID NO: 77513 - DNA, 231 bp, Glycine max
  Peptide Sequence Number=SeqID_169198
atggcagcagaatggagaaggaagagagagaggagacgccacttcaaggagaagatgagtctagaagaaactcaccaccataggaggccatggataagagcttggaggaagaaggagatgaatgaagggagaggaagagaggagcacgaaattttgtgctctaaaagagctctaaaatctgaacccactaatccaagatcaattccaagattctccactaagtgtgcttag

SEQ ID NO: 77514 - DNA, 124 bp, Glycine max
  Peptide Sequence Number=SeqID_169199
atggctgaagagccaagaagaaagtacttccctgaattgaagactgcagaaggcaaagctaccatctcttctttccaccagtttctagatgaatcgttgagtgaggcacttgaaagattcagag

SEQ ID NO: 77515 - DNA, 105 bp, Glycine max
  Peptide Sequence Number=SeqID_169200
ggtacatcttttgtggtacaagtagagggtatatctacatgggttgttgtgactgagaacaagagaggatatgatgcaatcctaccccgcaagggcattggatag

SEQ ID NO: 77516 - DNA, 231 bp, Glycine max
  Peptide Sequence Number=SeqID_169201
atggatgttcgtgataaggaacaagttatttctagaatgaaagcagtcgttgccaacaagcaatttggtcaagaagatatcatatgttcgcttgttgctgatttaagatttagattgccttggccaactgatgcaatcctcccaaagaggagacccatcactagagccatgctaggagactccaagaagattgggctagagatgcagaagaagaccctagggttctcatga

SEQ ID NO: 77517 - DNA, 192 bp, Glycine max
  Peptide Sequence Number=SeqID_169202
atggcaagctctcgcttcaactttgaaaattttatgcccacattgtattgtcactgccctgccactgtcttactaaaccctaataacacaagtgaggtgagagagaggagaaaagcagtaaagcaagtgagatcatgtgcttcttcaggagcacatcgatgttattctcgaaggccttccgcaagagtatag

SEQ ID NO: 77518 - DNA, 495 bp, Glycine max
  Peptide Sequence Number=SeqID_169203
atggatttcagtactattaagaatcaaatggaggccaaggatggtactggatataagcatgttcgggaaatatgtgctgatgtgaggttggttttcaagaatgctatgaaatataacgacgaaagaagtgatgttcatgtgatggcaaaaactttgttgtcaaagtttgaggagaaatggttgcaacttttacctaaagttactgaagaggaaacaagacgagaagaggaagaagctgaagcacagctagccttgcaagttgctcaagaagcagctcaagccaaaatggctagagatttaagtaatgagctgtatgaagttgatgtgattttagaagaactacgagagatggttgttaaaagattcagcctctgctcgccagaaattgtgtttcaaccatacatgactgaaaatgcttaccactatgccaaaaatatagctgttagtggaggcacaacacataacaccctgcatcagacatggcctctcccttag

SEQ ID NO: 77519 - DNA, 828 bp, Glycine max
  Peptide Sequence Number=SeqID_169204
tctccacagaggccattgcctccctcgcccagtattatgatcagccgttgaggtgcttcacctttggggacttccagctatcacccatggtggaagaatttgaagagatcctaggatgtcctctagggggaaggagaccatacctcttctcagggttctatccctcattagctagaatttctaagatagtccaaatctcggcgcatgaattagaccatagaaagcaagttgaaaatagggtggttggaataccaagaaaatatttggaggcaaaagcaagaatcttggcaagtaaaggcgaatgggccccgttcatagacattctcgcgctgttgatcttcggaggagtcctctttccaaatgtggatgggttggtggacctagcaacaatcgatgcttttctcgcctatcataaccacaaggaaagcccgtacaaggattgtttgcagtacgaggaccgttcatgcacagagaaaggaggcacaaattgtgaccaactcttagcaaacaaagaaggagcgtctatcaactggttccctcgatggaaagaaggaagaaccagagttcttattttgtgcggaggatttccgaatgttcccttgatggggacgaggggttgcatcaattacaatctcgttcttgctataagacaacttggctaccctatgagaggggcaccactagaggaagagatcgcgcccgtcatttcacgaggtttcaataagaccaacgtggaaacgcttcagaaggtccgcaaggcatgggaggtggtgcaaaagaaggacaaagaactcaagggcagtaacaatgggcccatcggtggctacc

SEQ ID NO: 77520 - DNA, 336 bp, Glycine max
  Peptide Sequence Number=SeqID_169205
atggctaagcacatggacaaatctggaagaaggatgagttgtatagaggcattgagtgaaggccaactcgctaagcacaccgtcttcaccttcaggctgatttttggctatggagagactgagagagagctgagcttgacgaggaaggcatcttgcggagctttggatgagattttgagagattgtgaggaagcttccctgctatggagagctaaaccctcagttggttcttcctatggggtacttgattactcaattctagtgtgcctttgccttgatcatgcacttccatgcttagttaggggcactcacattgggaaatggtttaatccttag

SEQ ID NO: 77521 - DNA, 303 bp, Glycine max
  Peptide Sequence Number=SeqID_169206
atgggcttagaaatctacgctgaggttcatgaaaaccatagggccttcttcaatggctctagcccaatcctcttggagcctcttgctcatggctctagtggctggtcccttcctagggaggattgcatcataaactataacaattcaagagttcaagataagaatcaagaagaattcaagactcaagaagaaagtctagaaacaagaatcaagattcaaggttcaagatctcaagaatcaagatcaagattcaagactcaagtttcaagaatgaagagaagactcaatcaagataagtattaa

SEQ ID NO: 77522 - DNA, 371 bp, Glycine max
  Peptide Sequence Number=SeqID_169207
gatgcctcaaattaggcaatttaactttgtttaatgaacaagtagttgtctctctggcaaaaccacctccaaagcccaatccggaggtcgatgatccgctttatctgatgacattgaccatcccagagcttttcttgaggccttatcaggttacatgggatgccaccgtgttcggggtctttaatccagatttcccactctatataaagcatgaagacctctttgaaatcgcacacggtggtcaatgtcttagcatatcagtgttacagttgtggattctgcatctcactgaaacatgtatgcgagcagggaattctgatatctatgaattcctcgaaccacagtccattcagaggtctgggcaatcgtag

SEQ ID NO: 77523 - DNA, 546 bp, Glycine max
  Peptide Sequence Number=SeqID_169208
atgcctggcattctctcaaggctgaatgcaaccatttactgtcgcattcgggaagcaataacaaggcaacaaggagtgccgacatccttgtacagaagttcagctttgcctctttgttcgctcacttcaagtcacacacttcacacaaaatcaatgattactgcctcacattccaatgctatgctgggagatgtttatgcttatggcttaatctcaggtcgtggtagtgtgcgagacttcacaaagcctgctgtaggttgcttgaggggtagtgtgaatctaaggagactacaaccattgtatggtcctttgagttttgggtgttctacttttgatgctaataggaggatccgggattcgagtttgctgcatggatcatggctcaagaatttctcagcctcttcttctgcttgctactcagccggggctgcacatgctgtctcatttgatggaagccctcctgatgaacagcttgcaaattcctctttttcgcctgacccgtatgtaattgttgttcttaatattttgaattctatttctccatga

SEQ ID NO: 77524 - DNA, 486 bp, Glycine max
  Peptide Sequence Number=SeqID_169209
atgactacacgtccttaccttcagaggactgcacatcctcaccttcagaggactagacgactacacgtcctcacctttagcgaactacacgtcctcaccctcagaggtctgcatgccctccccttcggagcattacacatcctcaccattagagggctgcacgtcctcgtcttcgggggactagacgtcctcggcttcagagggctgcacgccctcaccttcagaggacttcacgttctcaccttcagagggctacattccctccccttcggaggcctgcatgtcctcacctttagaggactacacgtcctcaccttcagagggctacatgccctcgccttcggaggactacacatcctcaccttcagagggctacacgccctcaccttcaggggactatacgtcctcgccttcaaagagctacacgccctcaccttcagaggactacacgtcctcgccttgaggactacatgccctcacctttag

SEQ ID NO: 77525 - DNA, 237 bp, Glycine max
  Peptide Sequence Number=SeqID_169210
atggggtgtagcaagaaaatgctcacctcccccttagaatttgctaagcgcaaccttcagtggctacgcacgaggaagaatccagaagaagatgagctgtcaagttcgctaagcgcaccgctccaggtcatcaagcgcaccgcttcatctcatccgctaagcgaaacaagcgggctaagccaaaatccacttatgtgcgctaagcgattcagatctgcgctaagtgcacgagcatga

SEQ ID NO: 77526 - DNA, 1484 bp, Glycine max
  Peptide Sequence Number=SeqID_169211
ccgaacagtggcagcaatggtcacggtattcgcacaccatcgatccggcggccccggcggccaaactcaacgaactgccaatgatgaccgctcgccgacttagctccggcagcaagctggcggttgagtgcgggctggcgatgctgcgccgccatgagatcgacgccgttctctataccagccgtcacggcgagctagagcgcaactatcggatcctccacgccctggcgatggagcaagcggtatcgcctaccgatttcgccctatcggtacataattccgccgtcggtaatctgacgattgcggccaaaaagcccattgcgtcgtcatcgctttctgccgggcgcgacactttccagcagggattatatgaagtcatggggcttctgcaggcaggttatcaacgcgtgttgatggttgattttgatggttttctgccggagttttaccattcgcagctgccgacggctatgccgacctggccctatgcgacggcctgggttattgagtccggcggcgaatggcagtgccaggccgagcgctatgatgccgttcctgaaagccccctaccgcaaagcctgctgtttttacggcactatctgcagaattcccccgcgcatgacgccgcttttccaacggttaaatcgcctgtggcgcgcggcgatgaccggattctgtttcgcactgtttggcgtcggtgggctgctgctgtcactgatctggttcaatctgctgctgatcgtaccgtcggcgtactggactaccagattaaagggcgcgagattttacgtcaggagcgcggttgcctggtggtcgctaatcatcccagcctcatcgactacgtgatgctggcctcggtgatgccggaaaccgactgcctggtgaaaagcgcgttgctgaaaaacccatttgtcagcggcgtgatccgcgcggcggattatttgattaacgatcgcgccgataccctgcttccggccagtcggcaacgcttacagcagggcgatactattttgattttcccggaaggaacccgaacggcgccgggagaaaaaatgcagctgcagcgcggcgcggccaatatcgccgtgcgctgcggcagcgatttacgcgtcgtcgttatccgctgtaccgagcatatgctgggcaaacagagcaaatggtacgacccgccgcgaacgaagccgttatttaccgttgaagcgttgcgcctgaaacaggaattaatgatggaagcgctctatcttgaaattaaaaatctgattatcagtacattgaacctggacgagttgtccgctgatgatatcgacaccgatgccgcgctgtttggcgatggtctgggtctggactccatcgatgcgctggagctgggtctggcggtgaaaaaacagtacggcgtggtgctgtcggcagaaagcgaagagatgcgccagcacttcttttccgtcgccacgctggcatcctttattcaagcgcagcgtgcctga

SEQ ID NO: 77527 - DNA, 570 bp, Glycine max
  Peptide Sequence Number=SeqID_169212
atgccctcaccttcagaggactacacgtcctcacctttagaggactacacgtcctcgccatcagaggactacatgttccccattttcaaaggggggcatgcactcaccttcggaggactacacgtcctcgccttcaaagggtcatgtaccttcaacttcagaggactacacgtcctcgccttcaaagggtcatgtaccttcaacttcagaggactacacgtcctcgccgtcaaagggtcatgtgccttcacctttgtagggctacatgccctcaccttcagaggactacacgtcctcacctttagaggactacacgtcctcgccatcagaggactacatgttccccattttcaaaggggggcatgccctcaccttcggaggactacacgtcctcgccttcaaagggtcatgtaccttcaacttcagaggactacacgtcctcgccttcaaagggtcatgtaccttcaacttcagaggactacacgtcctcgccgtcaaagggtcatgtgccttcacctttgtagggctacatgccctcaccttcagaggactacacgtcctcacctttag

SEQ ID NO: 77528 - DNA, 681 bp, Glycine max
  Peptide Sequence Number=SeqID_169213
atggaggccatgaaggaccaaatgacctccatgatggaggccatgttaagcatgagacgaataatggagagcaatgcggccatagatgccgccaccagcgccactactgaggcggactcgactcatccatccgacataaaccaaacaagttgtccaatcccgtacatgataggtcagggaggagagaataagaattctttcccaccgtaccgcttacctcccaactatacaccacccaatgtagtgcacgttcccaacgagaatgcctaccactccgttctcgttccccttgaaggccagcaaccccagttggggcatgaaccctttgctcagcctatgggggaagcccgtgaagagcctcgagatcatcctctaggcgagttcaaaccataccctacatatgccactaaaggaccagtggttagtggcatgcctcagcccaatgtcgcgggagctcctcaacgccacctgctgcaacctctatatttcttggtagggaaactacctttggccatggaagaaagagagaagttgaatctcatagaagaaaggctgagggccatcaaagaggtcggggattatccatttgctgacatggcggagctatacttaatgcccgacgtcgtcatctctcccaaattcaaagtaccagacttcaacaagtacaaggggaccacctag

SEQ ID NO: 77529 - DNA, 720 bp, Glycine max
  Peptide Sequence Number=SeqID_169214
gaaagtccggtcgttgctgttttggctgatgcttatgacacattcgaccggagatgcgagaagagcagcatgagaattgtctgttgtacacccgctctttatgtatggctggtctctaacatttttctccatgaaagtagacccgactgtcccctacaaggtcatcgcatgtgtgccgagaaagggaaagcgaattgggagcaactcttggcggggttcccaaatgtccccttgatgggaacaagaggttgtattaattataatcccatattggccataagaaagctaggctaccctatgagaggggtgccattggaagagattatcacacctttcatcgcacgaggtttctatgaaggcaattcaaatgtgcttcaaagagttcaaaaagcgtggaatgctgtggaaaggaaagataaagagcttagagtaagcaacaacgatgttattggtggctatcataaatggttgaaggctcggatgcaagggataacttggctcccgaagctaaagatttcaagtggtgaagaagccgaagtcccggaggagagcgaaaaagtgcaagccttgaaggcagaacttgaaagaacggtcaggaaagagtgtgacgagatgagggatgccaacatggacataatcgaaggacgagtcgaggttgggaagtatgatattagaggacaagttaaaggcttgtcaaaggttgaggaggagcttgactga

SEQ ID NO: 77530 - DNA, 156 bp, Glycine max
  Peptide Sequence Number=SeqID_169215
atgaaaggaggttcgaagatctttccgggagatatcacaaccatctggttggcgatgagggatggcaagaggtcttcgtacgtcatcgggataaggggcgaattcttgcgttggccttgggggaaagttccttgccgcattggaactgacgccaag

SEQ ID NO: 77531 - DNA, 468 bp, Glycine max
  Peptide Sequence Number=SeqID_169216
atggcttctaggaaaaggaaagccacagctttcaggccccagcctcactatgatactcacagattcacttctgaggacgcctggaatcgctacgctgacaacgttcttggccggatcatcctttcggaaaggaatgtgaagctttttgttatagagtttgatgagttcaggacagagctggttagaagaaactggcacaaaatgctgaccaaccttatggaggggagcatagatgtggctctcgtgaaggaattttatgcgtatctttatgacctggaggataagtctccgaagcagggcaaggttggtttatggattagtgatgaagatggacatgaaggttggatccctcatctttggacagatcactctcatggcttagtccaactcctagaggctcggatttcctgcccttatcacttccttatgaatcgcccaaggagtcacttcagattctctaacttttga

SEQ ID NO: 77532 - DNA, 261 bp, Glycine max
  Peptide Sequence Number=SeqID_169217
atgtatcatggaaaagaatttatcaggacacaggacactgttcatttgatcgccaatcatttcgctaagcgcatgcttctcgcaaagcgcataatctttcatgcgctaagccacgagtttcaagcgcttagcgcacatccctggtacctgaggttgattatttccgctaagctagccaaggttaagctaagcccaaatcaattcgagttgaattccgctaagcgacaaactaatgtcttagcgatggcttcccttggctaa

SEQ ID NO: 77533 - DNA, 201 bp, Glycine max
  Peptide Sequence Number=SeqID_169218
atgtctgggcgttcctccactcgccaatttcctagtcggaaaccaggagggcatggtcgtaccaactccgacccacttggcgaatcatcttcacatatcgcaacgacttggccttcgtgtcctagacccgcgcttataaagctcctactgatgtggcagggtgggcctcctttgacttcttgtcccaatcgcgagccttga

SEQ ID NO: 77534 - DNA, 531 bp, Glycine max
  Peptide Sequence Number=SeqID_169219
atgaccaccctgacccagatatggatgacgttgctgatcagcaacatcctgcccagtgatcataattccaacctccctttgccgaagtgtatggcgccgaccaggcaccctttggacccagataagtccaacagggccctgggatttcccgcactgatcacaggactctgccagtcgttcggagtccccgttgcacctaccaaggccgcaagcgcgccaccaccacctcatcaggctggcccgactgggtcatttgatatggagcagtatttacggcatttggttcgccagcaggcggccaaccaccgggcacatgtacagacccatgattgtctttaccagctgagcctcagcatgcagagccagggcttcgcttctttttcatgccctactccagaccagttcagggcagaggtcgcatggcccggggattggcccgaggcccaagcaggagaggcgtccccagaggctcccggcgatggagaggaggcccacgaggacgaggagatggtcgatttgcttgacttctag

SEQ ID NO: 77535 - DNA, 297 bp, Glycine max
  Peptide Sequence Number=SeqID_169220
atgacaaaattgaagaagaccttgtctcctgaaactaagacagttgcaccaaagtggattgaagtaaagcaacaatttagtgcagctatagtaccaccaagcttgccactgcagcagttaagtgaacaaatgaagtgtccacagtcattggatggttgcttggtagagatgatattatcatttgaccttgcttttgcttggattccgctcctaaagttcagtagcagcaaagtgactagcagcacaagcattgaagagagattgcagggattccaagggaaggggaccaggggatga

SEQ ID NO: 77536 - DNA, 112 bp, Glycine max
  Peptide Sequence Number=SeqID_169221
ggaattggaagaaggattggtgccatcccttgaagaatttgagtcaagaagcaaaggctcaaccaccttaagagctattggacttgatcgaggccgtacccgaatcaaataa

SEQ ID NO: 77537 - DNA, 417 bp, Glycine max
  Peptide Sequence Number=SeqID_169222
atgagcgagtccgatgacatgcgggaggtactttatggttatctgcacctttcgtcatccagagatggcgagttcgatgacatgtggggagacaacgagttcgatgacatgcgggggtaccttatgattatctgcaccttttgtcaaccagaggcaagcaagtccgttgacacgcagagactaacgtcgtcatctgcaccttttgtcaaccagggagacggtgagtctgatgacatgcgagggtaccttatgattattcgcaccttttgtcaaccagaggcaagcaagtccgttgacacgcagagactaacgtcatcatctgcaccttttgtcaaccaggggttttactttcgtcatgcagagacatttaagcctgacgacgcacaagattcttctctgctaggtgggaatgattga

SEQ ID NO: 77538 - DNA, 171 bp, Glycine max
  Peptide Sequence Number=SeqID_169223
cccaccaaaccagtctcagaaaaacgacgatctcgaacccgttcaccgttggatcgttgtgaaatttgagtatcatgttcgcaacacaattccgagcattctcaccgttgggaatttcgatatcatgtctgatcaagcttatcgataccgtcgacctcgagggggggcccg

SEQ ID NO: 77539 - DNA, 346 bp, Glycine max
  Peptide Sequence Number=SeqID_169224
atggcattcttgggagagacaagcagtcaaacagttgtgaactccacattaagtttcatttttccaaatggatccattgtttacaacgacggtgatgtttccttacaagcttccactccagttcccattcgagtacctaatgggtgtgattttcaaacgttaaaaaccagaatacacaatacccttaagctaactgacaaacaatttttggatgaaatttactaccggcagcctttcacatatgcaggaaaaaatcccaaaaagtttgacatttccatcagatgtaccatggatgaactgaaagatttgatcaagcaagttgcgcctcctgggattcccccttatg

SEQ ID NO: 77540 - DNA, 510 bp, Glycine max
  Peptide Sequence Number=SeqID_169225
atgacgttagtctctgcatgttaccagactctgagtttgacggatagcaaaagagtgtttgtgggttaccgtcgggtgtctccacatgctaccggactcttgagtcgctggatagcaaagggtgtttgcgggttactgtcgggtgtctacgcatgccaccagactctcgggtcgctggataacaaagggtgtttgcgggttaccgtcggggtgtttgcgggttaccgtcgggtgtcttcgcatgccaccgaactcttgggtcacggtaacaaaggaaagggtgcagatgaacacattggtctctgcttgtcaatcggacttgggactctcgggtcgctggataacaaagggtgtttgcgggttaccatcgggtgtctccgcatgccaccagactcttgggtcatgggcaaggatggactttctcaccctgggtcaaggtttatgcggttcagggataaaggggatgtcccacattatttccatgacacacatgcaacagggatcctctag

SEQ ID NO: 77541 - DNA, 174 bp, Glycine max
  Peptide Sequence Number=SeqID_169226
atgcagtttagagccacatcccacaatgacagggacatcgtaaaagtcccattttttaccacattcagtgggcaccagaatatcctgaatatgttcgtttcaaatataatggacttatatatcaaatccaactcagactccataagggaaaaatcttttttgttgaaggactga

SEQ ID NO: 77542 - DNA, 567 bp, Glycine max
  Peptide Sequence Number=SeqID_169227
gatggtattatttactctgaggtgcataatgtgtctattgttattgatcaatctttgttcttttcattgacaaaattacccaatgaaggtgttccttttgagggcaccattgttgatgactggaagtttgattattctagtcatgatgctcgttgtcagatcgactgggctcacttgattcggtaccggatgcataaggcattacgggccaatgcacctctcccctatcctcacctcgtcaccctttttcttcatcatttcaaaattcctttggaagatgaaccatttgttcaagtaaaaaggtcttttgttattggtgctggtgcggttatcttgtttggttaccgtaaggatgatgatggtcaggttgattcctcttcacttctgaatgatgttccctctgaactccatagtcttcgagcttttgtgggtgaccgatttgatgctatggatactcccctggatgccatggatgctcacttcgatgggatggatacgaggattactcgacttgaggacgatatgagcttcattaggcgttgcttcgatccaccagccaacccctta

SEQ ID NO: 77543 - DNA, 3030 bp, Glycine max
  Peptide Sequence Number=SeqID_169228
atggaggaacaagagaagggtttgtctggagtatcagaaaccacagtgactcacgaggagaaagtgagggttgaaaccctagaagggtctgtggattgtcggggtgtagttctgatggagggttcattcactgcagacttggttggggagggtggggcttgtaatgggaaggaagtaatggtggaggttttggggtctgatttgtacatagatggtgattgcactcatgagaatggtgatgagttgagtggtggtggatcaattgatggcggggaaggtttggttaaggacgtggggtctggaggggtaggcggtggggactctcggtgtttggaatccgaagaagataggagtgagaatgtaggaatggagttggatagtgtggtgttggggagggaagagagggatgaagcagtagttggaagtggagaagttgatgctccatctttactggaggagtctgttttggatagtagagctcagaaagaagtggggactgaggttagcaatgttgaagatcctagtgtggtggatgttgaggttgagtgcacaaatgcaccagatgccgaggcctcagatcacgaggtgaataatgctttaggatgcctgttagtaggagagaatgtacaagttagttcagatacagggcagggagttgataaggattcaacaatagaagaagaattaaacaagaatgtttctgatgctgaaaaatgtggtttgcataaggggatagaagtagaagctggaggtcaaccagaagcagaaagtactaaaacaacgaaccacacttcagagattgaaggagaagacactcaaattgatgaccaggataaccttgcactgatggacgctggacatgaagaaatctatgatgagtctaatattaggccaaatgttgaagtacaaactggcatttctgagcaggttggttcaaatggaggtcaggaatttgaagttgaagttgaagaatttattgaagctgaacagagaaaagtagagggaagagtcacgagacgttcatcattaatgaagtcaatgtgtttggaatcattgcataatgcaagatatttgctaccgatagaaaaggaaggtgagttttctgtgtctgatatggtttggggaaaggtgagaagccacccatggtggcctggacagatatttgatccctcagattcatctgagaaggcaatgaagcattataaaaaggactgccatttggtagcatattttggggatagaacatttgcatggaatgaagaatcccagctaaaaccttttaggacacatttctcctccattgaaaagcagagcacttcagaatcatttcagaatgctgtagattgtgctgtggatgaagtcacaagacgagccgaatatgggctggcatgttcttgtatacctaaagatacctatgactcaattaaattccagacggtagaaaacactgggattcgatcagaactaagtgccagacatggggtggatgaatctctaaatgccagctctttttcacctggtaatcttgtagaatacttgaaaacactgtctgcattgccaactggtgggtttgatcgtttagagcttgagattgctaaggctcaactgctttcattctatcgctttaaaggttactcgtgcttgccagaattacaatattgtggaggttttgatgatgacatggactccttagttcatgatgatgagaataatcatgcagcgcctgtaagcaagaattatggtcaagctggttctggaaatttaaaaaaccaaagcagctctcaccgtaaacggaaacataatttgaaggatattatgcatgaaacaaagaaggaaagaagcttgtcagaactaatgggtgggactccagactctcctgatggtgattattggtctgaggagaaggtaattgataatctggtttcacctggccgttccaagaaaaggaggactgttgatcactatgctgatgactttgggaagccagatggaagaaaaacaatttctgttgcaaaagtttctaataccacaaagccgtcatttttaattggtgaccgtattcgtagggttgctagtaaacttactggttcaccctctacggtgaagagttctggtgaccggtctcaaaagacagatggaagcactgatggtttttctgggaatggaactgatttttcttttgaggaggctcagaggtcaagtatggctgctccaacagagtattcatctctggacaatttgctatcttcacttcatttggtggcacaagaaccccttggagattacaacttcctgaatcctattgtaagcttcttctctgatttcaggaattcgatagttgtggctgatgattctgtaaaaggtatcttttgtaaagaaaaagttggtactaaaaggaagaaactgcccccagctggattgcctgaatcatttgaatttgatgatatgagtgacacatattggacagacagggtcattgacgatggcagtgaagtgaaaccagtgcaactgtcacaaccagcacaaccatcacaaccagcacggagaaacaggaaaaaagaccatcaacttgttcctgctgagccagggaagcctgttcaagttagtcataggccatattccaagaaacactattctaacaacaatcatattgaggctcctgcaaaacctcctggttatatagatgagaatgcccctgctgaacttgttatgaactttgctgagttgggttctgttccctcagaaacaaacctaaacaaaatgtttaggcattttggacctctaaaggaagcagagacagaagttgatacagtaagcagccgggcaagagtggtttttaaaaagtgtgttgatgcagaggttgcttgtagtagtgctcaaaagttcaacatatttggttcaatacttgtaaattaccagcttaattatactcctagtgcattgttcaaagcttcgtctgttgccacaacacaggaccaggagatgcatcttgatctctccaattttgaagttcatatgattggtaggtaa

SEQ ID NO: 77544 - DNA, 168 bp, Glycine max
  Peptide Sequence Number=SeqID_169229
atggtgaaaccttctgaagctgaaaagaaccttgttcaatctaatgcttctggtggagcagccggtgtaactggcccctatggagctgtggaccgaaaattgtatgtggggaatcttcacttcaacatgactgagagtcagctgcgggaggaatatgaatgcacatga

SEQ ID NO: 77545 - DNA, 255 bp, Glycine max
  Peptide Sequence Number=SeqID_169230
atgggcaaaaaggttttttcattgagtctcatggaccctagctcgcccaggctagccattgccctaagtgcccattttcctataaataggtatgctagggaggccaaggagaagttccaaggttcagtgcttgagggaattgagagaattgagagagaagaagaagaaagaagaggaaacgaagttgaagcactgccaaattgcgactatgatgaatctctatgtggttccttgttcggtgcttttcatgcgacc

SEQ ID NO: 77546 - DNA, 450 bp, Glycine max
  Peptide Sequence Number=SeqID_169231
gtgtggagtgttctctcatactccaacctggcccccacatcacatacctctgatctgatagtggacaaagctaggctgatctttggcctagtctctcgcatggacatgaacataggagcacttatttctggccagatgacttctatagctcagtctaacacttctagacttgggtttcttgctctgatcaccacattatgtagagccataggggttgtctctgacagccttacttttgagcgcctgagcctggtcattaacttggcctacatcaggaagaactgttggaatcttgaggatctaacagtttctatcctaggggctaggagggcgagggcgaggccagctgagcttccttccacttctgcagctcctactccagcatccacttcagcagctccttttgtcccagctctgacaaattctcagcactttgaagccatgctttag

SEQ ID NO: 77547 - DNA, 309 bp, Glycine max
  Peptide Sequence Number=SeqID_169232
atggagatcatgaacaagaccaagctggcaaatcgcaagaagcttttgaggtctcaaacagagagagaaatattgcagtctttagatcatccttttttacccacattgtatacacaccttgaggcaaagacattttcttgcttggtaatggagttcttccctggtggggacctgcatccactcaggcaaagacaaccagagaagtatttttcggagcatgctgtcaaggcgagtggtgtttgcaagaaatggaaacaaggggtgaaggagtctcttgctcggagacacaatctcagctttgctgactag

SEQ ID NO: 77548 - DNA, 216 bp, Glycine max
  Peptide Sequence Number=SeqID_169233
atggaactactccttttaagagctagacttaggggtcaagacatttatagtagtcaagaggagactacttcttccccttcctctagcgaaagtgaagatgaagtaaagagggaagagtctagtgaggaagtctacccccatgaagaaggtgacctcctaatggttagaaggcttcttggagtggatcttgttgcaattgttgtagcacaaaattag

SEQ ID NO: 77549 - DNA, 1701 bp, Glycine max
  Peptide Sequence Number=SeqID_169234
atggttaggaccagaggattaggtcgtgccctaggtcaggttactggaaaaggtgtggacaaaggagatcatgatgattccgatgatgctccgcagcatcgacaacttattgcatccgcacggaggcagcgagtcgttgtgactgtagcgcacgatgagccagtggtccctgcgtcagatgttcaggatgacccgatggaggcaccagctgctgtagaggacattgtggcagacattcctgcggacacaggcgcagaggctgttgaggatgagcatgagggatttccgggtggtccgagcgacccatctgtgttgacccagtatgcggatcacgttgcttgcagcgtatggatgggagaggagtgtcctaaatggaagctatcctctcatcggaggaaggtccatagtttaggcaggcctgtccctgccattgagggacttgttgttggtacaggactaagtcctctgatcgcgtgttcggtaaacaccagcaatcggggacttttgtccgcgtttgtggagcagtggctccgagagacgtctagtttccatctcccgcccttgcacgtggatgatgcggttcagatgctggtggacttattgatggtctctgcggagtttgctagggctgagatagcccagtgccgtggaccgtaccgccgatgccaggcaggtcattgggcagctgtggctcacgcatattttcttcatcttctaggttgcactctgtttgctaacaagagtgcaaccaatgtccatgttgtctacttggaggcccttcgtgacctcagtatgacggagaggtatgcttggggagtggctgctttggtgcatatgtacgaccagttgaacgatgcatctatgagccacagccggcagcttggcggttacatcacactgctgcagtgctggatttatgagcactttccgtcagtcgcagactccactgctgatcgggagtacgacaaggattctccgcttgcgtgtaggtggattgcgaccaagaagaccgtgaagagcattcgtacgtcggcatacagggagcacctggaccgactctggatttcaaatgtctgttggatcctttgtggggagcaccgggaggtccgagacttccacgtcagatcatgctattccggtctcttgtgctggaggcctggtgctgtttattaccgaccgaagaaggtcgtgtggcagtttggatacacacataccattcctgctcctcctgtcgattcatggttctcgtatgatgatatacacgacaggtggatgcactacgaggatcatatcgttccagcaggtgaggtgtgcgttgtgctaggccagtgttccagtgactacatggactggttcttccgcatctcccatcctttcatgacactaggccacgcattagatcctctgcctcatggtcacaccccgcagccccgagtcatccctcaggccccgcaaacggatatccctcacttgctggagctaggagcatcatcgacatctgcggaggagcctagacatgcaatggaagtttgtgatgacattgctgagaggttggagcgccatctgagtctagaggtggtcacgcctggctcatcgacacatgaggtgatcgaagaatgccttaggttggccaggagtgtgacacaggaccatctagtatatgttaggtctagacgcaggcggtgcacggatcaagcatag

SEQ ID NO: 77550 - DNA, 456 bp, Glycine max
  Peptide Sequence Number=SeqID_169235
atgtgtttttggtggttatcggtatattataaggatcccttaaaattccaacattggtctccattggggcttagagttgactcattacaaaatgtggccaatatcattatgtcacaatgggttgaccaatgtttgaatgttatgtgccatggtgtcgggtttgtggcacaaacacaatgtttgggttctaagaaagaagaaattggatttgtgaaaattttggccaaggccttgtctgtgtttgttactatggagtgggtcccacctttggatcccaaagttaaggtcaactttgttgttgcaatgatagaggatgttgggactggattggaagtgatttttagtaattctaaaggtgaaactatggcatcaggtacatgttttatgctagatgagtgttatgtttctaaaattgctgagacactctactacaagtgggctatggagaaatcatag

SEQ ID NO: 77551 - DNA, 3354 bp, Glycine max
  Peptide Sequence Number=SeqID_169236
atgtgcagtgatcaagatgttcctgaatcaaaccagtcgttgaggattctctcaaacctagttgcagctggtgccttcagttctagtggactaatagatgaactaataaaagagctccttgtgtttactgaatctgttatagccatgaaatcctctgaagttactgacatgatggcaaagctcctccttcccttggctcgtggtggtttgttacctgcattgtcgcagtggtttgttacctgtgttgccttcgttgtctttatggtgggtgttgtggtggcaatgactgtccggagcattatgtttgaagaaattaatatgaatgaagacacgggagaggaacttgctgtggttgaaaatattgattgttctgacgcattcaatacttctcaggacgcattgccatgggcttgtattgttgtgtatgatattggttttgtggctgtgatagtgaggtctgacacatcaactggaaagagaggaaggacctcatttgttttaattggttgcgagaggagtgtaaagtatagagtgtacaagaaaggtttagtactgacgatgactagcactagaaaatgtggttgtccttttaagctgcgaatgaaaccagatgggaagattattcttagtgatatgacaaaatcaatggtaaaatcaaaggatattcttctcattttgaaggagcaatatgccaacaattgtacaacaatgaagcaagtctacaattattactgcctcttatggaagaacgatatgcatatcttacgcagatatgtaaaaaatttacctctggacagtcgttgccaccgcgagatgtacaagaaaggtttagtactgacgatgactagcactagaaaatgtggttgtccttttaagctgcgaatgaaaccagatgggaagattattcttagtgatatgacaaaatcaatggtaaaatcaaaggatattcttctcattttgaaggagcaatatgccaacaattgtacaacaatgaagcaagtctacaatggtttctccatcactaaaattttgctagataatggtggaagtttcacttcaagctcttatgtaagtcactgggttgaatttgttgagatctattctcaggttgtaacttcaaataatgatgcatctggaagagttctgtatgaatctagtgcctgcattacagtcatgctatctagagttgctcaggtgcttagatcatctcctaaaatttcaggccaagagaaactgaatgaaactgcttacagaattttagagcattcaaaaacaactggtttagtagaccatttgtgtctgtgtttagccacttcaggatcgagtcttattacaggttcttccaatatgctacgggctgcttctgaagcatgcaaagctgtctggatggaagttgtgcatcatgagcaagatctcttgcataaagctgattcgactaaagttgttgatgcaatgacaagagcattcctgagatctaaaactgttctggttgctgtttactattgttttcaccaaggacttgaatctgcaatgaattgtggtcttcagcttttatcaaggtgctgtctacataatggaattgttcctgctctcctttgtggtcttcccagttcccttcccgtgactactgttgttagtggtggcggtgatggaactattgtttcagaagttttcactgttttatcattatgcagttcctctgttaacaaagacacacaaagtgtagaaccaagtaatgccaagtgcaaattaacaaatccttctgctctggttcgtcattcatgtctccttgttgcagtaattgctcagtgtttgaagtcatctggaagaaattcagcaatttttatgctcactacctcaccaaagaagcagtttgctcgactatcagtgcttgctcaccaaatttcttctgatgataaaataaaagcctctattgagcctcaaagtgcatcagccatgttggctctggcatccattctatccctcgaatctggggctttggttgagtctccaatatctgaaattgctatgcctttaattcctcgaacttctacactaagtgaccatcttaaattttcatctagcaatgtaaatgaattggacccttgcaacatcagtgggaagttctcatattggcaaggggtaagagatgggtttgttggtcttttagattccagactcaagtggggaggaccattagctgttcaacagttgtgtgcaagtggcactcctctacttcttatgggcctattaggcaatgatgtcttaaatgcttctcatggaaatgaccatgtaaatgatagagttggattgtctcctattggtgttgtatggacaatttcatcattatgtcattgtctttctggtggtgctttgacttatcgtcaaattttgattaggaatgaacatattaagctcttttccaacttgatatgtgatgttcatatgaagttggtaaaatgttggatcggacctggtggagggagagcaggagtcagagatctaataaatggagtgatagatctcttagcatttccttttgttgctctgcaaaatgcgcctggcttgccatctgccactgcttctgtcagcagtggatttcttcttaatattggctctcctggtcagagagtatgcatggaagataagggtatagttaaggcaattgaagaagacatgggaaaatatattaagattcttgtagaggtgggtgtgcctggtattatccttcgatgcctagatcatatggatttgaatgatttgggcaggcctgttgcctttatggctaaaatggtatgccaccgacctttagcaatccaacttgtgagtaaaggtcttctggatccaaatagtatgaggaagttgtttgactgtttggccccaaaagaggtcaaattggatgctcttatgattatttctgatcttgctcgcatggacaagggattctatgagtacattaaaggtgcttctattttggagttcttgaaagattttctttcacacgaggatcccaatatgcgtgccaaagcttgcagtgctcttggaaacatgtgtcgtcatagtgcctatttttatagttcacttgcaagacatcaaattgttggtatccttattgaaagatgttctgatccagacaaacgaacacggaaatttgcttgttttgctattggaaatgcggcctaccacaatgacttgttgtatgaagagctgaggagatcgattcctcaactggcaaatttgttacaaatggcagaggaagataagactaaggcaaatgcagcaggtgcacttagcaatctggttcgcaactctgacaagctttgtgaagacatcgtgtgtaaaggagcggttcag

SEQ ID NO: 77552 - DNA, 375 bp, Glycine max
  Peptide Sequence Number=SeqID_169237
atgaattgtaatctaaagagagtggtcggtggcatatatggttgccagtgcaagctaaagttgcctcctcctgaggacaaaacaccactattcatatcagaggtggctgaactagaatatgccaaggcaactgtcgcaacgtgccattttgcgggcgagcgaaggcgaggctcacgggtgcgctttccaaaggaggaaagatgcgcggagtcgccaccaacgtttatttgtggaaaacgtcgggaaaaccaaaggaaaccagtcaaaataaaaattcttagttcgggagttatatttatgcttgaggaaggtcgacaaaagcggggctcttgctcctacgtaccctctatcgaagaggaaatcagacctacgtag

SEQ ID NO: 77553 - DNA, 1293 bp, Glycine max
  Peptide Sequence Number=SeqID_169238
atgcattgtagaaaaccccatgcttctcacgttgtttttctcttcttcttcctctccattgaagcctccattaaagctccaaactttgctcaccatttttactccaaattgcaaaaggaagtcattttcggagtcgtgaagcgcaccactacgttgtgggacttcaaatttcagcagaatttttgttcttgtgcagaaaatgcttgtgcattgctggttatgggaaagcttggaggggttgatggggacccggtgctgagaggaacgaggataagggctacgtggggagtggtacctggagatatgtcgcgggggtcaggagaccttggtgacatcaggcgagctcctagcagtcaaccaataaaagaacaaagaccacaaagcaaggaggcttgtgtggtggctggccagctatggatcttgagtggtatctataatttggcctctagtaatcgattaccaagggaagttgagatggcctctggtaatcgattaccaaggggtgtaatcgattacaaggcttataaatggagacaggatgttgaggtggcctctggtttccatgttcagaagctgtgtaactcgagtttaggcactggtaatcgattacatactgtgatcacgatggcagcgcaattaatccatgatcgcgtggagatggagtgcctagagggagtttgggagaccctcgaaggcaatgagaggtgccgattccgtggcacgattcgactcactgctacttcattggtacatccagaggaacccgcacgcacacttcagcgaactgtggagtggatactacctacacatactccatatcgactagtggagccagtccaagtgatagaggagttacctcctgagcctgctgtggatgctcttgactttctagaggatgataaggacccactccctgatgtggattctccagaggatgtcatgtcagcatctgaggcagactctacggaggagagcggccctggagggacggcgaataatggagactcttcatcatatcattatttagggacgccacaagttacctgtggtgaatttggtgtacaacctgctcacgaggaatgggaattatctaagacaattgatccacctaagaagccagaaggaagacttaaatttcttaaaaagcctttggaacaaggaccaacaatcatgtatgtacccaccagaacagaaacactgagaattgcaaagtatctatgcaagtttggtgtgaaagccactacttataatgcaggagtatgggatatattatactcaatcttgtttgactag

SEQ ID NO: 77554 - DNA, 321 bp, Glycine max
  Peptide Sequence Number=SeqID_169239
atgaagccaaggggttacattgaattcgatcatgtacaagatgatgtaccttaccaagttgatgaaatgtcacatgtcaacgaggtcattgaagttgaaagtatttatggattgcaagatttaagaggtggtgttgaagaagtagaccctgctaatatgttgacaaatgaagaagaatcaaataatttaaatgaagaatcaaacaatattgaacaagacaatgaaggggaattagaagatgaatttgaaatatgtcatcaagtggttctgaccctccccgacccccatcacatcactccaatgggaaagggaccactgtga

SEQ ID NO: 77555 - DNA, 288 bp, Glycine max
  Peptide Sequence Number=SeqID_169240
atgtatggcctgccagagatgggtgatgcaaagggactgagcagtattgggtcaatctttgaagtgaaagtgagcagaggttttcattcaactggcatgaagaggatgggaggtggacatggccatgatgagccctattatcttcatgcaaagcacatgtacaacttggacaggatgaagcaccaggggttgaaaatgtcccttgctgtattcactgctttcagcattggggttgcagttccagtgtatgctgtcattttccagcaaaagaagacagcttctagctag

SEQ ID NO: 77556 - DNA, 249 bp, Glycine max
  Peptide Sequence Number=SeqID_169241
atgcggggttaccttatgattacccgcacctttcgtcaaccatgggcaaacaagtccgttgacgcgaagagactaacatcgtcttctgcaccttttgtcatccagggacagcgagtttttactctcgtcgtccagaaacattcaagcccaatgacgcgcaggattcttctctactcggcagggacgatcgagtgcaatggcatagggaagtgtcgtggttgtccaactttgtcactttcaagacactga

SEQ ID NO: 77557 - DNA, 213 bp, Glycine max
  Peptide Sequence Number=SeqID_169242
atgcgggggtaccgcatggttatccgcacctttcgtcaaccaggggcaaacgagttgatgactggtgagactaaccctatgagaggcaagtccgatgacatgcggggtaccgctatggttatccgcacctttggtcatctagagacggcaagtccgatgacatgcgggggtaccgtatggttatccgcaccttttgtcatcccgagacggtga

SEQ ID NO: 77558 - DNA, 222 bp, Glycine max
  Peptide Sequence Number=SeqID_169243
atgatacgcggagataccttacggttatccgcacccttttgtcatccagaggcggcgggcccgatgacaagcagagaccaaatttggtcattctgcacccttgtatcatccagaggcggcgggcccgatgatacgcggagattgatgcaatcctactccgcaagggcattggatagaaaaactccaagtagattgggccagagatgcaagagaaggccctag

SEQ ID NO: 77559 - DNA, 528 bp, Glycine max
  Peptide Sequence Number=SeqID_169244
atggccccgaggaagcttgcctcaaagaggtccaggagggataaagcggccgaaggaaccagttctgcacccgagtatgacagccaccgctttaggagtgctgaacaccagcagcgcttcgaggccatcaggggttggtcatttctccgggagcgacgcgtccagctcagggacgatgagtatgccgatttccagggggagatagttcgccggcggtgggcatcactggttacccccatggccaaattcgacccagacatagccctcgaattttatgccaatgcttggcctacggaggagggcgtgcgagatatgagatcctgggtgaggggtcagtggatcccgttcgatgcggatgctatcagccagttcctaggatatcctttagtgctggaagagggccaggagtgcgagtatggccagaggaggaaccgggaggcgagtgcgaattatgcgcaccaacatgaccaacctgacccagatatggatgacattgctgctcagcaacatcctgcccagcgatcataa

SEQ ID NO: 77560 - DNA, 234 bp, Glycine max
  Peptide Sequence Number=SeqID_169245
atggcagaagaagatgcactttctcttgacaacattgaaggttgtgtatgtgttgagtacaccgatgccggtgcttatggaagacgaaactctggatcaaacaaggaagcgttcgaaatgggagaacgacgattatatttgtcgtggacacattctgaacgtctgctaaggaattatgggactctcttgaatccaagtatatggcagaagatgcctcaagtaacaaattcttag

SEQ ID NO: 77561 - DNA, 1434 bp, Glycine max
  Peptide Sequence Number=SeqID_169246
aggatcccccgtgcacacgttcacgtccggcgtggccagccgcttcagcgtggaatacagggtggtggtcttgcccgagccggtcgggccggtgaccagcacgatgccgtgcggtcgctcgaccagcgcattccagccggcggcctcctgcgggctgaaaccgagctggtcgatgctcttgaaggcggcatcggggtcgaagatgcgcatcacgcacttctcgccgaaggcggtgggcatggtcgacaggcgcatctcgacctcgcggccgcccggcgagcgggtcttgatgcggccgtcctgcgggcgccggcgctcggccaggtccatgcggccgagcaccttgatgcggctgaccacggcggtcatcactgccggcgggacctcgaacaccttgtgcagcacgccgtcgatgcggaagcgcatgcgccccatttcgcggcgtggctccaagtggatgtccgaggcgcgctgttcgtaggcgtactgcagcagccagtcgacgatgtgcacgatgtgctggtcgtcggcattgacgtcgccggtgcggcccagctccaccagctgctcgaagctgggcagggtggtgttggcctcgccgcgcacgtcgccacgggcgccgcgcaccgagcgggtcaccccgtagaactccatggtgtagcggtgcaggtccagcggattgaccaccgccagttcgatgcggcggcgggtcaggtgctgcaggtcgcggcgccattcctgcaccagcggctcgctggtggccaccagcacgcgctcggcatccaccgccaacggcaggaaacggtggcggcgcgcgtaggcgtgcgacaccagcgcggtcaccgcagcgacgtcgacccgggttggatcgatgcgcaggtagcggctgccggtgcgctgcgccagccactcggtgaggcgctccagggtcagttcgccgccgccggtggcggccagcttgaggttggacagcagtaccagcggatgcacttcactggcgttgcgtgcgccatgcgcggaaaaccgcatgcgctcgcggtcctgctcggccaccaggtcatcggcgaccagggccgcggcaatctgctcgaactgcagccgtccccacggcagcgggacgccgccagcctcgccgggcgtgcccgccggcagccgatgttccatctgcctgctcctcccgggtacggaatgccccgcaggtcggccgttatactagcgcacccccttgccggccaagactcggctgcgtgctcatccagccgctcgacctggaggtgggtgccggtaccttccacccggccaccttcctgcgtgcgattggtccggagagctggaacgcggcctacgtgcagccctcgcgccgcccgaccgacggccgctacggcgagaacccgaaccgtctgcagcgctactaccagttccaggtggcgatga

SEQ ID NO: 77562 - DNA, 100 bp, Glycine max
  Peptide Sequence Number=SeqID_169247
atgaagcatagctcgaaactcattgggtggaggatgcatgacgaaaacgcaattaatggggctccgacaaaatggcgaggatggagggttgcactagagg

SEQ ID NO: 77563 - DNA, 1053 bp, Glycine max
  Peptide Sequence Number=SeqID_169248
tcgcccgtggtcgtcagtcctgtaccgcctcgtcatcatccagacgttaatgccgcgcctgctaaagcagtcctggcgccacaaatagaaggcgaattcagtatcaagccggctgaaacaaccgccgccaatcccgtggtttcggtgatcgagccaccgttagaagccgcaaatactgctaaacaggtcaaaagcaatcaagaggagcctggggttagaggtgtggtcaacaagcaggtccgtcccgatcaggaagtcaatttgctgattcagcgcgctgtggatcacgaacaaaaaggacgccttaacgaggcattggtcacattgcgacaggccataaatagctatccgcaatcagaggatgcacggcagttgctggcagcttatttgttcgagtcaaaacaagattctgaggcggttgctgtgttgcaaactggcatcaagcaatatcccgggcagattggtttatccaaatcactggctaaatggcagctttcacatggccagccagagcctgtgctgcagaccctgaaacccgtcgccaatctgctgatccaggatgcggagtcacaatggatgcttgccatggcttaccagcaaacagggcaacatgcagcggccttgccgcactttgagcgtgcgacggtgttgcggccaggcgtggcgcagtggatggtggcttacgcgatttcgctgcaggctgcgggccagtctgctcaggcattgcagcaattacgctggcttataacatgccactcagcgagcggttatctgagttttgctgttacccgctttgcgcctgccgtttgtggcagcgaaatgcaaacctcggtcattaacctggacggcctgaaaccatcgcgcggctgttcagaggattgcggctactgcccgcaagcggcgcgttaccacactgaggtggaaaacgagccattgatgcagttggatgaagtgcttgcagctgcccaggcggctaaagacagtggtgccagccgcttctgcatgggcgctgcctggcggtcccaagcagcaaagcttgttgatggtatttaa

SEQ ID NO: 77564 - DNA, 255 bp, Glycine max
  Peptide Sequence Number=SeqID_169249
atggaactactccttttaagagctggacttagggaggaggaaagaacaagcatagctaggttccttagtgggcttaatatggaagtgagggacaaggttgaactccttccgtatagggacatacatgagatagtacaactttgtataagagtggagcaacaacttaaaagaaatccttcatcaaaatcttatggctttcacttttatctaaggaaggaccaaacccaaggaacagtgggggctacaccttcaaaa

SEQ ID NO: 77565 - DNA, 789 bp, Glycine max
  Peptide Sequence Number=SeqID_169250
atgcgcatttccggccataatatcgatcgcgatgcggtttttgccgccgcgcgggacgatgatatcggcgtattgtttggaaggttcgataaactgcaggaacatcgggcgcacggttttctggcggatatccgtcagcagcaagatttgccttccagaatgatcacttttttaggttcgagatggacggtttctttcttggcgtatgctcggtgtagctgtacagcggcagttcatcgccttgccggctttcagcatttgcagatgctggaacagcaggttgtgatccatggcgctcgggtggtcatagttggttttgacccgttcttccatggtcaggtgagtctggtctttatagtaactgtcttctggaataacgccgatgtgctcatcgccgacctgctcgcggagttcgcggtacaacggggggaactaaaacgcgacaattatagggagtcgccggggattgcgccactgtatattgcgcggcggcgggcgaattcgggctgccacgccacgggcacgcggcattttaagaatctcgcggctagggcaacgcgccgtaacgggttacactccccggcgctgacttttgctccccgccccctttcatcggagattgatcatgttgttgctgccctgcgcgctgattctgtttttattgcctcgctcatacatctcccgcgcacccgcgcggcgggttggcagttgggtcgctgtcttcggatcaccggcggggcgatggtcttcgcgcagcgagatatggagcggcatctgccccagcaggcg

SEQ ID NO: 77566 - DNA, 162 bp, Glycine max
  Peptide Sequence Number=SeqID_169251
atgaggcaggaagggcagaagtggaacaagctaaccaaggtgcagcaggtgaaagaaggctgcaggagtcatctaattgaagagattttcttaaaagctgtttctatatctgtgtgtcttcttctttgttggaagaaagttaggatgctcaagtcacagtaa

SEQ ID NO: 77567 - DNA, 259 bp, Glycine max
  Peptide Sequence Number=SeqID_169252
agccccgcagacggatatccctcacgttctggagccaggagcatcgtccacatctacggaggagcctagacatgcagtggtaaaagtttgtgatgacattgttgagaggttagagcgccatctaagtctatgggtggtcacgcttggctcatcgatacatgaggtgatcgaagaatgcctcagattgaccaggagtgtgacacaggaccatctagtatacattaggtgtagacgcaggcggcgcactgatcaagcgtag

SEQ ID NO: 77568 - DNA, 624 bp, Glycine max
  Peptide Sequence Number=SeqID_169253
atggtgaaagttggaacatcttacgtgccgatcaacgtctcattttcgcccaaagttggcccagggcttcccgctgtccctcctgttcagctactgacggggtggtgtgtaacggcaaaagcaccgccggacatcagcgctggcaagtgtagtggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatgggggcgtgctgctgcacgcagccagcaacgcagccaggacaagaacggcacaggagcgcaagcgcatgtcgaatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgagaaaaaaggctgcaccggtgcgtcagcagaatatgtgatacaggatatattccgcttcctcgctcactga

SEQ ID NO: 77569 - DNA, 411 bp, Glycine max
  Peptide Sequence Number=SeqID_169254
atgaattttgttttcgttcatgagtcctccaccttcgagtttggagctatgcgtagtgattgcttagtgcaattctccattctcaacctttttcggagccccatgaattgcgttttcgttcatgtgtcctccaccttcgagtttggagctatgcgtactgattgcttagtgcaattctccattctcaacctttttcggagccccatgaattgcgttttcgttcatgtgtcctcctccttcgagtttggagctatgcgtagtgattgcttagtgcaattctccatcctcaaccttttttcgaagcctatgaattgcgttttcattcatgagtcctctaccttcgagtttggagccatgtgtagtgattgcttagtgcaattctccattctgaacctatttcggagcccatga

SEQ ID NO: 77570 - DNA, 539 bp, Glycine max
  Peptide Sequence Number=SeqID_169255
atggctattgtctctaagcagttcatttggaaattgggtaggggtgatcaaatccttttctgggaagactcttgggtgggtggtgggataacccttaaagaaaaattcccagaattttatcaaatttcatctaaaaaacttcagactgtggcaacttttattgatcaaactgtagcaataagtcctaatgtaacattgaaggattgttgggtgtggggagctgatcctaaggggatcttttctactaattctgcttatctttgtattaaagctaagcagttctctgaagatcaaagtactgttaatgtctatgcctcttgtgatctagctgggaaaagagccttgtgggaggagttaaggcagctgaaagtgtctaatcctaatggtttatggtgtttccttggggattttaacagcatgaggatccaggaggaaagaattggctcatcccaaaggatggctgacacttctgacatttcagatttcaatgagtggatatttgatatggaacttcaggaaattaaaggctttggtggcag

SEQ ID NO: 77571 - DNA, 576 bp, Glycine max
  Peptide Sequence Number=SeqID_169256
atgaagcggaaacgcaaagcctcacgtctacgatcgttgtctactagaccacctggtgctgagagaccagtggtccatgttgatcctgctaccggcaaggccgatggtccccaaaggaagaaattaagaacatatttggtaattgtggcacgtgataaggtggacgtcacctacgagaactggaaggaggtccctactgctcataaggacctgatttgggaggatattcaaaggcttctaacagtaggacgaaaaggaagttacttcagaccgtgggcgagagatggagccgatcaagacggcgaggaggacactgtccgtgagaaatatggcatcaagaaggaaaaatgggcccagttttgccagactcgcagatacccttcttgggaggatgtgcgcaaaaaggcacaggtcatccagaagcagaacactgccccccacgttttgtctcgtgggggttatgactatttggagcagaagctcctggctgagaagactaagaagaagctggaggaagctgcacagacaggaagcgttgatggcatcattgaccctccatccccagttaggcgccac

SEQ ID NO: 77572 - DNA, 513 bp, Glycine max
  Peptide Sequence Number=SeqID_169257
atgtcattaaaactgccacattatcttgaacttgtaaaggtcttctactgcaatttgaaaattcaggatggcattatttcctctgaggggcatggtattcctatgatcattgatcagtccttattcttttctttaactcatttacccaggcaaggtgcaccttttgagggcaccattgttgatgactggaaatttgattattctagtcatgatgctcgccgcatggtctgcaatgatcaggctggaatgaccgtcaagcattcctttgcaattggtgctggtgctgtgacttcctttggttaccgtaaggatcggaatggtcaatggctgaagaaagacgcactccctcctcaagatgagcgtactccttcacctcctcctcagcgtgaagattcagcactcctgaatgaagtccttaccgaattacgaggtcttcgttcttatgatggtgaacgtttcgactcattggatacacgctttgccggcatggatatttcgcctcacacaagttga

SEQ ID NO: 77573 - DNA, 372 bp, Glycine max
  Peptide Sequence Number=SeqID_169258
ctgctggtaattgattaccaaagagtaaatctcaatttatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcaggggggaccgctacacttgccagcgctga

SEQ ID NO: 77574 - DNA, 689 bp, Glycine max
  Peptide Sequence Number=SeqID_169259
atgagtgcagccagcagagcttggattgtggcatcaagcattggagcagtggaggcattgaaggatcaattgggggtgtgcaggtggaaccatgcattgaggtcactgcagcagcatgccaagagcaacattagatcctacactcaggccaaaaccttgtcttctgctacttctgctgctgtctccaataaggtcaagaggaccaaggaggagtccatgaggaaagtcatggacttgagctgttgggcgggaaatgcacccattgggaatgcaccccgtcactgtccaagcgggaaatgcaccctgaagttggctgaagttgatgacgtggcaattccacaaaacactatttataccctcgagttggctgaagttgatgctgcagttgaagctcgtaagaagcctcctgtggaagagatgaatgggttcagggaggaagatcgtcttattcgaatcacaccccatagtcacgaatgctatggttctgatgaccgtattgttctacttactgtggctactgggggtcaccacgctgctttcacagcgtattgggaccctcccaacaagggcattccgacacttcatgttggtagtcggaagcatttgctcggttttgatattgagcactatatctacactcattgcttggctcactgccatgttatggattatctttcttacagtgaccg

SEQ ID NO: 77575 - DNA, 1887 bp, Glycine max
  Peptide Sequence Number=SeqID_169260
atggaatcgacgacgcaaaagaacaaaagcaaaaagtcatcgctgttgatgcgtctcaaacccgttatgggcttcgacgactctattatgcccaatcgcaatggggatgacccagttttgtcgtatctcgcgatcgctaacaagaacggcgctgttttgccggccatgttgtcgtcgatgttcggaggggcggaggacctgggagaaaaatgcggatgtcgccggagaaagtggcaggccctcagggcggttttcagtggaaccactttgatgaggatggctattaaaaggagagtgaataaaggcaaattgtccttgaccagaaccactagcaaattggaagaaacaaatggtaaaatctcaaacccaaaatgtaaaagcacttgccgaactagttcaaaggtttcctcaacttttggaagctcatctacactcacctcctcttctccaagttcaagcatttcttcagtacgcactgtttcaagctcttccactaatgaaaaactctcacattcaataccattaaatggaactcatgtaatgaagcagaagcaatgtggtgttgaagataagaagaaaggacagaactatggttcaaacatagctcttagttttgagcaacaagtgggtggcagaatgataagcaaggtattcctaaagccccatctggttggtcttcttcttccctctaaattcggcttggtcttccctcacacaaccaagccttcttcttcccttcccaccactttcttcatttcacacttctcctctgcccctctctcttcctacggaccctccctccacaagggaacaacaatcccctcccaatccctaaacgacgccgttctctgcgaagaagccttcacgcgagtcttccacctcgccgcactccgcgtcccctcctccgaatgctccgccctcgagagccgcctccgtggccacctccttaactggccccgcctccgcaatatcgcccgcgtccccggcgacgacatcgaccccaccctcgcccctctcttgcctcaaccaggtaacggagaattcgacttcgacgaaaatgaagtagaagaaagacgtctcgtctcgctgcaacgccggattcacggcaaggcggacggcgacggcgacgtgttgagccccgtgctgtaccgtgacaggctcgcgaggacgttcaacaccagcggcttcgtgaagttccgccacctcgcgaagatttcgcggccgaacaggaataagaggaggaggaagaggaaggagaaggagtcgagtgaaggggttaagcgcgtgggggagaatgggtttgctgcagttgaggttattgaggaagaagaagaaggagaagaaagtggtggtttgaggaatttgcttggagaagagtttgcgaggaaaaaatggagaggttccacgaggttgctgcttctggatgaacgctacgccgatcgcggtttcgaggagttgcctgaggcaactaaggctgttttgaaggagtatgcagaaaagagtacaaatttgatgcttgagctagttagatgcaagttgacactattctatgattactggcagatgaatgaggtcttggagaccttgctgcctgagggtatgattattccttccgcttttgagactgttggtcatatagcacacctgaatttgagagacgaacatttaccatacaagtggctaatagctaaggttgtgctggataagaataagccaaggatacaaacggttgtgaacaagattgatacaattcaaaatgagtacaggaccatgcagcttgaggttttagcaggaaaccactctcttgtgactacagtagttgagaatggtattcactttcaggttgacttagcgacagtgtatgctcttctttccatccctgactaa

SEQ ID NO: 77576 - DNA, 747 bp, Glycine max
  Peptide Sequence Number=SeqID_169261
atgaccaccccatccttagaagcagtgaatgaaatcccctgctatgtaaattacctacaatatgtctttgatgaagacagaacttacgtagggtttgagtccatttttttgcaggaacagattgcaacctcagaaaaatcttattgttattgtatttatttattgcctcatagttgtcaaggttcaacttcaagcttttctggtaaatttgagaacttagctattagtcatcaaggaacaacttcgagctttgctggaatatttgagaacctggctactctatgtattgattttgatttgaaaacagtaaaaaatgccataaccctcttttcagctcttaaggcatgcccaaagttgcaaaatcttgaaattaatagcgagattaatgacaacgcagtggattactatgatcaacatgatgaggatgatgcaatggaatactaccgtagaaaggagccatgtgagtgcatcgatcaacaactaaagacccttagcataatgggatttgcaggaaaaaaaactgaggtggaattccttaaatatgtaataacaaatggtgaagtaatgaagaagattacaatttggtttgttgatgattgctcatggattcatgccgctgaaactggatgtttgctatcatttcagacagcctctccaaacttgtccatcattctcaatcctgggccattttacatggcaaatgtgggtgggaactttgaaacatggctctcaactctaagggagtag

SEQ ID NO: 77577 - DNA, 186 bp, Glycine max
  Peptide Sequence Number=SeqID_169262
atgatgatgagtttgaagcggcataaaggttcgtggctcacagcaatgcgtgtgcccgtggtaggtggttgggtggcagcatggtggtgggtttgtggtcatggaggtttgggggagaggcggctaaggttttgcttcggagagcaagaacaaaaaggggatattgaaaaaattggaggttcataa

SEQ ID NO: 77578 - DNA, 279 bp, Glycine max
  Peptide Sequence Number=SeqID_169263
atgacggaaaaaggagctgacccccatgatctcaagcaacaggaaaatgtgttggcagagtctaggatgatgattcctgactgccgcaagcgccttgaggccgctttggcagacttgaaaggaatattggctgagttggaggagtcagatgagaaggccagtcttgagattgatgaagctaagaacaccattgtagaagttgaaaaagttgatagcaatccactttgtcaaggagctaaaaaactcacacaacacttccacctctggttatggtcatag

SEQ ID NO: 77579 - DNA, 78 bp, Glycine max
  Peptide Sequence Number=SeqID_169264
atggaggtttgttggagagacagcttgggagaagaagtgcaagaagggaatattgagtattctgggggaaaaatttaa

SEQ ID NO: 77580 - DNA, 538 bp, Glycine max
  Peptide Sequence Number=SeqID_169265
gtgaccgcgccgcccatcaccacgatgcgcttgatgcgctgtggcagggtcgggtccagcttcagcgccagggccaggttggtcagcgggccgagcatcaccagcatcagttcgccggcgtgctcgtgcgacaggcgcaggatggccagtgcggcgtgctcggcttcggcctggcggctcggcggcggcaggtccacgtcgccgtagccgtcacggccatgcacgtgggcagcgtcgacggagggatgcagcagcggatccgggctgccggcaaacaccggcacgtcggcgcggccgacgatgtcgcagagcttgagggcgttgcggacggtgtactcgaggccgacattgccggcggcgatggtcagggcgaccacgtcgtgccgttcatcggcgaaggccatcagcagggccagggcgtcgtccacaccggggtcggtgtcgatcaacagcgggatcttgtggggctgcgccctgcacccgccgaggccggagcaacggcaaacgccagagcaacggcagaagcgggtttcctggg

SEQ ID NO: 77581 - DNA, 414 bp, Glycine max
  Peptide Sequence Number=SeqID_169266
atggggactttctctgaagatagatggagatgggatttcaaatggaggaggaatttatttgaccacgaaaatgatttggcagtgaattttatggaggatattacctctatctctattcaaagatatgtgaaggacaatatggtgtggaaagctgaatctacaggagtgtattccaccaagtcagcctatagaataatgctgaataccaatgcctcagcctcagatgtcagaaatttcaaattaatatggaagatgaaaatcccccaagggcaacaatcttcacttggaggctcctcaaggacagattacctactaaggatgctggctgccctctctgtggtcaagtgcaggaggaagtgggtcacctattttttaattgccaaaggacactacccctgtggtgggtatccatga

SEQ ID NO: 77582 - DNA, 145 bp, Glycine max
  Peptide Sequence Number=SeqID_169267
atggatattaaccccgcttacagctgccttttgggggcgcctgtggatccactcggtgggagtcgttccctctacgctccaccaaaaattgaaattcgtagtagaggggcatttggttatcgtatcgggcaaggaagacatcttg

SEQ ID NO: 77583 - DNA, 507 bp, Glycine max
  Peptide Sequence Number=SeqID_169268
atggcgtcatcggaggagaacttcgaagctccgaaggaagatgaagaagtccgagatctaaaattagagctaggggaggcaagactcgccaaggagaagttcaagtcagctgctacacacatccggaaggagtgcaccgagttacaagaggaaaacgcggccactgcaagagcccttgaacaagaaaccaaaagggcccgcaaggaggaatatggccgagagaaattccgaggagcattgtggggtagcaacaatgagctcaagctccgaagagaggagagagatcggtcacgggtgcatggcatgatcttaaaagaggagttagttgcttgcacgaggtccaaaaggagtttggctcaacacttggaagccacggagcaaagcatgctagctatcatagggcaatacaaggaagaattgaaccagtccatggcccatgaacaaaagctagtggaggattttgcaccaagtgtatgccgaaaaagaagcaagagggagggtgattga

SEQ ID NO: 77584 - DNA, 206 bp, Glycine max
  Peptide Sequence Number=SeqID_169269
aaatttccaggatgttacatgaggattccgcactcatgaatgaagtcctctccgaattacggggtcttcgttcttatgttggtgaccgcttcgactcgttagattcacgctttgccggtatggacattcgccttacacagcttgaagaggatgtcagatatattcgtcagagtttcaatcttccaccaccacctctgtcctcttag

SEQ ID NO: 77585 - DNA, 414 bp, Glycine max
  Peptide Sequence Number=SeqID_169270
atgggaagatggttatgggcttttgcatctgatcagcaacagctatgggctagggttataacctctaaatatggtggttggtcagatcttcaaaatgctagagacaaaaggggttattcccattggtggagagacattagaaacttgtaccatcagctagactgcagtatttttaaagataacttgtcttggaaggttgggtgtggggaaaatatcaagttctggactgataattggctaggggaacaatactccctgcagcagaagtactatcagctattcctcataagtagacagcaaagggatctcatctctcaagaagaagaaaattttctatgtacacttgttgactccaagaaaaacctcatgcccaacaggaaggatctcatacaaagtgaacaaagagggacttaa

SEQ ID NO: 77586 - DNA, 492 bp, Glycine max
  Peptide Sequence Number=SeqID_169271
atggcttctaagaaaagaaaggcaccatctacacctacccaagccagatttgaaaaatcaagattcacttcccaagaggcttgggaaagatacactgatgttattgtgcctaggaagctttttcctgagaggaacgtggtggtttattatacagagttcgatgagctcaaggaagaactcgaaagacgccattgggatgaggagttaactgactttggggacagcaataatgatgttgccattgtgaaggaattctacgccaacctatatgaccctgaggacaaatcatctaagcaggtgagggtgagaggtcatctgattaaatttgatgaggatacacttaatactttcttgaagacccctgttattatggaaaagggggaatcactctgtgcttattctagatttgcactcctgaggcctgatcctcaggagttggctgctaagctttgtatcccaaggaggggattcgagcttaatgctgatgggtag

SEQ ID NO: 77587 - DNA, 336 bp, Glycine max
  Peptide Sequence Number=SeqID_169272
gaaaataggggaggagcttgccacccagctcgcccaggcgagccaggttgcttcctccaaaagcaaccgccttctgtaggaacaatctggaaggcccaagtgggcctgaaactcacggattgcgtatcaatactttcttttgatttccggcatgttacggaatttcacggattgcgtaacaatgcttcttttttatttccggcatgtctcggaacttcacgtattgtgcaacaaagggtgccaagtacctcgaagcggtcaaccaaaggttgcatgccatcaaacaatagtccccggacgaaattagggtatgacagttgtcttgaccatacatga

SEQ ID NO: 77588 - DNA, 1161 bp, Glycine max
  Peptide Sequence Number=SeqID_169273
atgatttcgcccgctttgtctggtattactgcgaagatcgcgaatccggatatcgatcgtcactatcctcgcccggccatatgcgaggtgcttagccggccggaaaacgccgatttgctggaatacgtggtgcatgatccttttggttgccatgtgtttcccggtgatatcgacgattttccgctgccgaattttttgcgcgccatgcagcacagcctgagccatgcgccgcaaattcatctgtgggcgtatatccctacctgccgctacaagtgccacttttgccagtttcctacggtgattgtaaatccgcagtcgccgcgcgcacctgagctgttccgcgatatcgtcgatcgcaacattcaggaggcgaaactgtggctggcgcagctgccggcactgggtgaagtgccggtgggtgagttcaacctgttcggcggcacgccctcgctgctgccaccggatgagctgcggcgcttaatggatttttaccgcaaccatttcaacttccgcgaagccacgctgcgcttcgaaggcgagcccggcacgctgacgcgcgaattcctcgcgcagctgcgcgaactgggcttcagcaaactgtcgtttggcgcgcagtcattctcagatcgcctgatcaaaggctgtggtcgcctgcacagcgcggatgcctgctacaaggtgattcgtgatgcgcgcgagctgggcttcgccctggtcagcgtcgacctgatgtatggcctgctgggacaaacggtggacgacgtgcgtgacgatctgcagcaggcgcgcgcgcttgacctgtcgcatctgtatcagatgcgcgcgctggccgagcagtggctggatggcgattaccttgaacatcccaccatgtatttccaccatcgcagcgcaccgccggagaagtggaaagcgatcattaccgatctcgaccagcaggcaccggaagtggcgattggccttggcggcagctccaaatgtgccggcgcggagctgattaacctgaccgactacgccgattatcagcgcgcactggataacggccatcaacggctgcaagatggcgctgtcaacgctgattccgctcgacgatgtgctgtttcagcagaagtttggcgtcagcctgtttgcccagccgaccatcgcccgtgcgctgcgtga

SEQ ID NO: 77589 - DNA, 1320 bp, Glycine max
  Peptide Sequence Number=SeqID_169274
atgacatttatcgcaaccctgattctggcctttggtatgtcgatggacgctttcgctgcagcactgggcaaaggcgcgtcgctgtatcgtccgggtttcaaagaagcattacgcacagggctgatttttggcgtcattgaaatgctgacgccgctggtgggctgggccatcgggctggccgccagccactacattatggcgtgggatcactgggtggcatttggtctgctgggcattcttggcggacgaatgatcatggaaggtttccgtcagacggccgacgagccgtgcgaagcgccgcagcgccacggctttatggtactggcgctgacggcggtagcgaccagccttgatgcgctggcggtgggggttggcctcgcgttcctgcaggttaacattgtgctcaccgcgctcaccatcggtgcggctaccactatcatggcgaccaccggtgtgctggtcggccgctttatcggtccggtaatgggcaaatgggcggaagtgctgggcggcgtggcaagaaaaagttatggcatcgtgcaacccgacggcgtgatcgatctcggtgcgcggctgggcgacagctgtccggatttgaaaactctgctgcagcgcggtggcctgagtgacctgcaggtttacctgagcgagccggtggactatgccttcagcgcgattcgcttcctgccggtggtggaaaacccgggcaaagtcttctgcgttggcatgaactatgccgacaagcgccaggagtttgccgccacgctcgacgcgccgacgctattcgtgcgctttgccgattcgctggctgcgcacgagcaggccctgcttaaaccggcgaccacggctgaatttgattacgaaggcgagctggcggtaatcatcggcaaagcggcttatcaggtaaaagccgccgatgcgctacagcatgtagcgggctacagctgctttatggatgccacggtgcgcgacatgcagttcacctggtttaccgcaggcaaaaactggcagcaaaccggcggctttggcccgtggatgaccaccgccgacgacatcccggacccgcagcagctggcgatcaaaacctggctgaatcagcgcgaagtgcagaacgataccacggccagcatggtgcatccggtggcgaagatcattgaatacatctcggcgtttagtccgctgtcaccgggcgatgtcatcatcaccggctcaccaggcggcgtggggaaaaagcgtacgccaccgctgtttatgttccctggcgatgagatcgaagtggaaattgagaagattggtcgtctgcgccaccgcatcgtctga

SEQ ID NO: 77590 - DNA, 165 bp, Glycine max
  Peptide Sequence Number=SeqID_169275
atggcgtatccaatcatatttcttcctcattccgctgccattaaacttcaagatgcatgggactccattgatgaagaagatctaagtcctacaagctccacaaggagctacatcatgtggtatcaagagcatcttcgtctaggttctatcatttttcagtcataa

SEQ ID NO: 77591 - DNA, 198 bp, Glycine max
  Peptide Sequence Number=SeqID_169276
atgcatctacgtgatcaagagaagaacaagatgaaagattgcaaaaatacaagtggtgaggatgtctccttcacctctaggatctcaaactcatctcaagctctcaaactggcttctgcttcaagctctggtctctacagatcttcacacaacaaaatctctcaaaactctctagaacttggacctttctctctctag

SEQ ID NO: 77592 - DNA, 261 bp, Glycine max
  Peptide Sequence Number=SeqID_169277
atgggttggtctggtatgagaagttatgggaaagagtacattacaacatctctaattcatgaatttctaatgatcgtcgtgctccgcatgctggatcctctactattctatgttcttcccgaaagtgtgctaatccctatgttatgcggagctgagcatcttctattcattgggataaagcttttcctctgcagggacctcgacccgcctactcgggtcttgtatggatatgcaggaaggggtgctcctaggtgtatgtag

SEQ ID NO: 77593 - DNA, 642 bp, Glycine max
  Peptide Sequence Number=SeqID_169278
atgtacacgtctgcgaacccaatatttttttacggtagtcgttctattacgtttacacaattcattcaaaaaattaacaatcgtctccctgctcaagcaactgaacaagttgctcaattgttatttcatgtccctatttcatttcatctgggtcagacacgttttatttcagcacaactattcgacaatgatgatctcagaggcgcaatggaaacaattgtccagaatccacaattgaattctactgaattctatgttgttactgatcttattcctcaaccacaaccatcatctccacaaccctcatgtccaccattacaactaccacctccacaacagttatcgtacaacaacatagacctcaataatccagtatcttcatacaacaaccttgaatcacaagacccctttgacatgtatacttcatacacacaattattatcagaaaatgattatttttttcatgcccaacaaacctcctttgaccaacaaaaccatctttcatccctctttacgtcaccttcacaactaccacaaacacaaacatcaaaccaagatgaacatcccattgctaacgaagatcccattatacgatttcataatgaaaacatggatgattctagtgaggatgaggatcaatag

SEQ ID NO: 77594 - DNA, 276 bp, Glycine max
  Peptide Sequence Number=SeqID_169279
atgcaacaggaacaggcagatatcctcatagctaggttccctgaccctagctatgggtttcattctctaccgaaaccacgagccaagttggaagattccgcttcggttgaagagttcctctcggtgtgggtctcaacggagaacaatgacggtttgtggtggctaatggtggttgtgggtgatggagaaaaagcttgggtcgttggaaatgactttggaagaaagaaaggagaagaaatggcgtttttcctaagctacacgaaagctaaaggctga

SEQ ID NO: 77595 - DNA, 476 bp, Glycine max
  Peptide Sequence Number=SeqID_169280
agcttcggtattccatttcgagcatctcgatatattacgggactcaatcagacatccgagtaaaaagttattgtcgtttgaatttgctcagagcttcaacattcaatttcgagcgtctcgatatattacgggactcaatcagacatccgagtaaaaattttttgtcgtttgaatttgctcagagcttcagtattccatttcgagcgtctcgatatattacgggactcaatcggacatccgaagcttcaacattcaatttcgagcttttcgatatattacgggactcaatcagacatccgagtaaaaagttattctcgtttgaatttgctcagggcttcggtattcaatttcgagcgtctcgatatattacgggtgatgagaatcatgaaactggcctaatacaggctaaaggcccaagtggagaaggacgaaggcccaagtggagaaggacaaagcccccgagtggagaaggatga

SEQ ID NO: 77596 - DNA, 222 bp, Glycine max
  Peptide Sequence Number=SeqID_169281
atgttgctaagtagcaacgtcatccatatctgtgtaagagtggtcacgttagtgcgcatgatccacactcgtctctttgtagcggctcgagtgaaatcttgccccggtatgcatagtagctgcacaatagcctcctcctctggttgtgctcacacagttggccctcctccaggatcagggggtggcccaagaactgataaaaggaaactattgggctcttag

SEQ ID NO: 77597 - DNA, 381 bp, Glycine max
  Peptide Sequence Number=SeqID_169282
atggtcttcaccgacgaaaggatcgatgtgggtctgaaaagaggcaaatttagtcattctgcttggatgaatgagaaaactagggcaaatgaagagggtgagaatgagggagaagcccatgttgtgactgccattcctatacagccaagtttcccaccaacccaacaatgtcattactcagccaataaccaaccttctccttacccaccgcccatttatccacaaaggccatccctaaaacaaccacaaaccattggtcagtttgctcaagtgacctatgctcctcagtttgggacttccaagaccgttcaatcagagattactcgtcttgcacgttggtgggggtgccgtaaaacaacgagtaaagttcaaaacaaataa

SEQ ID NO: 77598 - DNA, 1328 bp, Glycine max
  Peptide Sequence Number=SeqID_169283
atgggaacaaatcaaaccggcaagaggttctaccaagtcaaggtcaaaagcccagataccaccagcatcaaggaattagggcggttgatggaacccctccaaatgcaagccttccgcaagacttacggaaagatctttagagttgaccatagcagagaattgcaactgtgggtcaaggattcagcaagaggtttggaccgcataaaacagactcggaacggcatagcgggcctaccacagaagtacctagaagacaaggcgaggggtatggccaatcaaggagactgggtcccgtttatggatgtgttagctttgctaatttttggggtcgtcctctttccaaacgtggatggtttggtagacctagcagcaatcgacgctttccttgcctaccaccatagcaaggaaagtctggtggtagctgtcttggcagatctatttgacacatttgaccgaaggtgcgaaaagagtagcgcacggatcatctgttgcttacccgccctctgtgtttggttggtttcgcgcttgttccaacaagacgcaagacatccatgtccgctcctgagccatcgctcgtgtactgaaaagaggagaatagattgggaccagctcttggccgggataggaggtagaacaatcagttggttcccccgatggaaggaaggaaaagaaggagtccttttctcatgtggaggatacccaaacattccgctggtaggaacgaggggttgtattaactacaatcccgcgctcgctataagacaactagggtaccccatgaggggagcaccgacggaagaaagcatgtctcctatccttgtgagggatttcggtgcacaaagttccaagactatacaaagaatccataaggcgtgggaaaccccgttaaagaaagatcaagagcttagaggcattcgtaatggcatcattggtgggtaccacgaatggctgaaagttcatatacgaggtttagattggctcgccaagttaaaagtcgtcagcaaagagagttttgaagcaccggaagaggacgaagaagtccaagctctcaaaagcgagttaggaaaggcaaaacttgccaaggagaagttcaagttggccgctacacacgttcggaaggagtgtgccgggttacgggaagagaatgcaattaccgcaagagcccttgaacaagagaccaagagggctcgcaaggaagagtatggccggaacaaatttcgcggagctctatggggtagcaatagtgaactcaagttgcgaaaggaagaaagggaccagtcgcgagcacatagcatggttttgaaagaggagttagttgcctgttcaag

SEQ ID NO: 77599 - DNA, 497 bp, Glycine max
  Peptide Sequence Number=SeqID_169284
gtatgccacccaccaggcaccctctagacccggataagtctaatagggccctggggtttccagcattgatcacgggcctctgccagtcatttggggttcccgtcacacctagtaaggtgatccaaccgccgatcacccaggccttcattgagaagtattgcacgcctaggcaggcgcacggtgatgcaccacaggccgcagacgcatcaccaccaccgcatcaagctgatcctgctgggtcattaggcatggagcggtatctacagcacttggttcgccagcaggcggccaaccaccgggagcagggccagagtttcactccttttgtgtgccctactccatatcagtttagggctgaggtcgcattgcccggagatgggcccgaggcccaggcaggggaggcacctgtaggagctcccggcaatgcagaggaggcctgcatggatgaggagatgacgaacttgctcggtttcttgggaggaagcggagccacgtga

SEQ ID NO: 77600 - DNA, 664 bp, Glycine max
  Peptide Sequence Number=SeqID_169285
gaaagatcaagagcttagaggcattcgtaatggcatcattggtgggtaccacgaatggctgaaagttcgcatacgaggtttagattggctcgccaagttaaaagtcgtcagcgaagagaattttgaagcaccggaagaggacgaggaagtccaagctctcaaaagcgagttaggaaaggcaaaactcgccaaggagaagttcaagttggctgctacacacgttcggaaggagtgtgccgggttacgggaagagaatgcaattaccgcaagggcccttgaacgagagaccaagagggctcgcaaggaagaatatggccggaacaaatttcgcggagctctatggggtagcaatagtgaactcaagttgcgaagggaagaaagggaccagtcgcgagcacatagcatggttctgaaagaggagttgattgcttgttcaaggtccaaaagaagcttgtctcagcgtctatgcgagacagaaaccaacatgttagctatcatcgccaagtaccaagaagagttgggtctagccaccggccccacgagcatagaatcgcggatgagtatgcccaagtatatgcggaaaaaagaggctagaggaaggggtgatcgactctttacacccaagaggcaaccatgtggatggatcggtttgctcttaccttga

SEQ ID NO: 77601 - DNA, 183 bp, Glycine max
  Peptide Sequence Number=SeqID_169286
ataatgaacaaaaagctcaagagaatcaagaacaagtcaagagttcaagaatcaagaagaattcaagattcaagaagaaagcctacaaacaagaatcaagattcaagattcaagatctcaagaatcaagatcaagattcaagactcaagattcaagaatgaagaaaagactcaatcaagataa

SEQ ID NO: 77602 - DNA, 204 bp, Glycine max
  Peptide Sequence Number=SeqID_169287
atggaatatttatcaatcaatcaaaatattgcagacttaattcgcaaatttgggatagaaaatgctaaacgtatggctactccaataagcactgcttgctacttggataaagatgaaatcggtcagtcaatagacattaagaaatatcgagattccaagcaagtcccaaagaatcacatcttagtgcagttaagagaattatga

SEQ ID NO: 77603 - DNA, 420 bp, Glycine max
  Peptide Sequence Number=SeqID_169288
atggctacccaagcccttatcacccctaagagtcgatgtctctggctcccactctgggatgcttcattcaacctttctactttcttttacagatttgaggctggactttcaaccatcactgctgtttccaatggtcttcaagcgtggaaagtcctggaagatccagaaaatggcattgatcttgtcctaacagaggtagctatgcctattttgtctggaataggtcttttgtgcaagatcatgagccacaaaactctgaagaatattcctgtgattatgatgtcatctcatgattctatgggtatagtctttaagtgtttgtcaaaaggcgcagttgattttttagtgaaaccaattcggaggaatgaacttaaaaacctctggcagcacgtttggagaagatgccacagtgtgagttga

SEQ ID NO: 77604 - DNA, 1302 bp, Glycine max
  Peptide Sequence Number=SeqID_169289
atgtcgcttgcaccagaacttcccattgcccttcgcaaagtgaaaattggcccaaatggaaaccctgatcattataaggctcgccttgtcgctaatggctacactcatacttctagcgttgactataggcaaaaatcttctttgttcattttttccttaccatgcttgtcatctatcattggcctattcatcaattggacattaaaaatgccttattacttggtgagcaacaagaagagcctatgcatttacctcattgtctacattgatgatattgtcatcactagcgacgattcagctaagatccacaatcagtttcagacgaaagacctagtcaaagaagagcttctgaatcttgctttagagaaagaaaagagagaaaattctgagatgccaaatgtggcctatgatctctcatctgatgatgaaattcaaattcctgcagcagctagcaatgttaaaggcaaaaagaatgttgctaaaaaagggcccatggatatgttttgtagaaatccaccatctgaaatatcgaagagacagaaggacaaactaaggcaagctaacattaaagagttatgtgacaaaactttgaaggcagatgttcatcagtacattgctcgtttttggtatcaagctggcttatcgttcaaccttgttaaactgaatagctttcaggatatgattgatgccattgctgcctacggcccaaatctgccagctcctagttatcatgatagtagatttccactgctcaacaaggagatggaactcactgaaaatttgttgaaggatcataagtcgcagtggggcagacacggctggacaatgtttgtgaagtccattgatggctctaaatttgtgaagacaggtgaaaagctgtttgagttgctttattcccttgtagaggagattggagaacacgatgttgttcagtataaccaacagcttgctcacagatataatattagggatgaaattgaccctattacactcaatgacaatgatgagtgcaatgagtggttagtgggacaagtggatgatgataatgacttggttcatgctgatgacccacacttaattgaaatgtatacaaggaggaaaactagcagcaaaaaaagaaagcagccatcaagtggtggtattattagtggagctgcccaagcttccaagaaaggtccagctgcaacttcagcctcaagaggaaaagggaaagcccatgaggcaattgaagaatctggagaagaggaggagggatatgctccattggatatgaatgaaattgattatgatggaactgagtaa

SEQ ID NO: 77605 - DNA, 585 bp, Glycine max
  Peptide Sequence Number=SeqID_169290
atggctattacaagaggcattgaggaattgacttacctgcaaaggggatgtctggaaaaactaccgaaaaatgtgctggaaaaggaagagcggtggtggggtcatcagagagaggcaaagccagtggtgtgggcgcaccagagatcagagatcacagcggtggctggcagcggcagcgggtattgtgcaccaatgaagaataacactcccaaaggaaaaactaccgaaaaatgtgctggaaaaggaagagcggtggtgggatcatcagagagaggcaaagccagtggtgtggtcgcaccagagatcagagatcacagcggtggctggcagcggcagcggtctagtggtagtgggagtgaaagtgcgacccacaccagaaaatttgcaaagtcaagaagtaatgatgcatgtgaaaacaatagtgacagcagtgatgagaatgactatggaagcagagacttgagcgttcgagatggaagtggcactcagacaagtcacatgggtcttgaaaacggggctaggtactgggatagaccaataaacattatgcaggaaaaggaagactttgaggactggggtagctga

SEQ ID NO: 77606 - DNA, 1368 bp, Glycine max
  Peptide Sequence Number=SeqID_169291
atgatgcagttgccggaaattgcgactgaaaaaggtgaccaatgtgtcgcaacacatcggaagagcttctggcactgccaatgctgtttggctcgcctaggaaacgcacgtgagagcgcatctgatgtcaaatggggatgctgtcgacagggttgggcagatcagggagagatggcggccgctggaacagtagcggcaatgttcggaaaagttgggaaagaagaaagggtcatcgaaaagcagaagcatgccaccagaataagtgtgacgctgttcccggtgggggatgctttttgttattccctcaacctagagctggttgcaaagagtataaaagttgttatgacttcaagatcagcatcagttgttatcacccttgacatgaaaagaatccaggatgcacatctaaatatagatgctaatattgtaaaagaatcaattttacgaactaaaaagacaaaactgaaaccagagcatatcaagattttagatattaaaaagcttgaagtggttccccaagatgtggatagaagtaaaatccattttcagcttcactatctgaaaaatttgcttccgacagttgtagtgaagggcattaaaactgtggatcgagttgttatcagtaaagacaccaaggctgaaaagttcagattactggtggaaggatggcacaaaaccatgcttcaagtagcgtttgacaggactggagttgtagaggaccctaaactagtgtcaggtcataccctccatggagatctgagcaggctcaagacacatcgctggaggaaaggaacaacgaaatccatcgtgcatttcagaacatatggtcgcaacagatttggtgagctcatcaatgctggtgagcagagaaccaagttgggtggaatgttgctgaagttcctatcaaaattagaccaaagagtagctgaagggaacttaagacagcttggtgttgaccagaaatatggctgcttaatcgccgttgtggtggagtatcctgcgagactgaaaagagctttgacagaggagagttctattgttgcaagtataaacacgggttttcgagaggttatgggagttgaagggattgatggacgtaaaactgttagtaatcatatccacgaagtgagggacacactgggaattgaagctgctagagagagtattgttaaggagataaagtatacaatggtggatacacatggaatgaatatagacatacgccatatgatgcttctagcagatatgatgactgccacggcatctgtacgtgggagggatgactcgattggtggagtaagtgaatccataatcatgggtataccaattcaaataggtactggaatgatcaaggtcaaacaaaggtga

SEQ ID NO: 77607 - DNA, 465 bp, Glycine max
  Peptide Sequence Number=SeqID_169292
atgtctgggcgtggaaagggaggcaagggtttgggaaagggaggagcgaaacgacaccgtaaggtgctgcgcgataacattcagggaatcaccaagcccgcgattcggcgtttggctcgtaggggtggcgtgaagcgtatcagtggtctcatctacgaagagacacgtggcgtgctcaagatctttttggagaacgtgattcgtgacgccgttacctacactgagcatgctaggagaaagaccgttacggcaatggacgtggctaatctggatttgagaaacccttgctgttatggatatagtaaaaagaaatggcaaggattgggtgtgggaagttgccgttttgcttggtcctctataggaccactttatcagcgcatgctttgtttggtagatggtggtcctcttaagccattggggagtgttttcaacattgtctgcatcaacttgcgtgtgagggtgtag

SEQ ID NO: 77608 - DNA, 288 bp, Glycine max
  Peptide Sequence Number=SeqID_169293
atggagaaggttgggaaaggaaaaaccatgaagattttggttgagtcagccgaaaaagactcgagcaacaagacaaaagatgacataaagagcacagcaaacgatgagaatgttgggggagttgctcttgatgtaattgcacttcagcttgattttcatgcaacctttgcgctaagcacgattgttgcgcttaaccagtatgacgacttctccctacttcttggtgctaagcgtgcattgtccactgagcaactgcatcgcgctggacccttgagacgtgctaagtga

SEQ ID NO: 77609 - DNA, 228 bp, Glycine max
  Peptide Sequence Number=SeqID_169294
atggtgccatgtgatgaagatattgccttggtgttgaaaagctttaatacaaggaaagcatggatgaaaggaaagggaatccttctgatatcatcttcaccacatgcatggagtgatcagattcaacgtaaatatcgtcaaagcatcggttttgtatcagcgttaagcccatgcatggagaaggagtgcacaaagctcagcttgaagcaccgagcaagctccttataa

SEQ ID NO: 77610 - DNA, 561 bp, Glycine max
  Peptide Sequence Number=SeqID_169295
atgaggaaaatgagactctttagatgggctgctatttgcacttctctttttatatttgcactccgagtttatttggcaaaaacaaggagtgcattcctaaaggaaaatggaagtgcaggaaacaatatcccttacaatgatggggaggggagggaaggtcatgggaagtggaggggaaaggtcgcgcgagggggagagggaggggaagggggaaggaggctacgaccatggcccaggggaaagaagaagaaggttgcggtggaggaagaagaaagaaagaaagaaacaaatagtgtatggggagagagggagagggagggggaggtagtgtcaagtggagcggagggggagggaggcaggagaaggaagaagaaggtggagcggagggggagggaggtaggagaaggaagaagaaggtggaggggaggagaagaagaaaggttagtaggggaggaggagaaggaaaagaaagaaaaaggaagtgcatgttgggagaaggaaaagaaaaaaaatgtattgggagaaggaagtgtcctttggggtagaggaggaaaaaaataa

SEQ ID NO: 77611 - DNA, 183 bp, Glycine max
  Peptide Sequence Number=SeqID_169296
atgaagaactttaaaattctagagactaaaatattcgtctcgatcatacaaggttactttgaaggtttatccctggaatatgagacttgtttctaccacgtccccttctcaactcgtgctctctatcgtggtggttctcttacaatgttttcgacagaagctgctactatagcctctgattaa

SEQ ID NO: 77612 - DNA, 1209 bp, Glycine max
  Peptide Sequence Number=SeqID_169297
atggaaaacaatggtgctgaatctgagaatccgaaagggattccaattcacggagggaagtacgttcgctacaacatcttaggcagccatttccaagtctattccaagtacgctccccctctccaacccgttggtcgcggcgcatacggcatcacgaaagaaggagtggcgataaagaagattgggaatgcgtttgacaacaggatcgatgccaagagaacgctcagggaaatcaagcttctctgtcacatggaacatgataacataattaaaataaaggacataattcggccagcggagagggagaatttcaacgatgtttatattgtgtacgaattgatggacaccgatctgcatcagattatacagtctaatcagtctctcaccgatgagcattgccagttcgtgatagttagtgtgggtgttagtgcaaaagaaaagaatgtgattgagtggatgggtgtaaagcctggatgcaggggtgatggattgaagtacatccactctgcaaatgttttgcaccgagatctaaaaccaagcaatttacttctcaacgcaaactgtgatctcaagatatgtgactttgggcttgccagaacaacctctgagaccgactttatgacagaatatgttgtcactcgttggtacagagcccctgaattgctactaaactgttcagaatatactgcagctattgatatttggtcggttggttgcattttgatggagatagttagaagggagcctttatttcctggtaaagattatgtccaacagttggcccttataactgagttaaaacaagcttccaaagaacaaattcctcataatcatctctcaaaacagttactaggttcaccaaatgactcggatcttggattcctcagaagtgataatgcaaagaaatatgttaagcagctcccacatgtagaaaagcaatccttcgcagagcggtttcctgaaatgtcccccttagcaattgatcttgctgagaaaatgctggtttttgatccctccaagcgcataactgtcgaggaagccctgaatcacccctatatggcaagtcttcatgagatcaacgaggagcccacttgcccaactcctttcatattttctttcgaacagacaattctcaaagaagaagatataaaggagctcatatggaaggagtctctaaacttcagccaggatcatcagatgttggaatag

SEQ ID NO: 77613 - DNA, 117 bp, Glycine max
  Peptide Sequence Number=SeqID_169298
atggataaccacttgggtatctccgcctgcaccctaacttcacagggtcagtatgacagacagcgcgaaagacgacataaatctctgcgtgtcaacgggctcgttggccgtgattga

SEQ ID NO: 77614 - DNA, 276 bp, Glycine max
  Peptide Sequence Number=SeqID_169299
catttggttcgccagcaggcggccaaccactgtgggcaggtgcagatacatgagtgtctctaccggttcagcctcagtcagcaggggcagggttccgccccttttgtgtgccctactccggagcagtttggggctgaggttgcatggcctggagactggcccgatgcccaggcaggggaggagcctgcaggatcccccggtgaggcggatgagtcctatatggatgaagatatgattgacctgctcggtttcttggaagggagcgaagccgcgtga

SEQ ID NO: 77615 - DNA, 376 bp, Glycine max
  Peptide Sequence Number=SeqID_169300
atgactagaggtaatccaggtgacttacaaccctttgatcctgaaatagatagaacatttcatagattagttaggcatagtgtgcatcttgattaccctgaaaattttgtaccttttgagcatcctgagcattctgttattggtgagtctgagcattctgtggttggtaattttgaacatcctgattttgagaattataattttgaacattctgaaaatatggctcatcctccacctcgtgagaggactctaagggaaatggctgcacctgatttcacttatgaaagcttgtgcattcaataccctgatgaggatgtcacatatgttcttaaaaatggactgacccacttgttgcccaagtttcatggtcttgcag

SEQ ID NO: 77616 - DNA, 564 bp, Glycine max
  Peptide Sequence Number=SeqID_169301
atgccttatgtggaggccgcagaggagtcattagaaaccgctttccagtcttttgaggtggtaagcatttcctccgtggactccttctctgggcaagcttgcctgtctgatgcagcagtaatgatggcccgagttatgttggggaacggttacgaacccggaatgggtttaggcaaagacaacggcggcataactagcctgataaatgccaaaggaaatcgtgagaagtatggtttaggctataagcccactcaggcggatatgaagagaagcatcgcgggaaggaagagcggtggtcaaagctcgtgttggagacaagaaagtgaaggaagcccgccctgccacataagtagaagctttataagcgcgggtttgggagacaaaggtcaagtggtcgtgatatgcgaagatgatgttccgagtacattggatttggtacgaccatgccctcctgatttccagttggggaaattggcgagtggaggaacgccctggcatttacgcaacgagcataatgtaaacccttacggttttaaaagctctatagttgggcctaggctttag

SEQ ID NO: 77617 - DNA, 270 bp, Glycine max
  Peptide Sequence Number=SeqID_169302
atgatattgttggataatggagacctggagagtgagagctcaagtgatgatgaaatgccactattggaggattgcagtaatgttgatgttgttgaacctgtaaatggagatgtgtttgttacaaggcgtgctcttaacatgcagcctaacataggaggtgatgaggagcaacatgagcatatttttcatacaagatgccacataaaagacaagatatgctcttcttttgaacaatcgcaccattgtgttaacacctcttcggcttgctaa

SEQ ID NO: 77618 - DNA, 489 bp, Glycine max
  Peptide Sequence Number=SeqID_169303
atggttactatgatagtagataccttgcctgtattctactatgagaaattagtgggttacatgccctctagcttcgcagacttagttttccccgaagaaaggattgagatgggtttgaagaggggaaagtttgattacatctccccagtaggtgccagcggtaggagggtcaaaacagctggggcaaagaagaaaaagggagatgcccataccgtcacttcaacacctgcgtggcccaagccaccagaaccccccatggtacccaccaatacgcacaacatcactcgagtttttcgactcacgccgggggctcttccgacacagtgctcgcccagccaagggcacccatgcccccacaagggggagctcctctggctccggctccaacccagcctcacccggccaacaatgcccaccttggctcgggctccaacacggcgaggaacttctcgccaaggcaggctcagattttcaccccgatcccaatga

SEQ ID NO: 77619 - DNA, 617 bp, Glycine max
  Peptide Sequence Number=SeqID_169304
ggcgatcggtgcggggctcttcgctattaccccagctgcgaaagggggatgtgctgcaaggcgaataagaaggggcgaattggagctccaccgcggtggcggccgctctagaactagtggatcccccgggctgcaggaattcgattcgttcatgtccaataattacaaaggacaatccccagcacgacatggtttcaaaagattacccatacctttcggcaaagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttacagggaa

SEQ ID NO: 77620 - DNA, 322 bp, Glycine max
  Peptide Sequence Number=SeqID_169305
atgactaggggcaatccaggtgatttaaaaccctttgatcctgaaatagatagaacctttcatagattagttaggcatagtgtgcatcctgatcattctgtgcattttgagcattctaaatattctgattttgagcattcaactactaattttcatacagagaacatggcccaacctccacctcgtgagaggactcttagggagatggctgcacctgatttcacttatgaaagcttgtgcattcaatatcctgatgagggtgttccatatgttctcaagattggactaatacatttgttgcccaagtttcatggccttgcag

SEQ ID NO: 77621 - DNA, 352 bp, Glycine max
  Peptide Sequence Number=SeqID_169306
atggcttacgaacggggcggagatttcctggaagatgccaggaagatacttaacagggaagcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaacccccccgttcagtccgaccgctgcgccttatccggtaactatcgtcttgagtccaacccggaaagacatgcaaaagcaccactggcagcagccactggtaattgatttagaggagttagtcttgaagtcatgcgccg

SEQ ID NO: 77622 - DNA, 201 bp, Glycine max
  Peptide Sequence Number=SeqID_169307
atggatacctcaaaaccctacactagggcaatgagggacatcgtgcatgagcctcaagcgaacctaggggaagatcaaaacggaagacaaaggagaagaggtgagaggaggcgccatccacaagggaataagccatggaagaaggagcttcaccaccaagatgagccttggataagaagcttggagaggatgcttcaatga

SEQ ID NO: 77623 - DNA, 780 bp, Glycine max
  Peptide Sequence Number=SeqID_169308
atgcggtatgtagcaggtcagcctgctgagcggatttttccgccaggggcgatgctgcatcttgggcaggcgttaccgcccggtgcaccgctgccagccgacccaaccctgcgcgtgctggtatggaatatcttcaaacagcagcgggcagactggatgtcagtactgcagggcttcggtaaagatgcccatctggtgctgctgcaggaagcgcagaccaccccggaactggtgcagttcgccaccagtaattatctggcggccgatcaggtaccggcctttgtgctgccgcaacacccttctggcgttatgacgctggcttctgcccatccggtctactgttgtccgctgcgtgagcgtgagccgctactgaggctgtctaaatccgctctggtcactgcctatccgcttcccaccggcgaaatgctgatggtggtcaacattcatgcggtcaatttcagcctcggcgttgatgtgtacagcaaacagctggggccaattggcgagcaaatccagcatcaccgcgggccggtgatcatggccggcgacttcaatgcctggagccgccagcgtatgaatgcgctctaccgctttgcccgtgagatggcgctgcgtgaagtaaactttactgatgatcatcggcgcaaagcctttggccgcccgctggattttgtcttttaccgcgacatgaaggtcagcgaggcatcggtgctggtgacgcgagcctctgaccacaatcctctgctggttgaattcagtcccggcgcggctaaacgttaa

SEQ ID NO: 77624 - DNA, 1159 bp, Glycine max
  Peptide Sequence Number=SeqID_169309
atgacggcgaccatcggtgcagcggcgcgcgccgtggccgcacctggcacggagattgtggcggtgtgcccgagcgagggcgtgccctccattgaaggacactttgatgaagcgattgccgcggtgggcgtgctggaacaggtaaaacgcggcaaagagcagggcgtcagcggccatatcatcgcctgctttggcgatccgggactgctggcggcgcgcgaactggcgagcggaccggtgattggcattgccgaagcggcgatgcacaccgcgacgctggtggcgacgcgcttttcgattgtcaccacgctgccgcgcacgctggtgatcgcccgccatctgctgcagcagtacggattcagccatcactgtgccgcgctgcacgctattgatctgccggtgctggcgcttgaagacggcagcggcgtcgcgcaggagaaagtgcgcgagcgctgcctgcaggcgaaacgtgaagatggcagcggggcgattgtgctgggctgcggcggcatggcgtcgctggcgcaggatctgactaaagagactgggcctgccggaacttgcagaatgagtgatgtatctgaaaagaaagagtacagcttcaacaaaaattatccgcgcgatctgattggctatgcgggccagccgccgcacgcgcagtggccgggtgaggcgcgggtggcggtgcagttcgtgctcaattatgaagagggagctgaaaacaatgtgctgcacggtgacgcgggctctgagcagtttctctccgacatcatcggagccgccagctatgccgatcgccacatgtcgatggattccctgtatgagtacggttcgcgtgccggtttctggcgcatccatcaggagtttcagcagcgcggcctgccgctgaccatctttggcgtcgcgatggcgctggcgcggcatccgcagattgtcgaggccatcaaagccgccgattacgatgtggtcagccacggctggcgctggattcactatcaggggatggatgccaaaaccgagcgtcagcacatgcagcagcagtggacgtgctcaccgagttattcggtaaagcgcccaccggctggcggcttcagctacgacagcgattactacggtgacgatctgctcttctggacgcagtcacctgtcagacggcacg

SEQ ID NO: 77625 - DNA, 273 bp, Glycine max
  Peptide Sequence Number=SeqID_169310
atggggcaaacacttgcaaatctattgagaattcatctaggatcttctatttgtatcatctactctaaaggagagaaatctttctgttcatctcataaactcagttgtaatcaagagactgattgtctcttggattgtgagaattgtaatcaagagactagttgtctcttggattgtgagaatcttgaacacaagggtgagggatcccaaggtgtgttcaaagtctgtaaaggatttacagaggtagtggaaaatcttaagtgggttgcttga

SEQ ID NO: 77626 - DNA, 798 bp, Glycine max
  Peptide Sequence Number=SeqID_169311
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatctgaggcaggagaatcacttgaacccgggaggcagagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaaatggcttacgaacggggcggagatttcctggaagatgccaggaagatacttaacagggaa

SEQ ID NO: 77627 - DNA, 172 bp, Glycine max
  Peptide Sequence Number=SeqID_169312
ccaaactggaagctacgcatggagagctgctgcattggtcagtatgtatgagaatttgaataatgcgtcaaagagaagcgctaagcaacttgtaggatatatcacacttttacattgttggatctacatgcattttcctactgttgcttcttcaattgctgctgaagattaa

SEQ ID NO: 77628 - DNA, 237 bp, Glycine max
  Peptide Sequence Number=SeqID_169313
atggcggatggatcaacttcaatgtcaagccttctgcaagacatatggaaaaatctaggatttggctatgatagaaaagagtttgaagagatcttgggatgcccgctaggaggaaggaagtcgtatctgttttctgggttatacccctccatggcaagaatagccaaagtggtaaaggtctcagtgcaagaattggaccgagtaaaatgttggatcaagtggcctcagaataattaa

SEQ ID NO: 77629 - DNA, 357 bp, Glycine max
  Peptide Sequence Number=SeqID_169314
atgctttatgcggcggatgatatgaatgcatttacggacacgagagcccggaaaatgatctcttcttacttgtacacttgggggtgtagtgccccatgcctaactcacaaaacaatccccagtggagtcgccaactgtcgcaacctacccttttgcgggcgagcaaggcgagggctcacagctgcgtcttccaaaggaggaaaatgcgcggagtcgccaccacacgtttatttgtggaaatgtcggaaaaccgaaggaactgatcatgaagaatattccagattcgggagttgtattacgttcgaggaggtattagcacctctcacgtttgtcccaaaggacaacaccttaaattag

SEQ ID NO: 77630 - DNA, 402 bp, Glycine max
  Peptide Sequence Number=SeqID_169315
atggtgcttggggtgggttattccatcattaaccagctgccgtcggtcaacctgccagttcctcgcgcatggagcgatgttcagtattttcgtgggtgcgctactgtggctggtcggcgcacgcgtcagcgggcgggagagggtggaagaccgcgtattactggcggcgaacacgcgtttcggctggccatgatagaactgcggaaaggcacaaagcagggcccacagcagcgcgccagtgatccagcaaaaaccgagtggaaggcggcaaaaagtacgaaaggcgttgagcagggtgccgtaggccagcagcatgatgacattcccgatcgccaccggcaaaaagtgcaaaccggcgctgcgcaggctgctgagcagcacggcggcaagcgtcagtattag

SEQ ID NO: 77631 - DNA, 530 bp, Glycine max
  Peptide Sequence Number=SeqID_169316
atggctaggaaggccaccgcaggggagggatcccgtgcagccccacaagcggagattgagtttgaagaacatcgtttccaaagcgaggagcatcagtgcccgttcctgggtgcgggccaatggatcccacacgatgaggatgctatcaaccaattcttggggcatccgttgatcttagaagagggacaatgttgtcaatacgatgaaagaagaagccaagtctcatgttttgatgaagaggccataggccagctactgtgctccccaggacatgatttttcacagagcgtggcagggagccaggtgcggatcatgcacactagcatgaccactttgacccaaatttggatgacgcttctgctcagcaacatccttcctagtgaccttaattttgatctcctgctacctaaatgccagttgatctacgctatcctgacccaaatcagggttcatgtatcacaacttatctcggatgccatctaccagtttataggtattgcacctccgagacacccagcgaacccaaagaa

SEQ ID NO: 77632 - DNA, 225 bp, Glycine max
  Peptide Sequence Number=SeqID_169317
atgatgttggtgcttagtgcatcctttcccgctaagctcagcttgaaagctcaacttacaaaatcaatctggggcttagcgcaggatggcatgcttagcgcagctataataaattttcacagagaggaggtggcgcttagcgcatcatccactctaagcccgttgcttaaggtgcaacttacagtgaagatgttgggcttagcgcagcaatgtgcgcttagctga

SEQ ID NO: 77633 - DNA, 1959 bp, Glycine max
  Peptide Sequence Number=SeqID_169318
atggttgatcatggaggtgtgccagtagaagttggtggtgaggcgggctatgcagtacgtaatgctcgaaaaaccgagttggttgaagctccttggaaagaagccccaaccatggctcatctatttgagcaatcctgtgacaaatatagccacaatccatttcttggaacaagaaagctaatacgaaaagagtttgttacatcaagtgatggcaggaagtttgagaaacttcatttaggaaactatgaatgggaaacctatggagaggtattttctcgtgtgtcaaattttgcatctggtcttcttaaattaggccatagtgcagatagccgtgttgcaattttctctgatacaagggctgagtggctcattgcccttcagaatgtaacagttgttactatttacgctacattaggtgaggatgctctggtctactcactaaatgagactgaagtatctactctgatctgcgagtccaagctgttgaagaagttggatgcaataagatcaagactaacctctgtccaaaatgttatttactttgaagatgatagcaatgatgaagatgctttctcaggaagtttgagcaactggacaattgcatctgttagtgaagttgagaaactcgggaaagaaagtccggttcaaccaagcttgccttccaagaatgatattgcggttatcatgtacacaagtggtagtacaggtctgccaaagggtgttatgattactcatggaaacattgtagcaacaacagcagcagttatgacaattattccaaatcttggtagcaaggatgtgtacatggcctacttgccccttgctcatgtttttgaaatggcagcagagtctgttatgctagctgtaggttgtgccatcggttacagctctattctgactttgactgactcatcaagtaaaatcaagcaaggaaccaagggagatgccaatgtgttaaagcctacacttatggcagctgtaccagctattgttgatcgtattcgagatggagttgtaaaaaagcgccgactgtctgctgtaaaaggaagctggcttggagcttggggattggagaagttggtgtgggataccattgtctttaaaaaaattcgtgatgctattggaggccgcctccgttatatgctttgtgggggagcccctttatctggagattcacagcactttatcaatgtctgcatgggggctattattgggcaagcatatggcttgactgaaacatttgcaggggctgccttctctgaatggtatgaccgcaaggtggggcgtgttggtccacctcttccttgttcctacattaagcttgtttcttgggaagaaggagggtatctgacatcagacaaaccaatgccacgcggagagattgtagttgggggatttagtgtgactgccggttactttaagaatcaagaaaaaactaatgaagtgttcaaggttgatgagcatggtatgcgttggttttatactggggatatcggacaattccatcctgatggatgtcttgaaatcatagataggaagaaggatattgtcaaacttcagcatggagaatatgtctctctcggaaaggttgaggcagcactatcatcatgtgactatgtggataatataatggtttatgcagaccccttttacgattactgtgtggctctagttgttgtttcatatcagtccctggagaaatgggccgaacaagctggtattgagcacagaaatttttctgatctgtgtaacaaacctgaaactatcactgaggtcctgcaagctatttctaaggtcgcaaaagctacaaagctggtgaaatctgaaattcctgcaaagattaagttgttgccagatccatggacacctgaatctggattagtcactaatgctctcaagataaagagagaacaactgaaagctaaattcaaagatgatcttctgaagttgtatgcatga

SEQ ID NO: 77634 - DNA, 513 bp, Glycine max
  Peptide Sequence Number=SeqID_169319
atggggcagctccaacggcaagccttccgcaaagcctacggtgagatcgatctgggacttggctatgatagaagtctctgcaaaggcgatcgcttccctcacctactagtgccgactgtagaagagttcaaagaaattcttggatgccctctggaaggcaggaagccttatctcttttccggattctacctctccatgtctagaatcgccagagtagttagaattttggcacaagaattagaccgggtaaagcaaaatagaaatggagtggtcggtataccaagaaagtgtctagaagaaagagcaagggccttggcaagtcaaaacgagtggcctcctttcattgatatcatggcgctgttaatcttcggagtagtcctttttccaaacgtggatggtttagtggacctagcagcaattgacgctttcctcgcctttcaccacagcaaggaaagcccggtcgtcaccgtcttggccgacatatacgacacattcgaccagagtgtgaaatga

SEQ ID NO: 77635 - DNA, 189 bp, Glycine max
  Peptide Sequence Number=SeqID_169320
atgtggtcatctgcaccctttccagagatgtcagcatcttccggttggaactttttagtctcacagacaacatctgttgatcctgacccacgggtcgggtggcaggcaaacatacccagatactttttgtcatccagggacgatcaagtggatgacgcgccaagaacctcttctgttgtccagaaatga

SEQ ID NO: 77636 - DNA, 332 bp, Glycine max
  Peptide Sequence Number=SeqID_169321
atgaagcttctcttttttttgggagatccttatgttctttcttctgagggtaaggataaaaaattcctatccttggtcaaggtttatggccgaagggttgaggttctggctcaaaaggtccccgcgggccctgcctgcgtctcaactcggtttcgtccccaggccaagccaccgtggcctcgaactgctcaggagtgggccaagggaaaggattggggtcctgactttgttggtgtaggttgttgtcgcaacctacccttcggcgggagggcgacgcgagactcgcgggatgcgtgttccacgaaaggaatacgcgcggagtcgccaccaac

SEQ ID NO: 77637 - DNA, 773 bp, Glycine max
  Peptide Sequence Number=SeqID_169322
ttcgtgacattgtcattaagggtgatcctttagttgtcggtggccatagtagtggtagtggtcggctaggttcctcaaggatcatggcagcatttttgtgcggtcccaattggggggaggttcctaaggatttatacatagctattcaagattgtctgatacatggtgtcagattaacgccaactcatgaagaaatcctgagtttgctcgcagggccattgagtttcctcagccttggtattaatgctagtcgtgatgatgccctagggcacgccttaatgtctaggagctacccttcttattccccccttctcccttcaacttttgacaaagacttctttgatgatgacatggatatgggttggaatgtaaggagggtagtgaagtcctcagagttgctccatcttcctcttgagagtgtcgagatgaattggatagatgatgagatttgggggactaggtccaagtttgacatttctgttatgaacgagttatgcaagacaatgtggcttacttgtgacaggaatggcgggtttagatcttggcagccactagagataattgctggatttgttccaaaggtttctccatctagttgcatcgcaacagctaggcttttatccttgcctttgagaggttatgtgagtggtttgatttggggtgttatcaaaatctattcagccacttctttgtgccccatcggaattgcatttgatggtggagggaaaaatgccacaaaattccctctatattggactgaggatcattactga

SEQ ID NO: 77638 - DNA, 450 bp, Glycine max
  Peptide Sequence Number=SeqID_169323
atgcgaagatcttatccatactataaaggagtgtgtggccctgaaggacaagataaagaagttgatacaacaggatcggaccaggtagaagcaaagccagatcaagtcggcacctcagcaaccaacgaaggaggaagatgcggggttatcaacaccatcacgagtggctttgtcggtgaagcaagctcgaggagatcaatcccactaataatgtgcacaggcgtcgactttgcaaggttcgatcccgagcaaaatgatccgatggttatcacagttggcatcgccaattgggattatgtcctcatcgacgttgacacctacaatatcctgatcgggagaacaacgttgaatgctctaggcacgatcatctcaatgccccatctaccaataaagttccccaaccaacgtggtgacatagtgacggtaaaaccaggccaagtggaagcctga

SEQ ID NO: 77639 - DNA, 351 bp, Glycine max
  Peptide Sequence Number=SeqID_169324
atgtctcaatgtcacatcttatcagagtattgtgttctaacgctgtcgcaaccttcccttcgacgggagggcgaggcgaaaggtaaaattgtgtcttctcgtgaagaaaaagcgtggagtcgccaccaacatttattcgaggaaaacattagaaaaaccaaaaagaggtctgtgaattttgaaaataagggttcaatagttttttacgcatggggaagtgatgaggacataaccaagggcaaggaccatgaagcacttgaaggtcccatgaccagaggcagacttaaacaagcccaacacgtcatagagacaaggctggtcatttgtatagctgccattgatgatgattga

SEQ ID NO: 77640 - DNA, 1014 bp, Glycine max
  Peptide Sequence Number=SeqID_169325
atggggacaaatcaaaacggaaaaagattttatcaagtcaaggttaagggtctagatgtcaccaacctcaaggaattgggacgattgatgggacctctccaaaggcaagccttccgcaaagtgtacggaaagattctagatttgaccgcaatggaggtatttacggaagctgttgtatccctcgcccaatactatgaccagccgttgagatgcttcacgtttggggacttccaaatggtaccgactgttgaagagtttgaggagatattaggatgccctcttgggggaagaaaaccgtaccttttctccagctgtggtcggagattcggcaaaagagttggatcgcatgaagcaaactcggaacggcgtagtgggcctgccgcggaatacttggaaggcaaggcaagggatatggcaagccaagagaagtgggtcccgtttgcggatatactagctttgctgatttttggggttgtcctctttctgaacgtggacggcttggtggacttagccgcgatcgatgctttccttgcctatcaccatagcaaggagagcctagtggtggctatcttggcggacttatttgataccttagaccgaaggtgcgagaaaaacagcgcacagattgtctgttgcttgcccgctctctgtgtgtggttggtttcgcacctattccaacaagacataagacacccgtgtccgcttcaaagttattgctcgtgcgtcgaaaaaagaagagtcgattgggaccaacacttggctgggataggaggcaacacaatcaattggtttcctcgatggaaggaaggaaatgagggagttcttttctcgtgtggggactaccctaatgttccgttgatagggacgaggggttgtatcaactataatcccgcacttgccataagacagctaggataccccatgaggggagcgccaacagaagagagtctctcgaaactcttccccaactataacccaatgtatctttgtccatcatccgcgtcctcaacataa

SEQ ID NO: 77641 - DNA, 624 bp, Glycine max
  Peptide Sequence Number=SeqID_169326
atggaaatttccaatcttaccctaggaagaaagaacaggaggatctttccagttgtcgtgcaatccgaaaggtttttcgatgtttcggaaaagaatatggaaaatacccaaaagagagggcaaaagggtcattcggaggctttttcagacccctggctcgcccaagctagcctctggctcgcttgggcccctagaagacttaggggtgaagtaaccagttcgccttggcgagcaaggttacttcaggttgaagcaacagcttgcctgggcaagctgctgttcaacctcctcccctcatttcctataaataggcgtgagggggctgaaggaatgggttcagactttcaaacattgaaagatttagtgaaattaaggagaagaagaatacaaattgaggccaaggcacttccgaatcgctttaaaatcaaccctacgtgtaacaatcctttttccgatgacccactctcaccgtggaagcagcaaccgatgggttcaagactgggactctcatgcccaaacctcaaagcctatcctttttccgaggttacagattcattttgccaacttttgttgcctacattgtttcatcgacctgaggttgttcaccttggagacctgaggtag

SEQ ID NO: 77642 - DNA, 183 bp, Glycine max
  Peptide Sequence Number=SeqID_169327
atgaagatggtaactgctttcaatggcaacatgaagaaagctgctgctggacttagacgcattaatcttgatggtcttcgatggagggtttttgatgcaaagggccaggagatacttctatttttctatcccctgtacaagatgcaattgggtggaactaaagttattatgcattctccttaa

SEQ ID NO: 77643 - DNA, 892 bp, Glycine max
  Peptide Sequence Number=SeqID_169328
atgcaaatagtgaaacctaaagaggaaattttccccaacaaacgcagaccagcccaagccccaagtacaaacccaaatgataaagagtgggctgttgctagtgcttcctcttcattttctctctttggtgcacagtgcttcgccgttttttcttcattttcttgcgattggttagcttcggtgaaggtgaaggagaaggtgtcggtgttcattcttgcggtggttggttcgtcggcggtgacattcgagatggatgaagatcaatggatgtatgacagtataatgtctgaagaagttaatatggattatcaaaatgaagaagaatatggtgtgaatgaaccacatgttgattgttcgaatgtgttcaatacttctcaagtaataatgtgtttgacagctgagatgatgtattgcggtgggctcgatccattgctcatgaaaacggatttgtggcggagtgacgagtataggtgtagaaagaaagaatttgttagaagagatactgggactaggaaatgtgggtgtcccttcaagcttcgtggcaagctagtggatggaggacaaggctggatgatgaagttgatgtatgggattcataatcatgaattgtcaatggtgaaaccaagaaacattctgctaactctgaaggagcacaatggcaatagttgtatgaccatcaaacaaatatacaatgaaagaagtgcataccgttcttccagaagaggaagtgatactgaaatgcaacatctaatgaagcttcttgaacgggaccaactcctactgctcgattttgttggggtgacacaacctgggatgacattctctgccggttttgcatatttggagggtgaacgtcttaataatgtggtttgggctttagaacggttccgag

SEQ ID NO: 77644 - DNA, 387 bp, Glycine max
  Peptide Sequence Number=SeqID_169329
atgcaaaataacaattcgtcagtgaggcgtagtgcatcatcttctgagcagcccaatccaagaaggatcatgcctatgttggatcaatttcagctatttatacacaacttcattcataacattgttgatgtcaaagctgatggaaactttggatatcggtcgattgccggtttattagactatatcaagctctttggtggcacggacaaatttgaggaattaaggatgtcactacttgttgatgggttaaccaaggtgactatggataagtggatggatataaccgatatgggatatgtctttgcatcaaggtataatgtaatccttgtatccttgtctcaacaacaaagcatgtcgttatttccttgtcttcagtgcatcgcataa

SEQ ID NO: 77645 - DNA, 372 bp, Glycine max
  Peptide Sequence Number=SeqID_169330
atggaagaaggattttccaccaacaaaccacccttatttagaggtgtaaaatatgattactggaaggagcgaatagtagataattttgaatccattcatattgatctatgggatatggtggaaaatggaaattacattccatatgatgatcagttaaacgaaattcctagaagtcgatggacgaaggcacaaaaaatcatatttttgttcaactctaaggctcgaaatgtgatgttatgtgctctattagaagaggagtacaccaagagatgcaattcactccctcacacattcactcgtgtatcactaactgtttcaagaaaagaattgcatacctacacactaggaatagcaccagagacagaaaaatga

SEQ ID NO: 77646 - DNA, 386 bp, Glycine max
  Peptide Sequence Number=SeqID_169331
cttctctttgggttccttgttgaaccaatctcagacttatcaagttaatccttatggtgtctaccctgacttatcttccttcaccggaagtggcgtctaccctgacttatcttccttcactggaagtggcgtcatccaaatctccatagtctgtatcaaacgttccgccccttcaagttgtaataagggcccaattggcaacctaggcatcagccttttgggagaccaaatggtggttgacttgatggctgttggggcttccgcgctgtcttcttcttctaatctccgtctagcgaaaccgtccctgtgtgcatctgagcatcgtgttcgtcgcactcgagcatcgtcacaagtctctgcttcttctccttcgccaccatacctag

SEQ ID NO: 77647 - DNA, 657 bp, Glycine max
  Peptide Sequence Number=SeqID_169332
aaccgtacttcaccctggccactgatcgccgccgatggtggatacgcgtttaagtttgaaaacggcaaatacgacgtgaaaaacgtcggcgtcgatagcgccggggcaaaagccggtctgaccttcctggtcgacctcatcaaaaataaacacatgatcgccgacaccgactactccatcgcggaagcggcgttcaacaaaggcgaaaccgcgatgaccatcaacggtccgtgggcgtggtctaacatcgacaagagcaaggttaactacggcgtcactctgctgccgaccttcaaaggcaaaccgtctaaaccgttcgttggcgtactgagcgccgggattaacgccgccagtccgaataaagaactggcgaaagagttcctcgaaaactacctgatgaccgatccgggcctggaagcggtgaacaacgataaaccgctgggcgccgtggcgctgaaatccttccaggagaagctggagaaagacccgcgtatagccgccaccatggctaacgcccagaaaggcgaaatcatgccgaacatcccgcagatgtcggcgttctggtatgccgtccgtaccgcggttatcaacgccgcaagcggccgtcagaccgtcgatgccgcgctgaaggatgcacagggccgtatcaccaagtaa

SEQ ID NO: 77648 - DNA, 225 bp, Glycine max
  Peptide Sequence Number=SeqID_169333
atggtgacgtcagaagttcggtgttcaggcgaggagaagacgttgaagtccaggaaagaggttgctgcggcgaccatgaaagacgttgccgagaaagcgcaagtctcaacggcaaccgtgtcccgcgcattaatgaacccggataaagtctcccaggcgacccgtaaccgggtggagcaggctgcgctggaagtgggctattttccgcaggcaatggggcgtaac

SEQ ID NO: 77649 - DNA, 291 bp, Glycine max
  Peptide Sequence Number=SeqID_169334
atgccgctcagccccgtgatattggttaccttggctgacaacgagctgaggtcgttggcctcttccttcctttcacttggaggtgcatacctccacgggactgcatggctgtttcagtatggaaacggaacaggtttaactaccaaggggtatcggggcttttggggagctgcatctttggtgaaatacatcaccaaaggcttaggtcttccaaaacttctctcatctgcggactatatacatatatgtttctcttccctcccctcatcgccgacttccagtcagccttga

SEQ ID NO: 77650 - DNA, 123 bp, Glycine max
  Peptide Sequence Number=SeqID_169335
atggaagaagagtactctactaacaaaccacctatgttcagaggaattaatgaagcattgggcttgaatccagaattgggcttggatttgaagaggacagactattttattctacaaaattag

SEQ ID NO: 77651 - DNA, 417 bp, Glycine max
  Peptide Sequence Number=SeqID_169336
atggatttctttttcgatgagagtttcgaatgcattcaagcatttcaaaactcaaatctcattccctttatgtctctaaaattgtctgtgtattctgaattggtaaaagctttttattctaatcttgaaattcaagaaagtaccttgatttcagaagtttataggataaagctagtcattgaccaatccttcttctatgttttgactcaattgactagcgaaggtgtaccatttgaaggtacactagatgatgattggaaatttgatttttccatgcatgatgcccgctggttggtttgcaccaaccaagcagatatgatcggaaggcttcttgccggttcattggctcttgaaagccgcatccttcactatcttattgttcgtatcttactcccaagatcttcaaaccttgcacag

SEQ ID NO: 77652 - DNA, 375 bp, Glycine max
  Peptide Sequence Number=SeqID_169337
atgcacctcaaccaccctaattcgcaacctcacgtggagacggaggtcttctccgaccacgacgttcagattttgcagttctcgacggtgataaagcgctccgtgaaccaccctcactcctccgtcaccacaattgttgctctggagcgtgcccttgagtccgaagagaacaatgctccaagcgctctcgctgctccggttctcgagaacgtgtctcacgaccaatttcaagcattttcgtatgttccctccgatagctttgctttcgacagtgattcctcttttgtcatcactccccctccaattttggaaggtcgtgacattgttaagtgctatggaactaaggctcttgtagttccaatgcattcaggttag

SEQ ID NO: 77653 - DNA, 496 bp, Glycine max
  Peptide Sequence Number=SeqID_169338
atgtcggcaggaatatatgtgatgagaatcatgaaactggccaaatacaggctaaaggcccaagtggagaaggacaaagcccccgagtggagaaggacttatcaaggtaatccttgtggcgtctaccctgacttatcttccttcaccggaagtggcgtcttccttgacttatcttccttcaccggaagtggcgtctaccctgacttatcttccttcaccggaagtggcgtcatccaaaccttcgtagcctgtatcaaacgatccgctcctactcaggaaatgttcgatcggcgtcatccggatccacttgaaggacttggaggatctatgaaaagggctagagcaaggaaagccaaggaagctcttcaacaagtgctgtccatactatttgaatacaagcccaagtttcaaggagaaaagtccaagggcccaattggcaacctaggcatcagccttttgggagaccaaatggtggctgacttgttggctgtagggg

SEQ ID NO: 77654 - DNA, 330 bp, Glycine max
  Peptide Sequence Number=SeqID_169339
atgggggagaagcttgccacccagctcgcccaggcgagcagggttgcttcctccagaagcaaccgccttctggaggaatcttctggagggcccaaatgggcctgggttctatttgcacccccatttttactaaaatctcacttaattatgcaacgatgcttccatttgatttccggtgtgtcacggaaacttacggattgtgcatcaatattttttggttttccggcatgtccggaatttcacaaattgcctaatgatgggtgccaagcacctcacaaggaccaaagaaaggtcgcatgtcatcaagcaaaggtccccggacgaaattag

SEQ ID NO: 77655 - DNA, 375 bp, Glycine max
  Peptide Sequence Number=SeqID_169340
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtggtgcgtaacggcaaaagcaccgcccggacatcagcgctggcaagtgtagcggtcaccgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 77656 - DNA, 118 bp, Glycine max
  Peptide Sequence Number=SeqID_169341
atgtgtttccatgaagaaaatccaagccaaggtgcttccgtaacacttttgagacgttttcgtgagcaatttcgtgaagattttccgccgttcttcaccgttcttcgttcttcaaccg

SEQ ID NO: 77657 - DNA, 306 bp, Glycine max
  Peptide Sequence Number=SeqID_169342
atggccccgaggaagcttgcctcaaagaggtccaggaaggacaaggcagccgaaggaactagttccgctccggagtatgacagtcaccgctttaggagcgctgtacaccagcagcgcttcgaggccatcaagggatggtcgtttctccgggagcgacgcgtccagctcaagactaggacgcacctagttgctcatgatcctgggaatttaaataaaacaagcgcaagctcggaaggtggcaagataccttggatatgcatgtatatagcaaaaatacctcacaaaaatatgcacatgtttaggtag

SEQ ID NO: 77658 - DNA, 135 bp, Glycine max
  Peptide Sequence Number=SeqID_169343
atggcatctttcggcactcctactatcttcaccgtgttgcaaatgtcgatgtatgtggccagctggatcaaggaatatggatatgagaagttggccgtctgcacctctggtctagctatgctggtgaagtactga

SEQ ID NO: 77659 - DNA, 279 bp, Glycine max
  Peptide Sequence Number=SeqID_169344
atgagggttgcgcttatcggacgctcgctaagccagcagattggcttagcgagaaggttgcattactcattgcattctttccttgaaatcagaattgtaatcattgtaatcaaaagaaaagaatgcgctttacggcgcccttaccgaacacgtgccaaagccagaataatgagtgaaatagaagaggtacatgaacaaatgaaggccgacatggagtccatgaaagagaaaatgaccacaatgatggaagccatgatgagtatgaggaaaatcatggag

SEQ ID NO: 77660 - DNA, 938 bp, Glycine max
  Peptide Sequence Number=SeqID_169345
gtatgctctcactcgaacccttcacagaagatcagggtcggtcggcggtgcaacccacagggggatcccaccaatcagcttccttgcgccttacgggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcacctccttttcatctttccctcgcggtacttgttcgctatcggtctctcgccagtatttagccttggacggaatttaccgcccgattggggctgcattcccaaacaacccgactcgccgacagcgcctcgtggtgcgacaggggtccgggcacgacggggctctcaccctctctggcgcccccttccaggggacttgggcccggtccgccactgaggacgcttctccagactacaattcggacgccgagggcgaccgattttcatggtgggcttttcccggttcgctcgccgttactaagggaatccttcgggtagccccgcctgacctgaggtctcgttgggagcgtgcgtgcacgcaaagggtcgtcgatgggtccagaactgaccggctcgcacgtgattggtctcgagcgtggctcatccaccattttatcacggcgaagtcggccatgaacccagatttcaaccaaccacgaggcgggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgacgaggaggccgggcgcacggggcgccgtggtcatcccctccctcccgacg

SEQ ID NO: 77661 - DNA, 156 bp, Glycine max
  Peptide Sequence Number=SeqID_169346
atggtgaaaaagaggctaagttttgaattgaaaaaagtagcagttgggctaagctcagcagttgggctaagcgattattcaccgctaagcgcggcttcagagcgcttagtgcaaaggagaatctggcagagcatcaacatcaaagtcgcgcgctaa

SEQ ID NO: 77662 - DNA, 165 bp, Glycine max
  Peptide Sequence Number=SeqID_169347
atggttctcgcatgtcatcgggtccgccgcctctggatgacaaagggaaaaagtgtgggaccaaatggttcccgcatgtcatcggatccgccgcctctggatgacaaaggaccaaatggttcccgcatgtcatcgggcccgccgcctctggatgacaataggtga

SEQ ID NO: 77663 - DNA, 166 bp, Glycine max
  Peptide Sequence Number=SeqID_169348
atggagctcagcctcatgtgtgacgcgttaaaaggcagcttatccaatgtagttttgggcatgacattgagggaagagccattgttgatgagcactttggccactatgaggtccaagcatttgggtaccgagctcgaattcgtaatcatggtcatagctgtttcct

SEQ ID NO: 77664 - DNA, 457 bp, Glycine max
  Peptide Sequence Number=SeqID_169349
atgacagatcttgtgagcgcggaagatgacgtaaatctccgcgtgtcaacgggcttgtcggccgcgattgacgaaggcgcagaagacgacacagcaaaaaagaatgtttatacggataaccactcgggtatttccgcccgtcaacgtgactcaaatgtgagtatgacagatcttgtgagcgcggaagatgacacagcaaaaaagaatgtttatacggataaccactcgggtatttccgcccgtcaacgtgactcaaatgtgagtatgacagatcttgtgagcgcggaagatgacacaacaaaaaagaatgtttatacggataaccactcgggtattcccgcccgtcagggtgactcaaatgtgagtatgacagatcttgtgagcgcggaagatgacgttaatctccgcctgtcaacgggcttgtcggccgcgattgacgaagggcgcagaagacgac

SEQ ID NO: 77665 - DNA, 63 bp, Glycine max
  Peptide Sequence Number=SeqID_169350
atgactgaagacattgtcgtcttccaaatattaccgtatagggcatctccgcatgctacctga

SEQ ID NO: 77666 - DNA, 348 bp, Glycine max
  Peptide Sequence Number=SeqID_169351
atggaactcatatatgatttgagagggcatatggagctactttataatgagatatctgagctaaggaaatcaataaagggctgcatggaaatgcagatagaattacaacaatccatgaaacaagaggttcaaacagttaaaaaagaagaaaagaagtccaataacaggactccaaagaaaggcaactgctgcatttgctatgagatgaaagttgactcagttttgtacaggtgtggacacatgtgtacatgtctcaagtgtgccaacgagttgcaatggaacagtggaaaatgtcctatatgtcgtgctaaaatagaggatgttgttcgcgtatatgttgacggttag

SEQ ID NO: 77667 - DNA, 441 bp, Glycine max
  Peptide Sequence Number=SeqID_169352
atgatgggaaaatccaatgtgcatattgagaagaatgagcatcttcaatggatgaacatgtcactgcaaagtagccaacatgaagtggaactgcaacatcaaaacaggcatcaaggaagcttctccaaaagtgaagcgacaatcaaagacagtggcaagagaatggaggatgaaggatccaaatgtggtaccctttgcatgtgtcttccatgctttggctttggtaaaacaaaggcagttaaggcaagaaaaggaggcatcaaagtggatcattccatgaatcatgtaatgtctagcacattttctttggagaactttgaacttaattctacacaagcgaaagggatagtaatacaggaaaataatcatgaagatgactccttcagttcctactttgacctgccttctatagtattgaaatgcagtggagatgatgcttaa

SEQ ID NO: 77668 - DNA, 74 bp, Glycine max
  Peptide Sequence Number=SeqID_169353
atggcggaactcatggataagagaattcctgaggttgagattgggagatatgccacaccccatgagtacagaag

SEQ ID NO: 77669 - DNA, 2562 bp, Glycine max
  Peptide Sequence Number=SeqID_169354
atggaagcatacggcggcttcatggtcgacgagaaagccgttagggttgagaacgctttccttgatttcctcaaaagcggaattagcagcttcaagtctagtagccagcggaacgaactttattacgaagcggagatcgaattgatgaagagcaatgaatccaacaccatgttcatcgatttcgaccacgtcatcagattcagcgacctcctccagcaaaccatctccgatgaatacttgagatttgaaccttatttgaagaacgcttgcaagcggtttgttatggatctcaagccatcacttgtgtccgacgatagccctgacaaggacatcaatattgccttctataacatgcccattgttaaaaggttaagggaattgggtacatcagagatcggaaggcttgtgtctgtgacaggagtggtgacgaggacgagtgaggttcgacctgaacttctccatgggactttcaagtgcctggaatgcggtggtgttataaagaatgttgaacagcaattcaagtatactgaggtgccaacaatctgcgcaaatgcgacctgtagcaatcgaacaaggtgggtactgctgcgccaagagagcaaatttgctgattggcagagggtcagaatgcaggagacgtccaaagagatacctgcaggctctcttcctaggtcattggacattattcttcgtcatgagattgtggaacatgccagagctggtgacacggtgattttcactggtactgtagttgttatacctgacataatggcattggcatctccgggagagagatcagagtgccgccgtgatgcttctcaacgcaagggttctacagctggaaatgaaggtgtgagtggtcttaaggctctaggagtcagagacctcaactatcgtctagcttttattgccaactctgctcagatttgtgatggtagaagagaaatagacatcaggaatagaaagaaggatgttgatgaagacaatcaacagtttactgatcaggaactggaagaaattaaacggatgaggagcacaccagattttttcaccaaacttgttgaaagcattgctccaactgtttttggtcatccagatataaagagagctatccttcttatgcttttgggtggtgtgcacaaatttactcatgaaggcatcaacctcagaggagacataaacgtttgtgttgttggagatcccagctgtgcaaaatctcaatttcttaagtatacttcaggcatagttccaagatctgtgtatacatctggaaaatcatcatctgctgctggcttgactgcaaccgttgccaaggaaccagaaactggggagttttgtattgaggctggtgctttgatgcttgcagacaatggcatttgctgcattgatgaatttgacaagatggacatcagagatcaggttgcaattcatgaggcaatggaacagcagactattagtatcacaaaagcaggaatacaagcaacacttaatgctcgtacttccattcttgctgctgccaatcctgctgggggacgctatgataaatctaaaccacttaagtacaatgtggcccttccaccagctatactttcaaggtttgatctcgtatatgttatgattgacgacccagacgatcagacagactaccacatagctcatcatattgtgagagttcatcaaaagcgtgaaggtgctctggctccagcattcactacagcagaactgaagcgttatatagcttatgcaaaaactcttaaaccaaagctctcgcccgatgccagaaaactattggtagactcttatgttgctctccgtagaggtgatacaaatcctgggagtagggttgcataccgtatgacagttaggcagttggaggcattaatcagactgtcagaggccattgcacggtgtcatttggacaatgaggtacaacctcgtcatgttcgtctagcagtaaaactgctgaaaacttccataataagtgtggaatccagtgagattgatctgtctgagtttcaagaacaaaaccacgatgatggtgcaggtggtggcaatgaaaatgataataatagagatgctaattatcaagaggggaatgatacagcgcagcaagctgctggaaatggtaatgatcaagtgggaaacgatgcagctcagcaagccactggaaataatggaaatccagcagatggatctaaaccccaagtgagaaaactcattatgagtgatgaatattatcagagagttaccagcgcccttattatgcgtctaagacagcatgaagaggctgttgtgcaaggagacggtttgtctgggatgaggcaaaaagatttgattcaatggtacgtagaccaacaaaatgagagaaacaactacagttcgatggatgaggtgcaagctgaaatttccaaaattaaagctattatagagagcttaattcggagagagggccatttgatagttgtagataatggggaagccgcggcagcagcagcagaacccccaggcgcaccaagaaattaccgaattttagcagtggctcctaattatgtcattgattga

SEQ ID NO: 77670 - DNA, 840 bp, Glycine max
  Peptide Sequence Number=SeqID_169355
atggtgaaagaaatcgaaaatctgacagaagatgaaagacgcgcacttcgtggcagcaaattcgcccctcttccccgacgttccaattccaaacccaggttggctcatccctgtggacccttggcgacgaataaagcagcggctttggccaagtttctggagagaaagctgaaggacccaaatggattggcatctattaaccccgatctccttgaacttgctgtcaataatgctaaagaaactgtctatgcaagtgctgtttgtgctgttctccaattagaattggagaactacctcagtaatccacataataaaggtgtgaaggtggagggaattattgttgaaacaactctaatttccacattaaatgcgggagctttgaggttgaacgtgattcaatggcaaattgacacctactgcgtttactccttcgccaacctcaacttaaaagctatcaagtgtgccattgttgttgcttctttggtgtttgtggattttgaaggtggaggaaggttgaaactggttgttgacttgcaaaaccaggcattgccattggcatggctctatcagtgtccaaaattcatcaccaccaccaccacgtcttcaaaaaaagaacactcttattcgcagcctcatacctcacacatacgtgctgggtctcccctcgccgtgctgaatagctctcccgacacttctcttccagacccgccagacacccgacgccgtccttcgctacctgaccgacaacctcggcctctccgaaacccaatccttaagaatcatccgatgcatccccagactcctccgcaccatcgttactggctacccctgcattcttga

SEQ ID NO: 77671 - DNA, 708 bp, Glycine max
  Peptide Sequence Number=SeqID_169356
atggttagaatcaaatgtttgagttgggctttaggcagggttataggaagagccttagggagagaaatgagtcgtgatgtggatgaagccctccagcagcgaagacctataacatctgcacaagcacttgttgatgatgtagttactgatgccgagggttttttaggtgggccccacaatacatcaattttgatggactatgttcatcatgtgccaatgactttttggaatggagaggaatgtcctgagttgaagttatcctcccatggaaggaaggttgagaaatttgacaggtctgctccagagattgaagggttagtaactgccacaggattaagtcatctgatcacattttcattagacactgatgtctttcgtgacctcacccagagtggaaactacgcatggggagttgttgccctgttctatatgtatgagaatttgaatgatgcgtcaaagagcagcgctatacaacttgcaggatataccatacttttacagtgttggatctataaacattttccttctgttgcttcttctattactgaagattatcgtgagaagacactgcgtgcttgtcgttggaagtttgagaagacattatcagtgttgatgtatcgtaagaagctgaatagattagcgtctaatgttgtgtgctcgattccttatgatgatcaccagacattaagagaatttgagttgaagtag

SEQ ID NO: 77672 - DNA, 1110 bp, Glycine max
  Peptide Sequence Number=SeqID_169357
atgtgtcggtggaggattttcatagacccaccgcttaaggtgctcaagaagagcgtcatctgcattgtctctcccaagtgcacaaaatacataaacagccgaaataaactactctggatgtgtggtaatgctgaatcactgaataagaaagttgggagagacaatgcagatgacgctcttcttgagcaccttaagcggtgggtctctgaaaatcctccaccggcgcatgtcatgttgatagctggtgacagaggctatgctcgaaccttaagacagctgagagagaacaagtataatatattacttgtcacgcgggatgcgcctccttccaaggtgttcagtgatatagcaagtatattgtggaagtggtctgccatattagagaagaaacccttaggaaaacatttgaacgatcccctgatggatacgtgcttgatgaaggttcatcgacggccaaaaaagagtagtaacatttcgactgtttatgtattttgtacagttgagagagacaatgcaaatgacgctcttcttgagcgtcgtccaccccgtatcaggcccctctactcgtccttttggtcccattatccctcgtcatcgttgtcatcaagtcccaccaacctcatgcaaatttgtgtttggtgggacataaaaaattgtctcattccttcatcgtgtgatgcttcccagattgatgattacatcgagaccgctctaattgccaacaaagcacacgatttatcccgacgaaaccaggagaagcttgttgaacgacccaagataagaatcatcttcaatcaaggtacctttcttgattcagtgattcagcattaccacacacccagagtaggtgtattttgtgttgttgggagagacaatgcagatgacgctcttcttaaacaccttaagcggtgggtctctgaaaatcctccaccggcacatgtcatgttgatagctagtgacagaggctatgctccaaccttaagacagctgagagaacaaatggcaagaggatgtataacacatgctgcaaccacaacaatgatagcagccgcaatagaggacagggttgtaaacagatccgagagattccactatgcaatagcactatag

SEQ ID NO: 77673 - DNA, 457 bp, Glycine max
  Peptide Sequence Number=SeqID_169358
tttctggggcatctcacaatcaatggaagatattggaggcagttcctcaaacgacaacaacaacaatggtggcatcatcaaggaacaggaccggttgctgccaatagccaatgttggtcggctcatgaagcggattcttcctcagaacgccaaaatctcgaaggaggcgaaggagacgatgcaggaatgtgtgtcggagttcataagcttcgtgacgagtgaggcttcggagaagtgcaggaaggagaggaggaagacagtgaatggtgatgacatttgttgggccttggcaacactaggctttgataactatgctgaaccaatgagaaggtacttgcatagatatagagaggttgaggtagatcataataaggtcaatcttcaagaaaaagggaatagtcctgaagagaaggacgatgaattatttaaattgagcaatagaggggttgggctttga

SEQ ID NO: 77674 - DNA, 126 bp, Glycine max
  Peptide Sequence Number=SeqID_169359
atggcgccggtgaccggtggggaagagttgtggtggtcctggctaggcaaagacgcacaaagaaacgggaaagggaaaggtcctgatgagtatcagaagaaattcttgattaacccaccaacatga

SEQ ID NO: 77675 - DNA, 1267 bp, Glycine max
  Peptide Sequence Number=SeqID_169360
tggaggacatggctatgaaggggtgtcttatgtggctgcacaaccattcttcctccttgacatgttcaatctccgatccattgaggtcaacatggacaccgagactgcttgggtcgaagctggtgcaactcttggtgaagtttattacagaattgctgagaagagtgaagttcatggtttccctgcaggggttggtcccactgttggggtgggaggtcgcattagtggtggtggctatggcaatctcatgagaaaatatggcacttcagtggataatgttgttgatgcacaagtagtggatgttcaaggtagattgctaaatagaagttctatgggtgaagatctcttttgggccattagaggtggtggtggaggtagctttggtgtggtccttgtctacaaaataaagctagttcgagttcccgagagagccactgttttccaagttgagaggaccttggagcaagatgccaccaacataacaacggagttgagaccaacaaaaggggttaatagtctccagcaacgtgatgaatcaagacttaaatttgaagaagtgtccatatttagtgatcaacaatgtctcgaacagaattatctccaacagaagatcataaagacacaatctgaatgcatcgaaacaagctggcttcaatccgtgctgttttggtacaacatggacattgcaaccccagttgagattttgctagagagacaaccttggtctctcaagtacttgaaaaggaaatctgactatgtgaagagaccaatacccaaggaggcagtaatgtatttcaacccttatggtggaagaatggctgagaatccatcaacagaaactgctttccctcatagagccgggaacctgtggatgatccaatacaaagcagataggtatgagacaggacaagaggtagcaaaatactacataaacttggtaagagatcttcataagtacatgactccttttgtctctcagaacctaagacaagctttcatgtgttacaaggacttggatttgggcatcaaccaccacaatgtttatggctactttgaagggagttcttatggagttcagtacttccatgataacttcaaaaggttggttcaaataaagaccagggttgatcctgccaatttctttaggactgaacaaagcatcccggtacttagccatgcggaattagttagaatggttactgaaaaatcgatagttcctattttgttcgggttgttcgcattaaattggattcgaaccttcaaataa

SEQ ID NO: 77676 - DNA, 1002 bp, Glycine max
  Peptide Sequence Number=SeqID_169361
atggattgcattcgtggttgcggatatttctttggttccggtcgtgcgtcgcggaatgtgatgttgttgattgatgagggagccacggactccgtcatcgcctttttgttacagaaaaggttttctgtgatcttgtgttctggttttaaggagactttggatgaaattaaggaaatggggtttgagcctttcaagaagaagttcgggctggcgctgcttgcgaaaaagattgttccgaaatcgcactgggaagctaaagttgatgtctttaagagctggggttggtctgaagaattggttattggtatgttcaagaggcagcccctctttatgttagcgtcccaagataagattgatcgggtaatgagattttgggttaagcagttaggttgggattctttggcccttgccaaaaagccagagatttttggatttagtttggagagaaggatcattccaagggctcttgttgtccagtatttagtcgctaaaggcttgaggaaaaagagtgccagcatgattgtcccatttgctgtttctgataaggagtttcttgaaaagtatgtgatgcgatttaaggaggaagaagcggaactattaaagctgtaccagggaaaaatgagtggtcatggaaataaggaggatggtgcagctcctttaaccgtagtgctttcgatgagtgagggctttcaagtttcaaacgatgacgaggaccaccacgacgcgagtagctcagcagtccagcacggcaacgatgacgatgaccacaacgatgcaagtaactcagcgggagtcattttcggggagttgttgtacgacgccgtttcgggttttcataaactcgtggactcagagcagactcgtgagtttgcacaaaattggacgagtttaacaaccatgattgaaactgcccctttgatcgggttcaagcattacagtaggaaccaaccagggatagctagtgggaaattgaaccctcaatgcatcatactcttgtcttag

SEQ ID NO: 77677 - DNA, 783 bp, Glycine max
  Peptide Sequence Number=SeqID_169362
atgggtgaaggttatgacacagatgacttagtggaaatcactctttttggaaagtatgttgatgagctgaatacatttcttgctactggagtcgtggacaatgtagttgttattcttcacttggacaaagtgaagacttacaacgaagaacaacttgtctgggatgtttcactggacatttcaaactttaaatcattggtgctaatcaaccttggagaaaatcattttgctggtgttgtaccaacaaagatgccagagagcatgcaagggatgattttaaggtgcaatcaatttactggcaatattccaccacaaaacaaactttctggatttattcctccttgtctgttcaacatcacttccatggatggtgcaagaagaatgagccattatcagttcagtgttgatttgtttttaaaaggttcggagatggagcatcggggtacttggctatttggaagtcttgatctttcaacaaacaacctgtctggagaaatttcaacagaaatttttggcttcactcaatttgtatctttgaacttgtgtagaaatcgtatcatgggaattatatccagcaacattggtggcatgaaaaatttggagatccttgatctctcctacaataatctttcagggaatcccaaactttgtggacctcccttaataaagaatagctctgatgaggaagcaaatcatgacaaggcaaagcaagagtttggtattctttgctcgtcagtagagcatggagacacaaatattttcagaccctggatcatactctag

SEQ ID NO: 77678 - DNA, 2037 bp, Glycine max
  Peptide Sequence Number=SeqID_169363
atggcgactgcggccggtgcggcggtgatgctctactacgtgctgagcaggcggatggcgcggaaggaggaggacgatggcgaggatcacggcggtgaggtgccgaaattgagcagatcggttcgccggagaaggctttcacggcggccggcgcaggctccggcaacgctgctggagtcgatcgtgacgctgtcggagactataaggttcacgtattccgagactctcgggaagtggcccatcggcgatttggccttcggcatcaactacttcatgcgcaagcagggtaatttggcagttgcaagtgtgtatgctgggagtgattgtgtgcagctcaaaggagatgagataattgtggagctctatgagttgttgaggcttttgactttgtgtatgcttttctccaagaagccatttcccgtgtttttagattctgctgggttttcccttgatgatgtgctcattcagaagccaaaagctgggatttggttatatatggaaaagctttgtggactctttgagataagggggagctatggtttgtactacctgggtgtattaggcattttgaaagtgactcctattttcttttcctattctaaatttgttaacattaagagaccccttgtggttttacttctgaagcctgcatttacaattatacgtgatacacaatcaaaatgtttacttctattgatccggggtactcatagcataaaagacacgctgacagccgcaactggtgctgttgtcccattccaccattcagttttaaatgacggtgggataagcaacttggttttggggtatgcacactgtggtatggttgctgcagctcgttggattgcaaagctctgcactcctaccctactcaaggctcttggtgaatgtccagacttcaaagtcaagattgttgggcactcacttggtggtggtactgctgcactgttaacatatattcttagagagcagaatgaattctcttcaactgcttgcatgacatgggagttggcagaatcaggaaaacactttatcactactatcatcaatggttctgacttggtgccaacattctcaacttcatctattgatgatctccgttctgaggtcactgcatcctcctggttgaatgatctacgggatcaggttgaacatacaaaggtcctgaatgttgtctaccgctctgcaactgcacttggatcacgcttaccatctatatctagtgcaaaagctagagtagctggtgctggtgctattctgtggccagtaaccagtagcactcaggttgtgatgaagcgtgcacaaagtgttgctgaagctgttgtcagaactcgctcatcattgtcatcatggtcttgcatgagtgcacggcgccgaaatgtgggttcatcagtaaactctaaaactgacgacttaactgaaacctctctaatatccgagagaagcactgaatctcgtatgactgaagaggtggtaagagaacctatgcttaaggatgaaaatacttcctctagtggaggatctggtcacgatgacacagatgaagaggaacaactcattcctgctaatcaagacattactgcatctgctgttgacgacttcacagaagggcagttatggtatgaactggagaaggaacttcaaaaacaggataatactatgaacattgatgctcaagaagaagaggctgcagcagcaaaagagatcacagaagaagagaatcaactcgttgatgctgctgcagaatgcagtagcagttcaatcacaacagcagacaacgtggacagccatcgattttatcctcctggcaggatcatgcatattgtctctgtaccttccttggatgagtcaaattcaaattctgatgaccctttagaagaacatgtcggcttatatgaaacacctagagagctgtacagcaagctcagactttcaagaaccatgatcaatgatcattacatgccaatgtataagaagatgatggaactattaatccgagaactagagaaagatagcagctgtaatattttggattaa

SEQ ID NO: 77679 - DNA, 244 bp, Glycine max
  Peptide Sequence Number=SeqID_169364
atggtccaaaaggaagggggaggaattggattcatcctagatgatgatggtagtgacaatcatggtggtgttaacaatgacaatcatgatgataaatgtgacaacaatcatgatagtagtgtatctaataaccatagcaatgatgatgacaatgatcatgggagtggtgaatatgtacaagatgatagtagtgatgaggtggatatagaacatcaacccacgtcgccttcccctaaagaatcag

SEQ ID NO: 77680 - DNA, 216 bp, Glycine max
  Peptide Sequence Number=SeqID_169365
atggctattattgattttctggaaaccgcgaaaggccatatatgtgtccatgtgtctaccgtgaggactgtgataaggtctgataggatcagggggtggttggttggtggtggtggtggtggtatcgaagccaaggaggtcagagaaagggtcaagctcggaccacagttcctgcgcggcgaggttgcggccacgcttcacaccaatgaagtctga

SEQ ID NO: 77681 - DNA, 303 bp, Glycine max
  Peptide Sequence Number=SeqID_169366
atggaatgttacagttatggccttcatgaggaggagcgtcaccttgaggaggtggatctagtggagggagagcttgttcgagtagcagattattatccagagggtgaggaaggcgaaggagaagacagagtagagaatgggaagttgggtctggtcgacagagaggtaatcgcaggggtgtttggagtcggcgtcgaggttgtagagcccggtgtggacaagcatggagagtattcgttggggattgtgacggggttggtgtggttggcggaggcggagggtggaggccgagagagttcatga

SEQ ID NO: 77682 - DNA, 279 bp, Glycine max
  Peptide Sequence Number=SeqID_169367
atggcacctcaacaagatcttgttaaaataggattggaagggtttgatctcatagacaggttctatggtgcaccaatcagaaggccagctaacgtgagcaagcagaggcaaggacgttccggagttcaagcaacccaccaaaaccacaaggaagagccagtagttatcaatagcagagaggcagcttctaagtttggtggaattatggttgtgaattattaccccaagactaagccacagaaccgttggggtaagttcatccaagccttcaaaccttga

SEQ ID NO: 77683 - DNA, 228 bp, Glycine max
  Peptide Sequence Number=SeqID_169368
atggatacacataaaagagagctgaaacttgagtgcaagatctacaatcttctttgcgaacttttcgttggagaaagactccaagctagtgcttcaagcccttctcaaacttcctctgcacgtgaggataatgaagaagaagctacagtggggaagaaattgaaaaggttagggtttgagaaaaagaaagggaatgaggaagaacctgttgcggaccattgcaactag

SEQ ID NO: 77684 - DNA, 327 bp, Glycine max
  Peptide Sequence Number=SeqID_169369
atggctttagcctcctcacttcccttcctatccattttcctcccaagacgccaaccaaagactgttaatggtgccaacttcatggccaaggatattggatttgaaaacacagcagggtccgcgaaaaaacaagcagtggcacttttagtaagagcaaaccaagctgtgttctacaattgccaaatggacggtttccaagacaccctttttgcacaatctcaacgccaattctaccgtgattgcagcatcagtggcaccattgactcagtggcaccattgactttatctttggagacgcctttggagtgttccaaaactgcaaactaa

SEQ ID NO: 77685 - DNA, 1947 bp, Glycine max
  Peptide Sequence Number=SeqID_169370
atggtgagaatagtgatgtgggtcagtgacagtattaaccaagaggtgttgagatcgaagagggtcctttgtgaccaagtggtcaatagtttgatcctctctgcttccattcttaaacaaaaaagtgaatttcagcacaaagttggtgtttgtgcattgcccgtgcttgatgacctatgttgtaggcatgttagagatatgaaaccaatcatacagcaggatcataaagatgggccatcagtccaacctgaagaaagtggtccctgtgcagttaccgatgaagaaaatgatcaattctggggtttggacgacatcccagttgaagaaaagaattccttggatggtacaacaggcaaagaagtgaatttggaacactttataaaacctcctgcaaatctagttgttcttgaaggtgactgcttggatgctggtggtgatggaggggaattggagtcttttctgttgtccaccacagacctgtaccaggattttattttattggacacatctgatgctgttgcagttcatgagtttttgaagggcagcaaagctgccacaactcaaaatgatgctaatagaggaacctcagctcgtaaaagctttcattctccaggacatactggtggaagtgctcgtagattatccgctgctaagaatcagggtgctaacaactgcacccctaaacttaattgtggttttgatgatgaaaatgtccggcccagttctcctgcttctgctggtcttgatgacttcaattacggatttgatatggatcatggatgtgatgcatctagagattcagacaattcagatgaagataatgatgatccatggaaacctttaaatcctcatgaaccaggcaacttgagggtgaagccattcagaaaattgaacactttaaaaaagaatagcatcaatgtgagacaaccagtttctatgaacaccttgtttccgcttgcaaaattgcatggtcctatcagtccagagctcatggaaatgtgggagatgcgacatcatgtccatgaacgacaaagggattctctagctctattatatgagaagctgaggcaatctcttgttaatgaggggaataaaactggtggcacattttttaactctgaagctgacaatgatgacaacgaatatgatggtggaaatcctgattttgatacgccagacaatgcttacatggaagaagatctacctcctttcagtaatgagcatgaatttgatgatgctcatatcaaccctgatgaagctgtagatctttctcaggctagtttggaagatctttgccgctctcacctgaatgctctcttagcaagcattgctgaaactgagaagcaaactgaaatggctgctagggtttcaacatggaaacaaagaattgagaacaacttggaagaacaggaatcacatccaccatttgatatccaagactatggtgagagaattcttgacaagttctccctgctttcccttgaagcaagcagtagtggtgtcctatccttttctgatttggtgaagggtcaagaaaagcatgatgtggcccgaagtttctcttcccttcttcaactggtaaacaacggagatgtaactttagaaagaaatggagttgatgggtctgtctgctgcacatccgttgatccctttcatgttaggctccttaagcaaagcagtaaggaaggcgacaatgcacagcttcgtttgccaaaaaagagagcaaagtctccaacaaaaaaaccctccacaaaaggtgacaagaacaaaactgtaagagaaaagtctccctcgtcttctagatatggatcaactggggtgtcaccaccaacaaattgcaagttttctgtaaagcttggaaaggtgagtgccatgaagtcccccgaagccaaaagaagacgtagatctcagtatgtggaaccagttaatttgcattcagcagggtga

SEQ ID NO: 77686 - DNA, 2244 bp, Glycine max
  Peptide Sequence Number=SeqID_169371
atgcccgctaccagtgtgagggagagggtgctagacaccctctctaggtaccgcaacgagttcatctctcttctctccaggtatgttgctgggggcaaaggaatactacaaccacatgacctgctgtacgaggtagaaaagcttcttgaagaggatgaagggatgcagaaactcaaagatagcccttttgaagcaatagttctgcctccttttgtgtctatagctttgcgtccaagacctggtgtttgggagtatgttcgtgttgatgcatttgaactcagtgtggataatctgagtgttgcagaatatctccgactcaaagaagaacttgtagatggacaactacaaggattgggatttgagagaggttggggtgatacagcagagagggtgtcagaaatggtgcatcttctcctagaaatccttcaagctcctgatccaaacaccttagagtcatttctaggaagaattcctatggtgttcaatgtcgtagttgtatcaccccatggttactttggccaagcaaatatcctgggtttgcctgatactggaggacaggactcgggttcaagtcctgggcatgcaactgtgttgaatacttggagagaaagctttgctgcccatagtggtcctatccggctcgaacaggattgtctccgtaatactgtcactcatgatggacagcttgtttatatacttgatcaagtacgtgctttggaaaatgaaatgctgatcaaaattcaaaaacaaggacttgatgtgtctccaaaaattctaatcgttactagattgataccagaggcaaaagggacaacatgcaatcagagactggaaagagttagtggaactgaacactcatacatactgcgagtaccttttagaactaagaatgggattttgagaaaatggatttcaaggtttgacatgtggccttatctagagacatttgcagaggatgcatcacacgaaattgcgggtgagttacaaggaattccagatctgataattggcaactgcagtgatggaaatcttgttgcaaccttgttatcttataagctaggaatcacacagtgcaacatagctcatgccttggagaagactaagcatcctgattctgatatatattggaaaaaatatgaagacaagtaccattttacttgtcaattcacagctgaccttattgcaatgaacaatgcagattttataatcactagtacataccaagaaattgcaggaagcaagaataatgttggacaatatgagagctacactgccttcactcttccaggactgtatcgtgttgttcatggcattgatgtttttgatcccaagtttaatatcgtgtctcctggtgcggacatgtgcatatattttccatactcggacagagaaaggagactaacttctctacatggttcaattgaaaaactggtatatggtgctgaacagaatgaagagcacataggcttgttaaatgatagatcaaagccaattatcttttctatggcaagaattgatccagtgaaaaatataacagggcttgttgaatgctttggtaaaagctccaagctgagagagcttgtgaatcttgtggtagttggtggctacattgatgtacagaagtctacggacatagaagaaatgagggagatagagaaaatgcacaatctcatagaagaatacaacttacatggccaattccgttggataaaggcccaaatgaatcgcgctcgtaatggagagctctaccgttatattgctgatgtgaaaggtgcttttgtgcagcctgctctttatgaagcgtttggcctaacagttgtggaagcaatgacatgtggtcttcctacatttgccacttgtcatggtggcccagctgagataattgaacatggcgtttctggatttcatattgagccacatcacccggatcatgttgctgcaattttaattaacttttttgagcaatgccagagtgatcctggctactggaacaagatttctgatgcagggcttaggcgcattcatgagaggtctacttttgctaggtatacatggaagatatactctgagagactattgactttagctggtgtgtatggcttctggaagcatgtgtctaagcttgagaagagagaaactaggaggtacttggagatgttttacattctcaagttcagggatttggtaagccatatttccctcaacaatttttgtgttcaacctttatgcctttcactttattag

SEQ ID NO: 77687 - DNA, 654 bp, Glycine max
  Peptide Sequence Number=SeqID_169372
atggctgatgtaaatgacggaaattgtgctaatggagggaaggaaggcaatgtggttaacccaccggagcgcaccttgcaggactatctcaccccatggtgggaatcactaccattgcatggcttgtcatttgaagatcttgttcttcatctgaagaaattcctgaggctcaaacacaataaagagcccaactacaactcgagactacatcagtttgcctacttttttgttagggaaaagcttaagaccggcatttggacttaccaaactggagcattaccacctaggactagtgttcaatgcaattcttgcaaaaattcttcccagtggcaaagcttgcaaatgaattgttcgcaccatggctactcatcacaaaggctagtccacattttctatggagggctatcacaacataacaagacctgcctcgatgttgctgcaaaggaaaacctcatgcataaattaaccaatgcaacagtagaaattattgaggccatggtttcaaatgcctataacggtattggagatacgaggattctcaagaggccaactggagtgcacttggtggaagccagttcatctagcatagctattcatcaaaagttggatgttctagctaagcaaatggagaccttgacgaaggcacaaatttag

SEQ ID NO: 77688 - DNA, 507 bp, Glycine max
  Peptide Sequence Number=SeqID_169373
atggcgatgagcgttgcaaggctgaagaaggatgagatccagaggctaaagaaggagatcgattcggtctggcgtccggcgatggagctgcatgagttagagacaagtgcgagacgagtgcagcaacaccaccatcaccatcgccgctgttattcaaaccctaaccctcctcaccctcaccctcagcctgctttgctcgtctttttcgatgggaccgccttcaacaacatcgtcgaggagttcaagaatttcaccacccacatcgctcacgttctccccgttttcgacgatggaggaagcactgctaagattgtggtttgccctagagattggagaaacttaatagtattgggtgacaatggattttttctttgttacatttatcaaggtggtaacactatattttttgaggtagcagtggatggaactcttgcaatagtggatggcttaaggtggggaggctcaacaacgatggatggacctaagctcattctaaaattattatag

SEQ ID NO: 77689 - DNA, 288 bp, Glycine max
  Peptide Sequence Number=SeqID_169374
atgggggaaccgccagtcaaactggcgagttcctggcaagagagcacaacctacattagctacgtgtgcaggctacgtgctgctgcaggagagacaggcgcacaggaagaactcgccattggtgcaggcgagttgcagctttggtgcagggaagaacacgccattggtgcaggcgagttgcagctttggtgcagggaagaactcgccagtttgactggcgagttgagcttcaaaattttgttttataaaacgcgagacatgggacttctgttaggacaacacaagtaa

SEQ ID NO: 77690 - DNA, 1086 bp, Glycine max
  Peptide Sequence Number=SeqID_169375
atggaaggtaacaaggacgaagcattacgctgcgttcgcatcgccgaagaagcaatcgcgtcgggaaacaaagaccgcgccctcaaattcctcagaatcgcgcaacgcctcaaccgcgatttgcccctccagtccctgctcgaaaagtgcgaccgcttcgattcgcactccgccgccgctgccgcctgcggcggcagcggcgcctctccggcgaacggtcactctccgcgtcgcgagggtttgaacggggagaggaattacacggaggaaaacgtgcagctaattagagaaatcaagggaaagagcgattactatgcgattctgggattggaaaagagttgctccgtggaagagattcgaagagcgtatcggaagctctctctgaaggttcatcccgataagaacaaagctccaggctccgaagatgcgttcaagaaggtttcgaaggcgttcaagtgtttgagcgacgacggctcaagaaggatgtacgaccaaaccggaaccggcaccgacgattatgagagcaccgaggtaaacaccttctggcgaagaagaagaagaaggacgacgacaacgcgcgatttcttcggagacgagttcgatccggacgagatattcagggcgttcttcggacactccgacgtgttcgggagaaacaacaatgtttaccggacacgcgggatggggaatccgaatcatcagcataggcacgaattcaatgctggatcgggagggaggcatcacaatgtgatgcttctgattcagctcttgccgtttttgattattgtgctgctcgcgtacttgccgttttcggagcctgagtattcgttacacaagcactacaactaccagattcccaagaccacggagcggctcgaggttcagttctttgtgaagtcgaccgcgtttgatgcgaattatccactagggagtgatgcccgtgaggcgattgaggagagtgttataaaggattataggagtatgctgaggagatactgtcaggtggagatgcagagacggagctggaataggaatctgcctgctcctcactgtgataagctgcataactttgcagtcgtggcatga

SEQ ID NO: 77691 - DNA, 1374 bp, Glycine max
  Peptide Sequence Number=SeqID_169376
atgccgcagggcaatgccgccgccgcagcagcgctgctggaccacggcggcgatgccggcgacgccgtaatggcgcggtggttgcagtccgctggcctgcagcatctagcctctcccctcgcttccaccgccatcgatcatcgcctcctccctaaccttctcatgcagggttatggagcacagtctactgaggagaagcagaggcttttaaagttaatgagaaacctcaattttaatggggaatctggttcggagccatatacacccaccactcaatctttaggtgtggctgggtcggatgggttttattctcctgagttcaggggggagtttggagctgggcttttggatcttcatgctatggatgatacagagcttttgtctgagcatgtagtttcagaaccttttgagccatcacccttcatgcctggagatactagagtatttgaagacgatttcgatccaattaacagcaagctggaaagcggggaagcagatactgatgcatcaatttccttacctatgaatagcacaagggaaaataatgttgctaagattaaagttgtggtacgcaaaaggcctttaaacaagaaggagcttgctaagaaggaggatgatgttgtaaccgtaactggcaatgcatatttgacagtccatgaaccgaaactaaaggttgatttgacagcttatgtggagaagcatgagttttgttttgatgctgtgcttgatgagcatgtgaccaatgatgaagtataccgaagcacagttgaaccaattattcctacaatatttgagcgaaccaaagctacctgtttcgcttatggtcagacaggaagtggcaaaacatacacaatgcaacctttaccactcagagctgcagaagaccttgttcgacagttgcatcagccagtttaccgggatcagagatttaaattgtggcttagctactttgagatatatggtggaaaactttatgatcttcttagtgacagaaagtgggtattcaatcttttatatgactacgttgggaaactttgcatgagggaagatggacggcagcaagtttgtattgtaggactgcaagaatttgaagtttgtgatgtactaattgtcaaagaattcattgaaaagggaagtgctgcaagaagtacaggatccactggtgctaatgaggagtcctccaggtcacatgctatcttgcaactggctgtaaagaagcacagtgaagttaaagcgagcaagcgaaacaatgatgggaatgaggcaagaagtgggaaggttgtgggaaaaatttcttttattgatcttgctggaagtgaacgaggtgctgacactactgataacgatcgtcagacacggtacttttacatctaa

SEQ ID NO: 77692 - DNA, 402 bp, Glycine max
  Peptide Sequence Number=SeqID_169377
atggcttcctttggacctattttctccttctctgggactccaaccatcacgactactaaactaaactggaaaaattacccctcgaggtctgcttccgtggaactttggtttctcggtcaaggacatcatgaccacttggagaaagcttccgattccgttccaaatgacaaaagacctgaatgggagaagtttgactatcaactctgcactgtgttatcatttaaaacgtgtcgttctttttggaagaaggcccaggaaatttttgccaatgatatccaaagcttgtttgatgcaaccatgaaggttacagccctcaagcaaaccagccatgacatgattgctcatgtgggtaaggctcgggctgccgtggaagagctaagaaagttccttgtggctgattga

SEQ ID NO: 77693 - DNA, 261 bp, Glycine max
  Peptide Sequence Number=SeqID_169378
atgaaggaggggtctcgggttcagagatttgaaagccctcttgggaaagcaagcctttggtcaggaaaagctcttgttatggaaggttcacggtggagggtgggaaggacctgtggcttcgtaacaaggaatcccttttatgtgcgtcctcgagctgaaggtataccgctagacatcatggtaggaaaccttatagatcatgatgaggtttgtgaaattctcagaattccattagatgataagcctaagaggacaagttga

SEQ ID NO: 77694 - DNA, 336 bp, Glycine max
  Peptide Sequence Number=SeqID_169379
atggcaccatcatcaacgttaacactctccaaagtctctttgttgctcttctttttgtcactttcttcttcctatgcaacttctcgcctcagccatgaccatgtcaacccaccaaaatcacgagcagaaaagctcattagaagccttaacctatttccaaagaacccaataaacattgttaaaggtgatggccttgctaatgcttttgtctcagggaatatcgtggagaagaagttctcgtttcttggtgattctggaccttcaattgaagaccttggtcaccatgcaggttacttttcacttcctaattccaaagctgcaaggggtgaaaattag

SEQ ID NO: 77695 - DNA, 684 bp, Glycine max
  Peptide Sequence Number=SeqID_169380
atggaggattcggcggcgcagaagaggaagcagcaagagtttgctctagcgtcggtttccgaggtgtcttcggctccttcttctgcttcgccgggggttgctctctttgctggtgaccgtcttcaaattaggaacgaatctcaccgtgttgctctcaatgcacacctttcagatattcagctattcagattaggtcctattgaatcggtttgcatggtggaagggtctgaggctgacaaacagacatcgtattccagtggagtcgctatacagtttagaaatgaggaagagagtgaggccttccattgtgtattccaacaatggaagaagggattcgatgttcaaggaggaaacttacctaatggaactgatgtaataacttctaaaagcaaatttgatgaaaagatagagccatcttctgcaaaaatgtattttcattattacggacaacttctgcatcagcaaaatatgttgcaggactatgtgaggacaggaacctattatgctgcagttcttgagaatcgtgcagatttcgtaggtcgtgtagtagttgatgttggtgctggtagcggcattttgtcactatttgctgcccagttaaatgaaaattctgggtgtttcccctgccctttacttccaaaacttagtatgaaatcttcctcagacccaaaactggacccatga

SEQ ID NO: 77696 - DNA, 543 bp, Glycine max
  Peptide Sequence Number=SeqID_169381
atgggttctttcaaaacagaaccccatgtgcattacatcaaggaagatgaaaatggttatcattatgcagtagtggatgtggatacttggttatatttcgaggcagttggtatgacgaaggatgatttagggtacaaaaatggaaatttcaaattgtggtggaaagaaaatggggtagattttcaggaaggctggaaagagatatacaatgatatggaggctctgaatttatccaattatgcagccaatattgggcttgtggtgcatatttatgtccaacaccttcccccaactcatggcggacaagatgttgtgtcaattgttgttaacagcattgatggtttcattcgaagtgaacctgattttgtggctaaaccaattgagaatggtggttttaaggaaatcaaaagtggaaaaggaaaagatgatgaagactttgtttcaaattcagaacatgctagtgaggaagaatcactatgtgccagtgatgtagaaaaggaggctgaagataacaaccgtgtgtcatggaggattccagtttaa

SEQ ID NO: 77697 - DNA, 513 bp, Glycine max
  Peptide Sequence Number=SeqID_169382
atggcttctcaaatcttgcatgacacaaagaaatcccaagctaggcgagcattacgttctctagcaataggcattgcagttcccttcactctcacattggccataatcatcatctttggttccggacgcaagtataaccaaattatatccaaaccattttggttttcaccactttggttcattcacttggccacattgggttcatctttcttcatgggtctcgcgatgtggctagtatgggctgatggaggatttcaaggagaaactgatgcaatgtctctctacatagtccatgtctctctaagtatcgtgtggcatcctcttgtgcttgttatgggtgtttattggcttgctttaatttcttgccttgtgaattttggaaccctctttttatgctacttgaggtttagaaaggtgaatccttttgccagagatctagccaaaccatgcttgacatggactgcgtacctttgtctgattatcaatgatcttaggcacaggaaaaatgtgtaa

SEQ ID NO: 77698 - DNA, 801 bp, Glycine max
  Peptide Sequence Number=SeqID_169383
atggatttcttaaaccaggagatgagcatgcttagccctgaaggtgaacttaaaataagttttggctatcaatgcaatagcgagagtgcaaatgctacacttgccaacacaaacatctgcaatggtgtaataggagaagacaaatccttccgattttggactctcctaaatcatttcgtaggcccatccactccaagtaatatgcttgaatatgacccttgtacgttcacgtccatgagtgctccttccagaagtgaaggttttcttaatggcatggaagttccagttgctggaggagctgctggtgaagatagagttcaagcagtttgttctgaagatgagtggcttttctgtgaaatttatgatgattccataaaagcttctaacattgcgagtatgggtggatcctttcaatataattttgatgatagtcttaatcttcaggagcatcaatctctgtcatcatttaagggaagcgattccagtcttgactgtttcacagacagtactccacattccaattcagaagcatctcctaaatcattttcacaaactacagtacttaatggcctccaacatgttcttagtcaggttgagaatgatttccttcacactgttgacaatgaagctgaaagagctcgacttctttctgatcatcctgatgatcctaaagccatagtagcagggaaagtgaagggaaaactgaaggttaaacgagctttaggagcgggctacttgaaaaaggcctacactccgaagagtctgtcagggtttctccctcccgatttaggtccaacctag

SEQ ID NO: 77699 - DNA, 264 bp, Glycine max
  Peptide Sequence Number=SeqID_169384
atgcgtgtgtttgagggaaggaaggagagggacaatggaacttggagtgtgatgattaagctgtatgcgttggaagtgttgggtttgtttcggagaatgcagagcgaaggcctggccagtcttaaccatggcaggcaggtgcatgcccagttgatggcatctgaattttatcagggtttatatgttgcctcggtcttgattacgatgtatgctaagtgtggcgatcttgttattcccagcatggctagggagaggaagctttga

SEQ ID NO: 77700 - DNA, 129 bp, Glycine max
  Peptide Sequence Number=SeqID_169385
aaatgtgataactcactctcggtttgttgtttgtgtttggatcctgtgatgatcttgagctttgtgttcgggggagcagatgaatatgaagaacctcatgctagaggacacgggaacaccacgttctga

SEQ ID NO: 77701 - DNA, 450 bp, Glycine max
  Peptide Sequence Number=SeqID_169386
atggtttccccacacaaagctccaaacatgtcacttattacctttacttcgattgatttcaaagcaatagacctagatcaagatgattctgttgtaataagtgtagaaatcacaagctttatagtgagaaagacacttattgaccaagggagtttggctgatatcttattctggaacattttcaagcagttggtgtacacccctcacttggctataaagttccccttgaatactggatacatcataacaattcatgtcgaccaaagaacaactagagaatgctatatggaaagtctcaagctaggccccttaatgaaagatgagccatgtcgagttgtgcactatgtggagattatggcagggatcgaagggtttgaggagctagatctggacccaagaactaatactgacaatagggttaaaccatatgaagaaacatgtgccttttag

SEQ ID NO: 77702 - DNA, 318 bp, Glycine max
  Peptide Sequence Number=SeqID_169387
atgaaggtgctggagaaatgtgctattgatgttgaggcttcaaacaagtttaataagaaggaggttatgagattggagtctgctttgggtactactgagaaggaaagagatgccaaaatagaggagaaaatttggattaagcagaaaacatataacgaagtttacaaagctcatgatttcgaattcaatcactacctcctaaaacggggcactagatggtgggcaaccaactacctccctggcgaaacccaaatggctaatcccggcgaggatgatgttttatcttcttctatcgggtccatcctgatctggttctag

SEQ ID NO: 77703 - DNA, 174 bp, Glycine max
  Peptide Sequence Number=SeqID_169388
atgtcgctttctttaagacgtttcatggcactgccaaaaattgtgcaagcagactatcaacaacgacgtccccaggataaaacagctcagatcactagagagaggagtgaaaaagttgtagacattgagaaaaatggaaggaaagaggaaatgctaaaagcagaggaagaataa

SEQ ID NO: 77704 - DNA, 798 bp, Glycine max
  Peptide Sequence Number=SeqID_169389
atggactccgattcctggatttccacgcgcctctcttcctcttcacgccgccaccattatcgatctgatctgtacgcggaggagagtgaagggaacgatgatttcagggcggagtttctatgccctttctgcgccgaggattacgacgtcgtttccctctgttgccacattgacgaccaccaccctatccaagccaaaaacggggtgtgtcccatttgtgggaagaaggtgggagtggatctcgttggacattttactacacaacatgggaacttcttgaggatatcctttttgcaagttgttattctagtgatttcagcattgttaactataacttacgtgcagcgcaaaaggagggtcaggaaaggaggctctgcttcaacaatttctatattgagaaaagagttacaagaaggagccttgcagtcccttcttggaggttcttcatacttagcttcctcaaattccgagcccgatcctctgttatcatcatttatgtttaacccagttgtagctgatgagtctgtgagtgcaacacctccttccactgaagatgctctagtaaaagaaagttcaaaagacgatttcttgaaaagattcgagaacttcttgtctgacaatggtatgatgtatggttacagaaaacctcagcagttacagctatcagaagaggatcaagtagagaaggctcggagctcatatgccaatgttgaaagagctggagctgttttgtcttcaagattttattcgatgatccaaatacataaaaagggtgagacggctggagtgtcaatttga

SEQ ID NO: 77705 - DNA, 496 bp, Glycine max
  Peptide Sequence Number=SeqID_169390
atggaaatatcctcattccatcaattccccgatgaatcactcaacgagctagtgcaattaaacatcttcttagatggcctgcgaccacagtcaaagcaactccttgacgcattcgcaggggaaaaaatcaagatgaagacactagaggaggcaatggagctgatagagaacatggcggccaatgatcatgccatccttcatgatcgagcatacacgccaacaaagagaagtcttttggaactcacagctcaagatgcaacactagcccaaaacaacctttccgatcttgtcgatcttcaactaggagcacatgatctcacctctaaggtcgtcgatctcgaaggtgaaagatctcatcgaggaaggggtggccctgccaaatatggttcaaagtgtcatggtcgtgacatggcggaggtgcttagtatggtgttcgacgatcacagagaaagaagtgaaggaccccgttggggaaagagtggtgtcatttatggtg

SEQ ID NO: 77706 - DNA, 396 bp, Glycine max
  Peptide Sequence Number=SeqID_169391
atgagactaattcatcatcctctcgtagcagacgcagtgacaatttatcgcagctgcgaagagacgtgtagattgaacgagaatggaaacctgaatgtgcctgtagagaaaactgatacattctgccaaggaccatgtttgtcagagacaaacttggtcctcaattgcctggacaacgttttcagcaacttcatattttacaacagggcaaccatacaagacatcagagaaacaattgaagctggatgtggctatggccgtcaaagaggaaacttcaatgtggctgagcacattcagagagaagaaagcaaagccccaaaggctactagccatgttgtaatgggacttgctattgtcatgatgggacgcgctctattgcctctgaattttacatga

SEQ ID NO: 77707 - DNA, 918 bp, Glycine max
  Peptide Sequence Number=SeqID_169392
atgggaaactttcaaagtagcaacaattactccgagatgttttcgctggacagttcatccgtggtgttcgtacgcaaaagcaagagccccaaagggcgtgaagttgtggacacttggagtgcagattacttcttattcggaagagcaagctgcgaactcgaactaaccaaaaccaaccccaagaatcacagagaagagttgtccatctcaatccacgaccacgcatccaaccacacaaacgacaacgtctactttcaggtgaaaatgagtgtcgaagagggtcttcttctagcaagctccaccctaaacggaccaagaagcatgcagcgacttcccgagagaaaaaaccctatttcgcaaggtggtggggttctcaagtcctcctccttcttgtatggacgagacactgacagaaagtgccttatcgtcattttgagggaaaagagaagcgatgacgatgaagagcttccttacatgatcaccgtgaagcactattttgtggcggcgtgttgttctcatggtgtctcttttgtggcaaagattcgcagcagcgatggaggtttgagtgttgagcttgggaagccttctattcggcccaaaggatccttgttgtccatgtttgatgatgtcaaagggaaagggtggtgccctgatcccatcgagccaattcccagccaaaacaagaatcctacaattgctaatattaatcctggcctccaaaacctccccatcgccgttattggcaatggaggatactttaaaggcaatgcggtaaagttgtgccttggtgacttgttggtcatgggttcgaatccggaaacagcctctttgcatatgcagggtaaggctgcgtacaatatccctcccccataccttcgcataacgaagagcctctgggcaatggggtacgaagtttga

SEQ ID NO: 77708 - DNA, 171 bp, Glycine max
  Peptide Sequence Number=SeqID_169393
atgcaaaccaatcatcgtcatgagcctctagatcagtctatagggacatgtctatcccacttcatcatctacaccaacagcagaccgatcgatgatcatcatcatgagcctccagatcggtctacagggaccatgtctacccgaccatggtatggttcctccaatgagtga

SEQ ID NO: 77709 - DNA, 1786 bp, Glycine max
  Peptide Sequence Number=SeqID_169394
atggctttgcagaagtatgctccttctggcaatgcaccttctgttaatatgaaacatttgagcttctccagtaaggtgcctaagaaagctgagctcgatgaagcaaatctgaatcacaacatggatgtggatattgaccttagggaaatttattttctcattatgcactttctttctgctgggccatgtcataaaactcatttacagttttggaatgagcttcttgagcatcaacttttgcctagaaggtatcatgcttggtattcaaggactggggcatgtagtggagacaaagatgatgatgcctccccatcactgggtatgaatcttggaaatgctccaaatgcagctgatgtacctactcttctaggaagcgatgatagggacaaaatgaaagaagtcaaatggccgcctcctcatatgcgctggcctcatatgaaagccaatcaggttcatgggcttaatttgagggaaattgggggtggtttcccaagacaccaccgtgcaccatctatacgtgctgcatgctatgccattgcaaaaccttctaccatggtgcaaaagatgcaaaatatcaagaggttaagaggacatcgcaatgctgtctattgtgctatatttgatcgggcaggaagatatgtgattactggttccgatgaccgacttgtaaaaatttggtcaatggaaactgcatattgtttggccagttgccgtggacatgatggtgacatcactgacttggctgtgagttcaaacaatgctttagttgcatcctcatcaaatgactgtgtcattcgagttgtaagctttcatttgaccgagcaatggcgcttgccagatggcttgccaatatcagttttgcggggacatactggagctgttacagccatagcatttagtcccagaccgaatgcttcaatgcacgtgattgtgctacgatcgtggggtggcgaagcagagtggccccttgccactcctaaggcactcgctgcggcatgcttggttgttgcagtgccattcatggaacaaattgcagaaaatcagggctgtgacatttgctgtccctggaaaagcgtctgcaacctcccatcttccatccccttctcttccacaggggtggtgctagctaacctagcaactgatggttcctctgatgatggaacttgtaggatatgggatgcaaggtatacccagtcaagtccaagattatatgttccaaggccttctgattctgtaattgggaagagcaatggcccatcttcaagtactgtaccacagagccatcagattttttgctgtgcatttaatgctaatggaactgtctttgtaactggtagctctgacaatcttgctagggtgtggaatgcttgtaaacttagtatggatgacactggccaacccgttcatgagatagatgtgctatctgggcatgaaaatgatgtgaattatgtgcaattcagtggatgtgcagtagcatctcggttttccacagcagaaacttggaaggaggaaaatattcccaaatttaaaaattcctggttgaatcatgacaacatagttacctgctctcgagatgggagtgctattatatggattcctaaatcacgaaggtcacatggaaaaagtggtcgctggacccgagcatatcatctgagagttccacctccacctatgcctcctcaacctcaaagaggtggtcctcgtcagagaattctaccaactccacgcggtgtaaatatgattgtttggagccttgacaaccgctttgtccttgcagctattatgg

SEQ ID NO: 77710 - DNA, 967 bp, Glycine max
  Peptide Sequence Number=SeqID_169395
atggcttctctcttcgccagaaccaagtggttctcgttgcctactctcctgcttcttctggagctattcacaataaaccttagcactgcagatgctcaaattggggtgtgttatggcatgattggcgacaatctaccaccggcaaacgaagttgtaccacttagaaattcgggcattgagcttactcttggggtgctccagcaagaccttcaaggccttgccaccaatgcctccattgctcaacaatgggtgcaaagtaacgtgttgaacttttggcctagtgtcaaaatcaagtacgtggtagttggcaatgaaattgatcctgttggaagttcttctcagtttgcccaatatgttctacctgcaatccaaaacacataccaagctataagggctcaaggccttcatgatctaatcaaggttacaacagctattagcatggacctattaggaaactcctataccccatcacaaaactacttcaagcctgatgtgaggtcatacatagaccccataattgggtacttgtttcctatgctcttttcaacaaatgttgtggtttgggatggtcaatatgggtaccaaaatttgtttgatgctacgttggatgcagtgcttgttgcaattgataacacagggattggttatgtggagggggttcataggattaatcatctgagaaatggcaccgtgattttgaacgttgatggaagtagagccttagtaaccctagaagattggcaaaccgccagtcaaactggcgagttcactgacagtgaagaagctgccatccccattggcgatttcgccatgcatgggggaaccgccagtcagactggcgagttcgtggcaggagaaggcagagggccaggctacgttgtagggctacgtcacaggggtgcaagtgaacgttgcagggatgcaagaatcgtcattggtgctggcgggttgcaggaagaactcgcca

SEQ ID NO: 77711 - DNA, 1014 bp, Glycine max
  Peptide Sequence Number=SeqID_169396
atgccttctctcttcgctagaaaccagaggttctcattggctactctcctgcttcttctggaactattgacaggaaaccttcgcatggcagatgctcaaattggtgtgtgttatggcatgctgggcaacaatctaccgtcagcaaacgatgttataggtctttatagatcaaataacataaagagaatgagactctatgatcctaatcaagctgctctagaagcacttagaaattctggcattgaactcattcttggggtgccaaactctgaccttcaaggccttgccaccaatcctgacacttctcgtcaatgggtgcaaaaaaacgtgttgaacttttggcctagtgtcaaaatcaagtacgtggcagttggaaatgaagtgagtcccgttggaggctcttcttcggtagcccaatatgttctacctgccatccaaaatgtataccaagcaataagagctcaaggccttcatgatcaaatcaaggtttcaacatctattgacatgaccctaataggaaactctttccctccatcgcaaggttccttcaggggtgatgtgagatcatacctagatcccataattgggtacttggtatatgcaaatgcaccattactagtcaatgtgtacccttattttagttacactggtaacccccgtgacatatcacttccctatgctcttttcacagcaccaaatgttgtggtatgggatggtcaatatgggtaccaaaatttgtttgatgctatgttggattcagtacatgcagccattgataacactaagattggttatgtggaggttgttgtatccgagagtgggtggccatcagatggaggatttgctgccacttatgacaacgcacgcgtgtacttagacaatttggttcgtcgtgctaatagaggaagcccaagaaggccttcgaagcccactgagacttatatatttgccatgctagggaaagttgttattgacgacttcaatgcaacaacttccattaagagtgatgtgtaa

SEQ ID NO: 77712 - DNA, 360 bp, Glycine max
  Peptide Sequence Number=SeqID_169397
atgctgctagaagtccaaaattatgaccttggtgtagctgatgagcgaactgtctgtggcaaaggaagggagcggcgttgtggtagttgtccattaggaggaaggtcaagcggtggtagaatgtcaggtcgatcgaatcatggtactataaactcattcaataaccatggcaacgggaaccagaatttcgctggtgcaacgatcaacagtggtgcaaactctggcaatcgtaatagttatagcactgccaactactatggtggtcacacgataaataacagtggtactttcaatgggaatggaaatggaagctttatcaagggtggttttaactcttccaccatgaactactaccgttaa

SEQ ID NO: 77713 - DNA, 252 bp, Glycine max
  Peptide Sequence Number=SeqID_169398
atggcattgacaagtcaattgagaaaccttcttgcagctctagaggctgaggaagcagcccaaaaatccaaaggtaaaaacatcactggcactaagaccaacagtggtgcatattctggtgatggtaacactcatcacgccaccaacaactacggtggtggtcctgctataaataatagtggcaatttccagggacatggcaatggaggctttattggtggtaatttcgatgcctcaacgaggaactactga

SEQ ID NO: 77714 - DNA, 855 bp, Glycine max
  Peptide Sequence Number=SeqID_169399
atggttccactatgtgaccaaacaagggacaagccacactcaaactcaactactcctttagcctcacttgaaatcttgaacaactatggcaagggcttcaagaggttacgcaatgatgatgtggctatggccaccacaaatgaagagtcagaatctttgcctttcttggaaactcacccttttggtatttacttttctgggctctctgatgaggagaaagaggatgcgaaacttgctgagttcctcttggcttctgctgagaaagttggccagcaacactttgaacaggcacttcgcctgaggatggatagagcaacaggaagagtttcatgcaaggatttgcaaaagggtccttcatttgatcctctagaggcagccaaggtactaaaccccactgttgttgcattttatgaagaacttcccttttgtcaaatttcagtgttcacagaagttcaagatataatagaagatgttgctgaagcaaagaagattcatgttattgatcttgaaatcaaaaagggagggcagtggactatcctaatgcaagcccttgagtcaaggcatgaatgtccaattgagcttctgaagataaccgctgtagaaagtggaaccactggacacatagctgaggacactggtaagagactaaaggattatgctcaaggtttgaacttaccattctctttcaacattgttatggtctcggatatgttgcatctaggagatgtttttgagattgatgctgaggaaataattgctgtctattctcactttgcacttagaaccaagattctagaatcagaccagcttgaaataatgatgagagtgattagaaccttgagtcctatagtgtga

SEQ ID NO: 77715 - DNA, 495 bp, Glycine max
  Peptide Sequence Number=SeqID_169400
atggcaggtgcaagaagattgggcgtggctgttgatttctcagcatgcagcatcaaagcactgaattggacggtggataacgtcgtcagagaaggagacaacctcatcctcatcatcgttcgcaatgctcatggttacgagcacggtgagatgcagctctgggaaaccactggctcacctctgatacctctggctgagttctctgaccctgtgctcatgaagagatatgaactgaaaccagcacctgaagtaattgatattgtgtcaactgctgccaagcaaaagaatattgtggtgctaatgaagatctattggggagatgctcgtgagaggttatgcgaagcaattgatcatgtacctttagactaccttaccttagggaacagaggccttggcacgctccaaagggttataatgggtagcgtcagcaactatgtagtgaataatgccacctgtcctgtcactgtggtgaagagttcagtccacaactattag

SEQ ID NO: 77716 - DNA, 93 bp, Glycine max
  Peptide Sequence Number=SeqID_169401
atgaaaaaacgagaactagaacaaaaggttgtgggaggtggaaccatggtggtggtggttggaggagaggctttacaggtgggtggattataa

SEQ ID NO: 77717 - DNA, 273 bp, Glycine max
  Peptide Sequence Number=SeqID_169402
atggccactggacaactattctcccgtactacacaatctttattttacaactacaagcaactttacatccagaggatgcttgattttgacttcctttgtggcagggaaacaccatcagtttctggaataattagccctggttctgagggatttcaaaaacttttttttggtcaggaggaaattgccatcccagttcatgctaccattgaagcagcttgtgctgcacatcctactgctgatgtcttcatcaactttgcttcatttagaaggtga

SEQ ID NO: 77718 - DNA, 3450 bp, Glycine max
  Peptide Sequence Number=SeqID_169403
atggcttcagcaagcggagcggagaattcctccgtcccgccgtcgccgttgccgcctccgccgccgccgcaaatccacacctcgcggacgaagctgagccaccaccaccacaacaacaacaacaacaacaacaacaacatcgactccacgagcaaggccatcgcgcagtacacggaggacgcgcggctccacgccgtctttgagcagtccggcgagtccgggaggtcctttgactactcccaatcaatccgcgtcacatcggaatccgtcccggagcagcagataacggcttaccttctcaaaattcagcgcggcggcttcatccagcccttcggctccatgatcgccgtcgacgagccctccttccgcatccttgcctactccgacaacgcccgtgacatgctcggcattactccacagtccgtcccttcgctcgacgacaagaacgacgccgccttcgcgctcggaaccgatatccgaaccctcttcactcactccagcgccgttctcctcgaaaaggccttctccgcgcgcgaaattagcctcatgaaccctatctggattcactccagaacctccgggaagcctttctatggaatcctccaccgaattgacgtcggaattgtcatcgatttggagcctgcgcggacggaggatcctgccctctccatcgccggagctgtccagtcgcagaagctcgcggttcgcgcgatttcgcagcttcaatctctccccggtggcgatgttaagcttctttgtgatactgttgttgagagtgtcagggaattgacagggtatgatagggttatggtttataggtttcatgaggatgagcatggggaggttgttgctgagactaagaggcctgatttggagccttacattggattgcattatcccgctactgatattcctcaggcttctaggtttttgtttaagcagaatagggttaggatgattgtggattgtcatgcttctgctgtgagggtggtgcaggatgaggctcttgtgcagcctctgtgtttggttgggtccacgctcagggcgcctcacggttgccatgctcagtatatggctaacatgggctcgactgcgtcgttggtgatggctgttattatcaatgggaatgatgaggaaggtgttggtggccgcacttcgatgaggttgtgggggcttgttgtttgccaccatacctctgctaggtgtattccttttcccttgaggtatgcttgtgagtttctgatgcaggcgtttgggctgcagttgaacatggagcttcagttggccgcacagtcgttggagaagcgggttttgaggacacagactctgttgtgtgatatgcttctcagggactctcctactggcattgtaactcagagtcctagtattatggacttggtgaagtgtgacggagctgctctttattaccaagggaactattatccgttgggtgtgactccaactgaggctcagataagggatattattgagtggttgttggcctttcatagagattcgactggtttgagtactgatagtctggctgatgctggctatcctggggctgcctcgcttggggatgcagtttgtgggatggcggttgcttatattacagagaaggattttcttttctggttcaggtcgcacacggcgaaagagatcaaatggggtggtgcaaagcatcatcctgaggacaaggatgatgggcagagaatgcatccccgttcttccttcaaggcatttttagaagtggtgaaaagccgtagcttgccgtgggagaatgcggaaatggatgcaattcactctttgcagcttattctgcgtgactcgtttaaagatgctgagcatagcaattctaaggctgttttggatccccgtatgtcggaactagagttgcaaggggtcgatgaactaagttctgtagccagagagatggttagattgatcgaaacagccactgctccaatatttgctgttgatgttgatggccgcataaatgggtggaatgcaaaggtttcagaattgacaggactcccagttgaggaggctatggggaagtccttggttcgcgatcttgtgtttaaggagtctgaagaaactgtggacaagcttctttctcgtgctttaaaaggtgaagaagataagaatgttgagataaaaatgaggacgtttggcccagaacatcaaaataaggcagtttttgtagtggtgaatgcttgctccagcaaggattatacaaataatgtagttggagtgtgctttgttggtcaggatgttactggtcaaaaaattgtgatggacaaattcatcaacatacaaggcgactacaaggctattgtacataatccaaatcctttgatccctcccatttttgcatcggatgataacacgtgttgcttagagtggaacactgcaatggaaaagcttactggttggagccgcgcggatgtcattggaaaaatgttggtgggagaggttttcggcagttgctgtcagttgaagggttcagattcaataacaaagttcatgattgtcttacacaatgcgcttggtggacatgatacagatagattccctttttcatttcttgatcggtatggcaagcatgtgcaagctttcctgactgcaaataagagggttaacatggatggtcagatcattggggcattttgctttttgcaaattgtgagtccggaacttcaacaggctctgaaggcacagagacaacaagagaagaattcatttgctaggatgaaagagttagcttatatttgtcaaggagttaagaatcctttgagtggcatacgctttacaaactctcttttggaggctacatgcttgtccaatgagcaaaaacagtttcttgagactagtgctgcttgtgagaagcaaatgttaaagataatacacgatgttgatattgaaagcattgaggatgggtccctggagcttgaaaagggggaattcttgcttggaaatgtcataaatgcagttgttagccaagtaatgctactgttaagagaaagaaatttacagttgattcgtgatattcctgaagaaatcaagacattggctgtttatggtgatcaattgaggattcaacaagtgttgtctgatttcttattgaatatagtgcgctatgcaccatctccagatggctgggtagagattcatgtacatccaagaataaaacaaatctcagatgggctcactcttctccatgctgaatttagaatggtatgtcctggtgaaggtcttcctcctgaattgattcaaaacatgttcaataacagtgggtgggggactcaagaaggtttagggctgagcatgagcaggaagattctaaagctaatgaacggcgaagtgcagtatatcagggaggcccaacggtgctacttctatgttcttcttgaactacctgtgacacggagaagctctaaaaagtgttaa

SEQ ID NO: 77719 - DNA, 219 bp, Glycine max
  Peptide Sequence Number=SeqID_169404
atggctttacgatgtgggaacaagcttgctaatatcgtggatgacaagtgccacgtaaagcttggccttgtggatcaaatcacagttgaagatacgccaccaacgacagaggtgacgacaacgatgacaacgacaaaggtgatgacaataatgattatgatggtggaaccgacaatcatgataatgatgggttgtttgatatgcgtaaggaagtcataa

SEQ ID NO: 77720 - DNA, 198 bp, Glycine max
  Peptide Sequence Number=SeqID_169405
atgttatcttgtgaatcactcaccatcactgccatagacttcaagacccctattgagttatttggatatccaacatacaatcgagtaagcgaaggtaaactggagcctagatccaagaagggattctttatggactatgaagatggagtcaaaggattccaagttgggtctccatatgaaaaaggtcattctgagtag

SEQ ID NO: 77721 - DNA, 1149 bp, Glycine max
  Peptide Sequence Number=SeqID_169406
atgtttcgagtttttatggtcttgctcttgttcaagattggcttatcaaattatgtaccagcgtcttttgttttcggggattccctgctcgatgtagggaacaacaactatattgtttcactggccaaagcaaaccatgacccttatggaattgattttggaatggccactggtcgtttcagcaatggaagaacagttgcagatgttataaatcagaaactgggtcttggcttttctcctccttacttggctcccactactactggatcagtggttctaaagggtgtcaattatgcctctggtgcaggtggaattcttaacaactctggccaaatttttgggggacgaatcaacttcgatgcacagatagataactttgcaaatacgagggaagaaatcatctccttaattggtgttcctgcagctctcaatttgtttaagaaggccctctttacagtagcattaggctcaaatgatttcttggataactatttgacacccatactctcaattccagagagggtgttggtatctccggaatcatttgtggccacattgcggctattcaatctaggggccagaaaaattgttgtggtaaatgtagggcctattgggtgtataccatatgtgagggattttaccccatttgctggagatgaatgtgtcacgttaccaaatgagctggctcagttatttaacacccaattgaagagccttgttgcagagctgaggacaaaattggaggggtcattatttgtttatgcagatgtttaccatatcatggaagatatcctacagaattataatgactacgcctctcattcttcttcttcttcctcatctccttcccgccacctcacttaccctcttcctcgtcgttcaggttaccttccatcagagcctcctcccaaaatgaccccactcctccaaaccctaaacttattcatctcccttgtcgtcgaaaccacctacattgtcatcgccgctgccgacaccgacattgtcttcactgaggacgaagttgaaagggtcgagtccttgaagaccatctcagcaccaaccttcatgacaccaacgctctcaatgcccaggccttctttatgcccttcttctcgtccctcagtttcaacacgcatgaccacactatga

SEQ ID NO: 77722 - DNA, 309 bp, Glycine max
  Peptide Sequence Number=SeqID_169407
atgcggattaaagggtacacgaagaaggacatcttttgcccctcaaactgcagcaggaaattctattacccactagtggtgaaagtggagaggaaagaggagagcgccacgacgacggacagggaaggagtcgagatggaggaagagaaaggtggtctacctgtgtttttagggcttgcggcggagcaagccgaagcgaggttggtgagagcgaaggtgagatatcatggtgttcctgatcttggcaccatctccatggtgtttcgtgaaggccatatagttaagtgtaatgcagaagaaaggaaatga

SEQ ID NO: 77723 - DNA, 410 bp, Glycine max
  Peptide Sequence Number=SeqID_169408
ttgaagctgcattgggtgatggtgagagcaacttttggattgagccttggttcgaaaattcatgcattgcattggagattccttttgtggacgtccatgctgttgatcttagggttcggggtgtcatcaacgacgagggtgcttgtgatctctcgttgggagaggaggatcttcatcatatcttctgggaatgtgggagtatcgtatatcttaaaggccgagttgttgggtttgctctttggaaggagaattgcagcaatattttctgtgtttctgactcactgcatgcggttcagttgatcaaacaacaagttcaaggctgtcatgcatatgctgcaattgtagagcatattagagacttcttggagggtggagttgaagcattctctgcaagtgtgcaaatgccctag

SEQ ID NO: 77724 - DNA, 201 bp, Glycine max
  Peptide Sequence Number=SeqID_169409
atggatcagcacaaagaaagggagatggatatgcgggttctccaatcttatgtagcagagttgttgggtgttaaactaacaagattgaaggaattgaatactgatgagattcagatagactctgaagctattgtcaatggagccatatgcaagctatttgaaagctggcaggtcaagtttatcagatctatgggagggtag

SEQ ID NO: 77725 - DNA, 1278 bp, Glycine max
  Peptide Sequence Number=SeqID_169410
atgttaagacatgaacgggtggcactgcttattaccacagtgtattctgtctattgtgcatggctgtatgttgggtggcttggtttgctattggcttttaatataacttttatctctagtgatgttctgatatacttcctgaagaaaaacatagaacaacagagtagatccaatccttttgagcatagagctggaatgcatgaaccaggatttagtgatgaaccgacacatgcttcttcctctgaaaatggacagggaccatctgcagatcgcaatgctggcatcccttcaactagtggggttgattctgatgtaacttctgaagatgaagttgtccgtttgttgaactgctctgatcattatgcagcactgggattcatgcggtatcaaaatattgatgtttcaatactaaagcgggaatacaggaaaaaggcaatgttggtacatcctgataaaaatatgggtaatgaaaaggctgcagaagcctttaagaaacttcaaaatgcatatgagattctaatggattcgttaaagcgaaaagcttatgatgatgagctaaggagagaggagattttgagtgtatttcgtagatttaatgatgcttctcgtaagaatggtaggcatggattctttccttcaggatttgcacggtctgatgcagatggtgaggacccatttggtgattcaaggcgaattgcctgcaaaaggtgtggtggctttcatgtctggatacacaccaagaaacaaaagtctcgggcaagatggtgccaggattgccaagattttcatcaagctaaggatggtgatggatgggttgaacaatcttcccaaccatttctttttggcttattgcagaaggttgatgctccttcagcatatgtgtgtgctggtagcaggatatatgatgccaccgaatggtatatctgtcagggcatgagatgtccagcgaatactcataagccaagttttcatgtgaacacaaatttaatgtccaagcataattctggcaaaggaactagttcaggtcaaagaggtgggcgtatgccaacacctaacatcgaagaaaccatgactgaggaagaattctttgagtggttacagaatgcagtacagactggtgcatttgacaattttagtggtactgcaacagagagcccatctcccaaatctggaaatggaatgaaaagtcctggcagtagtagtggtggtgcgggtgccactgccactgccagtggtagtagtagcaagcgaaagaaaaagggaaaaaagcaatggtga

SEQ ID NO: 77726 - DNA, 878 bp, Glycine max
  Peptide Sequence Number=SeqID_169411
gtgttaacggctacatggctcggaagggtactcagcagaagaatggagtggaccgtcatggattgaataacaaaaaaggggtttctggtggcgtgcttccgggaatgaaaggccatggtaaaggagggccggtgaaggttttcccgagggagggacttgcagaaactgatagtatcggtgtttcgcagactgcatgtgatggtagatcttcaggtgatgactataacaatgagcagaggtctgaaaagatttctgggaaagagaagcaagggatggctgggaagcatgacctggaggagtcctcatcctttgagagtaattcgggagatggcagtctgaattctgaagctgaagcttcaatacaagaagaaaatgggactttacctagaagtaatcaaggtcaacagagtataaagagtagattgagctgtatactggatagtttgctcctgaaaagtgtggtggaaaaagtagagcttgccgataatgtgataatcaggagattaaggttgtcagtgttttccatctttacagcagcttcagagtggttaaataggcatactccattgtttgtatctcttagaaccatcatgtttgaaacctgcaatactgtcagaacgaaggtcgtgcaggcatatcctgtagttctgaagtggctcatgcatcttggaaacataatgctcctattattggtgttttggttggactgtgcccttcgaggtgttgattcttttgtgcgtatgggtacaacatccttcttctctgttatatggtgtagcatattctcggtgattagtatgatagggatgctcaagtttcttgctgtcctggtaagctcaggtcacacttgtcattgctttttgttatcttggagttaa

SEQ ID NO: 77727 - DNA, 1023 bp, Glycine max
  Peptide Sequence Number=SeqID_169412
atggatgtgcgaggagatgggattttcccggatgaggtggttattcagattcttgcaaggttgcctgtgaagtcccttttcaggttcaaaaccgtgtctaggaagaaccccatgattctggtggagatttcggattcgtccgagtccaaaactagcttaatctgtgttgataatttgaggggggtatctgaattttcactgaatttcttgaatgatagagttaaggttcgagcatcctgtaatggcttgctgtgttgctctagtattccagataagggtgtcttctatgtctgcaatccggtcactcgtgagtacaggttgcttccaaagagtagggaaaggcatgtgactcgattttatccggatggtgaggctaccttggttggcttggcctgtgattcagcgcatcagaagttcaatgttgttctagcaggctaccatcgcatgtttggacataggccggatggaagtttcatatgtttggtgtttgattcggagttgaacaagtggaggaagtttgtttcgttccaagatgaccattttactcacatgaataagaaccaggttgtttttgtcaatattgctctgcactggttgactgctagctctacatatatacttgtgcttgatttaagttgtgacgtttggaggaagatgcaattaccgtataacttgatttatggaacgggtaataggatttatctcttagacttagatggctgcctgtctgttattaaaatttcagaagcatggatgaatatatgggtgctaaaagattactggaaagatgaatggtgtatggtggataaggtgagtctgaggtgtatcagaggaatggttccaggcatttttccaatcagtcagactggtgaatgtgtttttttggcaactcataagcagattttggtgtatcatcgcaagactcaaatttggaaagaaatgtactctgtgaagtataggtcaacactcccattatggttttctgctcatgcatatcgcagcacaatgttctcatgtaactga

SEQ ID NO: 77728 - DNA, 156 bp, Glycine max
  Peptide Sequence Number=SeqID_169413
atgtgtcactgtaaattactccgttacatggtacatatgttgatcatatggtatggagcatggcagaaacggtctagtgatgaaaaagataagctgacagcaaatcttctgtctagcagaatcacaatgcaaaatctgttgactagcagcttctaa

SEQ ID NO: 77729 - DNA, 96 bp, Glycine max
  Peptide Sequence Number=SeqID_169414
atggaaggaatttacaatgttaagggatacaacctgaaaaaggagagtacaagtagtgatgaccgtatggttatgaaaatgagtgtgcaagactaa

SEQ ID NO: 77730 - DNA, 387 bp, Glycine max
  Peptide Sequence Number=SeqID_169415
atgcatggcatgctttcctcggttgttcaaatattactgacgtctggaattgttcaggttgctagaaccatgtcaaaccaatcgttgatgatgcaaataaacataaaccacaccataaggataaactacataagctctaggtcaatcaacaatatagataactttaaagaggaaacaattatggataatgcgtcttcatgtccaaatacgcatatccatgaagtctacaacgacacaagagcacttcctatccatgtgctatccatgtacgtcaaatacaagatcatcataggcacgaaccacaaatgcaataatgcaaggggtggtacttggaaagataccacactaggcaagacccttggttgctttagtgaggcagagttctaa

SEQ ID NO: 77731 - DNA, 237 bp, Glycine max
  Peptide Sequence Number=SeqID_169416
atgagcagagacgaaaaggcaacgacgaagtggaggcatgagagatggaacggagacagagaggtagagaatctaccttctattggtatacgtccattgagatctttgaggataagggaaatttcgtcgatgataaggatctcacgccatctgagattgcaatctactgagtggcctttgatgaagagatattcggggaagagatggttttgtccaacgaggagtgcaattccttaa

SEQ ID NO: 77732 - DNA, 3543 bp, Glycine max
  Peptide Sequence Number=SeqID_169417
atgaggtcgtggaaggatgaatggttcaagaatgagcatcaacctgctagatcttcccaggaaaatattagctctgatgaagcagatcctttctttcacgcggttgagattggaaagacccgtggggatactgagaaatttgacaagtggagtccacgcgctctgacgcttcggaattccagaatgagagaagaggttatcagctccggaggcaccgttgatccaacacctgctgccagttctgctggggcgtcatcagctgttccaatgaatgttggcagcatagatgggtcaagtcatggacaagtctctaaagcggcttctctctcgtgtgttggttcacaaccaccatggacttcattgagcacaagtgctggcagttctgctttttggttcttcaagatcttcattctccagggatcacatgtcctctttaatttcttccagatcatcagttcattggcttgtgctcagaaaggctggatgaataatggagtagacaaaattgcttgcgagtcatgcggttcttgcctgagttttacagcattgccatcttggacattagctgaaggcaatgctttcatgcggatcatggatgttaaaagttgtgcttcgttgagcaaactgtatccagtaactaggctaaaggagttctctgttgttgctgattatattcatcagttgtttttaacttgttttcttattgtcatggccaaagctcaaaatgccagcgaatcctttgccaggcagctggattcgggtcataaagttaattacctttggaaaggaaacagctgtccagaaagcttagtgcagttccctccaactcctccatctgcattaattgggggctacaaggatagatgtgatggactcgtacaatttcactgccttcctgtggtagccatctctgcaattgagttgatgtctgtttctcgtggcccacaaattgaacgctttctatcacagtctcagaattctatgtcaggagaagtagatatcaaaccagacattgcacagaagcttataagcctttgtgggtgggaatcaagctggcgtttaaatgttcaagattgtgaagaacactctgcccaatctgaaagaaatggatattcttttggcccaagcaagactcaacttcatcttactcaagatcccgggtcaaaggcagtttctgcttctactaaattggatgccagaaaggcaaaggcgcctcttaaggagtctagacttgactctaggtcacctttgcttgattgtagcttatgtggtgctacagttagaatttcacattttctgacagttcctcgtcctgctcgttttgcatctaacagtatagatattcctgatactagtaaaaaaatacgattgactcgtggagcgagtgcagctagtggaatcagtggttggattgcagctgatgatacagagaaagatcagactgaagaccgtgatgaagttgcaacaacgaatgaggggaaattgttggtgaacacagatttagatctaaatcttaccatggcagggggttttccttttactcctttgggcaggacagcaacatctgaatatactcatgaggatatgggaagggatttaatgatcggccagccttcagggagcgagattggtgatcgtgcagcttcatatgaatcacatgggccaagctcgcgtaagagaaatcttgaaaaaggtgggagctcagataaccagcctgttcttaggctgcagcagcaggctgatagtgtagaaggaactgtcattgatcgtgatggtgatgaagttacagatggtggacaatattcagctggtccttcaaaacgtgcacatgactctgatatttttgacacatattgttcacctcaacaaagagactcatctggtgccgctagagactcaacccgtgcatcatctgtcattgcaatggacacaatatgtcatagtgtgaatggtgattctatggaaagtgttgaaaactaccctggagaccttgatgatgttcatttcccctcctctagcatgtatggcaatgtggacgtgaatgaaaaatctgaactgaataacagcaatcaagctcagcaaagcacttgcttacaaacagctactgaagttgcccgtggtgatgtgggcgtcagtggtacaaactatggggaagaacttttcaatgcagaaactgtgactgctcaggctcctgaaatccacggggctgatatatctgtgcacagagctgatagtgttgttggtgaaatggaacagagagtagaagatgctgaaaaccagggacagacaggtgaatctgtttcagatccaggtctaatggatgagtttatccctgatatgaacagggaagatcctattggtgatagccaggagatgatgtctcactctgcaggaagaacagacagtgggtcaaaaattggctgctctacagaatctgttgaaagtgagatcatgaagcatgataaatcatcatttgccaacaattgtgctctccctgaatcagattttgccattgcaaatgggataggccctccaaaaggagagagtaattatgaagctgcagagtttgatcctattgtgcatcacaatcaatgttgcccttgggtgaatggcaatgttgctgctgctggctgtgctagttctgttccaagtagtgatgcaattgccctcagtgtttggcagctgacgatagatgctttggatgctttgtcactggggcacaatgcaattccaacagtaccatctgaatctgctgcatccttgtacaagcaatttgttgttaatctagttgttccacctcattatctcaccggggatgatcgcattgctgatcgtgtcaacccagagtacgaaacctgggaagttcaagaccgaacgcttcttgtttggctgcagtctacgctttcgaagtccgtgttatcaagagttctaggtctcaatcattcgtatcaggttttggagttaatgatactaagtcccaggattgtgaataccagacttagaccttgtttgcatagggtgagcgttaactgggatagagttgggctaaaggcccaagtggagaaggacgaaggcccaagtggagaaggacaaagcccccgagtggagaaggatgaaggtccaagtggtctttttgttcagctacactataattccttgttgaaccaatctcagacttatcaaggtaatccttgtggcgtctaccctgacttatcttccttcaccggaagtggcgtctaccctgacttatcttccttcaccggaagtggcgtcatccaaacctccgtagcctgtatcaaacgatccactcctactcaggttcacatcacaaggtacagaaacagtggtgaaaaggattctaagatatctcataggcgctctacctcagggactgctatttttcttagcccaaacttagtctcttggtggtctcacaaacaaaaggctgatgttctaactaaacctctgtctgcatcaagatttgaagctcttagaggcaaactcaatgtgaagagtgtttccaatgaaaactctcccccttga

SEQ ID NO: 77733 - DNA, 1794 bp, Glycine max
  Peptide Sequence Number=SeqID_169418
atggaaccccttttgctgaagattaatgcctatattcaagttgaagtggatgctaatcccctgttgttggattttcatgctttactcaagtctattggtaaattacttgctagttttatgcaagacaaagtttatgtgagaaccgaggacacatctggaggagcttgtcttaatttcttgaagaaaatatttaatacactgatgactagtttcactagtgtacttcacttctccaactatgatacaaccaacaggacggagatatctagtaccttgcctgctaacgagattctagttgctatgggatatcttttgcaaattgaatatgaggtggaaattgctattttagcattgtgcaaagcaataaggcttgttatatctcacgagggtaatactgagggttcttccaggttcttggtatttctgtcgaatgaatttcattctgaagcagttgaaaggctgttatcttcagagaagttcatcaatgccatttataaagctgttgaatctattcccgaagggcaagtatgtggttgtattagacaaataacagaagatatttcagaatctctcaggtggatgaaagatttctgtccattggttgatggcaagaaattgcaaaattttaatctgcaaggggaattgctgggtagagggctgtctagactgtattgtttagttcttggttcggttattatcaccaacagcaaccgcaatcttcttggggttgctgtaaatgaacttatggcattagtgcgtccctacttgagtattctagttgggcaacaaccagatacaatctgcaagttcttttcttctgtcataggagaaactgttgatcaggtggttagaaagggaaaagttttaaagaaatttggtaggtccagtcaatgggttcttgtgttcttctttcagttgtttgtgtcctgtcaaagcttatataggcaagcaagccttaggcctcctgatttgccaaagatgtctgcagaggtggaggattacacaacatattctgcctctgagttgatggagaggattgataagatagactttggttatttttcttggattgttcaaccctcttcttccctccttgttgttatgcaatttatttctgacatatatcttaaacttggctcagatgactcttcccctttgatctatatatttcagtctatggctcttcgaaggcttgtttacttgaataagcagattaaattgttcaagtatttaaaaaagaaacattatttgcaaaagaagtcttatagatctcaaatcaagacactgaaagaagaggcggctgaccttactaattttattttggagtatttatcatgtgtgtatcaatccccaatctttgtttctgattatgtaacttgtgaagatgtagtttctgtggtcactcaaagcatccaagaccacataaaagaaagatgcaaccaatgggattgggatctaggagtgtatgctgctaacaaaaaatcattgccaacactcatttggtcaaagctttgcaaaaatgttgatatttggagcaaccatgcttcaaagaagcaattgaaaacgttcttctcacatttactccatgcttaccttcacagtgtaacaagtagttttcaagagccaggtgtgcaagaaattgacaagtgtaagctgctcaagacgatcactttgtcacaaatatcatcagaacttctaaatgattcacttttttatgaacaaaaaataacaaaaagaacttatattatagagaagagaaacatttcaactaatgctggcgtagggtattcataa

SEQ ID NO: 77734 - DNA, 306 bp, Glycine max
  Peptide Sequence Number=SeqID_169419
atggaggtggttggaacatcaatgatgtttgaatcttggaatgtcaacttgttgggtgagcttttaccattaaactttgttgcatctatggttgacagctcagcaatggagctaaagcaaaaggttggaggatttaagaagttgatgaaaaaggctgaggctagtgattgtcttgagtatactgttccatccagtttgattgaagcgcttcatagtacctaccaatcagcactgacaaaattgaaggagaaaattctggagtcccggagaaaaccaaggataagtcttgtcaatcgatcaaagtga

SEQ ID NO: 77735 - DNA, 540 bp, Glycine max
  Peptide Sequence Number=SeqID_169420
atgggaaagtttaagttttgggaagagattgatcaaccttgttattgccaagccacgggtagccatagaaggtcgttaatctccatcgtgaaaggatttttccagagcggtgccaaaccaccactacttccattggcatccactaagaacaagaatcaattccaactgggtaaagtcattatcccgggagggcctaactgggtttggagcaaaggatattcgagccctagatcattcccatcaaggttaaggttctccatgtctggcatctccatgcgaagggaaggtcaaggattaggagtggttaagggagaaagcggccctagctatgggattagccgctcatggccattgaggggctttacaactggggtgaaggaaagaatggataaaagcaaagaatatagagagaaagggagagctcaggcttggaatgctaagagaagtgctctgaggcgagcgcctgctgcaggcttagtgtgtgcttatgttggaacgcctcgcttagcgcctgtgtttccttccacgcttagcgcgtga

SEQ ID NO: 77736 - DNA, 105 bp, Glycine max
  Peptide Sequence Number=SeqID_169421
atggggccctgggcccatctaggcccatcaagaagcttctacatgaagcaaccagctcgcctgggcaagcctgttacttcaggcttaagccaccagctcgcctag

SEQ ID NO: 77737 - DNA, 183 bp, Glycine max
  Peptide Sequence Number=SeqID_169422
atgacatatcctccaccttttgacacaaagtcagagggtttgcacttgtcacctgcacctggtgcaatcctccctaggaagggaccagtcaccagagacatgagcaagaggctccaagaggattgggctagagcagctgaagaaggccctagggttctcatgaaccttaggatagatttctga

SEQ ID NO: 77738 - DNA, 168 bp, Glycine max
  Peptide Sequence Number=SeqID_169423
atgtcgatctccccctgcggaagtatcagttgggatcgtgcccacatgacacccagtggacctggagaagtccaacagggccctggggtttccagctctggttatgggcctctatcagtcctaccgagtgcccgtcccccccagcaaggtcacgccatcgtgacatag

SEQ ID NO: 77739 - DNA, 186 bp, Glycine max
  Peptide Sequence Number=SeqID_169424
atgaagaaacaacaatggaagagaagattcagcggaagacaaaggagaagaggtgagaggaggcgccatccactaaggaataagccatggaagaaggagcttcaccaccaagatgagccttggataagaagcttggaaggatgcttcaatggaggaaaagaaagagggagagaagtggaactttga

SEQ ID NO: 77740 - DNA, 240 bp, Glycine max
  Peptide Sequence Number=SeqID_169425
atgagtgaagtagaggaggtgcaagaacagatcaaggctgacatggaggtcatgaaagagaaaatggccacaatgatggaggccaatatgagcatgaaggagataatggagcatacactcccagtgaggatgtcaataactccactcctatacccattaagagccaacaaccccaaactgatcatgcacatgtctcttaagccgtgggggagacacatgaaattccccaccacaatctag

SEQ ID NO: 77741 - DNA, 276 bp, Glycine max
  Peptide Sequence Number=SeqID_169426
atgcatcaccaaaagagaaaaactctagatgaggcttcactgtcatcaagcgagtcgaagacccagcatgaccgcagatcgacctccactccttatggctcacatagacccggtctccagtggagtcaccaattgtcgcaacctacccttcgatgggggtgcaaaaaggccaaagttaggccaaagtgtttgtcttcgagggagaaaacgagcggagtcgccaccaacgctattcgagggaaaacattagaaaaaccaaaaagacgatggaattaa

SEQ ID NO: 77742 - DNA, 150 bp, Glycine max
  Peptide Sequence Number=SeqID_169427
atggtaaccaagcctagtgagttcaaaatacataggaatgttaaaaggaattggaaaggaggattggtgtcatcccttgaagaatttaagtcaagaagcaaggggcaaaccaccttaagagctattagactaagaagcactccaaattga

SEQ ID NO: 77743 - DNA, 330 bp, Glycine max
  Peptide Sequence Number=SeqID_169428
atggataaatttgatatctttgtccctcatcctctcacaaatgcatctttgcttattcaactttcaccggaatgtgggtgcaagccattggtctgtttgctcaagcgacctgcgctcttgagtttggacttccaagaccgttcaatcagaaattactcgtgctacacatttggtgagggtgctgtaaaacgacaaccctacactggggcaatgaggggcactgtgcatgagcctcaagcgaacctaggggtagataaaaagttctcacccgtcgatgtttttaaacagaaaagggggggacaaaccctggcatttcaatggattgattaa

SEQ ID NO: 77744 - DNA, 162 bp, Glycine max
  Peptide Sequence Number=SeqID_169429
atggaacaatttcttgcttcaagattgagggaaattatgaaggcaaactcctgcgacttttttatgcccaagggttttggaggggaagaggggagaatgagggtggaggaggaatgcggagttgagggtggtggtggcaccgggaagaagatgaagagatga

SEQ ID NO: 77745 - DNA, 252 bp, Glycine max
  Peptide Sequence Number=SeqID_169430
actattgatgaccagttcatcactttagataaggctttagcaagcaccctgatcatgaggttctcctctctctggctcaccagtgtgaaaggtgtgcatgagtacataatgcaaatgtgggatatttcaactcaatttagtaaattggaggaagaagaagggattataatggagataggtgagagtgcattgctaacaattgcttgtgggaagaacaaaacaacaagtcttaagataattagaagaggaatg

SEQ ID NO: 77746 - DNA, 987 bp, Glycine max
  Peptide Sequence Number=SeqID_169431
atggtagaatcatccaagaagcgcaagggttcatcctcctccgctgcagcacatcgaacatcatgttctggagccaacagagcatccgcgacaccaattccaccatccttgtcatcctctacactattttcatcagatgaacaacatatccggtattcctctctctttcaatctcgtcaaattcttgatcccaaatatcttgaccttgaattttttgatggggaaacatttgattgctatcaagtgtttcaaaacactggtctgattccttttatgtcattaaaattaccatattattctgagttagtgcgagtcttttactcaaatttgaaaattcaggatggaacattaatttctgaggtgcatggtatacctatgattattgatgagtctcttttcttttctttgacacaattacccagtcaaggtgcaccttttgagggtacccttgttgatgaatggaagtttgattactctagtcatgatgcccgctgcatggtctgcattgaccaggcggatatgaccggtagactgcttgccgggtcattgacatttgattgtcgcatcatgcattatatcattgttagaattttgatgccttgttcttttaatcttgctcaagcctctgaggaggacttgattctgatgtgggctttcttgaccggtcatccaatcgactgggcccatttggtttgttaccgcatgcataaggcattgcggtctggtgcacctctcccttaccctcaacttgtgactttatttcttcgacattttgaaattcctttggattctgagccttttgttctagttaaacgctcctttgctattggtgccagtgcggtaacctcctttggctaccgtaaggacgtagatgggcagtggctgaagaaggacgcgcaacctccgcaagatgagcgtactccctctcctccgcctccacaagatgattcctcagccctcatgaatgaagttctttcggaattatga

SEQ ID NO: 77747 - DNA, 288 bp, Glycine max
  Peptide Sequence Number=SeqID_169432
atgggtggtaaacattttgaggtggtcaaacgaaggtctcatgccgacaaagaatggtccccggacgaaattaggatggatgaagatcaatggacgtatgacaatacgatgtatcaagaagttgatatggattatgaaaatgagcaagaatgtggtgtgaatgaaccaccacatgttgattgttcggaagcttttaatacttctcagaatttgttagaagagacactgggagtaggaaatgtggttgtcccttcaagtttcatgggaaaccagtgcatggaggggaag

SEQ ID NO: 77748 - DNA, 558 bp, Glycine max
  Peptide Sequence Number=SeqID_169433
atggcttccatgatggaagccatgttaggaatgaggcaactcatggagaaaaacgtggccaccgctgccgctattagttcggctgccgaagcagacccaactctcctagccaccgcgcaccatcctcccctaaatgcggtaggacggggaaggagcacactggggcataacaacaacccccatttgggatacaatcgggtggcttacccttatggattgctgcctaattacacgccgccagtcgtgcaggatgacgcaggtcatgtctcttcccccatccttgaaggggagcctcctcgacagcctgacgaggtccatgaagatcaccgagaatatgcccaaggagatgtcaatttctaccccccgatccctgttgaggggccgacacccaacacattgcctcatcccaatctgacaacacaaccaatattcttgtccacagaaggaccacccccggcggtcgaagaaagaaggaaactcgatctcctcgaggaaagattgagagctgttgaaggcttcggtgactatccgttcgcgaacatgacagatctttgcttg

SEQ ID NO: 77749 - DNA, 696 bp, Glycine max
  Peptide Sequence Number=SeqID_169434
cgtcgtgggctgatggtcagcttcgggaatgcgtcaggcgcggtgaccggggtaaatctcggcattctgaatcagaaaggctcgctgtacgtcacgcgcccatccctgcagggttacatcaccaaccgggaagagctggaggaagccagtaacgagctgttctcgctgatcgccagcggggtgataaaagtggatgtggcagaggcgcaaaaatatccgctaatcgatgcgcaacgcgcacatgaggtgctggagagccgggccacgcaggggtcgaggtacagctcgatgaattctttagcggcagccatagtgacagattcgataagtaaatcctattctgttctaagccctgctgccggaaaagttacaatgggcagttttggtgattttatcgcccgtatcacccacaccacggcaatggccagcagtaaccacggcaacagcttgatcgtcagggcaaataacccgccgataaccattaccaccgtcgccacgacgatagccgccagaatgccgagcagcgacacacctgtcgctaacagcatgacaaaaaagccaatcacaaaaagtagttccagcatggtgctctcccacgagttcccgagtaatgcaacaggcattacaaaatccatgccaaacttaactcttgttcttaaagcaaaacgccccgcgagacgtcgcagggcgtggtga

SEQ ID NO: 77750 - DNA, 144 bp, Glycine max
  Peptide Sequence Number=SeqID_169435
atggccaaaaatataatcaacaacagggacaatggagaactcaccctgttggtgattgaaccagaaattgatccagtgatggaacttttgagtgacactgaggaagaagtggaagcagaagaagataccaataattctgagtga

SEQ ID NO: 77751 - DNA, 1044 bp, Glycine max
  Peptide Sequence Number=SeqID_169436
gcgcaggttcggcagcgcgcggatgcggtcggcggggaacggcgtgcgttcgcgcatggcgacgatgacgtcgaacggcgcgagcgtggcctcgacctgctcgtcggggatgaagttgttgaagatccgcacttcggcgtcgccgccgagggatccccagtccgcgtagcgcttggcgacgtcgtggtaatcgtcgagtattgcgattttcaagttggtctccgggtggcatggcgctcgctgcgccagccgcccggccggcgcgacccgcgccggtcagttcagtcgtgccttgagttggtccagcggcagcgcgccgctggtgcgcgagccgtcggcgaagaacatcgtgggcgtcccgcgcaccatcaattgcttgcccagcgccagcaacttgtcctcgggcacgctgcaattggcggtggccggcttctggccgcgcagcatccagtcatcccacgccttgcccgggtccgccgagcaccagacgtcacgcaccttcacgttggagtcgggcgacaggatcgggtacaggaagtaaccgcagttggggtcctcgaagatcgcgaccttgcgcgagccgtcgcccttgacctgcttgatggccaggtccagcggcaactggtcgaacgggatggaaccgagcttttcctgcgcctcgcgggtgacgtcgcggcgcgtcatggcgtcgatcagcggaccttccatcacccaggtcactttttcatcggtgtagatcaggtccatgcccaattgcacctcgaacagcccgtagggcgtgcggcgcacggcggtcacgtccatgccggtgaagcgctgcctgaaacgttccttgaccgcatccgccacgggatcggcgggcgccacctgggtggtggaatagctcttgctgcccttgcccgcctggccgaccgtgctggtggaaacggccttgtcgcccgttgcctgcgcttgagcgctggcggacaggcccaggcccgcggccatgaagcaggcggccagcgtggcggaaaaacggaaattcatggggactcctgtatttag

SEQ ID NO: 77752 - DNA, 60 bp, Glycine max
  Peptide Sequence Number=SeqID_169437
atggccgaccagcaggctaccaaagtccaaagcccaaaggacgcacctagttgctcatga

SEQ ID NO: 77753 - DNA, 262 bp, Glycine max
  Peptide Sequence Number=SeqID_169438
atgctgtcagacttaacaaagggtcaattactgggaaaagtggttacatatatgcatactatagagtttcaaaagcgaggactccctcacgtgcatttattactatttctacatccagacaataaatatccatcttcaactgacattgataagatactatcagctgaaataccttcccatcaagatgacccagaactctacagattggtggagaaccatatgatacatggcccatgcggaattttacaacccaactctccat

SEQ ID NO: 77754 - DNA, 757 bp, Glycine max
  Peptide Sequence Number=SeqID_169439
agggctgcacaccctcaccttcagaggacttacacgtcctcgcctccagagggctacatgtcctcgccatcagaggattacacgtcctgccacttcagaggactacacatcctgccacttcagaggaccaaacgcatcctcgccttcagaagactacagctcctcgctcttcagaggactacacgtcctcaccttcagaggactgcacatgtcctccacttcagagggccactaacatcctcatcttcagaggactacacgtccttaccttcatagggctacacgccctcaccttcagagggctgtatgtcctcacctttagaggactacacatcctccatttcaaaggactacacgtcctcgccttcagagggctacacgctctcgccttcagagggctacacgctctcgccttcagggccagtagttgccttttatcaactccggggcaacccccttatcctggaggagggccaactgtgcgagcacaaccaaagagggaggttatcatgcagctactatgcataccagggcaagatttaacccgtaccgttgcaaagagacgagtggatcgcgcccacaagacacccaatggacccggagaagtccaacaggtcatagggtttccagctctgattacgggcctctgtcagtcctacagggtgcccgtcccccctacaaggtcatgccgccatgacatagggatcgcacccgcaagacaaatagtggacccggagaagtccaacagggtcttaag

SEQ ID NO: 77755 - DNA, 181 bp, Glycine max
  Peptide Sequence Number=SeqID_169440
atggatgtaaaaacaaccttttttaatggtgatttagaggaggaggtttatatgaaacaacctgaaggcttctcctttagcagtgatgatattttacttgtagccaatgatcgaggcatgaaggatatgggtgatgcatcttattacattggcatcaagattcatagagatagacctcgag

SEQ ID NO: 77756 - DNA, 598 bp, Glycine max
  Peptide Sequence Number=SeqID_169441
atgatacgcggagataccttacggttatccgccccccctttgccattcagacacagtcgtgttcgatggcaagcagagaccaagtttggtcattctgcacacatgatacgcggagataccttacggttatccgccccccctttgccattcagacacagtcgtgttcgatggcaagcagagaccaagtttggtcattctgcacacatgatacgtggagataccttacggttatccgccccccctttgccattcagacacagtcgtgttcgatggcaagcagagaccaagtttggtcattctgcacacatgatacgcggagataccttacggttatccgccccccctttgccattcagacacagtcgtgttcgatggcaagcagagaccaagtttggtcattctgcacacatgatacgcggagataccttacggttatccgccccccctttgccattcagacacagtcgtgttcgatggcaagcagagaccaagtttggtcattctgcacacatgatacgcggagataccttacggttatccgccccccctttgccattcagacacagtcgtgttcgatggcaagcagagaccaagtttg

SEQ ID NO: 77757 - DNA, 279 bp, Glycine max
  Peptide Sequence Number=SeqID_169442
atggagtgcctagagggagtttgggagaccctcgatggtatgagaggtgccgattccgtggcacgattcgactcactgctacttcatttggtacatccagaggaacccgcacgcacgcttcaacagcctgtggagtggatactacctacacctactccatatcgactagtggagccatttccaagtgataaagaggatatcatgtcagcatctgaggcagactctacagaggagagcggccctggagggacagcgaatagtgaagactcttcatcatag

SEQ ID NO: 77758 - DNA, 138 bp, Glycine max
  Peptide Sequence Number=SeqID_169443
atggcgaggacggtgtcgcaacctacccttcggcgggagggcgacgcgagactcacgggtgcatcttccaagctttttaaaaatccacgtttaaccaataaaagcgaaaaggaccatttcaaggcgttggacctttaa

SEQ ID NO: 77759 - DNA, 214 bp, Glycine max
  Peptide Sequence Number=SeqID_169444
atgggtggtggtgcatggccgttcttagttggtggagcgatttgtctgggactatggccgcttaggccacggaagtttgaggcaataacaggtccgggtaaatctttgaaatttcatcgtgatggggatagatcattgcaattgttggtctttaacgaggaatttcctagtaagcgcgagtcatcagctcgcgttgactacgtccctgcccttt

SEQ ID NO: 77760 - DNA, 54 bp, Glycine max
  Peptide Sequence Number=SeqID_169445
aagttgaaataaatggagtggatcaatcgaggttgagtgacattggtgttgatc

SEQ ID NO: 77761 - DNA, 2316 bp, Glycine max
  Peptide Sequence Number=SeqID_169446
atgggtgtattagagattggtgtatttgagattggacaaatggaggaagaatatcccctcagtttactcagtctggccttaacccctcaccttacgcgccggtgcgagacgcgtgagtgtgaagaagagacaaaggtgcagttctggggtttggcggtgaagaacagaacacacacgatggggaagaagagaggtacaagttatcaaaagaaagatgccaaaagctcgaaaagtaaaacaagttctcgccatggtgcttattccagtgatgacatggacgacgatattgatacttttcataagcagagggacattgtcccccttgacataaatgatgatgctgaagaatcggaagatgaggagctccctatttttgatgttcaggatattgatgaagatgaggatgacgaagatgaggatgatggtgaagatgacgacgacgacgacgacagggatgacgttgtggcaaagatgattaggcaaaggaaatatttacagggaaagtttggtggaggcgatgatgaaatgaatgatgccgatgatgatgatgaagatgaggaagattataaacttacattgggtgggaaaaaattctcacacggtgctgagaatcgaaattttgagctacaatcaagtgatgatgaggccccaaaagaagaggaagaattggcattacaaatacaaagggagaaggcaaaatccttaacaatggaagactacgaccttgtggatataagtgaagacaaagataatgagaaattaactttgaaggatgcatcagataaaggaagcgaagcaataaagtcactggatagagatataaatttcagtgttgatgaactgaatgctttgtcaaaggaggagcaaatgaatgttttatatagatctgctccagaattagttgattggttgtcagaactaaatgaggcacacagacaactcgaatgtaaaaagggggaaatagttatgaaaggagaagtgcgttattttgagttgaagcagcttattttgctgtcctattgccaagctataactttctaccttctcctcaagtctgaagggcagccagtttatgatcatcccataatagctcgccttgaagagatcaagaaattattggatcaggtcttgttattttcaaaatacctaaatatctgtgactttaaggatctagtttccaaaatcatttgtcttatgagtatgataaaacaacttgacacaaaacttccatttgaacttgaggacattcttaaaggaaataatgggttagaaacagtagtaaattcagataatgagaacgctccaacaacagctgattctatcattaaaaaccaagagcagcctcttgtctctgccaaatcaacagaagaaacagtgcctaacaagcaatttgagatgcaaaaattggaaacctcaaagaatagtgtacagaaaacaagaaaagttaaacctcagaaggatcacattggcgcacagagtttggaaatgctaaaagttagagcttccctcgaggaaaaactgaaaaacaagggtctgtacagctccattgctccaaaacctacatgttggaacttattagccacttacaaatttcacagcatgctcgaaacatatgatgattttaatgatgataccatggatgccaacggggaagctagattgattaatggttctgtctccaaaagagtttctcagttccttaatgcaaatatgaagaagcccaagcctacatttgctaaaatgagtggaaggacttgggtcccttatgccctgtttggtagagaggagagaaatagggtggtttctggtgatgatgatttaccaaagagagatgatattggtgaaagacgaaggaaacatgagcttcgggtgttggctggtgctggaattaggactgaggatgatgatgatgatcaaatggctgatcttggacctaatgaggttaccgatgaagaggaggatggtggaagtggggactcagaaaatgaattttacaaacaagtggaacaactgcgagctgcaaaactggcagcaaaagctgagacttactcaaggaactcttcagtctcttcattgccagagactgtagaaggaaagcgccatatttcttctcagatcgagaagaataggggactaacccgcaatcgcaacaaagcaaaaaagaatcccagaaagaattacaagctcaagcatcaaaaagctgttaagaatcgcaaggggcaggttcagagtatcaagaggccgaccgctccttatggtggagaatcctctggaattaatgcggctatcagtagaagcattagattcaagagctga

SEQ ID NO: 77762 - DNA, 390 bp, Glycine max
  Peptide Sequence Number=SeqID_169447
atgcctattgaagcagatgggataatatgcggagcattgcttaatggttcttggttctggaaggacatggaagtgggggagagagctgctgagaagttgttcagtttggatcccaacccaattttcacttttgtcgttctgtccaacatgtatgccatactaggtagatgtgggcagaagacaaaacttaggaagagattgcagagtttggaattaagaaaagatccagggtgtagctggatagaattgaacaaaaatattcctctgttctcagtagaagataaaacccatccttattctgatgatatttatgcaactgtagagcatataacagctaccattaactctattataccattctattatcgctatagcagcaatggtggataa

SEQ ID NO: 77763 - DNA, 513 bp, Glycine max
  Peptide Sequence Number=SeqID_169448
atgaattccatcccccaccactacattttgagcaagaatggtggaccatgcgtgtgggcgacttctctaacaagcacaatagcagagttggggtcattctggaagtacccagcgacgtggccatggcataatccttacattttagattcaaagccacatgcaatcaggctcgccaaagaggttggtgctcaaagggtctggtgccgaagcgactccaagatcgccactgagcaaattaacaaggtgtttcagacccgagaccccaagctcctaaaatactatcatgcgtttgagaagcttaggggacaatttgaggaagtccaagtgactcacataagtcaagaggtcaatgacaaggccgacaagttggctcaactagctacctcccctaagcttggacaacttaaaaccttcatccttcatttagtgcccaaacccaacatctcaagaaaaaatgtttacaggtggaagaagccttccaggggtagagataggagatactcaactacttga

SEQ ID NO: 77764 - DNA, 267 bp, Glycine max
  Peptide Sequence Number=SeqID_169449
atgggagaggtagacccagctttcatccaagacccacaacataggccaaagctctctatcatccaacctgaacacattcccgtaattgacctctctccaataaccaacaacacagtttcagacccatcttccattgaaggcttagtgaaggagataggaaatgcatgcaaggagtggggcttcttccaagtaaccaaccatggagtgcccctcactctaagacagaacattgagaaagcctcaagattgttctttgctgagagatga

SEQ ID NO: 77765 - DNA, 675 bp, Glycine max
  Peptide Sequence Number=SeqID_169450
cagatcaatgtcacaatttatgattgggatataatttggaaaagtgctgttcttggttcagtgactgttccagttgaaagtgaaggtcaaactggtgcagtgtggcatactttggatagcccatcagggcaggtttgtcttcttataaaaacaataaaactatctggaaatgcttccaggataaatggttatgggggagccaaccctcgaagaaggatgcctcccttggaaagacagtggcccactgtagtccatcaaaagccaggccctcttcaaactatatttgatcttcatccagacgaggttgttgatcatagttattcttgtgcacttgagaggtcattcttgtaccatggtcgtatgtatgtctcagcatggcacatttgtttccattccaatgtgttctcaaagcaaatgaaggtggttattccatttgaagatatagatgagatacgaaggagtcaacatgcatttattaatcctgctataacaattattcttcgcatgggtgctggtggacatggtgtccctcctttgggaagtcctgatggtagggtcagatatatgtttgcatcattttggaacaggaatcatgcattcagaaatctacagcgtgcagcaaagaatttccatgaaatgttggaagctgagaagaaggttacagctcttgcttaa

SEQ ID NO: 77766 - DNA, 1014 bp, Glycine max
  Peptide Sequence Number=SeqID_169451
atgagttacgacagagcgagaggactatggaatgaagtaactaacccaaacctagtccccttacttggctcgctggttggatttgattcgactcgattctcgctgatgaagaagcatttgatgcacagctatggcgttgccgtgattgtggtgttggctttgagtttgagtttgggtgcatcagcggaacaactcagttcacgagaatgcgagaatctcggtttcaccggactcgccttgtgctccgactgcaacactctctccgagtacgtcaaggacaaagagttggtatcggattgtttcaagtgttgcaccgaagactccaatgatgccactaccaaggtagaactattcactgctaaggatctcgttagtgcaaagttaactggcaaaccggatccttatgctgtcattacatgtggcaaagacaagcgattcagttccatggtctcgagttcaagaaatccaatgtggggcgggggcgagggtgaggtgttcaatttttctgttgatgaacttcctgtccagatcaatgtcacaatttatgattggtataaatgtcgggaaaatgctgttcttggttcagtgactgttctagttgaaagtgaaggacaaactggtccggtgtggcatactttggatagcccatcagggaaggtggttattccatttgaagatatagatgagattcaaaggagtgaacttgcattgattaatcctgctataacaattattcttcgcaagggtgctggtggacatggtgtccctccttccagtcctttggcaagtgctgatggtagggtcggatatatgtttgcatcattttgggacaggaataaagcattagagaatcttcagcgtgtatcaaagaatttcaatgaaatgttagaagctgagaaggaaaatgcagagccacagctgtgtgcgcatagcagttctgtaccggataaggttcttgaagatagcatgccaaaactggaaaacttaaaccttttatcaaagaagaggctttag

SEQ ID NO: 77767 - DNA, 486 bp, Glycine max
  Peptide Sequence Number=SeqID_169452
atggggccccttgatggtcattcaccgaccagagaggaaattgatgatagatggatgcagtttggtgagtacattgcacctgtaaggcaattatgtgcaatgtctgaccactgttcgtcagattacatgtattggttttacatgatcttgcacccattcatgagtccgacacagccaagggatcctcctagagtaccgccagttcagcaacatgaagaatttgttgaaccaaatatgtatcagcaaccgatagcggcagcggcacctaataaggcagacattgatgtgcatcatcttcgacatgcagtggatgactttgtagcaattgctgataggttggacatgctattgaacctgaggatattgactgaaggaacaaaagtctataccgttgttgaagaatgtgtgggcatcgcaagatgctacattggccaaccaattgtaggtcacaaatcaaagcaaaggtggcgtacgaacgatcattga

SEQ ID NO: 77768 - DNA, 213 bp, Glycine max
  Peptide Sequence Number=SeqID_169453
atgaaattacaggaaaaggtgttgagggaaaaagcccaaagtttcaagaacccttggatttatggacaaatccttttcaagcgggaggggatgatgcaatcctaccccccaagggtattggatagaagactccaagaagattgggccagagatgcagaagaaggccctagggttctcatgagccttaaggtagattttaggcccatgagctaa

SEQ ID NO: 77769 - DNA, 186 bp, Glycine max
  Peptide Sequence Number=SeqID_169454
atggtgttttgctcaatagtgggtgacccttctttcttaggagacctcatcgttccatctttcgagggcaaggatcgaaattctcatcttgggtcaaggttcatggtgagttgggattttggctcaaggcttgtagaacggctggacatgatgtatgccagggtgttggtttggctagcagtttag

SEQ ID NO: 77770 - DNA, 552 bp, Glycine max
  Peptide Sequence Number=SeqID_169455
atggttgcttctagtagcatagcttctctgttattgcctggaggtagaactgcacattcaaaactcaaaattctagttccagtttttgaagactcaacttgcaatatccatcaaggaactcaattagctgaactattaaatcagacgagtctgatcatttgggatgaagcacccatggctcacaaattcttttttgaggcacttgatcacaaccttagagatatcatcaaacataactcaaaggacaataaaatctttggaggtaaagtaatggtctttggtggagatttccggcagatcctgccagtcatttcaagaggcagctgctttgatattgttaacacaacaattaattcctcttatctattggatcattgtcagatcttgagactgacaaaaaacatgcgcttacaaaacaacatgcaagcaacatatcaagaagaaattgtggcttttgcacaatggattatagatattggtgatgatattattggacatgaaaatgatggctatgctactattgaaattccacaggaactattaaccacataa

SEQ ID NO: 77771 - DNA, 156 bp, Glycine max
  Peptide Sequence Number=SeqID_169456
atgggaaattcagctaaagttgtgatacaacaagacatgaagggaagaaggcataaatatgggtttaacaacaatgaacgttattccgtaaaaacatggtctatatttacttctaagattgttaggggtaaaaatgaccatgtccctatggcatag

SEQ ID NO: 77772 - DNA, 462 bp, Glycine max
  Peptide Sequence Number=SeqID_169457
atgtgggcctttcaaactggttgtcagatcgactggggccatttagttcggtaccagatgcataaggcattacgggccaatgtacctctgtcttatcctcaccttgctactctttttcttcatcatttcaatgttcctttggatgatgaaccatttttcaaggtcaaaaggtctttctctattggtgttggtgcgattacctcctttggttaccgaaaggatgttgatggtcagtgggttcgcaaacaggacttgtcattgcctattcccgacgaacgtaccccatctcctccaccacaaaggactgattccacttctcttctgactgaagtactcacagagctccgcgaccttcgagcttttgtggatgagcgcttcgatgccatggacacccggattactaggcttgaagatgatatgagcttcatcaggcgttgcttcaatccccctgtcaactcttag

SEQ ID NO: 77773 - DNA, 1095 bp, Glycine max
  Peptide Sequence Number=SeqID_169458
tctttcgcccctatacccaagtcagacgaacgatttgcacgtcagtatcgctgcgggcctccaccagagtttcctctggcttcgccccgctcaggcatagttcaccatctttcgggtcccgacaggtatgctctcactcgaacccttcacagaagatcagggtcggtcggcggtgcaacccacagggggatcccaccaatcagcttccttgcgccttacgggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactcttgactctcttttcaaagtccttttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccggttcgctcgccgttactaagggaatccttcgggtagccccgcctgacctgaggtctcgttgggagcgtgcgtgcacgcaaagggtcgtcgatgggtccagaactgaccggctcgcacgtgattggtctcgagcgtggctcatccaccattttatcacggcgaagtcggccatgaacccagatttcaaccaaccacgaggcgggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcatt

SEQ ID NO: 77774 - DNA, 279 bp, Glycine max
  Peptide Sequence Number=SeqID_169459
atgtcacgatggcatgaccttgctgggggggacggtgatgtaagctccattggagcttgtaggcctaggatcttcttcatcaatggattcctttgcttcttggaagatgaatggcagcggaatggagaaaggaagagagagaggagatgccacttcaaggagaagatgagtctagaagaagttcaccaccataggaggccatggataagagcttggaggaagaatgagatgaatgaagggagagggagagaagagcacgaaattttgtactctaaatga

SEQ ID NO: 77775 - DNA, 546 bp, Glycine max
  Peptide Sequence Number=SeqID_169460
atgtttggaagcaaaggcgaggaccttggcaagtcaagacgaatgggccccgttcatggacatcctgacactcttgatcttcggggtggtcctctttccaaatgtggaagggaaagcccgattgtcgctatcttagccgatctatatgacacattcggccgaagatgtgaaaagaacagtgcaaggatcgtttgttgtacaccggcactctatgtatggttggtttcacacctttttcgccaagaggtgagacacatttgcctgctagaaggccaccactcatgcaccaagaaaaaggaggcaaactgggacaaactcttagcaagcaaagaaggagtgtctgtcaattggttcccccgatggaaagaaggaagaaccgggattcttatttcgtgcggggaatttccaaatgttcccttgatggggacgagtggttgcattaattacaatcctgtttgtcataccctaatttcgtccggggaccatctgcttggtgggatgcaacctttgcttgaccacttcgaggtacttgacacccatcgttag

SEQ ID NO: 77776 - DNA, 174 bp, Glycine max
  Peptide Sequence Number=SeqID_169461
atgtctcctccacctctagaacctcataatcactcacaaactcatatcaagctctcaggacgacttcctcttcaagctccgttctctacagattcttcctcgcgctcagctaagggaatggtgcgctcagcggatggctcgctaagccaactgattggcttagcgagcagataa

SEQ ID NO: 77777 - DNA, 153 bp, Glycine max
  Peptide Sequence Number=SeqID_169462
atggagaagtctgaaaagaaaaatatcaatgaaaagaaattgaagaaagcatacattacatgggatgaaaacgatatagaatcttctgaagattcagaaaatgaagaaataaacctttgctttatggctaaaagttatgaaagtgatgaagag

SEQ ID NO: 77778 - DNA, 279 bp, Glycine max
  Peptide Sequence Number=SeqID_169463
atgaggaagattgggctttacgggacgttttttggaggcacgagaacgagagtgaggctgcgcaacgtgattggtttcgaaggtatttatagaggaggacaaggtgtaatcgattacaaggtatatggtcaagaaggattccatagtcagaaagttgttgcttcatccataagatttgtgcacaacaactgccagcagaaatatattccgcttctgcagtggataaagcaacattattttgtttcttactatgccaagaaactagagcagatccaatga

SEQ ID NO: 77779 - DNA, 449 bp, Glycine max
  Peptide Sequence Number=SeqID_169464
atggcttctccacctgcctcgcctccttctcctcttcctcgtcctcctcatcctccttcagacgcatcagcttcatcgtctgccgtgaagcggacacgcagagcctcactggtccacattgatcctgctaccggtaaggccgacggtccccataggaagaaattaagaacttatttggggattgtggcacgtgataaggtggacatcacgtacgagaactggaagaaggtctctactgctcagaaggacttgatttgggacgatattcagagacttctgacagtaggacaaaaagaaagttacttcagactatgggcgagagatggagccgatcacgacggtgtggatgacactgtctgtgaaaaatacggcataagcaaggaaaactgggcccagtttcgccagactcgtagagacccttcttgggaggatgtgcgcaaaaaggctca

SEQ ID NO: 77780 - DNA, 788 bp, Glycine max
  Peptide Sequence Number=SeqID_169465
ccggaggtctccatcgtctccataagctaggccaccctatgagaggtgcaccatcagaggagatcaaatcgcctttcatcgtgcgaggtttcaatgaaactaatgcgaggatacttcagagaatccgtaaagcgtggaatatagtggaagggaaagataaggagattaggggaagtagcaatggcatcatcgacggctatcacaagtggttgaagtctagaacgcaagggataacttggctctcgaagctaaaaggcctaagtgggaaagaagcaaaagtccttgaggaaagcgaagaagtgcaagctttgaaagtggagctcaaaaaaatgagagtggtcaaggagaagataaagacaatagtcactagggtcaggaaaaagaacaagttccgaggggctctatggggaagcaccaatgagctcaagcttagaagggttgaaagggacgggtcaagggtggaaagcatggtgttagaggataagttgaaggcttgtcaaaggttgaagaaaagtttgacggaacagctaagcagaatggaagagaatatgttgaaaattattgatcaatataaggagaaggtgaacctagctactagtcatggggaagctatgaaatggatggataggttcgctctcactttgaatgggagtcaagagcttccaaggttgttagccagagccaaggcaatggccgacacgtactcggctcccgatgaagttcatggtcttttcgactactgccaacacatggtcgaactaatgacccacataattaggaattgctga

SEQ ID NO: 77781 - DNA, 827 bp, Glycine max
  Peptide Sequence Number=SeqID_169466
atggtgaaagttggaacctcttacgtgccgatcaacgtctcattttcgccaaaagttggcccagggcttcccggtatcaacagggacaccaggatttatttattctgcgaagtggatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatcatgtagccctctgaaggcgaaggggtgtagcccacttaaggggcggacgtgtagtcctctgaaggcgagggcgtgtagccctttgaaggcgaggacgtgtagtcctctgactatgagggcgtctagccctcttcaagggctgcacgccctcacctccaaaggactacacatcctcgccttgagagatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 77782 - DNA, 156 bp, Glycine max
  Peptide Sequence Number=SeqID_169467
atgtgtagtcctttggaggtgagggcgtgcagccctctgttggcgaggatgtgtagtcctcttcaagagggctacatgatcgaattcctgcagcccgggggatccactagttctagagcggccgccaccgcggtggagctccaattcgccctatag

SEQ ID NO: 77783 - DNA, 249 bp, Glycine max
  Peptide Sequence Number=SeqID_169468
cgctacgcaataacttcgcggggctccagactcgttggtggaggatgcatgaacagcgcttggcaaataacattcatggggcttcaaaaaaagtggagaatggagaattggcgaacagcgctacgcaataacttcgtggggctccaggctcgaaggtggaggatgcatgaacagcgccaggcaatgacattcatggggctccgtaaaaaagtggagaatggagaattggcgaacatcgctacgcaataa

SEQ ID NO: 77784 - DNA, 108 bp, Glycine max
  Peptide Sequence Number=SeqID_169469
atggaggagatacatggagaagacgatgaagaacaaggaattaaaagattgaaggtaggagaagatgagtggagggagagggagagaaggggcacaaagatgctctga

SEQ ID NO: 77785 - DNA, 132 bp, Glycine max
  Peptide Sequence Number=SeqID_169470
atgggggatattgtttttcgaagttgggttgcttctcggaagcaacccagctcgcctgggcgagttgggcggcaacctcctccccctttttcctataaaaaggcaaaagggggttgttctaagggtccctga

SEQ ID NO: 77786 - DNA, 420 bp, Glycine max
  Peptide Sequence Number=SeqID_169471
atggaaagaggtgtgaaagctggtgaaagaaagtgggtcccacagaaaacttttgacctaaaaaatgaggtggatggtgagctcaaatgggtcatgaatatggaggtggcagtgaaggatgctatgtcaaatttgggtgttctagaagaagaagatggaagagagggagttggagttagagtccaacaaggtggcgtcacgttgaatcatgtaccatatttgtcagacttctatgacaatggctgtcatagcgtgacgagatggggctggcatggcatcaaccgagtaatgatacataatgctacggcagcaggaatggctgagcctcagagcgcattaaaaaaccacatccacatggaacatggaagaacacttcagtttctccaccgtccccatcgaacacaaatattcaaatcttaa

SEQ ID NO: 77787 - DNA, 2311 bp, Glycine max
  Peptide Sequence Number=SeqID_169472
agcgaaacagaagcagaagctctttgttggtgttctatttttggaattttctgctggtgatctcgttggaaaacccgagctttctgaggctcgggatctgaattgtgaagatggattcaaattcaacaaaggagaagctgcagaacagtccactgcttgtccattcctgtcttactcccctcaatacagcagtagcgttgtgaatatatacggaaattttgatgaaaaaggggcaaagattgacagattggagccatctgaattgaatatctttgaagattcaacattatactcagatattgagtgttgtgaccttctgaggcggatacatgaaggaaacaagtcaacaggggggcttaaatttgtaacaacttgctatggaatcatcggatttatcaaatttcttgagccatattacatgctgctcataacaaaacgaagaaagatcggaacaatctgtgggcacactatatatgctatcacaaagagcgaaatggttccaattcctcatgctattgagcggtccaaaatggcttattctaaggatgagaacagatacaagaagcttctatgcagtgtggatcttacaaaggacttctttttcagctactcctacaatgtcatgcttagtcttcaacggaacttatctgatcataatacaacaggacaatcactttatgaaaccctttttgtttggaatgagttcttaactcgtggaattaggaacaatctccagaatacttcctggactgtagccttagtgtatggtttttttaagcaggtcaaactttctatatctgacaatgagttcaacttgactatcattgctaggcgctcacggcattatgctgggaccagatatttgaaacgcggagtgaatgaaaagggtagagtagctaatgatgttgagacagagcagatagtctttacagatgctcgtggtggacggccaatgcaaatcagttctgtggtgcagatccggggttcaatccctctgttctggaaggactctaattttgaagccacaagacttcattttgaaaatcttgtcaagagatatggaaatccaattattatactgaacttgataaagacacgtgagaagaagcctcgagaaactattctgcgagccgagtttgcgaatgctgttaggtctcttaataaaaatttgaaaggcgaaaatcgcctgagatcaaacacctttagcagcaaagctactaatgtgttgggacaactgggaaaagtggctgcatatgcgctgaagctgactggcatcttctattgtccagtgacatcaaatgtgaggctagatggattttcgcattattcctacaccgacttgaagcatggacaatgcacaagtccacactaccttgtgctgaaacttcttggtcataaaagctactgtgttatggaccaagtcttccaaaagcataagctgaataacaatgtcactgatcactgcatcacagaacaagctagtataaacaaggataatgttgataaagaaacagaaattatcaattgttactgtagtagtgatgagaacaaagattacagtgtcaaaccccagatgcttcaatctggggtcttgaggactaattgcatagactgcttagatcgtaccaatgttgctcaatatgcttatggactagctgcacttggatgtcagctacaagctttaggatttgttgaaaccccactcttggggcattttcaaccccaacaaggaaatccagcactatgggaactagattcggatcagcattacactgtcaagaaacatggtctgtatgtagcagatgacagcgttaggtcaactattaaaagatcactatcagatggtaacattctcagtgaaagtgacactacaattaggaacttgaatgttacaaatgatcagaactcgtctgaaaaacctgataagcgtttcctttcgggctctactccagatatctatacttgtggaagtgatatctgtcattgcaggcagatatatgtcaatggccaaaattgtgagagtgatcatatttgttatgatgaacatggagatgcatgtgactgctccaatttccttgatgtggactggctttcttcttctggaaattcttgtgaagaggaattgcttgaaaggtcaaccagcatctcctcggagaatattgcgaatgaactaataactactgagacatctgcaagtgaatctggctccagcattaagggaaggcagagtggagaagaactcaacaaagatagcaaatacagtgaaagctttgaacgttggataactcaaggggagatgctttttatttga

SEQ ID NO: 77788 - DNA, 714 bp, Glycine max
  Peptide Sequence Number=SeqID_169473
atggttgaagctgtcgccactgttggtggtggcggtgacagagagagagagatgtcgagattgcgaagactgatccaagcttcagttgatgctactaagaaagttatatctggtaatcttgatgatttgatgccaccaccggagagacccatcttcagcttcaattccaagcaagagttaagcaagtggcatttgtattctgattctgaatttggaggtgggataactgagtcggaaaatggagcaacttctggaatcttctccgggaacctttctctggatgtctctgagggctctaaatggaacatcactcggagtggcttctgtggaatgcgctcaaaaaagtttgatggctttattgatttggattcatatgatactattgctatgaaacttaaaggagatggaagatgttatatatctacgatctacacagagaattgggtcaattcacctggacagatggaagataattcatggcaagcttttgtttatgtgcctgaaggcaactggtacattaccaagattcctctagctcgatatttacctacttggagagggaatgttatagatgcacaaatcgaaatgaatccatcccgtgttttgggcatgtctctatctgtcaatgctgagggtggtgtcccaggtgctagatctggaccaggtgatttcagagttgaacttgattggatcaaagccatgagaacagaatga

SEQ ID NO: 77789 - DNA, 2934 bp, Glycine max
  Peptide Sequence Number=SeqID_169474
atggcgatgggcacttctcccagttacttcgaccctcacaacctctcctccagacagcagttccgcagatacgggaagagacactcaagttcaggtgcttcaatccaatacgacaactcggcttctaagttaagtgaaactgggttgttatatgatggccaaagcatccatagtccaactaatgcagcacttgttcttgaaaatattaaacaagaggttgagagtcttgatgctgattacctggaagagaagacaccatattccactagaaggaaattgtctgccgttattgatggagtccctggggtggatgctggttttgactctggacgctactcattaaaggcttgtaagacagagggtgactcattgggagatggtgcagaaacaatcttcactttatttgcatctctgcttgattcttctttgcaagtgactgaagaactatctaaagatcaaatactggtgtcaggaacctcacatgtggtggcttgtgagtttgttgtggaggaccacacagctcaattatgccttcggatagtccagtggttagaaggtttagcttctaaagcacttgacttggaagcaaaggtgcgtggatctcatgttggtagttatctccccagctgtggagtttggcatcatactcagcgttacctgaagaaaggaaatcttgacatgaatgttgttcatcacttggactttgatgctccaacccgtgaaaacgctaatcttttgcctgatgacaagaaacaagatgaatctcttctagaagatgtatggattcttttaagggctggaaggctagaagaggcttgtggactttgccggtccgctggacagccatggagagcttcttctctttgcccatttggaggcttgaacacgtttccttctgttgaagctctggtgaagaatggtaaaaatagaactttgcaagctgttgaatttgaaagtggcattggtcatcagtggcatctttggaaatgggcttcattttgtgcatcagagaaaatagcagaccaaggtgggaaatgtgaagcagctgtatatgcagcccagtgtagcaacctaaaacggatgcttccactctgcaacgactgggagtcagcatgctgggcaatggcaaagtcttggctagatgtgcaggtggacttggaaatcactcgttcactgccagggggagttgatcagcttagaacttttggagatgtaattgatggaagccctggaaatgctgatggttcctttgagccttctaatggacctgaaaattggccaattcaagttttgaatcagcaacctcgacaactctcatctcttcttcagaaacttcattcaggggaaatgattcatgaagctgttacccgacaatgcaaggagcaacagcgacaaattcagaaaaccttccagtttgtaggaatcatttcacctaaattctttgtgctttctcacaggcctagtggagatcctcaaatgatacgatttggtgcacacctagtgcttgtgcttagatatttacttgccgaggaaatgaaggacaccttcaaggacaagattctgagtgttggtgataatattttgcacttattgcctaagctttcctgcttgtttcatgactttctagtctgtgaccgtgagcatgaggagttggtgggcatatatgcttctcagcttgcacgccaccgttgcattgatctctttgtgcacatgatggaacttaggctgcacaacagtgtacatgtcaaatacaagatattcctttccgctatggaatatttgccattttcttctatggatgattccaagggaaattttgaagacattattcagagatcccgagagatcaaggttggcaaatacgataacctgtcagatgttgcagaacaacacagactgcagagtcttcaaaaagctaaagtcatccagtggctttgctttacaccaccatcaacaattactaatgtcaaagatgtcagtaaaaagctgcttctccgagcactgattcatagagtaccagcaatgcctataggtgcccacacagtacttggttttcttgctgaacccttaaaacagcttgcagaaactcttgagacctctgaggattataatgtttttgaggatctgagggagttccaagactggcgtgagtattactcctgtgatgcaacctaccgcaattggctaaaaactgaagtagagaatgcagaagttcctatctcggaactgtcactagaggaaaaggaaagggccatttcagctgccaaggaaacactgagtgcatccctttcactactaaaaagaaaagaaacaccttggttggcttcgactgattgtatgtatgaatcagctgaacctgttttccttgaacttcatgcaacagcaatgctctgcttgccatctggagagtgtttgtgtccagatgctactgtttgtactacactgacgagtgccctctactcttcggctggtgatgaggttgtcttaaatcgacaactaatggtgaatgtttccatatcttcaagggacagttattgcattgatgttgttcttcgttgcttagcaatagctggtgatggacttgaaccacatgatctcaatgacggtggtattcttggcaccatcatggctgctggttttaaaggtgagcttcctcggtttcaagctggagttacaatggaaatatcctgtttggatgcatggtattctgacaaagatggtaccttagagtgcccggcaacatacattgtgaaaggactttgtcgtaggtgctgtctcccagaagtcattcttcgttgcatgcaagtttctgtttctcttatgggatcgggagtcctgcctgattgtcatgatactttgatagaactggttggcagtcctgaaaccgactttcttcacttgtttagtcaacagcaattacaggcaagattataa

SEQ ID NO: 77790 - DNA, 894 bp, Glycine max
  Peptide Sequence Number=SeqID_169475
atggcggtgctcatccgttgctcttgtttcctcactcgccctcgcttctcacaacctcaattctacgccaacaacaccaaacccgtactcccaggaaaattagcttgtctttctctaaaacgggacaagggtgttccacactttgtagacacgtttgatggatcttctaagattccgagtttgctgcactgctcaaagtgtaaggaagacatacaccaaaggttcccgtcactgatatttgtagcgagcaatattttgatgttctctatgcctaacacagccttggctgaaacgtgtgaggctgatacctctgttttcaatatgcctatactgctggcagtagcccttattggagccacagttggagggttgctcgctcggcaaagaaggaatgaattacaacgggtaaacgagcaattgatccaaatcaactcagctttaaggaagcaagccaaaattgagtcctatgcccctagcttgagttatgctcccattggcggtggtaggatacttgataatgaaattattgttaacccaaagaagcaggagctaatttcgaagttgaaaaatggaaagaactttctaaggaatcaacgaccagataaagcattcacggagtttaagaatgcacttgagcttgcccagaatctaaaagatcctattgaagagaaaaaagctgctagaggtctaggagcctcactacaaagacagggaaaatacagagatgctattaaatatcattccatggttctggccatctctgaacgggaaggagaagactcagggagtacagaagcttttggggcaattgctgattgttacactgagcttggagagcttgagaaagcaggccaattctatgacaagtatattgcaagactggaaaaggactaa

SEQ ID NO: 77791 - DNA, 618 bp, Glycine max
  Peptide Sequence Number=SeqID_169476
atggcttctgttctgtccacttcgtcaatttcattggctactctctccttcaattctgggggaagctctatgtttggtgagctaaaacttgtgaataaagtccagttaaaaagggcaacaaaaacgtcatttgcactctctggtggcattaacactataatctcgtgctccacggctgaactagaaactctgcaaattgtacaaagcacaattgcgaagcagctttctattgatgaagccactgtgactccccaaactaaattttcagatttgggtgctgattctcttgacaccgttgaaatcatgatggctttggaagagaaatttgacatttccattggagagggtggagctgagaacatctccaccgttcaagatgctgctgatctgattgagaagggggtgcgaggggtggtaggcgcagaaggagcagaggtggtggtggtggttccgaaaccagattgggagcgaacaatggtgatgctgcgacttatcggaacatgctccgccaccgttgaccggacggagcttccgccggagaacgagttgtactttcggagcttccccagacccgtttccggtgctggacccgccaacgtttcgtcccatagtttgtga

SEQ ID NO: 77792 - DNA, 3438 bp, Glycine max
  Peptide Sequence Number=SeqID_169477
atgaagttaagtgtagccagagaggaaagagaaaaagtaaaaaaaccgtactcagttcttaattgccccaacagaattgcgttatcaacattgttgagagcatgtgggaatggagcaggagccataacagtggcagatgcaaccacaaaggagctcctaagggcaattgatgtacgattgagtgcagttaggcaagacctaaccacagcatgtgctcgtgcatcagcctccggtttcaatccccacaccgtttcacatctcaaacatttcgcagatcgattcggtgctcatcgcttcaatgaagcatgcactaaatacatgtcactgtacaaaagaagaccggaccttatcagtcactggccaggtggcgatgacagggaactccgttcatctgttagttctgacatgtccatcgacaacgacgatgggcccaaccaagcccaggaccaggcccaacccatcgatccacctaagcccaagcctatttccaacttcgcttcgctgcgacgtagcaacaccagcgtgagctcgaaagacgagaccagcgacacccccaccaaagaggagacggagtcgccggctccggctccaacgactgctccgtcggggcggaggctgagcgtgcaggaccggatcaacctctttgagaacaagcagaaggagaattccggaggcagggcgccggagctccggcgcctctcctccgacgtgctgcgccggtggagcggcgctagtgacatgagcatcgacggcagcggcgagaagaaagactttgacagccccttacccccgccagcatcctctgtttctgaaaccaagtccgttgtcgtttctgaagataaggttcgaatcgacaaatcggagaaatttgtgataaccgatcaagggtcttctcaggaaacagggaaagtttcagtttttgatgaggacaagaatggggggtttaaggatcaggtgggtggtggtgtttctgaggcgacattgaagaagggttcatccgaggttgttattgttggtcctatgttgtcttctggggatgatgatgcgaagttttatggtgggatgaaaaatcatgtggttgcaccgtcacttattaggggatcccgaagtcattctcgatctctatcagcacagttcgaaggtggcaatggactcaaatttagggatgtttctgttcgtgttgatcaatcttcaccgaatgaggttgaggactcttcttcttcttcttcattccctaacaaggaagaggattcccaaatcccaaaaatgaagtaccagaaaccattacctggtagaaatgaacaacaaataagcacggcacaaggtaaaagggatggtgctaatgaaagtagcaagatgaaacaagttttggagactcaggataatgcacgcgcaacctcaaccccacctttagagcagcaacaccagagggtgaggcaatctaaagggaatcaagggatgcatgatgagctgaaaatgaaggctgatgagcttgaaaagctttttgctgagcataaactgagggttcctggggaccagtctggttctgtgaggagagttgagccagccgatgtgcatgtggaacagtcacaatatagaagaggtggagtaggggagtcgactcctcagttgccttccagaagcaatgtgattgaagtggctgcgagttctagcaatttgacaagctttgatgctaagttggttactaagatggtggatagtcagaattatggtgatgctttgaggcaaaacttctctgatcttaacttgagtgaagattctagaggaaagttttatgaaaagtacatgaagaagaggaatgctaagcttcaagaagattggagtatgaacagagctgagaaggaagctaggatgaaagccatgcaggatagccttgagaggagtagagctgaaatgaaggtcaagttttcggggtctgcaaacagacaagattcagcatcaggtgcttaccgtgccgagaaacttcgatatttcaaatcaaatattaagaaagagcagcatccaatagattcccttcaaaatgaagatgatgaagatctttctgaattctcagaagagaagacttatggtgcttcaaggcaaagtaggaaattttttcccaacagacatatatcttcaggcacacctcgtacaatagctgtgtcagtctcccgttcatctggtggcaggcgaagagacgatcctcttgctcagtctgttccaaacttttctgatttaagaaaagaaaatacaaagccttcttctgcagttagtaaaacaacccgcactcaggtaaggacctattcccgtagcaaaagcaccactgaggagatacaaggagtaaaggaagagaagtcaaggcaaactctgtcgttacggaaaagttctgctaatcctgcagagtttaaggatttgtcacatttgaactcagatgggattgttttgtctccattgaaatttgatatgggcgagagtcatctaggcccttatgatcaatcacctaggtctttccttaaaaaagggaataacataggttcaggttctgtcggcaacgctatccggatgaaagcatcaatggtatctgatactcagaaaaataaagaatttgatgaccttgaatttgatgaggaagattctttgcggatggccacagaggaacaggatgacattgaaactatggctatcaaagatgttgcttataataataatggaaaggtgagtctgagccaggaatctggtaagtctggtaattctggatctgaaattggtgattctactaggtctcttgctcaggtagatcctatttcagggggcgagatggctactgggtttccatcaacattcaatggtgtaagatctctgcaggactctcctgttggaagtcctgtgtcatggaattcgcgtgtgcctcatcctttttcgtacccgcacgagtcatctgacattgatgcttctatagattctccaattggaagccccgcatcttggaattctcattctcttaaccagggtgacaatgatgctgcccgaatgaggaaaaaatggggaagtgctcaaaaaccatttcttgttgctaattcatcccaaaatcaaccccgcaaggatgtcactaaaggttttaagcgattgctgaagtttggtagaaaaactcgtggatcagagagtttggctgattggatttctgctacaacttctgaaggagatgatgatactgaagatggccgagatctggccaatcgttcatcagaagacttgaggaagtcaagaatgggattctctcatggtcatccttctgatgacagcttcaatgaaaatgagctgttcaatgaacaggtccaatccttgcaaagctctatccctgcacctcctgctcattttaaactgagggatgatcatatatcaggaagttcattaaaaggtgatccctgggtaacataa

SEQ ID NO: 77793 - DNA, 378 bp, Glycine max
  Peptide Sequence Number=SeqID_169478
atggtgaaagttggaacctcttacgtgccgatcaacgtctcattttcgccaaaagttggcccagggcttcccgctgtccctcctgttcagctactgacggggtggtgcgtaacggcaaaagcaccgccggaatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaa

SEQ ID NO: 77794 - DNA, 304 bp, Glycine max
  Peptide Sequence Number=SeqID_169479
aagtagagggtacatctacttgggttgttatactgaaaacaagagagggtacatctcttatggatcagttcaagtggagggtacatctcttatggatcagttcaagtggagggtacatccacttggttgttcaaagagaacaagggagggtacatcccttgtggatctttggcttgtaaaggattttaaaaggttgaaagaaatctcaagaaccgttggttgcttggggactagatgtaggcacgggatgttgccgaaccagtataaatcttgtgtttgtcttcttcttccctacactctttaa

SEQ ID NO: 77795 - DNA, 193 bp, Glycine max
  Peptide Sequence Number=SeqID_169480
ccttgaagattcaaatgcagtcggtctcatttcttccaactccgagagttgtagcttcctttgctctctggatgcggcttcatcaaagttcggaagtttaaggcctagtatgctttatgttccatctccactggtaagtgacaagacttgccatagaccagttggaatggggataagcctatcagagtcttaa

SEQ ID NO: 77796 - DNA, 165 bp, Glycine max
  Peptide Sequence Number=SeqID_169481
atgtggtcggaatatgcgcttgaagtggtggacgcggtagcgcgcaccggcagttttagcgcggcggcgcaggagctgcaccgcgtgccctctgccataagctataccgtgcgccagctggaaggctggctggcggtaccgctgtttgagcggcagcatcgcgaa

SEQ ID NO: 77797 - DNA, 1413 bp, Glycine max
  Peptide Sequence Number=SeqID_169482
atgaaaaagaccaagatcgtttgtactatcggtccgaaaaccgaatccgaagagatgctgactcaactgctggaagcgggcatgaacgtcatgcgcctgaacttctctcacggggattatgccgaacatggtcagcgcatcaccaatatgcgtgccgtcatggaaaaaaccggtcgccaggccgcgattctgctggacaccaaaggcccggaaatccgtaccatgaaactggacggtggcaacgatgtgtccctgaaagctggacagaccttcaccttcactaccgatcagtcagtgattggtaacagcgagcgcgttgccgttacttacgccggtttcaccgaagacctgaaaattggtaacaccgtgctggtggacgatggtctgatcggcatggaagtcaccgaagtcacggaaaacaccgtggtgtgtaaagtgctgaacaatggcgaccttggcgaaaacaaaggcgtcaacctgccgggcgtgtccattcagctgccggcgctggcggaaaaagacaagcgtgatctgatcttcggctgcgagcaaggcgtggatttcgttgcggcttccttcatccgtaaacgttctgacgtgctggaaatccgtgagcacctgaaagcccacggcggtgagcacattcagatcatctccaagatcgaaaaccaggaaggcctgaacaacttcgacgagatcctggaagcctctgacggcatcatggtcgcgcgtggtgacctcggtgtggaaatcccggttgaagaagtgatcttcgcgcagaagatgatgatcaagaagtgtaataaagcgcgcaaagtggtaatcaccgcgacgcagatgctggattccatgatcaagaacccgcgccctacccgtgctgaagccggcgacgtggccaacgccatcctcgacggcaccgacgcggtgatgctgtccggtgagagcgccaagggtaaatacccgctggagtcggtcaccatcatggcgaccatctgcgagcgtaccgatcgcgtgatgaaatcgcgcatcgattccctgcaggattcgcgcaagctgcgtatcaccgaagcagtgtgccgtggcgccgttgagaccgctgagaaactggaagcgccggtgattgtggtggcgaccgaaggcggtaagtcggctaaatccgtgcgtaaatacttcccggatgccaccattctggccctgaccactaaccagaccactgcgcgtcagctgatcctcagcaaagggattgaaacgcgtctggtgagcgaaatcgcctcgaccgatgatttctaccgcatcggcaaagagatggcgctgcagagcggctacgcgcagaaaggcgatgtcgtggtgatggtttcgggtgcgctggtaccgagcggaaccaccaacaccgcgtcggtgcacgtactctga

SEQ ID NO: 77798 - DNA, 50 bp, Glycine max
  Peptide Sequence Number=SeqID_169483
tgaggctttgagagttggaaggttaagtctgaattctgtggtaaatggag

SEQ ID NO: 77799 - DNA, 902 bp, Glycine max
  Peptide Sequence Number=SeqID_169484
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcgcccagcttggaggcgcgcgaaccggtgaacgagaacagcggcaccggcaccgggatcggcacgttgatgccgacctggccgacgtcgatgtcttcctggaacttgcatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 77800 - DNA, 207 bp, Glycine max
  Peptide Sequence Number=SeqID_169485
atggctgccaaactcaggagcggcactggtcccctcagccacggcgtccctcctagatctctttgtggaaagctttctcggagccatttcttgcaaggacaaacatttggaaagttagtttacaagaaaacacttattttaaagcaaaaacaacatgctaatctttctgatttagaacaaacttgtgcacacatttccttaatgtaa

SEQ ID NO: 77801 - DNA, 175 bp, Glycine max
  Peptide Sequence Number=SeqID_169486
tgcatccgacgctaagcgcagcttcagcgcgcttagtgtgacaagggaatctggaagagcgcaagaatcaacgccgcatgctaagcgcgagatcagcttgctaagcaagatgttcgtctcttgccaggctcagtgcacaactggcgctaagcccatatccacttactcgcgctaa

SEQ ID NO: 77802 - DNA, 225 bp, Glycine max
  Peptide Sequence Number=SeqID_169487
atgcgtctattggggaaggagatgcggggcgagaaaatcgctggcgcacaggatttggttggcaatcaaagggagacgaccactttgggtcgtggtgtcgcaacctacccttcggcgggagggcgacgcgtgactcgcgggtgcgtgttccaagaaaggaatacgcgcggagtcgccaccaacgtttatttgaggaaaacatcggaaaaactggaaaagacgtga

SEQ ID NO: 77803 - DNA, 819 bp, Glycine max
  Peptide Sequence Number=SeqID_169488
atggctaagtttgaccctgatatagtcctggagttttatgctaatgcttggcccacagaagagggagtgcgagacatgcgatcatgggtgaggggtctgtggattccctttgatgcagatgccctcagccagttcctgggtgacccgctagtgttggaggaaggccaggagtgtgagttcaatcaaaggaggaacagggccgatgggttcgatgaggaggccattgcccagctgttatgcacctcggggcaggatttcacccggactgctgcagggaggcaggtgcagatcatgcacaccaacatgaccaccttgacccatatgtggatggcattgctgctcagcaatgtcttgcctagtgatcataactctgaccttcctctgtcaaagtgtcagttggtgtatgccatcctgacacggatgagcgtccatgtggctcagttgattgttgacgccatctatttatttacaagtatgccacccaccaggcaccctctagacctggataagtctaacagggccctggggtttttggcattgatcacgggcctctgccaatcattcggggttcccgtcactcctaacaaggcggccaaccaccaggggcaagtacagatacatgagtgtctctacaagctcaacctcagtcagcaggggcagggtttcgctccttttacgtgccctactccagagcagtttagcccgaggcccatacaggggaggcacctgccggattcccccgccgatgcagaggaggcccgcatggatgaggagatgacggacttgctcggtttcttgggaggaagcggagccacgtga

SEQ ID NO: 77804 - DNA, 534 bp, Glycine max
  Peptide Sequence Number=SeqID_169489
atggctgaagaagacgaggtgcaagagcggatgaaggccgacatggaggccatgaaagaacagatgaccacaatgatggaggccatgatgagcatgaagaagataatggaggtcaatgtggttgcagttgccactgtcagtgctgtttctggggtggacccgactctcccatctggcctcaacctaataaatcgtccaacctcggatacgggcggcccccattttgtgcaagtccagaacaagcatgttttctccccatatggtttgcctccaaactatgctccacccaatgagaatatcaataactcctctcctatactcattgagagccaacaacctcaaactgatcatgcacatgtctctcaacccatgggggagacacatgaaatatcccatcgcaatctagccgacttcgagcctcgccttggatatgccactaaagggcaagcagttggtgatatacccctacaaaacactttggagggccctcagtatcacccacaaccacacccctttgcattccacagcgggtaa

SEQ ID NO: 77805 - DNA, 183 bp, Glycine max
  Peptide Sequence Number=SeqID_169490
atgccaaaagatagagggacttgtcttgatttcagggattgtcatcatcaaaaagggggagattgtagacaaaggatcaagctgaatgttttgatgatgccaaaggatcacatgtttctcaaagctttattcaagacaaagaaattaaagatattcaagatggatgatcaagatagtctctag

SEQ ID NO: 77806 - DNA, 1680 bp, Glycine max
  Peptide Sequence Number=SeqID_169491
agcgtgatcctaacaatattgactggcgcaaaggtggtgctgaggtggtggttgaatctaccggtgcttttttgacgcaggaaacctgtcagtcgcacgtgaatggcggcgcggtcaaagttgtacaatctgcaccgggtaaagatgatacgcccatgtttgtgtatggcgtaaaccatactgattacgctggccaggcgattatttccgcagcgtcttgcacgactaacggactggcacctttagcaaaagtgctgcatgacacttttggtatcaagcgggggttaatgacgactattcacgcggcaacggcgtcccaattaaccgtagacgggacctctaaaaaagactggcgcggtggccgcagcgtgtttgaaaatattattccttccaccacgggtgctgccaaagcagtgggtaaggtcattccatccttgaacaagaagctgacagggatgtccatgcgagtcccttctgcagatgtttccgtggttgatctgacggttgagctgaatagcgaagcgacttatgaagccatttgcgcggccatgcaacaagctgcagacggcgcgctgaaaggtgtacttgagtacacgaatgataaagtggtttccagcgattttcgtagtagtcctgcggccagcgtgtttgatgccggtgccggtattatgctggatccgacgtttgtgaaagtggtgggctgtttatattcaagcggcggtgaccgcttaagggagaccttcatgaaattcatcaaaatgaccgacctcgatttgcgtggcaagcgtgtgtttatccgtgccgatctcaatgtgccggtaaaagatggtgtagtgaccagtgatgccagaattgtagcgagcatgcctaccattgagtttgccttgaaagcaggcgccaaagtgatggtgacttctcatttgggtcgcccggaagagggagtttacagtgaagagaactcattgcagccggtagctgacgtgatgagcaagttactgggccaacccgtgcgattggtgaaaaactggctcgcacctaacgcaccagaagacagtttgaccacgcaagatggccagctgattttgctggaaaattgccgctttaatgtgggggaaaagaaaaataacgatgagctggcgaaaaaatatgctgccttatgcgatgtgtttgtcatggatgcttttggtacggcacatcgcgccgaagcctctacgcatgggatcgccaagtttgcacctgtggcttgtgccggcatcctgctgacggaagagctggatgccttgagtaaggccttgctggcgcctgcgcggccactggtggcgattgttggcggttccaaggtctccaccaaattgaccgtgttggaaagtttggcggacaaagtggatcagctggtggtgggtggcggtattgcgaatacctttctgaaggcttctgggcaagaagtaggtaagtctttatgcgaggatgacctagttgacactgcgaagtgcctgatggataaaatggccgcgcgtggtgcctgtgtgccgattgccaaagacgtggtggtcggcaagcaattcgatgccaacgagcctgccgtgaaaaagccagcgactgaagtggccgccgatgaaatgatttttgatatcggcgcgcaatctgcggctgagttggtagatattattatgaaagccg

SEQ ID NO: 77807 - DNA, 843 bp, Glycine max
  Peptide Sequence Number=SeqID_169492
atgtctcaggctgcattgaacacgcgcacccgcgatgacgaagaagaatacgcctcttcacgccggagtaatggaacgcgtcttgcaggcatcattttcctgctcggggtgctgtgcaccgtgtttatcagcggctggatggtcctgggctggatggaagatgcgcagcggttaccgctttctaagctggtggtcaccggtgagcgtcactacacgcgtaacgatgatattcgccagtcaatactggcactgggctcgcctggcacctttatgacgcaggacgtcaatattatccaaagccagattgaacgtctgccatggataaaacaggcgagcgtaagaaagcaatggcctgatgaattgaagattcatctggttgaatatgtgcccattgcgcgttggaatgatcagcacatggttgacgtcgacggaaattccttcagcgtcccgaccgatcgtgtcaacaagcagaatttaccgatgttgtatggccctgaaggcagcgaaaacgaggttttacagggttttcgtgaaatgggccaggtgctggcgaaggacaggtttacgttaaaagatgctgcaatgacggcgcgccgctcctggcagcttacgttaacgaacggcattaagctcaacctgggacgcggggacaccatgaagcgtctggcgcgttttgtcgaactttacccggttttacagcagcaggcacagactgacggcaaacggataagctacgttgatttgcgctatgactcaggcgcagcagtcggttgggtaccggctccggtcgaggaacctaatcagcaacagaatcaggcacaggtacaggcagaacaacaatga

SEQ ID NO: 77808 - DNA, 261 bp, Glycine max
  Peptide Sequence Number=SeqID_169493
atgatggtggcccgggtgatgctggggaatggttacgaacccgaaatgggtttaggcaggaacaacgacgacagaaatagcctgataagcacaagaggaaatcgtgggaagtttgggttaggatataaacccacgcaagcggacataaggaaaagtgtcacgggaaggaagagcggaagccaaggttcgcaatcgggacaaaaagtcgaagggggcccgccctgccacatcagtaggagctttataagcgcgggtctatga

SEQ ID NO: 77809 - DNA, 192 bp, Glycine max
  Peptide Sequence Number=SeqID_169494
atggcgaggacgtgtaatcctctgaaggcgaggacatgcgttggaccttgtcgcaacctacccttcaacgggtggacgacgcgtgactcgtgggtgcgtgttccaagaaaggaatacgcgcggagtcgccaccaacgtttatttgaggaaaacgtcggaaaaaccggaaaagacgtggtctacgagctttaa

SEQ ID NO: 77810 - DNA, 483 bp, Glycine max
  Peptide Sequence Number=SeqID_169495
atggtggtcacagcacgaccggagagggtggtacgccagtttggttacatccagagcatccttccactgcctgttagtgctcgattgtcacacgatgagatagatgacaggtggatgcagtttgcggagcacttactacctgcgagtcagctttgtctagtgcctgggcaggtatctgtggattacatggagtggtttttccgcatatctcacacattcatgataccaacccaggcaggtgaccagtcgagagatgcactagctgcagaccctgaggactacatacagccgcccagcccccaggttccagtgacatttgacccccctccacatgtgaggttggagcgtgtgctcaaccttaggatagtcactgcaggcacaaagttatatgacattaggcaggactgcctgacgatcgcgagagggggacccagtgctgatggaactgtcagggctcgtcagagacgccgcacggaccattga

SEQ ID NO: 77811 - DNA, 165 bp, Glycine max
  Peptide Sequence Number=SeqID_169496
gttgttatactgagaacaagagagggtacatctcttatgaatcagttcaagtgtaatgcaatcctccctaggaagggaccagtcactagaaccatgagcaagaggctccaagaagattgggctagagctgctgaagaaggccctagggttctcatgaacctcagg

SEQ ID NO: 77812 - DNA, 144 bp, Glycine max
  Peptide Sequence Number=SeqID_169497
atgggctctaaattcacgacgttgcgcttagcgccaccctcctgcttagcgcggcacgttgaagctgcgcttagcggtggatgtgcgcttagcccaactgctgagtgttcagcttccggcaagtgcaccggatcgcacaagtag

SEQ ID NO: 77813 - DNA, 405 bp, Glycine max
  Peptide Sequence Number=SeqID_169498
atgtctcttgccactctctttggaaaacttcaagaacatgaaatggaacttatgagactccatcgacatgaagagaatgatataaagagaaaaggaatagcactcagagcctcatcatcttttattcaagaagaaagtgacaaagaggacttgactgaaacaaaagaagatgatgatgatttcagactctttgtgaaaaggttcaataaatttttgagaaacaaaagaaataaaagggaatcaatcatcaatacagagaagaaagaagaagactcctccttaaccccaacaggctatgaaagtaatcaacttgggcacatgagattcgattatcttgtctttgaaagaagaattgaaaaatccgacaagaggaatctcaaagaaaagaaagaaaagaaagcatag

SEQ ID NO: 77814 - DNA, 432 bp, Glycine max
  Peptide Sequence Number=SeqID_169499
atggcagcgcagttagtccatgattgcgtggtgatggagtgcctagagggagtttgggagaccctcgaaggcgatgagaggtgtcgattccgtggcacaattcgactcactgctacttcattggtacatccggaggaacccacacgtacgcttcagcagcctgtggagtggatactacctacacctactccatatcgactagtggagccagttcaagtgatagaggtgtcatccttcgaagaggatcctgaagaggacccagaggagttacctcctgagcctgctgtggatgctcttgactttccagaggatgatgaggacccactccttgatgtggattctttagaggatatcatgtcagcatctgaggcagactctacagaggagagcggccctggaaggacagcgaatagtgaagactcttcatcatag

SEQ ID NO: 77815 - DNA, 204 bp, Glycine max
  Peptide Sequence Number=SeqID_169500
atggctccgagaaagctttccgcaaagagatccaggaaggacgccgcagctgaagggactagtgccgctcccgagtttgacaaccatcgtttcaggagcgttgagcaccaacaacgtttcgaggccatcaagggatggtcattccaccgagagagacgcgtccagctcagggacgatgagacacagatttccaggaagagatag

SEQ ID NO: 77816 - DNA, 521 bp, Glycine max
  Peptide Sequence Number=SeqID_169501
atgaacgaccctctccatgagtcgatctcttgctttctcataagggtggacccttgggtactagtacctatcaccttcagagggctacacgtcctcgccttcagaggactgcacgtcctcgccttcagaggactgcacgtcctgaccttcagaggactacacgtcctcgccttcagagggtcatgtaccttcacctttagaggactacacgtcctcaccttcaaagggctgcatgccctcaccttcagaggactacctgtcctcgccttcaaagggatacacgccctcatcttcagagggtcttgtaccttcacctttagaggactacacgtcctcgccttcaaagggctgcatgccctcaccttcagaggactacctgtcctcgccttcaaagggctacacgccctcatcttcagagggtcatgtaccttcacctttagaggactacacgtcctcgccttcaaagggctgcatgccctcaccttcagagactacctgtcctcgccttcaaagggctacat

SEQ ID NO: 77817 - DNA, 520 bp, Glycine max
  Peptide Sequence Number=SeqID_169502
tattatcttggtcatcaccaacatcaatcatatgcgaaacctaatgtacctccggtgcatgttcctagatttatgtctcatcatcatccatcacaagcacaatatcaatcaacaagtttccctggtcatgcgtctcaagaaatcactggggttctcatcatatatacctcaatactcatttcaagttccttctacctcaaatgttttttatggctcctcacaaatgtttgccaccactttcaatactccaccatctgcatgtaatcttgcaccatcaagttcttgttatcatccatcattacctactcaaatacgtgacatcagtcacgaagatgaggatgaggatggggataacaacaataacaacgatgacgatgatgatggtgatggtgatgatgacaatggtggtcatcatgttcctcaacaacaacagacaattacaggtgagcatccaagaacaagaggaggtagaggcggtagatcaagaggacaacaaacacaaacaaatccagtccaataa

SEQ ID NO: 77818 - DNA, 204 bp, Glycine max
  Peptide Sequence Number=SeqID_169503
atgctccacagcctaaatcaaaggcttctgctagctggattgttgtcaagacaaaaaggaagtactaagtgtggctactatgtcatgcactggatgtccaccatcattttaggatcttttaggaataactgggaagcgaccattggagccagagagatgaaaggcgttgcggatccagtgggcacagtattatctccgagttag

SEQ ID NO: 77819 - DNA, 414 bp, Glycine max
  Peptide Sequence Number=SeqID_169504
atggcggcgacactagcgtctagcggtagcgatgctagtagttatggtgctaatgatgaaggttgtagaagtggtggtgacaatgaaacaattcttgaacctaatgaaaagttgccgccatatggagggcaacatgaagtggggtgtcactatgaggactctgaatcatacctattcaccattgaaactcctttcaacagagtcttcccttggaagagagattttgttgctgagtttgattgcaacttctctttcatggttcaactacctcttcatcttcactcgtcacaagctgaagctgatccaaatactcttgcagttgaagtttataatcccccaccatccaaggaatatgtttgttgtattgaaaagactcttcttagaacaaggggagctcttgttacagcattttag

SEQ ID NO: 77820 - DNA, 363 bp, Glycine max
  Peptide Sequence Number=SeqID_169505
atggaagggtatgcaaacaaaggaagaaaaaaggaaagtgcggtttccttcccaaaggaagtccaagctcatgccaagaagagatggtcaatttcaagtgatgacttcgtagatttgaggacaaatactttacaagaaggagggaatgatatgggcatccaagcccatgacaaccaccagacccaggcccatgaccagatggaagcccaagacccaatacaagacataggaggacctatgacaagagctaaaaaggcccaagaaactttgaaacatatggtgactattctaggggcagttcaaatgcagggagaggcccacaagggagagttactagtcttatgtgttgattgcttgggatga

SEQ ID NO: 77821 - DNA, 345 bp, Glycine max
  Peptide Sequence Number=SeqID_169506
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaagtatgctcttgacatcctagaagagactatcttattgaatgccaaacccatggacactcctatggatcctagtatcaaattgctaccatcaggtggagcacttatcaaatcctgggagatacaagaaattggttggaaaattaaacgatctgacaattactttcccatataa

SEQ ID NO: 77822 - DNA, 351 bp, Glycine max
  Peptide Sequence Number=SeqID_169507
atgtcaaagaacatccctccttcacgaaaagaggcatcatttgcacttgctgcattgatggaaattccttctcagtataaggcagcaatagagcttaatctactgggtactcggcaagtgaatgctcttcaaaggcatgccctcccacctcccacatataatcctcatgcagcaaggtttgagccaagtattcctcctcaacatggcaacagccacctagttgccacagctccttctgccccaagttccacttatgacaatcaaaaaatggacaagattcaaggcaaggctaggttaaccagtatgttagcacttaatatatcatatgctgattatggtagcaggcagtag

SEQ ID NO: 77823 - DNA, 333 bp, Glycine max
  Peptide Sequence Number=SeqID_169508
atgggtggacgtattatagcaccattctgcaagggagagttgggtgcatgcaatggtgaaaagttcgcgccaaaatcgtccaatgaagatgggatcacggtccgagatgaggctgcggggaaaaccgtggagtttgcataccatattgaggaagagagtggcaaccttatgggcggaataagcaggcttcaaggcgccaaagtgagcccctttggtgaaacaatcgaccacgacaaggatagtggtgtagccatgcgaaggaggaaggctcgtgataaagtcaagagtgagatcttcccatggagaggagggtatcagaattggttggagtaa

SEQ ID NO: 77824 - DNA, 1164 bp, Glycine max
  Peptide Sequence Number=SeqID_169509
atggggttcctcgtgcaatttgttgtttttatgttattcccttggtttctgagtgtgagagctgaggaaaattactcatcacagcattgtgatttcccagccatattcaactttggtgactccaattcggatactggttgcatggctgcagcattttaccctgaggttttgccatatggtgaaactttcttccatgagccagttggtagagcttctgatggtcgccttatcatagatttcattgcccagcatctaggtttcccattcttgagtgcatacataaattcaattgggacaagttataggcacggtgcaaactttgctgcaggatcatcaaccattaggcgccaaaaaaggacagtctttgagggtggcactcctttcacttttgaaatacaggttgctcagttcaaccagtttaaggcacgcaccagaaagttcttcaaccaagatgcacaagggaaaaactccttcagaggacactttcctaggccagaggactttgccaaggctatctacacatttgatattggacaaaatgatattgctgctgctattaacaaagtggacacagaagattctcacgcagtgatctcagacattgtggattattttgaaaaccaagttcaaactttacttggactaggagcaaggacattttggatacataacacaggccccattggttgcttgccagttgccatgcccgtgcacaatgccatgaacactactccaggggcaggttaccttgatcaaaacggctgtataaattatcaaaacgacatggcaagagagtttaataaaaagctcaagaataccgtggttaaactaagggtacagttcccagatgcctcattaatttatgtggacatgttctcagctaagtatgagctaatcagtaatgctaataaagaaggatttgtggacccttctggaatctgttgtgggtatcatcaggatggttaccacttgtactgtgggaacaaagcaataattaatggtaaagaaattttcgcagatacttgtgatgatccttccaagtacattagttgggatggagtgcactacacagaagctgcaaatcactggattgcaaatcgaatacttaatggttccttttcagatccaccactttccattgcacactcgtgccgtgcccaataa

SEQ ID NO: 77825 - DNA, 2358 bp, Glycine max
  Peptide Sequence Number=SeqID_169510
atgattagcacttggccctccaaagttaaccacttggtggttcctcgctttgaaataggcccttctggtgttactgatcagaataggagaaggagggtgaaactgggttttgctttttccgtttctcatagtgaaaaagttagtgtttttcaattttcaagagggtatgggactgtggtcttttctggacatgcaaagttggatttgagatgtgggtttttgttgggatgctctagacccaaattgggtatcattttgaagccacacaagagtcatgttggagacttagctccacccttagggtgggcattggaggaggatggtgttgggagtgaattggttgatgagcagattgattctaatgatgcatcggtaaaccgtgagtcagagggtgtaaagtctttgaatttggatcaagttcaggacagtgactttgaaggacaaattcgtggttatgatgacgatagcaaggaaagtggtggcaatgaattggttgaggagcagactgattctaatgatgcattggttaacggtgacttggagggtgtaaagtctttgaatttggaccaagttaaggacagtgattgtgaaggaaaaatgtgtggtgatgacaatagcaaggaaggtggtgaagaagaaagtgatggtaaggttgatgtgagagcacttgccttgtcattgcagaccgtgaagacagtggaggacgtggggggtattcttaaggacaagggggacttgcccctccaggtgttttcgacaataatcagtggttttggtaaagagaagaggatggattctgctttgattcttttcaactggatgaagaagaggaagatagaaactaatggctcttttggccctaaccttttcatttataacggtctattaggtgttgtcaaacaatctggacaatttgcagagatggaagtcattttgaatgaaatggctgaagatggaattgcctacaatgtggtgacatataacaccttgatggcaatttacattgagaaaggagaatgtgacaaagctctcaatatgcttgaggagattcgtaggaatggccttaccccatctccagtatcctattcacaagccttgttggcatatcggaggatggaagatggctacggagctctaaatttctttgttgagtttagggaaaaataccgtcaaggtgaaataggaaaagatgatgatggagaagattgggagaaagaatgcttgaagctagagaagttcacaatccgtgtttgctatcaagtaatgcgttgttggcttgtcagtcgtgataacttgagcaaaaatgtgttgaagtttcttgttgatatggataatgttgggattccactaccgcgggctgatcttgagcggcttgcgtgggcttgtacccgtgaagatcactacattgttgtgaaagagctgtacaaccggataagagaaaggtatgataagatcagcttgtctgtctgcaaccatgcaatttggttgatgggaaaagcaaagaaatggtgggcagctttggagatatatgaagatttattggacaaagggccaaaaccaaataacttgtcatatgaactgattgtctctcacttcaattttcttctcagtgcagccaagaggaaaggaatttggagatggggtgttaagttgttgaacaagatggaggataaaggcctaaaacctggatgtagggaatggaatgcagttcttgtggcctgttctaaggcttcagaaactactgcagctgtgcaaatattcaagagaatggtggaaaatggtgaaaaacccactataatatcatatggggctttgttgagtgctcttgaaaagggaaaactctacgatgatgctcttcgtgtgtggaaccatatgatcaaggttggggttgaaccaaatgcatatgcctacacaattatggcttcgattcatactgcccaaggaaattttaatagggttgacgccatcattcaggagatggtaacattaggaatcgaggtaacagtagtgacatacaatgcaataatcactggctgtgcacataatggtatgagcagtgtggcgtatgaatggtttcaccgaatgaaagttcagaacatctctcccaatgagataacttatgaaatgctgattgtagcccttgcaaatgatggaaagccaaggctggcatatcagttatatacgagagctaaaaacgaaggccttaccctctcttcgaaagcttacgacgcagttgtccaatcctctcaggctaataatgcaaccattgaattaggtcttttaggacctcgccctgttgataaaaagaagaaagtgcaaattagaaaaacattgaatgaattctacaacttagctggt

SEQ ID NO: 77826 - DNA, 1284 bp, Glycine max
  Peptide Sequence Number=SeqID_169511
atgaagttcaacagtagaaattgggttacactaatagcctcagtgtggatgagcttcacagtgagtgtaatggaaggtgtgcgtcctttacctaatccattaatagaggcacatgggcacgttaagcatgcaacggcaaaaagatgggccgttcttgttgctggttcaaagggttatgataattataggcaccaagcagatgtttgccatgcctaccaagtactaaagaagggtggtcttaaagatgaaaacatcattgttttcatgtatgatgacattgccaaccatactctaaaccctaggcttggcactgtaatcaataaaccaaatggtccagatgtttataaaggagttcccaaggattatactggaaatgccaccacttcagaaaacttttatgctgtaattagtggtaaccgaagtgctctctctggaggtagtggcaaggttgtggacagtggtccgaatgacaccattttcatttattatgcggaccatggtgctaccggtgtcattggcatgccagttggggattttgtgatggccaacgatttcgtagatgtgttgaagaagaaacatgcagctaaatcttacaaaaagatggtgatatacatggaagcatgtgaatctgggagcatgtttgaaggtattcttccgaataacatagacgtatatgcgaccaccgctgccaacacagatgaggatagttatggtttttattgtcctgatctctaccctactccaccgcctgagtacactacttgtttgggagatgagtacagcatttcgtggttagaagacagtgacaaaaatgatatggtaaatgaaactctgcaacaacagtatgaaacagttcgtcgaagaacgttagttagtcatattaatgccacttcccatgtgatgcaatatggagataaagagttgaacaatgattctctagctatctacattggtgcactagcccccagtctaagtcttaatgaaaatgcacattcctttgaacaatctactactcaaactaaacttattagccaacgagatacccgtttactccatctcaggctcgagttgcaaaaggctcaagatggttctgagaagttgaaagctcagaaagagttagctgatgaaattgcacataggaaacatgtagataatgttgtccatctcataggggatctcttgtttggagaagagaatagctctgctatgatgttccatgttcgtccagctggcaagcctcttgttgatgattgggattgttttaagacccttgtaagtgcataa

SEQ ID NO: 77827 - DNA, 246 bp, Glycine max
  Peptide Sequence Number=SeqID_169512
atggcagcggaatggagaaggaagagagagaggagacgccacttcaaggagaagatgagtctagaagaagctcaccaccataggaggccatggataagagcttggaggaagaaagagatgaatgaagggagagggagaaaagagcacgaaattttgtgctctaaaagagctctatatctgaacccactaatccaagatcaattccaagattctccactaagtgtgcttaggtgtcatgaggcatga

SEQ ID NO: 77828 - DNA, 408 bp, Glycine max
  Peptide Sequence Number=SeqID_169513
atggcaaggattcctgacaagattaagtctattgatgggtcaagagagacacttaaacttgctgtgagaatcatggatctttggttcattgggactcccaacaagtctgagcaagcggaaatggttactgctgattctgagggtgatcaaattcatgttgtttgtaaagcggaccagctaaagtcttggaaagcttatttgaaggaaaattccacttatgttatgcataatttcaaagtggtgaagaatgatggtcaatttagagtgtgtgaacatgagtacaagttagtttttattggagtgactgttgttagagaagcttatttgcatgaactgccttttaaggaatttagatttgttgaatttggaaatgtcgttgctgggattttgtggctggcctgttggttg

SEQ ID NO: 77829 - DNA, 315 bp, Glycine max
  Peptide Sequence Number=SeqID_169514
atggacatgaatgtgggagcctttatctctggccagatcacatctatagcccagtctaactcttctagacttcggttccctgctttgatcactgccctgtgtaaggccagagaggttaattctgacagcttggttttcgagcgcctgagaggggccaagtgggcaaggacgaggccagctgagcctccttccacatctacaactcatattccagcacgtatctcagcagctccttctgtcccagcttctgcagattttcagcatcttgaagccatgcttcaaagcatctatcaggggcagattattctattatag

SEQ ID NO: 77830 - DNA, 452 bp, Glycine max
  Peptide Sequence Number=SeqID_169515
gagtgtgccagattacgggaagagaatgcaactaccgcaagagcccttgaacaagagaccaagagggctcgcaaggaagagtatggccggaacaaatttcgcggagctctgtggggagttagttgcctgttcaaggtccaaaagaagcttgtctcagcgtttatgcgagacggagaccaacatgctagctatcatcgccaagtaccaagaagagttaggtctagccacggcccacgagcataggatcgcggacgagtatgcccaagtatacgcggaaaaagaggctagaggaagggtgatcgactctttacaccaagaggcaaccatgtggatggatcggtttgctcttaccttgaacgggagtcaggaacttccccgattgttagccaaggccaaggcgatggcggacacctactccgcccccgaagaaattcatgggcttctcggctatt

SEQ ID NO: 77831 - DNA, 506 bp, Glycine max
  Peptide Sequence Number=SeqID_169516
atgactaggggcaatccaggtgatttacaacccactgatcctgaaatagatagaacctttcatatattagttaggcacaatgtgcatcttgatcattctgtgcattttgagcattgtgagcattttgagtattctattgctggtgattctgaatattctgattttgagcattcggctattaattttcatattgagaacatggctcaacctccacctcatgagaggactcttatggagatggttgcacctgatttcacttatgaaagcttgtgcattcaatatcctgataagggtgttccatatgttctgaagactagactaatacatttgttgcccaagtttcatggtcttgcaggtgaagatccacataagcatcttaaggagttccatattgtttgtttcaccatgaagccccctgatgtccaggaagatcatatctttctaaaggcttttcctcattctctggagggagtggcaaaagattggttgtactaccttgctcccag

SEQ ID NO: 77832 - DNA, 201 bp, Glycine max
  Peptide Sequence Number=SeqID_169517
atgaggaaggatctggaagaagatgatctgtacaggctcactgagcgcaccacttcatctcatcaagagcactgcttcagcccatccgctgagcgagaaaagagcgctaagcaaaaattcactaatagctttgcatgtctagagattctagagagagaaaggtccaagttccagagagttttgagagactctgctgtgtga

SEQ ID NO: 77833 - DNA, 155 bp, Glycine max
  Peptide Sequence Number=SeqID_169518
gtgaaaagatgaagaataagaaggttgttgtggctggtgtctcgctatgcgaggcttgtgcgcttagcgagaatcattcgctaagcgagacactcagcccgtttagcatgtcgggagaatctagaggagaatctgtcaagcatctacgcgcttag

SEQ ID NO: 77834 - DNA, 270 bp, Glycine max
  Peptide Sequence Number=SeqID_169519
actctagaggatcccagtaagggcatcagcccccctactaatcgagctttcatcaagaagtactgcgtctccaggcaggcacagggcgaaacaccacaacagcctggggatggccggcagcgggcaacagacgcaccgccatcacctctagagttcacctctgctcatccacaaaaaggtttgagtattgtctacaccacatggccgaccaataggcgaccaagtccaaagccaaaggtagcaagataccttggatatgcgtgcatatag

SEQ ID NO: 77835 - DNA, 981 bp, Glycine max
  Peptide Sequence Number=SeqID_169520
atgggtttaccttggtatcgtgttcatactgttgtattaaatgatccaggccgtttgctttctgttcatataatgcacacagctctggttgctggttgggccggttcgatggctctatatgaattagcagtttttgatccctctgaccctgttcttgacccaatgtggagacagggtatgttcgttatacctttcatgactcgtttaggaataaccaattcgtggggcggttggaatatcacaggagggactataacgaatccgggtatttggagttacgaaggggtggcttgttttggttttggcgcatttcatgtaacaggattgtatggtcctggaatatgggtgtccgatccttatggactaactggaaggatacaatccgtaaatcccgcgtggggcgtggaaggttttgatccttttgttccggggggggtagcttctcatcatattgcagcaggaacgttgggcatattagcaggtcttttccatcttagtgtgcgtccaccccaacgtctatataaaggattacggatgggaaatattgaaactgtcctttccagcagtattgctgctgtcttttttgcagcttttgtcgttgctggaactatgtggtatggttcagcaacaacccctattgaattattcggtcctactcgttatcaatgggatcagggatactttcagcaagaaatatatcgaagagttggtgctggactagccgaaaatcaaagtttatcagaagcttggtctaaaattcccgaaaaattagctttttatgattatatcggaaataatccagcaaaaggggggttatttagagcaggttcaatggacaatggagatggaatagccgtcggttggttaggacatcctgtctttagagataaagaggggcatgaactttttatggggatggaattgttagggccgatgttccttttcgaagggcagaatctaaatatagtgtggaacaagtag

SEQ ID NO: 77836 - DNA, 219 bp, Glycine max
  Peptide Sequence Number=SeqID_169521
atggacatagaatatactataagaaaagacgaatcacctgccatcactgatgaaagtagcccaactgatgttgcgctatatgagcactgggagcgatccaaccggctcagcgtgatattcattaagactaaaatttcggttgagatacgtggttctattgaccagtatgaaaagctcaccagtgtgaaaggtgtgcatgagtacataatgaaaatgtga

SEQ ID NO: 77837 - DNA, 204 bp, Glycine max
  Peptide Sequence Number=SeqID_169522
gtcttccggaagttacgaatgcaatatccggaagaaggtcttccggaagtagttccggaagaacttctccggaatttgtacattccggaagaccttcttccggaagtggtcattccggaccttcctccttctgtgcctaaaatttcttccggatacactttttactgtttttcttctctaaaaactaaccggaaaatgaaataa

SEQ ID NO: 77838 - DNA, 120 bp, Glycine max
  Peptide Sequence Number=SeqID_169523
atgtcgggtctgctagctgttaaatatagtgcagatgttctgatgcaatcctactccgcaagggcattggatagaaaaactccgagtagattgggccagagatgcaagagaaggccctag

SEQ ID NO: 77839 - DNA, 270 bp, Glycine max
  Peptide Sequence Number=SeqID_169524
atggactcgaaatctaccctaaggctcatgagaaccctagggccttcccttggatctctagcccaatctacttggagtcttctatccaatgcccttgcggggttggattgcatcaagccgaggatcttcttcatcaatggattcctttgcttcttggaagatgaatggcagcagaatggagaaaggaagagagagtggagatgccacttcaaggagaagatgagtctagaagaagctcaccaccataggagaacatggataagagcttga

SEQ ID NO: 77840 - DNA, 318 bp, Glycine max
  Peptide Sequence Number=SeqID_169525
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggttttcccagtcacgacgttgtaaacgacggccagtgccaagcttgcatgcctgcagtcgactctag

SEQ ID NO: 77841 - DNA, 126 bp, Glycine max
  Peptide Sequence Number=SeqID_169526
gaacgtatagttgatcctgagggatttctggaatgttccagtcatccatattggtgtttcttgaagaagatgaagaggaggaatttgagcgaaaagagatacgggaaaaggatcgcaataatctag

SEQ ID NO: 77842 - DNA, 634 bp, Glycine max
  Peptide Sequence Number=SeqID_169527
atggtcattgaccaatcccttttccatgacttaaaccaattgtccagtgacggtgtaccatttgaaggtacactaaatgacgattggaaatttgatttctctgcacatgatgcccgccagttggtttgcaccaaccatgcggatatgaccggacgcctccttgccggttcattggcttttgaaagccgcatccttcattatcttattgtgcggattttacttccacgatcttccaaccttgcccaggtttctaaggaagatcttgttatcatgtgggcctttcatactgggtgtcaacttgactgggcacatttagtcagatatcgcatgcataaggcattgcgattaaatgctcctttgccatatccacaccttgttactctcttttttcgccattttcaaattcctcttgattctgaaccttatgttccaatcaagagatcctttttaattggtgctgctgttattgcttctcttggttaccgcaaaaagcatgatggctcttgggtcaaaaaggctgctcaacccgctgatgatgaaggcaacctaccaactgaagataaacttgtaaaaggaatttacaagatagtggactctcaagcgcgttgcttggggactggacgtaggcacaagg

SEQ ID NO: 77843 - DNA, 477 bp, Glycine max
  Peptide Sequence Number=SeqID_169528
atgcctcaaaatgttctttacgatgccattggggatatatcaacggtgggatatccagtgatttttttctccattttagctcccctagctcctgaaaatctcgataactcaaaaaatacgcccggtagggatcttatttcattatgggtgaaagttgggaacctcttacgtgccggatcaacgtctcattttcgccaaaagttggcccagggcttcccgcaccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaa

SEQ ID NO: 77844 - DNA, 60 bp, Glycine max
  Peptide Sequence Number=SeqID_169529
atggagactagcggaggtgtgaagataggtcataggggcttgtggattgcacgtaactag

SEQ ID NO: 77845 - DNA, 513 bp, Glycine max
  Peptide Sequence Number=SeqID_169530
ggtggaccttgggtactagttaccctcaccgttgagaggactacacgtcctcgccttgagaggactacgcgtcctcaccatcagagccggctgccacgccctcaccatcagaggactacatgtcctcgccttgagagggctacacgccctcaccttggaggactacacgtcctcaccatcagagggctgcacgccctcacctccagaggactatgtcctcgccttgagagggctacacgccctcaccttgggactacacgtcctcaccatcagagggctgcacgccctcacctccagaggactatagtcctcgccttgagagggctctacgccctcaccttgggattacacgtcctcaccatcagagggctgcacgccttcacctccagaggactatacgtcctcgcctggagagggctacacgccctcaccttgggtactagttaccctcaccgtcagaggactacacatcctcgccttcagagggctacacgccctcaccttgggtactag

SEQ ID NO: 77846 - DNA, 418 bp, Glycine max
  Peptide Sequence Number=SeqID_169531
tcgactggtaccatcgcccgatcgccacctagtaccacatgtgacggagtggtacctggagatatgtcgcgggggttaggagaccttggggacgtcaggcttaaaaatgaagacaggaagttaagatggcctctggtaatcgattaccaagggcttagaaatggagacagtatgttgtggaggcctctggtaatcgattaccaatactgtgtaatcgattacacagagtatcaggccactgggagtttgggagaccctcgaaggcaatgtgaggtgccgatttcggggcatgattcgattcacggctacttcattggtacatccagaggaaccagcacgcacgctttagcacactgtggagtggatattacctacacctactccatatcgactaggggagccagtcccagtgatagag

SEQ ID NO: 77847 - DNA, 481 bp, Glycine max
  Peptide Sequence Number=SeqID_169532
tcagggtgcaccttttgagggtacccttgttgatgactggaagtttgattactcagtcatgatgcctgccgcatggtctacattgaccagaattttgatgcctcattcttctaatctcgctcaagcctctgaggaggacttcattctgatgtgggctttcttgactggtgccggtgcggtaacctcctttggctactgtaaggacatggacggccaatggatgaagaaggacgcacaacctccgcaagacaaacgtactccttctcctccgcctcaacgagatgattcctcagccctcatgaatgaagttcttttggagttacaaggcctccgcacctatgttggtgaacgctttgattccttggatggtcgtatcgatgctattgatgctcgctttgaaggaatgaatacccgcatcactcaacttgaagaggatgtgagttatcttcgtcggtgcttcgaccttccaccaccttcctag

SEQ ID NO: 77848 - DNA, 234 bp, Glycine max
  Peptide Sequence Number=SeqID_169533
atggtagatacgttgcctacgttctactatgaaaagatgataggatacatgccagctaactttgcggatctcgtcttcgccagagaaagaattgagttcggactgagaaaaggcaagtttgaatatgcctccaacgtggcccccaacataccagaaggatgcatgtctcccgtggtgggtgcgaggaaaaaggaaggagatacctcagggtcaccaccgccccaacatagatga

SEQ ID NO: 77849 - DNA, 393 bp, Glycine max
  Peptide Sequence Number=SeqID_169534
atggatatctctgaagatactgacatccctgtgatattgggaaggtcattcatgttgaccacaagctgcatagtggatatggggaagagaaagctggagctaggttttgaagatcagaaaattgattttgatttgtttgttgaagacaagcctactccagagcacaatgtctgtttacaggaagggactgaaaaatggattagaaaacattttctgaaaaatagtcctttcactaagcgccggcttcgcgctaagcgcttctttggtcatgtgctaagccgagagtctcaagcgcttagcgcccaacccttgcatctgaggctaatttggttcgctaagctggccaaggctgagctaagccaacttcaattcgatctgaattcggctaattga

SEQ ID NO: 77850 - DNA, 1866 bp, Glycine max
  Peptide Sequence Number=SeqID_169535
atgcttcaacaaaatgaggacattgattatcttgcaaagatcaataggctacaagaaaaagatttatctccttcagtatatcacactcttaagaaattggacgacaaattcaatgagcaagcacaaaagtcccaggatcttgctactaatgttctggaaaaagactgtcccactgtggagctgaatcctgaaactttgccttctacgttttctcaatttgacaatttatattcttcttcaattatcgatcttcccttgcatggagagttgttctggacatgccgaagtccacttcaaagtaatcagttgtggtcccaaaatattcaagaccttgggatatgcaaagaacttgtttgtcaagacgattttaacatccctgatgttgacttaactttccaaaactttgaggaactatttggaggagatcaagattcaattagaatactgcttgatgatcaagatgtctcctgctcttctttagagaaggataagtcagttggcaagtcagatattgacaatccaagtgcaatggaggaatcttctgcagctgcgtctattactatctcccaatctgatcttgacaataaggatatgaatcctctcagccagtaccgtccaagaagcatggatcccgcccttgcaattcgaccatttgattcaaccataccattctccgttttgagattcaatgaggaaagcagttgcactagccatgatgacagtgccctttctccctacagtgaaaggaaggcttattcagcaccgagtaaaatgcataacaaggacacttgctctccctcctccaacggcggatttggcggcggcgcctctgccggtcaaatgccatcaaccggcggcctctacagttcgctgtactcggcactgtcgagcgagaaccttccctcgctctccgcgagctgcagcaacagcagcggcggcggtggttcgctctatccttactccgagtcaattcagaagcaccaggacatggtgaaccgtcaaagcatgtgtctgaatcgcctggtggaaacttcgaaggaggtggaggctctgagggaggagaatggcctgctccgagccgcgaacaaggagctccagaagcagctgcacctcgtcatccaggcttcgctggagaatcactacggcggcggcggctcatccggccagatgcaaccgacgctgttcgatgtcttgcatggcttccgcggcctccacattggggaagggaataaagagaattatgccgattggaataacaacaaccacaataatcaaaatcataacaatattatgaacaataataataataacaataaggagctgcaggaagtttcggacgagagtccaacgagcgtgattgagaataacaacgtggtggaagtggagaggttctcgctccctaagagcatttctgtgaggtccaatggctacttgaagatgtctcagtctgcggctcttgcccccaacaacaacaatgccactcgcaacaaaggcgccactcgcccacgcgcctccgccactccacctgaacccgttcaaaaggtatatgtgcgtggaggggagaaagaggaagagcctcttgaaatgatagtgtataaccaagggatgttcaagactgagctgtgtaataagtggcaggaaactggcacatgcccatatggagaccactgccaatttgctcatggtattggggagcttcgcccagtgatccgccacccacgctacaaaactgaggtctgcagaatggtccttgctggggttgtgtgcccatatggccatagatgccatttccgccatgcacttactgaacaagagaaagctgtcgtatcgcagcctaagccaagatcaatgaagctcgaaagataa

SEQ ID NO: 77851 - DNA, 1290 bp, Glycine max
  Peptide Sequence Number=SeqID_169536
atgacggaaagttgcatccgatccgtcgtagaagccattcactcctctcctttccaagccgttctccatctcgccggtggagcttctcaggtggtgggttcgttgctatcagttcccggtgcttcgaatactgtgctcgaagttgtggttccttactctaagatgtctctcattcagttactcggaaagattccatcccaattttgtggccaacagactgctgaagatatggctttattggcgtataatcgcgctcttaagctctccaagccaggatccccggctgttggagtgggtttcactggttctttggccagcagtcgtccaaaactcggggaacacagagttatttacttatttcctatttgtgccaagaaattcacatttgcaaggcagtcttgtgtgattaacctggcaccaccttatgaaactaccccgaagattgctatagctgaatactacttcgatgagaacatgggtgctcaaggttgctgcctagcgacttggatatcatgtactcagaaagcagcctttctgcttgtggttgtaagactttgtacacttatatccaataataagcaccaggggcttcgtactcgagaagaagaggatagagtttctagtcatcttttgatcaaggcaattggaaatgcatgcaaagttcccggagcatctgttttgttgttgagtgagtcagatgtatctgatgaatgtgaaacacaattcaatgaagatcaacagttagaacaacttataaatggacaaatatgctttaaaatttacccatttgaaaatgagatatcagccgaaaggaaaataataatgcctggttctttcaatccattacatgatgggcatctgaagcttatggatgttgctactcgcatttgtggtgatgggtatccttgctttgaaatatcggcagtcaatgcagacaaacctccattatcagtgtctcagatcaaagatcgcatcaagcaatttgaaaaagttggtgaggctgaacttttcccaggcagtgcttttgtaattggggccgacacggcagtgaggcttattaaccctgaatactacgatggtgactacaacaagatgctgaagatacttgttggttgtaaagaaacaggatgcactttccttgtgggtggtcggaatgttgatggtgctttcaaggttcttgacgatattgatgttccaaaagaactaaaagacatgttcgtctccattccagctgaacagttccgcatggatatatcctccactgaaataagaaatagaagtgggatgtaa

SEQ ID NO: 77852 - DNA, 141 bp, Glycine max
  Peptide Sequence Number=SeqID_169537
atggctgatggacccgggagaagggagaagggatggggtgggtgtttgcggaatcacacaattcagaaagtgaggagggcagaggaagagaaagaggaaggggctagtgatgaagataccttgaaacacagtgttacatga

SEQ ID NO: 77853 - DNA, 2427 bp, Glycine max
  Peptide Sequence Number=SeqID_169538
atgcgtgaagtcgaagtgaaaagggtgtttattggagcgggatgcaacagaatagtgaacaacgtttcatggggtgcttctggtttgctctcttttggagctcacaacgccgttgctattttctgccccaagagtgctcaaattttgactactctcccgggtcacaaggcagttgtgaattgcactcactggctcccatctagcaggtttctatttaaagcaaaacaattggagcagcactatttgctatctggagatgcagatggtgctattattttgtgggaactgtcccttgctgatgggaagtggaggcaagtgttacagctgccacaatcacacaagaaaggtgttacatgcattagtggaattatggtttctcaaactgaggcaatgtttgcatctacttcttcagatggcactgcttgtgtatgggaacttgcatttccaatgacaggaagcggtgactgtaaattatcgtgcctggattctttctctgttggttctaaatctatggtaaccctatcgttagctgaattgcctggagatagtgggcaaattgtccttgcaatgggaggattagataacaagattcacctctattgtggtggaaggtcaggaaagtttgtacatgcatgtgagctaaaagggcatacagattggatccggagtttggacttctcattacctataagcatcaatggggaagtaaacaatatttttctggttagttcatctcaggataaaggcatacgaatttggaagatggcattacgtagctctatgtccaatggacacggcatagacaggaaaggagaaataagcttatcatcctatatagaaggtcccgtgcttgtggctggttcatcttcttttcaggtatccttagaatctcttttaattggacatgaggattgggtatattcagtaatgtggcaaccccctttggttgcacccatggaagaggatgcctattatcaaccccaaagtatcttatctgcatctatggacaagactatgatgatctggcaacctgaaaagacttctggtgtctggatgaatgtggtcactgttggggaactaagccactgtgctctggggttctatggtggccattggagcccaaatggagattcaattttagcacatggatatggtggatctttccatctttggaaaaatgttggtaatgataattggctgccacaaaaggtcccctctggtcattttgcatcagtgactgatattgcatgggctagatctggtgattatatcatgtccgtcagtcatgaccagacaactagaatttatgctccgtggaaagttgaggcttctctccaagatggagaattttggcatgaaatagctcgccctcaagttcatggacatgatataaattgtatggcagttattcatagtaaggggaatcatcgttttctctgtggagctgaagaaaaagttgccagagtgtttgaagccccgttatcatttttgaagacattaaataatgccactttgcagaagtcctgttcttccgatgatatcatgggagatgttcagattttgggtgcaaatatgtcagctcttggactatcacagaaacctatttatgctcaagctgtgcatgaggcccctaaaagaagtgggatcgatggtcttgacaccattgaaactattcctgatgcagttccaactgtgttcactgaaccacctattgaagatcaactggcttggcatacactttggcctgaatcacacaaactctatggtcatggaaacgaactattttctttatgttgtgatcataagggtgagcttgttgcttcttcatgtaaggctcaatctgcagcagttgcagaggtatggctttggcagttgcaagagtttcttattggctactgcaactcagcatatatcctaatcacgcagttgtggtttacaggcaccggtgaaatcagttatagtcttcttgtgagacaggaggggcacaaacggattatctggtcatgttcttggaatccacatggtcacgaatttgcgacaggttcaagggataagacagtgaaaatctgggccatagagagggagtctgtcaagcagcttatgtctttacctcaatttacgagtagtgtaacagcattatcttgggttggtctccatcatcggaagaataatggacttctagctgttggaatggaaaatggccaaatagagttgtggaatctgtcttataacagagcagatgatgggagcatagcagcaccaggtttggctgcttctcttgctgtacgtatagatccttttatatgccatgcgtctaccgtaaaccgtctagcatggaagaaaaatgaggatgatcaaacgagtatgcaacttgcttcatgtggagctgataattgtgtaagagtgtttgatgtatctgttgagtaa

SEQ ID NO: 77854 - DNA, 1353 bp, Glycine max
  Peptide Sequence Number=SeqID_169539
atgaaagggagagatacccatcttctcttttgcaccacaggcattttattaagaagattactagctgatagaaagttaaaaggcgtaactcatgttattgtggatgaaattcatgagcgtgggatgaatgaagattttctgcttattatccttaaagaacttcttccacatcgaccagaactgaaactgattttgatgagtgctaccctagatgctgagctcttctcttcatactttaatggggccccaattatgtttattccgggcttcacataccccgttagaactcactttttggagaacattcttgaaatgacgggctacagattaactccttataatcaaatcgatgattatggtcaagaaaggatgtggaaaatgaacaaacatgccccaagaaagagaaaaagccaaattgcttctgctgtagaggatgcaattatggcagctgatttcaaagattacagcctacagacacaggagtctttgtcgtgttggaatcctgactgtattggttttagtctcatagaatatattttatgcaatatatgtgagaatgaacggcctggtgctgttttggttttcatgactggatgggatgatataagctctctgaaagagaagctcctgacacatactgtcttgggagatgcaaaccgtgttttgttgcttacatgtcatggctcaatggctagttcagagcagagattaatatttgaagagcctgaagatggagttagaaaaatagtgctaacaacaaatattgctgaaacgagtatcacgataaatgatgttgtttttgttcttgactgcggaaaagcaaaagaaacatcatatgatgcactgaataacacgccttgtttgcttcctacatggatctctaaggtttctgctaaacaaagaagaggaagagctggtcgggttcaaccaggagagtgttaccatctctatcctagatgtgtgtatgatgcttttgcagagtatcagttgccagaaattttgagaacacctttgcaatctctctgtttacaaatcaaaagtctaagacttggaagtatatcggagttcttgtctagggctttgcagtctcctgagacactcgtggtacaaaatgctattgaatatttaaaaataattggggctttggatgaggatgaaaatctcactattctagggcgctgcctgacaatgcttcctatggaacccaaacttggcaagatgctaatattaggtgctattttcaattgcctggatcccatattaactgtggttgctgggcttagcgtgagagatccttttctaacaccattggataaaagagatttctgttgcttagacactaatttcaattga

SEQ ID NO: 77855 - DNA, 1266 bp, Glycine max
  Peptide Sequence Number=SeqID_169540
atgtcgtcgcagaatcagaataggtcgttggagcaagctggaccctccggctccggtggacaggtgggagtgagagtagtgaattggagtggttccgataggctttgcataagccctaagcgagatcacaagcccgaaaactatgacgaccttcaattcgagttcaatcctaatatcttcgcctctctcgagcactatttgcctcctcatatgctcaacctctcacgtgatgttaagcttcactacatcaggaacattcttcttcgctatttgcctgagaatgaccgcatttggattcaaaagctgagggaatacaggctaaagatcatattgaattatccaccgctgcataaggagatatttactatggatgctgagagctttttcgtaccatcatttctcagagcaataaaagaaaacacagaagcgagttttagaagtataatggctgaaccttgtaaaggagtttatacatttgaaatgcttcaaccacaattttgtaaaaaactgatgtctgaggtggatcattttgaaagatgggtccatggtaccaaactcagaatcatgcgacctaatgcaatgaataaaaataaacatggtgttattcttgatgattttgcctttgaagccatgcttgacagatttatgtgtgatttcatacaacctatatctcgagttttctaccctgaacttggtggatcctcactggactctcaccatggttttgttgttgaatatggaattaataaggatgtggaacttggtgatgccggatcaagtattacaattaaggttagtggaagccaaaatcgttctaggccagggtcaaactcaaatatcaaccaatctggccaaaataaaggaaattcatctgtggcattctcaggcttacatgaggatgaggcagaagtcaccttaaatgtttgcttgggaaaagaattttctggtggagacctgttcttccagggtgttcgatgtgatgcacatgtaactacaaatacgcaaccagaggaggccttcaattattcccatgtcccaggacacgcaattcttcatcctggtcgtaaccggcatggcactagacctacaacatctgggaatcggatgaatttaattctctggtgtagaagttcggcttttatagagttgaagcgatatcaaagagatttttatagctggtgtgcagaatgcagacgcaagaaggcagagagagtgcgtttgtcagttgtggccgccaaacaggaattactaaagagcgaaatataa

SEQ ID NO: 77856 - DNA, 1122 bp, Glycine max
  Peptide Sequence Number=SeqID_169541
atgccaatcttatctttcatttgcatgtttttcgtctgttggagcttggaagtacttggttgtgcctattttgataatgatacatctgctatgtatattcaaaaacacaaggaatacaggcacaggatcatgctgaactatccaccgctatgtaagcagatatatagtatggatgctgagaaatttttcacaccctcatttctcagagcagttgaagaaaattcagaagcaagttttagaagtataatggctgaacctcgtaaaggactttatacatttgaaatgcttcaaccccaattttgtgagatgctgatgtctgaggtggataattttgaaagatgggttcatgacaccaagttcagaatcatgcgaccaaatataatgaatcaatatggtgccgttcttgatgattttggcatggaatccatgctcgagagattgatgaatgatttcataagtcccatatctcgagttttctacactgaaattggtggaacctcgctggactcccatcacgggtttgttgttgaatatggaatcaatcgggatgtggaacttggcttccatgtggatgatgcagaagtcaccttaaatatttgcttgggaaacgaattttctggtggagaactgttcttcaggggtgttcgatgtgatgaacatgtaaattcagatatccaaccaggggagatctttgattatccccatgttccaggacatgcaattcttcatcctggtcgtcaccggcatggcgctagacctactacatctgggaatcggatgaatttaattatctggtgtagaagttcggcttttagagagttgaagaaatatcggaaagatttttctagctggtgtggagaatgcagacgcaagaagaaggagaaagagcgcctattagttatggccacccaacagaacgcctgtgcaaaagcacaggaaacaacccagcagagtcccatttccggagttgcgttggacattgcagatttgctgatggacgaagatcagtggatgtatgatagtataatatctgaagaagttgatatgaatgaccaaaatgaagacaaagctggtgtgaatctagtacatgttgattgttctaatgcgttcaatacttcttag

SEQ ID NO: 77857 - DNA, 156 bp, Glycine max
  Peptide Sequence Number=SeqID_169542
atggaaggagcttatccttggctaagcgtgacctatggtcgccaagcgcaattccttatggccataactgaggtccatgaagctaagcgccagtcatggcagctaatcgagattcgttgcggcaatgtgagcgctaagcgagtccttatcagctaa

SEQ ID NO: 77858 - DNA, 1469 bp, Glycine max
  Peptide Sequence Number=SeqID_169543
aagaaaagcagtttaaatcacctgcgctgtaccgattcggcccgcataacgcactggtcaagccagttaagccattgttttcgcgcattcaggggacaacacaaacccaacttccaccgcaacatcagctacaggcagtacagaagtttatgacacatcgtttaacctccagggatatcctggcgctgggcttcatgacctttgccctgttcgttggcgcaggaaacatcattttcccgcctatggtcggtattcagtctggtgaacatgtctggattgccgccttcggcttcctgatcaccgcggttggtttaccggtgatgaccgtgatcgcgctggcgcgcgtcggcggcggtattgatgcgctcagctcaccgattggtaaagcggccggtctgctgctcgccaccgtgtgctatctcgccgtcggaccgctgtttgccacgccgcgcaccgcgaccgtttcatttgaagtcgggattgcgccgctgaccggcgacggcccgctgccgctgtttatctatagcctggtgtacttcgcgctggtgattggcatttcgctctatccgggcaagctgctggacaccgtcggtcacttcctcgcaccgctgaaaattgtcgcgctgaccattctgggcgtcgcggcgctgctgtggccggctggcggcatttcgccggccaccgccgactaccagcgtgcggccttctccagcggtttcgtgaacggctatctgaccatggatacgctcggcgcgctggtgttcggtatcgtcatcgttaatgcggcgcgttcacgtggcgtggaagacagtaaactgctgacgcgctataccatgctggccggcgtgatcgccggtgtcggtctgacgctggtgtacctcagcctgttcaagctgggctccggcagcggcgcgattgtcgatcagaacgctaacggcgcggcgattctgcatgcttacgtgcagcagaccttcggcggcatgggcagtgtcttcctcgccgcgctgattttcgtcgcctgtatggttacggcggtgggcctgacctgtgcctgcgcagaattctttgcgcaatacctgccgctgtcgtataaagcgctggtgtttattctcggcctgttcgccatgctggtgtcgaacctcggtctcagccacctgattcagatttcaattccggtgctgacggctatctatccgccgtgcatcgtactggtggtgctgagctttaccctgagctggtggaatcgcagcacgcgcatcattgcgccaaccatgctgatcagcctgctgtttggtatcgtcgacgccatcaaaaccaccagctttaaagatgcgctgccgctgtttagccagcatctgccgctggccgatcagggtctctcctggctgccgccgtcgctggcaatgctggtgattgctgcggtggtagaccgggtgaaagggcgtgagcaggttgccgttcaccagtaa

SEQ ID NO: 77859 - DNA, 498 bp, Glycine max
  Peptide Sequence Number=SeqID_169544
atggatcgcgcccacaagacacccagtggacctggagaagtccaacagggccctgcggtttctagctttggttatgggcctctgtcagtcctaccagggatcgcgcctataagacacttagtgggcctggagatgtccaacagggtcctggggtttctagctttgattacgagcctttgtcagttctacgaagtgccattcgcccctaacaaggtcatcaggcctcctactaatcaagctttcattaggaagtactgcgcccccaggcaagtagggcgagacaccacaacagccaggggatggctggcagcaggcaacagacacaccgccgccacctccagagcccctcagctcatctacaaaagctggagcgttgcctacgacccgtggtcgacaaccaggcgaccaagtccaaagccaaaggtaagcaaaagtactaggtccgtgaccgacaagtcatcatgcgtccagctcaagacgttaaagaagcgctactag

SEQ ID NO: 77860 - DNA, 948 bp, Glycine max
  Peptide Sequence Number=SeqID_169545
atgtcatctttcagcggaaaactgcgttcactgttcattgcgagtggtttactcgccgcaggttcattatgcgttcaggctcacgccgcacccacttatgcgttagtccagattaatcagcaggcgctgttttttaacctgatgaatcagggcgcacaggaagcggccaaagccagcggtaaacagctggtgatttataacgccaacgataatcccgtagcgcaaaacgatgcgattgaaaactatattcagcagggagtgaaaggcattctggtggatgcgattgatgtcaacggtattatgccagcgataaaagaagccgcagcggcgaatattccggtgattgcgattgatgccgtattgcctgccggtccgcaggcagcgcaggtgggcgtagataacctcgaaggcggaaaaatcctcggtaaatactttgtcgattatgttgcgaaagagatgggcggcaaagcgcgactgggaattgtcggcgcgctcaattcggccatccagaaccagcgtcagaaaggctttgaagagacgattaaaagcaacagccagataacggtcgccgatgtggtcgatggccagaatattcaggataacgccatgaccgctgccgaaaacctgattaccggcaacccggatctcaccgcgatctatgccaccggcgagccggcgctgctgggtgccattgccgcagtagaaaaccaggggcggcagaaggacatcaaggtattcggctgggatctgacggcaaaagccatcagcggcattgacggtggctacgttaccgccgtgctgcagcaggatccgaagaaaatgggtgaagaagcgctgaaagcgctgaatagcctgacggccggcaaaactgtgagcaaaaccattctggttccggccacggtggtgaccaaagccaacgtggacagctaccgttcgctgtttaagtaa

SEQ ID NO: 77861 - DNA, 828 bp, Glycine max
  Peptide Sequence Number=SeqID_169546
ggctattcgattccggtgccggctgacagcctgttcacctttatgggtcgcgcctgggtgctggggattcccatgccggcactgatcggcatcgtggtgttgctggccggtcacattgtgcttaatcacctgcgctttggccgctacgtcaccgccatcggtgccaacgcggaaggtgcacgccgcagcggtatcaataccaaagcggtgaccatgaaagtgtacattctcagcggcatggcggcggcgctggctggcatgatcatcaccgcgcgcctcggcagcggctcctctaaccagggcgaaggtgattgcggcggtggtgctgggcagtaccagcctgtttggcggctttggaaccgtgatcggtacgctgctcggcgcgctgtcgattgccattatccagaacggcctgattttatcgcatatctcaccgttttatacccagatcgccactggcaccatcattttgctcgccatctggctcaacacccgcattctcaacccgagccgcgcgcccgccaaaggatagcccatgaaaggatcaatttttcgccatgcggatccgttgccgctcggcgtcagcagcggtcaggtgatgacggtgctcggtccgctgccggtggcggagatgggcgtcacgctgatgcacgagcacattttactggatgcctccgcgaccgccacattgctgaaatgccggtgcgcatcgagaacctcggcgagctgtcgctcaacccgctgatgagtcgcgacaactgccagctgtttgacgtcgacaccgcaattgaagagctaatgaaataccgcgcgctgggcggcgaaacg

SEQ ID NO: 77862 - DNA, 198 bp, Glycine max
  Peptide Sequence Number=SeqID_169547
atgaaagctaaaaatgaatcgcttattttggacgatggagacctcagcccgccaggctggctgccacggcggaaaactaccaggaacccacattacaagcgaaacctcaaagagagttgggcttcatcatcaaaaggaaacaacaccagaaaatctagccttccatggattcaaacagaaaacgcaaatgaaacatga

SEQ ID NO: 77863 - DNA, 648 bp, Glycine max
  Peptide Sequence Number=SeqID_169548
atggttttgcaagccatcttcaacgggcgccttcttctcaacgacgggttcttcttcgacaactctcttcattggcagttctacaagtactcttgttgccgtcgattctcgtcatcatcgatgtctcatataacacaaatgttcgcatctctgggataccaagatgaccatgctccaccgtggtcatttgttacaataaagggaaagataggagatgggggaattactaatgcatatttggttgatttgaggagggtttgtgaagaggctgaaaacagattaaagtctaagaatgttcctttacctattgacaaaaggactccaacaccaccaacattaccaccaaaaagaagaaaatcaagcaatatagagagtgcatttaatattgaggataggaatcatcttagagcagagatagcaaggatgttttattctgcaggcttgtcattccatcttgctagaaatccacattttgttagttcttattcatttgctgctaactgtaatctaagtgggtttcttcctcctagttataatgcattgagaactagtcttttacagcaagagaggtctcatattgaaaggttgcttcaacctatcaaatctttgtggagtttaaaaggagttacattggttgcagatggttag

SEQ ID NO: 77864 - DNA, 231 bp, Glycine max
  Peptide Sequence Number=SeqID_169549
atgagcaagaggctccaagaggattgggctagagttgataaagaaggccttagggttctcatgaaccttaggctaagctctagcttctcaaggaagcttctcaaggaggtgagcttagtttttagatggcttctcaaggaagttttctcaaagaagcttctcaaggaagttttcttaagaaagcttctcaaggaagttttcttaagaaagcttctcaaggaagctacctag

SEQ ID NO: 77865 - DNA, 450 bp, Glycine max
  Peptide Sequence Number=SeqID_169550
atggggtcaaaaatctaccctaaggttcatgagaaccctaggtccttctttagtagctctagcccaagcctcttggagtcttctatccaatacccttggggggaagaactgttcgaatcccgaggatctaacagtttctatcgaggggctaggagggcaagggcgaggccagttgagcttccttccacttctgtagctcctactccagcatccacttcagcagctccttctgtcccagctcagacagattctcagtgctttgaagccatgcttcaaagcattcatcagggacaaatcattttattacagagtttacaggtggttgcgcctccaggatctattccatcagttgagcagttcagggagatggtagcctggcctaggactcaaacttctcttcacaggaagatgaacgtccattgcccaggtaccacaacatgtggaggatga

SEQ ID NO: 77866 - DNA, 381 bp, Glycine max
  Peptide Sequence Number=SeqID_169551
atgtttgttaaatttctcattttcttctgcaaagcttcaatttgtagcctcaaatcagccactaccattgtttctcttgagacagaagacgaattagaaattcgaatagctgcacgtcttccatggtggcattgccgaatgaaactaccagaaaatgcacaacaactgccacttgcagacatggacaaatcaagtgaacaagcagcagggactgagcctcagagtagaagaagaagaagcaactcaacgtgggaagaagaagaagaagaagaagaagaagaagcaaccagcagcttcgtaaaccctaatttttttggggaagaagaagcaaccttgcattcagggactaatatgcaaagtggttacaatctcagggactaa

SEQ ID NO: 77867 - DNA, 444 bp, Glycine max
  Peptide Sequence Number=SeqID_169552
atgcaccacctgtgtccgcgttcccgaaggcacccctctctttcaagaggattcgcggcatgtcaagccctggtaaggttcttcgctttgcatcgaattaaaccacatgctccaccgcttgtgcgggcccccgtcaattcctttgagtttcattcttgcgaacacgctttacgcccaatcattccggataacgcttgcatcctctgtcttaccgcggctgctggcacagagttagccgatgcttattccccggataccgtcattgcttcttctccgggaaagaagttcatgacccgtagccttctaccttcacgcggcattgctccgtcaggctttcgcccattgcggaaattccccactgctgcctcccgtaggagtctgggccgtgtctcagtcccagtgtggctgatcatcctctcggaccagctactgatcatcgccttg

SEQ ID NO: 77868 - DNA, 651 bp, Glycine max
  Peptide Sequence Number=SeqID_169553
gagagcgcacgagggagcttccagggggatacgcctggtatctttatagtcctgtcgggtttcgccacctctgacttgagcgtcgatttttgtgatgctcgtcagggggccggagcctatggatatacgccagcgacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagagagcgaggaagcggaagagcgcccaatacgcaaaccgcctctccccgcgcgttggccgattcattaatgcagctggcacgacaggtttcccgactggaaagcggacagccaattttgcaaaatgggagccaggtcatggcaagtttagatttcgtcatccttgggacttatacctcaaagttggtgctctttctcgccaatgcatgcgagcttggcactggccgtcgttttacaacgtcgtgactgggaaaaccctggcgttacccaacttaatcgccttgcagcacatccccctttcgccagctggcgtaatagcgaagaggcccgtaccgatcgcccttcccaacagttgcgcagtctga

SEQ ID NO: 77869 - DNA, 165 bp, Glycine max
  Peptide Sequence Number=SeqID_169554
atggagtcctttacttcttcaagatcaatggtagtggaatggagaaggaggaaaggtgattggagatgtcacttcaaggagaagatgagtcacaaacaagctcacggccataggaactcatggcccactaatccaatatcaaatccaagattctgggaggtctag

SEQ ID NO: 77870 - DNA, 444 bp, Glycine max
  Peptide Sequence Number=SeqID_169555
atgcatggcgccaccaccactggcgcttccgtgaaggagctgccacgtggagagggacgtgctagtagcagcagcggcttcgccttctacttacgtggagtgggacgtgcaacatccactggcgcgttgtgcatggaggccagaaacgccagtcaaactggcgttttagctatgcaggtgacagggtgcacagtgctgcagcagactgctgcagctgcaggaagcagggaaatgccattggagcctacgacttgcgtttgcaggttcaacgcgccatcacgaggagcgctttcttccttttatatgcagttctcgtgcttccttttatatgcctacccgtttgctcagccttcttcaagcttgcttcctttggttggttccttgtttccttgcttcatttgcatctttggtttctgctgtaacttcttgattagatttagttaa

SEQ ID NO: 77871 - DNA, 267 bp, Glycine max
  Peptide Sequence Number=SeqID_169556
atgtaccctccaatggtgttaatacaaagttctcaggcggttagtcctttgaaattttgtttatgggaaagggaagaatcaaaagaattctcagactgtgtcgttttgaattccttgacaagggagaagggagacacaaaagaatttaggcagttagtcctttgttctttgggaaaagggagaagagagacacaaaaagatttaagccggttagtcctgggcgaattctttttggcaaagggagaagggaatgaaaaagatgaatag

SEQ ID NO: 77872 - DNA, 240 bp, Glycine max
  Peptide Sequence Number=SeqID_169557
gtcgacaagaggagagtctccctagaaaggaaggagagaagcctggctcatctacaagggcgaggactacaagtggaaggggtccctatttgtcatatcagcaaaagctttatcagtgtggggtggatgcgcaaggatcaggttacggtgatagaagaagaaacccctcaaaaccgaccgaattgggtgcaaccatctcctccgagctttgaattggggaattggaaaatcgtcgaatga

SEQ ID NO: 77873 - DNA, 384 bp, Glycine max
  Peptide Sequence Number=SeqID_169558
atgacaaaaagatattggaacataatcttggaagagatgatggaagcaggagttcattttggccacggtactagaaaatggaatcctaaaatgtcaccttatatatctgcaaagcgtaagggtattcatattacaaatcttattagaactgctcggtttttatcagaagcttgtgatttagtttttgatgcagcaagtgagggaaaacaattcttaattgttggtacaaaaaaaaaagcagcggattcagtagcacgggctgcaataagagctcgagtgtctattattggggatactacagaaacacgacttcaaaagttcatatctgagaatgcaagttttcaaaagacggggagactcaatagttttccaaaagccaagtag

SEQ ID NO: 77874 - DNA, 492 bp, Glycine max
  Peptide Sequence Number=SeqID_169559
atggaagctcatgctctggttgccaggttaattgagaaagatttgcagtttccattcatggccgtacttatttcagaaagcggtgtaaggacgagggaggagaggggaagagaggtacatttctcacgtacattttctgagtggagacgagggaggagaggggaagagaggtacatttgtcaggcaaagatcgttgtggacatggatggattcaagcatctcgatctccagcagtgtgagaaatttaaggaatttggagcacctgagtttcatcatgactgcgcgaaggaactcgaaattcatagtgagttcaaagtctgtaaggtggccctattcataacacgtgtgaaagccatggctgatagcaactctggtacccccaattcctttaatttctcacactgcaaaaacaacaatcaaaggccaagaatatcaattcatcatattgaaattcaaccggaagatttatcaattactttgttgcatgcataa

SEQ ID NO: 77875 - DNA, 193 bp, Glycine max
  Peptide Sequence Number=SeqID_169560
atgcagtgcaccgaccgccaccacatagcgcccgcgcggcaacgccagcagcagctcgcgccagtgctgattacggttgcgcatcagagtatcgttcagttcactgctgaacgtagtcggcagcgccaccggctgactggcgggcggcgcatccagccaccagctgatcatggtttgcagcagtcgcgcgttg

SEQ ID NO: 77876 - DNA, 244 bp, Glycine max
  Peptide Sequence Number=SeqID_169561
gaaagctggagttgctgcacatgatgtcaaggaatcagatcgggctgcacaatgcacaaggcaagataaaatgtcaaatgaagaattgaagctgcaggatccacgatgtcggatacaatgtccaggacatcctgcccgaaaatactggacacataaatctgttatatctttaacagattgtgcaggatcatcgatgtcggatacaatgtccaggacatcctgcccgaaaatactggacacataa

SEQ ID NO: 77877 - DNA, 156 bp, Glycine max
  Peptide Sequence Number=SeqID_169562
atgcatattcatggaaaagatcataaaggaaaaggagaaagaaacaatgaagactctcaagttgatgaagtcaaaacaaatgatgatcttccaagagaatggagaacttctagatatcatcctcttgacaacatcattggtgatatatcaaaagag

SEQ ID NO: 77878 - DNA, 309 bp, Glycine max
  Peptide Sequence Number=SeqID_169563
atggaaaaatctgaaaagaaaaatcatagtgagaagaaactaaagaaagcatacatcacatgggatgaaaatgatttggaatcctctgatgattctgaaaatgaagagataaatctttgccttatggcaaaaagttacgaaagtgatgaagaggtatctttgagaaagaagtggtacatagatagcggatgctcaaaacatatgactggagatgcatcaaattttacacacatatctccaaagaaaagcgggcatgtcttaagcacagcctgcttagcgttagtcaactatgtgacaaaggctatctag

SEQ ID NO: 77879 - DNA, 231 bp, Glycine max
  Peptide Sequence Number=SeqID_169564
atgaagaagatccaaggcctacaagctccacatgaagctacatcatctacacatggggaagggtgttgcccttgctcctacatatccttaggggcgataaagaattcagacctacgaagttctttaagtctgaaagcttgtgtgttgagttgtttttatgcttttgaaaggttcattttagttgcgaacaaagagtcatttaaggcgttggaccttgaaatgatgttttaa

SEQ ID NO: 77880 - DNA, 2937 bp, Glycine max
  Peptide Sequence Number=SeqID_169565
atgttcaagaacgcatttgcaaacctgcaaaaagtaggtaaatcgctcatgctgccggtgtccgtgttgcctatcgcaggtatcctgctgggcgtcggctccgccaactttagctggctacctgcggtagtctcccacgtgatggcggaagcgggcggttcggtcttcgccaacatgccgctgattttcgccatcggcgtcgctttgggcttcaccaacaacgacggcgtttccgcgctggcggcggtggtggcctacggcatcatggtgaaaaccatggcggtggttgcgccgctggtgctgcacctgccggctgaagagattgcggccaaacacctggcggataccggtgtgctcggggggattatctccggcgccatcgcggcctatatgttcaaccgcttcttccgcattcaactgccggaatacctgggcttctttgccggtaagcgtttcgtgccgatcatttccggtctggcggcgatcgttctgggcgtagtgctgtccttcatctggccgccgatcggtacggctatccagaccttctcgcagtgggcggcttatcagaacccggtcgtggccttcggcatttacggcgtggttgaacgtgctctggtgccattcggtctgcaccacatttggaacgtaccgttccaaatgcaaatcggtgaattcaccaacgcggcgggccaggtattccacggcgacatccctcgctacatggcgggcgaccctaccgcgggcaaactgtccggcggcttcctgttcaaaatgtacggtctgcctgctgcggccatcgccatctggcactcggccaagccggaaaaccgcgcgaaagtcggcggcatcatgatctccgccgcgctgacctcgttcctgaccggtatcaccgagccgatcgagttctccttcatgttcgtcgcgccgatcctgtacgtgatccacgctatcctggctggcctggcgttcccaatctgcatcctgttgggcatgcgtgacggcaccagcttctcgcacggcctgatcgactttatcgtactgagcggcaacagcagcaaaatctggctgttcccaatcgtcggcatcgtctacggtctggtgtactacaccatcttccgcgtgctgatcgccaagctggatctgaaaactccgggccgtgaagacaccgctgccgagcagactgcgcagggcggttccgaaatgtcagcggcgctggttcaggccttcggcggtaaagaaaatatcactaacctggatgcttgtatcacccgtctgcgcgtcagcgtggccgacgtgtccaaagttgaccaggcgggcctgaagaaactgggcgcagccggcgtagtcgtcgctggctccggcgtgcaggccatcttcggcaccaagtccgacaacctgaaaaccgatatggacgaatacatccgcgccaaggcgctgttcgagttcggcgagagaagggaggaactagacctgttcgccgcggttggcttcacgcacgaaatcttgcagcgcattgctttgcgccagccagggggagatatcgcccagcagcgcaacgcgcaggcggtagttgatgaatttctgcaatacggcgccggccacgccgcttctgagctggaaaaaggcggcgtcgaggcggttgacggggagggcaatcatcccggcatcgtgttcaaaggcgggcgcgataaacaggctgacgtaatgctcgaacaccgccagcgtttcgtccgagatatggtgctcaatcccttcgctgtccagctcggcggtttcgctcggcaccccgacgcacatcagcagatcgaccacgatgcggtgacggcggcgcaccttctgcgccagcagctcgccttcctcgcggcgcgcgatatcggtggttctggcttcgcgggtgctttgcagcaaatcggcgatcagctcaacgtaatcttcgatcagcgcattggactgcgcttcgcgggcgcggctaaaacgcagggcgtgctcggcctcgtccggcatgtcggtctgggcgtggcggtcggcgttatctggcgcgcgggtaaccatagcgtggggcgtcctgtaagcataaaaatggcgtctcccggcaatgcggggagggttgccctaaggtacttcatgcgtgatgcggcaaccactccatcgttaaccgaacggaccaacatcgcgattggcgccgcccttgccggacgcaagcgcggcgcctttacgccgttgctgttcgccggcccggcggtgattgcttctattgcctatatggatcccggcaacttcgccaccaacattcaggccggggcgaaatacggctacagcctgctgtgggtggtggtgatggccaacctgatcgccatgctgttccaggcgctgtcggccaagctgggcatcgtcaccaaccgcaatctggcggagatgtgccgcgaccagttttcacggccggtggtgatcggcatgtggctgctcagcgaagtggcggcgatggccaccgatctggcggagtttctcggcggggcgatcgcgctggcgctgctgttccatatgccgctgttggcgggaatgggggtgacggcggtgatcacctatgcgctgttgatggtggaaaaaaaaggtttccgcccggtcgagctgatgatcggcggcctggtgggcatcattgcgctgtgctacctggtggagatgttcatcgtaccggtagactggcaggcggccgggatcggcatggtgacgccgcagttgccggacgcgcaggcgctgaccatcgccgtcggcattatcggcgccaccgtgatgccgcacgccattttcctgcactcggggctgacccagcaccgcagcccggccagcgataacggcgaacggcgcaagctgctgcgtttctccaatattgaggtggtgatcgcgctggcgctcgccgggttggtgaatatcgcgatg

SEQ ID NO: 77881 - DNA, 327 bp, Glycine max
  Peptide Sequence Number=SeqID_169566
atgaaggttattctatggatgaatgctctcctagaacctaagcttttgaatcctagaaaaaccatgaattgttggcagcctaaccctattacaagcctagaaagtctttcggattcattttctgtgttcattgatgtgaaaaagaggctaagtcatgaagtgccaaaacacaatttcagcgtgcttagcgcgatagaagaacctggcagggcatcaatatcaaggtcgcatgccaagcgcgagatcaatgcgctaagcgcaacagttgtcttcagccagactcagcgcatgactggtgctaagctcaaacccacttactcgcgctaa

SEQ ID NO: 77882 - DNA, 630 bp, Glycine max
  Peptide Sequence Number=SeqID_169567
atgcggctagacgtactcaccttcagagggctgtacgcactcaccttcaaaggactacacgtcctcgccttcagagggttacacgtcctcgccttcagagggttacacgtcctcgccttcagagggttgcacgccctcaacttcagaggacttcatgcccttacctttaaaggactgcacatcctcaccttcagagggctacatgcccttgccttcagagggctacatgcccttgccttcagaggactacacgtcctcgccttcagaggactacacgtcctagccttcagaggacaaaacgtcattaccttcagagggctacacatcctcaccttcagaggactacacgtcctcgccttcagaggacatcatgtcctcacctttagaggactacatgtcctcgcctttagaggactacatgtcctcgccttcagaggactgcacgtcctcgactacagagggcttcacgccctcgcctttagaaggttccacgccctcgacttcaaaggactacacgtcctcgcctttagaggactgcacgtcctcgcctatagaggactgcacaccctctccttcagagggctgcacgccctcgccttcagagggatatgtagaaacaaagcttcatga

SEQ ID NO: 77883 - DNA, 840 bp, Glycine max
  Peptide Sequence Number=SeqID_169568
atgggatcaagtcaaaagccttcgcttaaaaagaggttctatcaagtcaaaatcaagagcttagaggtcaccagtttacgaaagttggggcaattaatgggtcaacttcaacggcaagccttccacaaagcctatggtaagatttgggacctagctagggtagaagtctccatggaaccgattgcatccctttcccagtattatgaccagcccctaaggtgcttcacatttgaggacttccagctagtgccgactgtgaaagagtttgaagaaatcctgggatgcccactggaaggaaggaagccatatcttttctctgggctctatccctccacgacaagagttgccaagtaccaaggaagtgtttggaggaaagggcaaaggccttggcaaatcaaggcgaatgggctttcttttattgacatcttggcgcttttgatctttggagttgtcctctttccgaatatggaagggttagtggacctagcagcgattgacgctttcctcacctttcatcatggcaaggaaagcctggtcgtcgccattttggccatatatgacactcccgttctcgccataagacagcttggctaccccatgagaggagcgccattagacgaaagcatcgcgcctttcatcgcacgaggtttcagtgaccacaacgcgaggtggctgaaagtccggacacaaggattggattggctcccaaatctaaagactgtgagagacaatgaggttaaagcttcggaagaaagtgatgaggtacaagccctaaaggcaaagcttgaaagagcccgggtagtcaaagagaagttcaagtccatagccatcaaagtctga

SEQ ID NO: 77884 - DNA, 782 bp, Glycine max
  Peptide Sequence Number=SeqID_169569
atggtgaaagttggaacctcttacgtgccgatcaacgtctcattttcgccaaaagttggcccagggcttcccggtatcaacagggacaccaggatttatttattatgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatgtcttcacatcttggctaagatgtcactggatgcaggaggccttcttggagctttggagagtgggttgggtatcttgccttgcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 77885 - DNA, 201 bp, Glycine max
  Peptide Sequence Number=SeqID_169570
atggaaaaatctaacaagaaaaccttcaaagacaagaaaggaaagaaaacacacatcacttgggaagataatgacatggattcatcaggtgattcagaaaatgaagtcgtaaatctaagtctcatggccaaaaactatgaaagcgaagaagagatgcattcaatgacttgcataaagaatctgccaaacttgccaaattag

SEQ ID NO: 77886 - DNA, 291 bp, Glycine max
  Peptide Sequence Number=SeqID_169571
atggtgaaagttggaacttcccacgtgccgatcaacgtctcatttcgccaaaagttggcccagggcttcccggtgctccagtgggttctgtttctatcagctgtccctcctgttcaggctgcgcaactgttgggaagggcgatcggtgcgggcctcttcgctattacgccagctggcgaaagggggatgtgctgcaaggcgattaagttgggtaacgccagggttttcccagaattcgatctggatattcctcaatgtgccgactattcatggaacgtgagaagcagatga

SEQ ID NO: 77887 - DNA, 972 bp, Glycine max
  Peptide Sequence Number=SeqID_169572
atgggacctgaagaatctcttgacctgaataatgtgattgagaacagccttgatgcattggttcagaatgagagtgaagatatcccatatcctgaaaaacactctgtctctttgtttgagtgccgtgcagatgtttctggaggagatggaaaagtccatgatcaatccactcctacaactatagatcatgaagttgtagatgaatctcatggacctgatgccacagtattatcattctcatcccctggccatacaaattcagattcatctagtgtcagatatcatcaaactgatgtttctggagcattgacttcatgtgttcaagggagtgagcccatatatgaaggagaggaatgtgtgttggatacaagaactggaaattttgaggatcgtgaacctgtttatgaaggtgaggtggtacttgcagaacagtctgacaaaagcaccttagctgctcctgatctaagagctaaggatgaacttactccagaacaaggtgaattgatcaagagtttcttgaggaataacgccagccagttgacattttatggcaccatgttcaagtttgagggtgagctctatcttctagccacggaacaaggttacataaatcaacctgatctggtctgggaaaaactgaatgaggtcaatggtgatacattgtttttgaccagtaatttcaaggaattcaaggtagaaaaccatgaaagtagcacttgggatgagaacaatgctctgaccagcactgttgactatcttgccagcatagatagtgcaacacatgcaagcttagatatcaattctgatctacaattagcaatagccttgcaacaacaagagtttgagcaacagccaccacgccaggataattcacagcagcaatcatccattagcggtagctctagactggtcacaggtcccaagccaatggatgggatcattttcaattttgtcgggaatctttattattaa

SEQ ID NO: 77888 - DNA, 69 bp, Glycine max
  Peptide Sequence Number=SeqID_169573
atgcagaatctgcagatcgtacctatatatccagtattcagcacatgcatgcacagaaggcaaagttaa

SEQ ID NO: 77889 - DNA, 1212 bp, Glycine max
  Peptide Sequence Number=SeqID_169574
atggagtcgatttcggacccaccctttcacgaggcatacaagatcctgtttgacaagaccagaaacggaaacaattttgaagagcataaggagctcttggcggtggccgaggaatgcgaccttccggtgatcgatctgagccgtttagaagagagcgatgaggttgtgagggaagagtgcaagtcacagatagctagggcttcgcaggagtggggtttcttccaggttgtaaaccatggtatttccactgagattttcagcagcttgaggtgcgagcaagagaaggtcttcaagcagccatttgaaaagaagaccaaagaggacaagttcttgaacttctccgccggtagctaccgttggggaacaccctctgccacatgcattaaacagttatcttggtcagaagcctttcatattcctttaaccgatatattaggatccactggatcaaactctcttagttggacaattgaacagtttgctacaacagtttcgagtcttgcacaaacattagccgacatcctggccgagaaaatgggtcacaagtcaaccttctttaaggagaattgtttgcctaacacatgctaccttcgattgaaccgatatcctccatgccctattggttttgggattcacggtctcatgccacatactgacagtgactttctcaccatattatatcaagatcaggtcggaggtttgcaattggtcaaagacagcaaatggatcgcagttaaaccaaaccctgatgctcttataatcaacattggtgacttattccaggcatggagcaacggggtgtacaagagtgttgaacaccgtgttatgaccaacccgaaactagaaaggttctctatggcgtatttcttttgcccttcaaatgatacagtgatagagagttgcagagaaccctctttttacaggaaatttagctttcgggagtatagacaacaagttcgggatgatgttcagaagttgggttccaaaataggcctaccaagaagacagaagagagagatcgatctagaagtagaagtagaaagaaaacaagtgtgcttgtcagtgtacgtttgggttggtaataaaattaatttggcagagacggtcggtttgaaatgctggattacagttcaaaacatttcaaacctatccttggcgtacagacataatgctggattgctgggtaggcacattgcatttgaatatggatag

SEQ ID NO: 77890 - DNA, 573 bp, Glycine max
  Peptide Sequence Number=SeqID_169575
atgtgtgaaggcaagagtctctacatatggcccctgaaagttataggcctcttaggccttattgttctgtgcctgtggctggccttacgtcccaagaacccctcctactccattatgttcatctccatacaacatccctccaactcaagtgaaaactgcaccatcttttacagccttcaaattgaaaacccaaacaaggactcgagcatttactatgacaaaacgattttaagtttcttatatggggagcctgaggacgaggtgggggagacaactatagtcccattccatcaaggaactggcaacacccgggatgtatctgatactgttaatgccaaacctcgaccattcaaacctctcttcagtgccatctcaaatgcaaccacagagttaaaagttgctttgatcacaagataccgatacaagacatggggaattaagagcaagttccacgggttacaactcaaaggtattctaccaattgattccgatgggaagctctcacgtaagaagaaaaagtacccacttagccgtaattccaacaaactaggaaggttcaaaataaggcactga

SEQ ID NO: 77891 - DNA, 7188 bp, Glycine max
  Peptide Sequence Number=SeqID_169576
atggatcatattctttctgtcttaaaagtaccacaagatcgtgatagtgggttcatcgctctcggagagatggctggggcactggatggggaactcatccattacttgccgacaataactactcacttacgtgaggcgattgcaccacgaaggatcaaaccttcacttgaggccttggcttgtgttggaagtattgctaaagcaatggggtcagcaatggaacctcatgtacgtggacttttggatattatgttttctactggcctttctactgtacttgttgaagcccttgagcaaataagtaccagcattccgtctctgctgccaactattcaagaccggttactagacagcatatctatggttctttctaaatcacattatcatctggggaggcctgcacaaagcgtgggcagaggaacaataataaatgtccctcaacaagtttcagagcttaatggttctgctcttatacaacttgctttgcagactcttgcccgttttaactttaagggccacgaactacttgaatttgctagagaatcagttgttgtctatttggatgatgaggatggagctacacgaaaagatgcagctctatgttgttgcagattgattgctagttctttctctggtatggcatgctcacattttggttctagcaggttgactcgatcaggggggaagcgccggcgccttgtcgaggagggacctaaagaatgtatctcaacatccacaacaggggcagctgttgaacggtccgatatcatggaagggggagataatcacttactagagaagtatcataggttatacaccatatcggttcagcaaaatcaattaattcagcatatgggagtatacaaaaacacaggatgggaatgggatttcaagtggcagagaccattattcgacagtgagatagatcaggcggtttcatttatacaagaagtggaggggttcagaattcggcctgacattggtgaccagtgggtgtgggaggcagatccaagtggacggtattcggttaagagtgcttatagtgtgcttagacaggatgtatcagaggaggccccggatgaagagttcaaggaattatggaagcttaaagttccatctaaagtggctaataatggaggagagcgcaagtcatctgttttttcactgcagcaaaatacttccgctttggtgggaatcgctgtcttgggtgaatctgcattgacatggtctatttggaagcacagaaatagcatagttttctccaacaacactctcaatgcaaataaaatgatggatgaggcacttgtagagaagcttctcatttctgctgttgcagatgctgatgttactgttcggcattctatctttacttctctccatggagatagaggttttgatgagtatttggcccaggcggacaacctgagtgcagtatttgctgctttaaatgatgaggattttgatgttagagagtatgcaatttctgtggctggaaggctatcagagaaaaatcctgcatatgttcttccagctcttcgtcgccatcttatacagttgttaacttacttagagcagagtgcagatagcaaatgtaaagaagaaagtgcaaagttaattggctgtttgataaggaattgtgaacggctaataattccatacattgctccaattcataaggcactcgtagccagacttattgatgttaatgccaatactggaaccattagtggagtccttgtaaccgtgggtgatcttgcgagggtgggcggttttgcaatgaggcaatacattcctgaacttatgcctttaattgttgaagctttattggatggagctgctgtctccaaacgtgaagtggctgttgctacactaggtcaagttgtgcagagcacggggtatgttataactccatataatgagtatcctcaattacttgggttactcttaaaattactaaatggtgaactagtatggtccaccagacgtgaagtattgaaggttcttggcattatgggtgctctggatcctcatttgcataaaagaaatcaaaaaaccttgccagggcctcatggagatgttacccgtcctgctagcgattcaagtcaacagattcagtctatggatgaatttcccttggacctttggccttcttttgcttcatcagatgactattactccacagttgcgattaattctctcatgcgaatattgagggatccatcacttgctagttatcacttaaaggtggttgggtctcttatgttcatattcaaggttttgcctgatctttttcatactgttcggacatgtgaagatagtttaaaggactttataacatggaagcttggaacactggtgtctattgtgcgccagcacattcgtaaatatttgcaagatttgctatctttaatatctgaattttggtcagccttcactcttccagcaccagctcgtcctggtcctggctatccagttagtgttgcttcttccctggttcttcacctggtggagcagctttgcttggctcttaatgatgaatttagaacatatcttccagttattctgccaggttgtattcaggtccttagtgatgcagaacggtgcaatgactacacttatgttcttgatatccttcataccctagaagtgtttggtgggccaaaaggtgtgatgcacctaatcatagccaaaaaggtgggaatggggagtgagggggccaaaactggaattggacccttgggagagtttaggttgctcaaagtgcctaaggagagtatttactgtaaaaagtgctatatctcaggatctgggactttggatgagcatatgcatctacttcttcctgctctaatacgattgtttaaagtggatgcctcagtagacataagacgtgctgcaattaaaactttgacaagcctgatccctcgtgttcagcacaaggaatttgaggaaattgaagggcgtttacagcgacgggagccacttattcttgggatcacagcttcacaaagactgaacagacggcttcctgttgaggtcattagtgatcctttagatgatgtggagattgatccttatgaagatggatctgatgctcacaaacttagagaccatcaggttaatgatggtcgattacggacagctggggaggcttctcagcgaagtactaaggaagattgggcagaatggatgaggcattttagcattcaacttctaaaggagtctccttccccagccttacgaacctgtgctaggcttgcacagttgcagccttttgttgggcgagagttgtttgcagctggatttgtcagttgttgggcgcagctaaacgaaactagccagaaacagctagttcagaatctagagatggcattttcttctccaaatatccccccagaaattttggcaacacttcttaacttggctgagttcatggagcatgatgagaaacctcttcctattgacatacgccttcttggtgctcttgctgagaagtgtcgtgcatttgcaaaagccttgcactataaagaaatggaatttgaaggagcacgttccaagaagatggatgctaacccagttgctgtagttgaagttcttattcatataaacagccaattacaccaacatgaggctgcacttggaatactaacctatgcccaacagcatctagattttcaacttaaggagtcatggtatgagaaactgcagagatgggatgatgccctcaaggcttatacagcaaaggcttctcaagcaacaagtccacatcttgtcttggatgccactttaggtaaaatgagatgccttgctgcattggctcaatgggatgagttgaatatcctatgtaaagaattttggacccctgcagagccagctgctcgtcttgaaatggcaccaatggctgcaagtgctgcttggaacatgggagaatgggaccaaatggctgaatatgtgtctcgattggatgatggtgatgaaacaaaacttcgaggtttgggaaataccgctgccagtagtgatggaagtagtagtggtactttcttcagggctgttctattggttcgtagaggaaagtatgatgaagcacgtgagtatgtagaaagagctagaaaatgtctggcaacagagcttgctgctttgaggctcttcgctatgcgaaggtatgagggagggatgttgtacgcagctttacccttgcatatgcaaagaggctgtttccggattcaaacccatgaccaacaagtcaccaaggcacaactttaccgctgcaccagggctcgccctcaagttttggagagttatgaacgtgcttatagtaatatggttcgtgttcagcaactatcagaactagaagaggtgattgattaccgtacgcttcctattggaaaccgagtagcagacgagcgacgggctcttattcgcaatatgtggactcagcgtatagaaggagccaaaagtaatgttgaggcacttttagctgtcagagcacttgtgctgcctcctgtggaagatgttgaatcctggctcaaattcgcctctctttgcagaaaaagtgggcgcattagccaagcaaaatctactttagttaaacttctacagtacgaccctgaaaagtctcccgaaaatgttcgataccatggccctcctcaagtaatgctggcatacttgaagtaccagtggtcacttggagaggattcaaagcgcagggaagcatttataaggcttcagaatttggctatggaactctcaagtgcacccaacattcaaccagttacaccatcaagcttcacaaatggtttgaatcttagtgttcctctccttgctcgtgtttatctaaatcttggttcctggcagtggtcactttctcctgggctagtcgatgaatctattaaagatatacttaatgcattcacaaaagctactcagtatgccaataaatgggctaaagcttggcataaatgggcattattcaacacagcagtgatgtctcattacactttaagaggtttccccgatgttgcagctcaatttgttgctgcagctgtcactggatactttcattctatagcatgtgcagcaaattccaaaggtgttgatgatagtttacaggatattcttcgacttttgacattatggttcaaccatggagctactgcagaagtacaaatggccctaaagaaaggattttccctggttaatatcaatacttggctagtagttctacctcaaataattgccaggatacactctaataaccatgctgttagagagttgatacagtcacttttggttcggattgggcaaaatcatccacaggctctcatgtatcctttgcttgtggcctgtaaatcaataagcaacttacgcaaagctgcagctcaggaagttgttgacaaagttcggcagcatagtggtgtactagtggatcaggcgcaacttgtatcgaaggaactgatcagagttgctattctttggcatgaaatgtggcatgaagcactggaagaagctagccgtttgtattttggtgagcataatattgaagggatgctaaatgtgttggagccattgcatgaaatgcttgaagaaggagcaatgaaaaacaatgtcaccataaaggagagaatatttattgaggcttatcgacaggaattattagaagcttatgagtgctgtatgaattataagagaactgggaaagatgctgagctgacccaggcttgggatatttattatcatgttttcagaaagatagataagcaacttcaaagtcttacaactttagacttggagtctgtttctccagaattgctagaatgccgcaatttggagcttgctgttcccgggtcataccgtgctgatgcaccagtggttacaattgcatcatttgcacgccaacttgttgtcataacatccaagcaacgacccaggaagttaaccattcatgggagtgatggtgatgattatgccttcttattgaagggacatgaggatttacgccaggatgaacgagtcatgcagctttttggtttggtgaatactctccttgagaattctcccaaaacagcagagaaagatctgtctattcagcgatatgctgtaatccctttgtctccaaacagtggtttaattgaatgggtcccaaattgcgacacattgcatcatcttattcgggagtatagagatgccagaaagatcacattgaatcaggaacacaaatgcatgctcagttttgcacctgattatgatcatttgcctcttatagctaaagtggaggtgtttgaacatgcgttgcacaatacagaaggaaatgacctagcaagggaggacaaattatacaaggagtttggcagttatgagcatgttcctccaagtagctttgctaaacctttgactttacaatcggctgggaaaggtggaacatgtgcctttgtatacaacaaaagccttgtcccactaggacgtgcactttgtaagctggttggttaccttcttggtttaggtgatcgccatccgagcaatcttatgttacaccggtttagtgggaagattttacacatagattttggagactgttttgaagcatcaatgaaccgtgagaagttcccggagaaggttccttttcgcttgacaagaatgcttgtgaaagccatggaagttagtggtattgaaggaaacttccgctcaacttgtgaaaatgttatgcaagttttgcgaacaaataaagatagtgttatggccatgatggaggcctttgtacatgatcctctcataaattggcgtctttttaacttcaatgaagttccacaaatgtctatgcttaccagcaatcatgtacctcctgttgtaaattctgaggaatctgccccaaatagagagcttccccaccctcagcgtggtgcccgtgaaagagaacttctacaggctgttaatcaacttggtgatgctaatgaggttctgaatgaacgtgctgtggttgtcatggctcgtatgagtaataagcttacaggacgggatttttcaacttgttcttcagtatcaaacaactcccttcagcatgctgtggaccatagcagcttaatttctggagacactcgtgaagttgatcatgctttatctgttaagttgcaagttgtgcattatccacacgattcaagccccaaagggctcttgtgtgagggtacgtgttag

SEQ ID NO: 77892 - DNA, 1077 bp, Glycine max
  Peptide Sequence Number=SeqID_169577
atgaggggaggggaggagagatcgacgacagggattcgaaagaagggaagcggagtgaggcaatggctggtactggacggcaaaggagagacggaggtggtggaggccgggaagcacgccatcatgaggcggacgggactccccgcgcgagacctgcgtatattggaccctctcttgtcctacccctccacccttcttggccgtgagagggccatcgttatcaacttggagcacatcaaggccatcatcaccgcccaagagctcctcctcctcaactctcgcgacccctccgtcacccccttccttcatgagctccaggcaaggatcatccgccaccacaaccaggctgatgctgaccccaaccccaaccccaacgacgccatcaagattcttcccttcgagttcgtttccctcgaggcctgtctggaggctgcttgtagcgtcttggaaaacgaggctaaaaccttggagcaggaggctcatcccgccttggacaagctcacctccaagatcagtactctcaatttggaacgcgttcgtcaaattaagagccgattagtcgccatcaccggtcgtgttcagaaggtcagggatgaattggagcacctgctcgatgacgacgaagatatggctgagatgaccgctcctgaattatcgttcgacaatgttctcggtagggacagcgcctccttcagtgccgtcaccaagcaacttgatgtcgaggagcttgagatgctcttggaggcttactttgtccagattgatggcaccttgaacaagctctctacgctgagggagtacgttgatgacacagaggattacatcaacatcatgctggatgacaaacagaaccatctcctccaaatgggagtcatgttgaccacagcaactctggtagtgagcgcctttgttgttgtggcgggtatttttggcatgaatattcacattgagctatttgatgaccagaaagcggggatgacgcaattcctctggactgttggtggtagcactgcagggaccatattcttgtatgtggttgccattgcctggtgtaagcacaaacgcttgctagagtaa

SEQ ID NO: 77893 - DNA, 564 bp, Glycine max
  Peptide Sequence Number=SeqID_169578
atggctctgtcttttggttttgggctcttgtcttcttcttcttcttcttcttctttatgtgttctccctccatcagaaacccacactttcatgatgaggccttctgcttcttctggtttgcgcatgatgcgtaccagtcgcattacctgttgcaccctttctcagtcttctaagccagcccgcaaaatccgtggtatcatgaaaccccgcaaagtctcccccgagatggaagacctcgtcggcgctcccgagatggctcgaacccaagtcctcaaacggatttgggcttacattaaggacaacaatcttcaggcttatgttagtatgctgcttcactggcttactaatgagactctatccttcttgtacaagtgcagtgaccctacagacaagaggactataaattgtgatgagaagctgaagaaggtgtttgcagggaaagatcaagttgagatgctagagattgctcgcttgattagccctcacttccttaaaagtgaaagaattaccggtggggtcgagagtagggctgaaaagggtggcagtgtgaattgcaagttctga

SEQ ID NO: 77894 - DNA, 576 bp, Glycine max
  Peptide Sequence Number=SeqID_169579
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccaggcgaattggagctccaccgcggtggcggccgctctagaactagtggatcccccgggctgcaggaattcgatggttcgtcgttggcgacatacgagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 77895 - DNA, 1084 bp, Glycine max
  Peptide Sequence Number=SeqID_169580
cagaggtgtccatagaagccattgcatcacttacccaatactacgaccagcctttgaggtgcttcacattcgcagacttccaattagtaccaaccattgaagaatttgaggaaattctaggatgtcctctcgggggaagaaaaccatatctttcctccgggtatctcccctctttgagcagaattgcaactgtggtcaaggattcagcaagaggtttggaccgcataaaacagactcggaacggcacagcgggcctaccacagaagtacctagaagacaaggcgaggggtatggccaatcaaggagactgggtcccgtttatggatgtgttagctttgctaatttttggggtcgtcctctttccaaacgtggatggtttggtagacctagcagcaatcgacgctttccttgcctaccaccatagcaaggaaagtccggtggtagctgtcttggcagatctatttgacacatttgaccgaaggggttgtattaactacaatcccacgctcgctataagacaactagggtaccccatgaggggagcaccgtcggaagaaagcatgtctcctttccttgtgagggatctcggtgcacaaagttccaagactatacaaagaatccataaggcatgggaaaccccgttaaggaaagatcaagagcttagaggtattcgtaatggcatcattggtgggtaccacgaatggctgaaagctcatatacgaggtttagattggctcgccaagttaaaagtcgtcagcgaagagagttttgaagcaccggaagaggacgaagaagtccaagctctcaaaagcgagttaggaaaagcaaaacttgcaaaggagaagttcaagttggccgctacacacgttcggaaggagtgtgccaggttacgggaagagaatgcaattaccgcaagagcccttgaacaagagaccaagagggctcgcaaggaagagtatggccggaacaaatttcgcggagctctatggggtagcaatagtgaactcaagttgcgaagggaagaaagagaccagtcgcgagcacatagcatggttctgaaagaggagttaattgcttgttcaag

SEQ ID NO: 77896 - DNA, 550 bp, Glycine max
  Peptide Sequence Number=SeqID_169581
gcccttagggcagaactcgagcaagcccaaacagtcaaagaaaggttcaagtcggcagctctgaagatccgaaaggagaatgccgaactgagagatacaaatatagctacgaccaaggccttggaactagagaccaagagggctcgtagggaagaacacggtcggaacaagttccgaggggctctttggggcagcaacagcgagcttaagctccggagagaggaaagggaccattcacgagtagacagtttgatcttgaaagatgagttgaagaccaacatgttagctatcatcagcaagtaccaagaagaactaaagctagctacagcccacgagcatagagtggcggacgagtatgcccaaatgtatgcgcagaaggaggctagaggaaaggtgatcgactcgttacatcaagaggcaatgatgtgtatggaccggtttgctcttaccatgaacgggagtcaagaacttccccgattgctagccaaggccaaagcaatggcggacacctactccgcccccgtggagatccacggacttctcggctatt

SEQ ID NO: 77897 - DNA, 162 bp, Glycine max
  Peptide Sequence Number=SeqID_169582
atgagaacagatcaggaaagtgctataaaaaccctaagcctagccccttcactttattcctcacctcttgacttgagcttagaggctgtgagggcaacctgtcaattgcgcaaaggtgctagttcgcattttagaggtgttgtcgaatccctagttgcgtaa

SEQ ID NO: 77898 - DNA, 806 bp, Glycine max
  Peptide Sequence Number=SeqID_169583
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatacactcttcgaccggttaccaatcggtctgagggtacctttagaagcctccgttacgcttttggaggcgaccaccccagtcaaactacccaccatacactgtcctcgctctgcgatcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 77899 - DNA, 802 bp, Glycine max
  Peptide Sequence Number=SeqID_169584
cctgaaaggtgatagagcttatcacactgagctagatgactttaaggctgagttggagaggcgtaatttccataaacgcctcatcaatttagccgataggagcatagacctgactttggtgaaagagttctatgcaaatttatacagttctgaggaccgtccaccaaagcagtccaaagtcagaggtcatttggtgaagattgttactgatagtctcaatgcattcctggagacacctgtggtattagctgagggagagactcttcccgcatactccagatactgcaggttgcctatagatttcagagagatagaggctgctttatgcatacctggccgagggttcatcttgaactctgagggccatcatgggaggattctcaggaaggatttgactacactagctcaagtgtggagtgtcctctcatactccaacttggcccccacatcacatacctctgatctgacagtggacagagctaggctgatctttggcctaataacttttgtagcccagtctaacacctctagacttgggttccctactctaatcaccgcattatctagagccagaggggttttatctgatagccttaccatcaagcgcctgagcctggtcattaacttggcttacattaggaagaactgttggaaccccgaggatctaacagtctctatccgaggggccaggagggcgagggcaaagccagccgagcttccttctacttctatagctcctactccaacagctccttctgtcccagctcagacaaattctcagcgctttgaagccatgctctaa

SEQ ID NO: 77900 - DNA, 555 bp, Glycine max
  Peptide Sequence Number=SeqID_169585
atggattctccacttgcctcgcctcctcctcctcatcctccttccgacgcatcagcttcaccgtctgccatgaagcggacacgcaaagcgtcacgtctacgatccttgtctactagaccacctggtgctgagagaccagtggtccatgttgatcctactaccgacaaggccgatggtctccacaggaagaaattaagaacatatttggggattgtggcgcgtgataaggtggacgtgacgaacgagaactggaaggaggtccctattgctcaaaaggacttgatttgggaggatattcaggcggaatttgaaatcccagaggcttctgacagtaggacaaaaaagaagttacttcagactgttggcgagagatgtaggcagtttaaatcagacctcacgaggaaatgggcccttgcagccgatcaggacgatgtggacgacactgtatgtgacaaatacggcataagcaaggaaaaatgggcccagttttgccagactcacagagatccttcttgggaggatgtgtggaaaaaggcacaggccatccagaaataa

SEQ ID NO: 77901 - DNA, 528 bp, Glycine max
  Peptide Sequence Number=SeqID_169586
atgaacgagcagggccttttgcagcgtattttcaggctgcaggaacacggaaccaccgcgcgcaccgaagtgattgccggtttcactactttcctgacgatggtgtacatcgtcttcgttaacccgcagattcttggtgccgcaggcatggacacccaggcggtgtttgtcaccacctgcgtgattgctgcgttcggcagcatcctgatggggctggtggccaatctgccggtagcgctggcaccggccatgggcctcaacgccttctttgcctttgtggtggtgagtgcgatgggctactcgtggcaggttggcatgggcgcgatcttctggggcgcgctggggctgctgatcctgacgctgctgcgtgtacgctactggatgatcgccaatattccgctcagcctgcgcgtgggcatcaccgccggtattggtctgttcatcgccatgatggggctgaaaaacgccggcattattgtgcccaatgcggacaccatcgtgaccgtcggcaacctggcctcgcacaac

SEQ ID NO: 77902 - DNA, 670 bp, Glycine max
  Peptide Sequence Number=SeqID_169587
tcttacaaatgatgctgaggaatttccaggtgggccacatgacccatcagtgttgactttatttgcggaccatgttgcacatgtcatttggagtggacaggaacgttctgagttgaagttggtgtcgcatgggaggaaggtgatgttaattgggaggtcagtgcctaagattgaaggactggttgctgtcacaggattaagtccattgatcaggtgttcaattgtaatcggcgatcctggacttatatccgcatttgtggagatgtggcagagggagaccaacacattccaccttccaataggagagttgatgatcacactggatgatgtgttgtcactcctccatctgcctatcagtgacgccttccacagctttcatgctctttatgtggacaaggcgatatttttgttgatagagttgcttgaggtgtctgctgaggaggctagagccgagacaacacgatcacgcggggcatatgtacggctaggatgggttcgagacatctacgagatgagatgtcaggcacggcgatgggttgtagcagctcatgcttatctactgcacctgaggcttttcacgagctgggtcagagtggtggttatgcctggggagttgtcgcgctggttcatatgtatgaccagtttgatgaagcttctaggaccacgacac

SEQ ID NO: 77903 - DNA, 621 bp, Glycine max
  Peptide Sequence Number=SeqID_169588
atggcagaggtctccacggaggccattgcctccctcgcccaatattatgaccagcctttgaggtgcttcacctttggggacttccagttaacacccacggtggaagagtttgaagagatcctgggatgctctctaggaggaaggaaaccatacctcttctcgggattttatccctccttagctagaatttctaagatagtcaaaatctcgacacaagaattagaccgcggaaagaaagtcgaaaatggggtggttggggtaccaaggaaatgtttggaagcaaaggcgagagtcttggcaactcaaggcgaatgggccccgttcatggacatcctggcacttttgatcttcggggtggtcctctttcccaatgtggatgggttggtggatcgggcagcgattgatgcttttctcgccttttatgaccgcaaagacagcccggttgccgctatcttagccgatctatatgacacattcgaccaaagatatgagaagaacaatgcaaggatcgtttgctgtacgccggccctctacgtatggttggtttcacacttctttcgccaagagatgagacacgtttgcccgttagaaggccacggctcatgcactgagaaaaaatag

SEQ ID NO: 77904 - DNA, 81 bp, Glycine max
  Peptide Sequence Number=SeqID_169589
atgtggggaataccttatggttatccacacctttcgtcaaccaaggcgaacaagttcgatggttttactttcatcatctag

SEQ ID NO: 77905 - DNA, 360 bp, Glycine max
  Peptide Sequence Number=SeqID_169590
atgtacacacgaagtttcataattccacaattccctaaaataggcctaactcacaaaaaacagtccccagtggagtcgccaactgtcgcagcaagcccttttgcgggtgagcgaggcgaggctctcgggtgcgctttccaagggaggaaaatgtgcggagtcaccaccaacgtttatttatggaaaacttcagaaaaaccgaaggtcgacaaaagcggggcttttgctcctacgtaccctccatcgaagaggaaatcagacctacacagttcttttaagggtgaatcaagcgattctttttacttggaaggtgatcattttaaggcgttggaccttaaaaatgatccatttacttggtaa

SEQ ID NO: 77906 - DNA, 1031 bp, Glycine max
  Peptide Sequence Number=SeqID_169591
gaaatggctccgagaaagctttatgcaaagagatctaggaaggatgccgcggttgaagggaccagtgccgctcccaagttcgacaaccatcgtttcaggagcgttgagcaccagcagcgtttcgaggccatcagggacgatgagtacacagatttccaggaggagatagcctgtcggcgttggacgtcgctggtcactcccatggccaagtttgacctagatgtagtcctagagttttatgccaatgcttggcccacggaggagggtgtgcgggacatgcggtcatgggtaaggggccagtggattccctttgatgcagacgccctcagccagttcctgggatacccgctagtgaaccgggccgatgggtttgacgaggaggccatcgcccagctgttatgcataccgggtcaggattttgcccggaccgttgccgggagacgggtgcggatcatgcgcaccagcgatcataactctgacctccctctgccgaagtgtcagctgatgtacaccatcctgacatggatgagtgtccatatgccacctaccaggcaccctttagacccagataagtctaacagggccctgggttttccagcattgatcacgggtctctgccagtcgttcggggttcccgtcacacctagtaaggtgattcgaccgccgatcacccgggccttcatagagaagtattgcacgcctagacaggcgcagggtggcgcaccgcaggccccagacgcaccgccgccacctcatcaggctgatcccgctgggtcatttgacacagagcaggcgcatgtgcagacccatgactgtctctaccagctcagcctcaatctgcagagccagggtctcaccccttttccgtgccctaccccagatcagttcagggcagaggtcgcatggcccggaaattggcctgaggcccaagcaggggaggcgcctgcagaggctcccgacgatggggaggaggcccgcatggatgaggagatgacagatttgctcgatttcttgggaggcagcggagccac

SEQ ID NO: 77907 - DNA, 210 bp, Glycine max
  Peptide Sequence Number=SeqID_169592
atggtgtggcctttgggtccaaatcggaagggcacacgaagtgacgagaagagaaaacatcgagcttggctggaggaagatggagagggaaaacaaagggagaagagagcttgggcggagggggaaggaggttgggggcagaggagggaggtttgtggaagagggaagaagagaaagaaagaagagatgggtggaggaggtgggtactaa

SEQ ID NO: 77908 - DNA, 801 bp, Glycine max
  Peptide Sequence Number=SeqID_169593
atgaaaccacaaaagccgcgagataatatttatgatgtcgccaaaggtctctgtataattctcgttgtttttggccatgcggagagaggtctaaacggctccggagcaccgccgcacttcagccttatgggtttttgcgactatgctatctacaccttccatatgccgttttttttcttcttgtcgggattattcttctccggacaggctaccgccccagggcgcttttttggcaagcttggaaaaaatatcgtctacccctatttcttctggtcagttctccatggaagtctgatggtgatgatggggcgattgggccttacaaacacgatcatcgatctaaacagagtcctggaaatcctgtggagcccaataagtcccttctggtttctctactcgctctttttctgccaccttgcctcctattcattgagttgggtgcccgtcttcctccgggtggcattcgcactcatactgttcggtttgttttatatccagaaccagtgggtccaattggacgttgcctacgggtttctctatttcacactcggcatcgccgccaaacaatacgacttccagcagatgcgatacacgacgcgctcgttcatggggatattggcagcctttttgattgccacctatttttcctggaaaattgaggttcctgaacggcttccattcctgtcggctatcctcggaatagtgatgactgttgctatttcgcaggcgctggttattcgcgaaacgcaattgcatcaacactcaagacaatcggccaattatccgtcggaatctacgtaa

SEQ ID NO: 77909 - DNA, 336 bp, Glycine max
  Peptide Sequence Number=SeqID_169594
atgtgggatacattacaagtaacccatgaaggcacaactgatgttaagaggaaattgaagagatcaaactccaatccaaagaagaaaggagaagattcctccttagttccaaaatgttatgaatgcgatcaacctgggcacttgagatttgattgtcctgtctttaaaagaagaatggaaaaatccgacaagaaaaatttcaaagataagaaagaaaagaaatcatacatcacttgggaagataatgacatggattcatcaagtgattcagaaaatgaaatcatcaatctgggcctcatggccaaagactatgaaagcggagaagagttgctctaa

SEQ ID NO: 77910 - DNA, 309 bp, Glycine max
  Peptide Sequence Number=SeqID_169595
atgtcattgcctagcgctgttcatgtgttctccattatcaagtgcgaagcttctggtgactgggaagcacgttattctgttgttttccagatcggttccttcgccaagaagcaggcttgcgcgatccgtgaaattccgcaatgtggcggaagtcgtaaaggggtgtttttgcgtaatccgatcactttggccttccagaagattcctccagaaggctgttgcttctggaggaagcaacctggctcgcctgggcaagctgagctcgcctgggcgagctgggcggcaagcatctcccctattttgctataa

SEQ ID NO: 77911 - DNA, 589 bp, Glycine max
  Peptide Sequence Number=SeqID_169596
atgggtgaagcagaggaggtgcaagagcagatgaaggccaatatggaggccatgaaagagcaaatggccacaatgatggaggccatgatgagcatgaagaagataatggaagccaatgcggttgcagtcgccgctaccagcactgttgctaaggtaaacccgatgcccccatctgccctcaaccaaatgaatcatccaacctcagctatgcatgccttcccaccatatggcttgcctcccaactatacaccacccaatgtagcgtacactcccaatgagaatgtcaataactccactcccatactcattgagagccgagaaccccaaactgatcatgcacatgtctctcaacccatgggtgagacacatgaaatgccccaccacaatctagccgacttcgagccttgcctcggatatgccactgaagggcaggcaattggtggtatgcccctacaaaaccctttggagggccctcagtatcatccccagctacacctcttgcattccacaacaagtaaaaaccctcatgctatgctagaaataggaaagttggatcatctagaggaaaggctcagggccattgaaggag

SEQ ID NO: 77912 - DNA, 195 bp, Glycine max
  Peptide Sequence Number=SeqID_169597
atgataacaaaagatgatgacaaaggtgatgacaaaaagctcaaaggtcaatcaaagaatgagttcaagatattcaagagatcaagatttcaagaatcaagattcaagagatcaagattcaagactcaagattcaagaatcaagaaaaagcttaatcaagataagtatgaaaaggttttttcaaaaactgagtag

SEQ ID NO: 77913 - DNA, 1826 bp, Glycine max
  Peptide Sequence Number=SeqID_169598
ccgtgaaagggggcgaaaaggcgattgccagcgcccatcagctgcaggccgatctgcgccgtggcgatcgcagcgtggcggagctgggctgcgatcaggtggcgcaacagctggggctggcggtggaccgggtgatgaccgaaggcggcatctttgacacacagctggcggccttagccatcaaacaggccagtggcgatttggtcgaggcgattttcctgctgcgcgcctaccgcaccacgctgccgcgcctcgcggacagcctggcgctggaaaccgcggaaatgcgcatcgagcgccgcatctcggcagtttacaaagatctgcccggtggccaggtgctgggcccgacctatgactacagccaccgcctgctggattttaccctgctggccaacggcgaaacgccggccgccgcgcgtgacgatcaggcgctggcgcagcgttgcccgcatgtgttcagcatgatgacgcgtgaagggctggcagcgcgtgaagaggatgacggcagcgagccgtgcgacatcacgcgccagccgcccggttatccggcgtcacgcgctgcccgcttacagcagctggtgcgcggcgacgaagggtttctgctggcgcttggctattcgacccagcgcggctatggccgcaaccatccgtttgccggtgaaatccgcaccggctatctcagcgtgtcgatctgccccgaagagctgggttttgagattgaaattggcgagatcctgctgaccgaatgcgaaatggtcaacggcttcaccacccagggcgacagcgccccacactttacccgcggctatggtctggtgttcggacgcgcagagcgtaaggcgatggcgatggcgctggtggaccgtgcgctgcaggcacccgagtatcaggagcgcattgccgggccggcgcaggacgaagagcggagctggagctgctgcagcggctgcgccaacagcatcaggagcagaatgatgagtgagttaaccggctacaacaacggctacctggatgagcagaccaaacgcaccatccgccgcgccattctgaaagcggtcgcgatccccggctatcaggtgccgtttgccggccgcgaaatgccgatgccgtatggctggggcaccggcggcattcagatcactgccagcattattggcgacagcgacgtgctgaaagtgatcgatcagggcgcggatgacaccaccaacgcggtctctatccggcgcttcttccagcgcgtcagcggggcggcaaccaccgaagccaccaaagacgccacgctgatccagacgcggcaccgcattccggagacgccgcttgaagaggatcaggtgctgattttccaggtgccgatcccggagccgctgcgctttattgagccgcgagagacggaaacccgcaccatgcacgcgctggaggagtacggcatcatgcaggtcaagctgtatgaagatatcgcccgctacggccatatcgctaccacctatgcctatccggtgaaggttaatgatcgctacgtgatggatccgtcgccgattcccaaattcgacaacccgaagatgcacatgatgccggcactgcagctgtttggtgccggacgtgaaaaacgcatttatgcactgccgccctacaccaaagtggaaagtcttgatttcgacgatcacccgttcagcgtgcagagctgggcacaaccctgtgcgctgtgcggttcgcgccaaagctatctcgacgaagtggtgatggatgatgccggtacgcgcatgtttgtctgctccgataccgatttttgccaccagcagcaggaacaacagcatgcacagtga

SEQ ID NO: 77914 - DNA, 177 bp, Glycine max
  Peptide Sequence Number=SeqID_169599
atgtttaaagaatttaagcctttgaatcctagtgtcgcaacctacccttcggcaagagggcgacgcgagggctcacgggtgcgtcttccaagaaaggaaaatgcacggagtcgccaccaacgtttattcaaggaaaacgtcggaaagactggaaaaggtgtggtctgcgaactttaa

SEQ ID NO: 77915 - DNA, 1701 bp, Glycine max
  Peptide Sequence Number=SeqID_169600
atggggttcttgagcagtttcttgggggtttttggttttgccgttggaatacctcttggcctcttggttgggttctttctctttgtctactcagaaaccaaacgtgtcaaggaccctgttgttaggccaattagtgaattaggcccaaattctctgcaggaacttctgcccgagattcctctctgggtgaagacgcctgattatgaacgagtttatgatgactacgatgatgatgttactgtgttattgatattatttttgcatgttattcaggttgattggttgaacaagtttttgttggatatgtggcccttcttagacacggcaatttgtaagattattagaagcacgactcaaccgatatttgctgaatacattgggaagtatcagatcaaagcgattgattttgatgagttaagccttggtactcttcctcctactgtctgtggtatgaaagttttagaaacaaatgaaaaggaattggtcatggaacaagttatcaaatgggctggtaatccaaacatagtggtgtccttgtatgtgtcatctttgaagatcaccattcagttggtagacttgcaaatatttgcagcaccacggattactttaagacctttggtgcctacatttccatgttttgcaaatattgtggtatctttgatggagaagcctcatgtggattttgggatgaacgtatcaggaggggacatcatgtcaatacctggtctctatagatttgtacaggaaacaataaaaaaacaagttgcaaacctctatctctggcctcaaaccctggaaattcctattcttgatgaatcaacggtggcaataaagaagcctgtggggatattacatgtgaatgtggttcgtgcacaaaagcttttaaagatggatttgttgggtacttctgatccttatgttaaactaagcttgacaggagacaaacttccagcaaagaaaaccactgtcaagagaaagaatttgaatcctgagtggaatgagaagttcaagattgttgtaaaggaccctcaatctcaagttctccaattacaagtttatgactgggacaaggttggtggacatgacaagctgggaatgcagttagtccctcttaaagtgctaaatccgtacgagaacaaagaatttatacttgatttactcaaggacacaaatctcaatgaaactccacataagaagcctagagggaaaattgtggtggacttgacttttgttcctttcaaagaagatagtaacaagtttggtggaccttcagaaggatatagcaggaaggaaagtggaattgatattgtatccgatgatgaggtccaagaaggagcaggtttgctttcaattgtgatccaagaggctgaagaggttgagggggaccatcacaacaacccatttgcagtgctgacctttagaggcgaaaagaaaaggacaaagacgatgaagaaaactcgacacccgcgttggaatgaagaattccaattcatgctagaggagcctcctctacatgagaagatacatattgaggttatgagcaagaggaagaactttagttttctgccaaaggaatcattggggcatgtggagattaacctaagagatgtggtgcacaatggtcgcattaacgataagtaccatctaataaattcaaggaatggagtgatgcatgttgagataagatggaaggtggtttaa

SEQ ID NO: 77916 - DNA, 2118 bp, Glycine max
  Peptide Sequence Number=SeqID_169601
atggaggccatcaccaagtttttgaaccataacataaccccatgtcttcctctacgtggtacaatcactgcatcaggtgacttggttcctttatcatatgttgctggcctcttgattggaaggccaaactccaagtctattggacctaatggacaagttcttaatgctaaagaggcctttcaactagctggaatagatggtggtttctttgagttgcaacctaaagagggtttggcactagtgaatggcactgcagtaggatctggcttggcttccacggttctttttgaggcaaatttgcttgtcatcctttcagaagttttgtctgcaatttttgctgaagtcatgcaaggaaaacaagaattcacagaccacttgactcataaattgaagcaccaccctggccaaattgaggctgcagctatcatggaacatatattagatggaagctcatatgttaaggcagcacagaagttacatgagattgatccacttcaaaagcctaaacaagataggtatgctcttagaacatcacctcaatggcttggaccacaaattgaagtaattaggcatgcaacaaatatgattgaaagggagataaactctgtcaatgataaccccttgattgatgtttcaaggaataaggcactccatggggggaatttccaaggtaccccaattggtgtttcaatggataacacccgtttggctattgcatcaattggtaaacttatgtttgcccagttctctgaacttgtgaatgacttctacaacaatggtttgccttcaaatctaacagctagtcgcaatccaagcttagactatggattcaaaggtgctgaaattgcaatggcatcctattgttcagaactccaataccttgccaatcctgttaccactcatgtccagagtgctgagcaacataaccaagatgtgaactctttaggcttaatttcctctagaaagacagctgaagcaatagatgtattaaagctcatgtcatccactttcttagttgctttgtgccaagccattgatttgaggcatttggaggaaaacttgaagaacactgttaagaataccgttagtcaagtggccaaaagagttctcacagttggcatcaatggcgagttacatccttctaggttttgtgagaaggacttactcaaaattgttgatcgtgagtatgtctatgcttacattgatgacccctgtagtgcaacctaccctctgatgcaaaagttgagattagtcctagttgatcatgcattgcaaaatggtgacaaagaggcgagttcaagtacctcaattttccaaaagattggtgcctttgaagaagagctcaatgcccttttgcccaaagaggtggaaagtgctaggattgaagttgagaatggaaatcctgctattcctaaccgaattaaggaatgcaggtcttacccattatataagtttgtgagagaaaatttgggtacaactttgctaacaggagagaaagtcaagtcacctggtgaggaatctgataaggtatttactgcattgtgtgaagggaagttcatcgatcctttgttggactgtctaaaagagtggaatgtggaaaaggctaagtactattatgttgctggatttttcctcaccgtgtcccttgagtccattaaaattcttgctaggaatgcagctgcgaataataaggctagaaccttttcacaggcgcatggctggaagactgataataatgttatcattcaagatccagttcttcccgttgtactggctgaggatggaaagatcaaattattctcagctgttccactgccaaaagagaagattgtggataccaatggagtagcggacgcatttgttggtggattcttgtcacagctggttcaagaaaaggccattgaggagtgcgtgaaagctggttgctatgcagcaattctcatcattgtgaagaacaagaaggaaaatgttctcattgcaagggatacggagtttagaatcattggtgaatccaaacacatcctctgcatggtccagcaaggcttggaagagtggatggttgagcatacctactttgatcacaaatctcttgcaatcctcaccaacatagacaactag

SEQ ID NO: 77917 - DNA, 1212 bp, Glycine max
  Peptide Sequence Number=SeqID_169602
atggcaatatatgaactggatcccgatgttgttcgctggggtcttcatctcctagatgattgcacactttcccaccattattcgcctagtattgtaactcaatatgatcctgatttaagtcaagttgaatatgttacagaaggcttttgtcagcatcagtatgtggatagtgacgaggctgttgcacaagcttatcaagaagaattatggcaacttgattccatggtagcttctgggatatccaattttgagaatgaaggaatgcaaggatctgtttatacacaagattggcctcagtcttcaaatggaaatgataacttaggcaatgaatcttgccagaactctgtaggtgagtcctataatatgaaagaagtggggaattatggtccaactccaagtgaaagaaaaaatgacgtgcatgaaaatgatgtttgtggttcgtcttctggatcagtagaggtacctgctactgctactagtgatgacttctgggattcattggaaatatcggatgaatctcttgatggtgaagttggcaaaagattaaaccagatggttcccattcctaaaataacagcaatttgcggctactcctctgtttgcaccattgctggacaggctatgcgacctgtgccatcatcagacagcctttgttctgcgtcttttctagaatttccagtgaggcaaaattgttgggtgaagaggaggagaggggcggctgatgggggaaagaggctaggtttttctttcttgggtgaggggcatgttcctaaaaccaatgaaaaaataccatctgatgacgaagaaatatcagatcatcaaagacttctagacaggaatttggtctttcttagattgcagttatatgatctgattgaatgcaaggttcaaggagatggtaactgccagtttcgttctttatcagatcaactctatcgttctccggaccaccacaaatttgtgcgggagcaaattattcaacagctcaaatattacccagatctgtatgctggttatgttcccttggcgtatagtgactatttgagaaatatgagcaaaagtggcgaatggggtgatcatgtcacattgcaggctgctgcagattggccttacccttgcatatgcaaagaggctatttccggattcgaactcatgaccaatcggtcaccaaggcacaaatttaccgttgtgccagggctctccctcaaatga

SEQ ID NO: 77918 - DNA, 1008 bp, Glycine max
  Peptide Sequence Number=SeqID_169603
atggttaaggtaattttgacatgtgtaaagaaggttattggaagcattgaagaacaaagtaaattgcatgatagccctatgaacaaggatagaggcattccaggaatgataatagaggaaattattaagagggatcttaaggcttttgttgatgatattgatttgaaactatttgaattgctagtgatgctgttcccttattcatattttggattttgtaggcataaatgttctttgtggtgttggaatcctttctacaccttatgctgccaaagtagtgaacctgagcttgagacgtatcctgatattggccaagctgcatttggtactactggacgtattgccatttcagtaagtcttcatgctgatctctactcttatttgaagtgtccatgtcccacccgtggtgacaatttgtcttctttatttccaagtgcacacttgaatttgggtggaattgaactgaattcacgtactttgtttgctgtgattactaccttggctgttcttcctactgtttggctccgtgacctaagcattctcagttacatatccgctggtggagttgttgcatcgattttagtggttctctgcttgttatgggttggcatagaggacgtaggctttcatagcaaagggaccacactcaatctttcaactcttcctgttgctgttggtctttatggttactgctactctggacatgcagtgttcccgaacatttatacatccatggcaaatccaaaccaatttcctggagtgctcttagcatgttttggtatttgtaccttattgtatgctggggctgctgtaatgggatacacaatgtttggagaagctatactgtctcagttcactctcaacatgcctaaagaattggtagccacaaatattgctgtctggactacggcagcactttgcattacaattatcacagtaggtgttgtatgttctgcttttggaacatactccgccctctccgagattgtgaagagtttgagggagtga

SEQ ID NO: 77919 - DNA, 279 bp, Glycine max
  Peptide Sequence Number=SeqID_169604
atgttgggttctgctgtggggttgggttctgcggggttgggttctgcggggttgggttctgctgtggggtctattataaagtctggtgtattgctaacacctaaggttccatttaatcctttactgctcaagaaacaaatcatgcatgacactcaaaagaaaagaataggtacagaatctgagcactgccaactagtaaaaggagtggtgaaattgggcttggcaaaacaatgcaaagtgaaggaggtacaacagagttggcacaacaagtgtcaatga

SEQ ID NO: 77920 - DNA, 2007 bp, Glycine max
  Peptide Sequence Number=SeqID_169605
gctggtcctcatccttgggctattgagaactttgctttggtagcaaaatatccatctggtcaagttattgcacaggatctgttttcttctggggccataaaatctgcaactgatttccaagtgtacaaagaggttgctggcctttctgggcttgactttgcatatttggataacacggctgtctatcataccaagaatgacaaattagagcttttgaagactggatctcttcaacatctgggggaaaatatgcttgctttcctgcttcatattggggcatcttctcatattccagaaggcaattcaactgaatcagaggaagatataagcaagaacaatgccatttactttgacattttgggaatgtatatggttgtataccgtcaaaagtttgctaatatgctgcacaattcagtaataatgcagtcacttctaatatgggttacatcattggttatgggtggtataccagctgcagcttcattggccttgtcgtgtttgagtgttctcctcatcccaatgttggtggttggattatttggtgcaccagcttttctcggagcattgactggtcaacattttggttttcttctacttcaaaaatatctttcgaatacactatcaaagggaaggcagttgacccccattattaaagcagctgttgtcaaaatggaggctgaaagatggctctataaagctggatcctttcaatggcttatacttctcattttgggaaactattttaaaattggctcttcttacttggctcttgtttgcaacactaaccccagccaggctaccaaagccactcaaactggcaaccataattctggggttagccactccgattttattttctgcaggcatatttattcggctggctgctacacttatagggggaatcctggtggtactcctgaatggctaggaaattttgtgattgctgcttttattgcttctcttttatccttgaccttggtgtaccttctttcatatgtccatctttcaggtgcaaaaagggcaatcatcctagctactttggtgctatttagtttatcacttgcagttgtattaacaggtgttgttccaccattttccgaagacactgctagagctgtgaatagcccctttaatatacttcaagatatggattactgcatcccaatgtccttcatgtggagaattaaggaattcgtttacttcattcactgcaaagtagatgcctggacgatgactccctaccctgacagaagtatggcattaggatccataggagtatcagaaggtttagcacccatcaatcctgtatcctttgatgttcgttacatactttctttgggaaattacaaagcattcttggattgtgccacccctatccccaagaagtatccccaagggaatggaaaacttgatcaaggacagaatccaatatcatatgtatctttattttctaatactcctggaaatttgaacaaggaggttaaacagattgatgaaggttttgtatgtggtagagacaaaacagttgattttgtgactttctcggttaaatatggttgttggacctataatgacaccactaatgactggactgagatggatattcctacaatgaatgttgttagtgatgctaaaggaaatggaagaattacacaagtttcaatcaatacaaagggttctatccgttgggttcttgcaatcaatatagaagaaatagaagatttcgagtttaaagttgacaaaaagagtagtgtggatggttggcacattattcagttttctggaggaaaaaatgcaccaacattgtttgatctgactctttactggaggtcaggttcaactcataactctgatagtcctcttctgaaactaaggactgatgtgaacagattaacaccaataaccgaacgagtccttgagaagcttcctcgttggtgttctttgtttggcaaatccacctctccttacaccttggctttcttgacaaatctgcctgttaaattttag

SEQ ID NO: 77921 - DNA, 1968 bp, Glycine max
  Peptide Sequence Number=SeqID_169606
atgtatttactgtgctgcacaggaataggattctatctaggaataggaatagtgagagaagagaaggttacagaaaaacaaaaacctgtctctgtttctccgtcgtggcaattgaaggaagcactgtctgtctctgcaactttagtcacattcacatggcaggaaaatgagagaaagacatttgatgaacttagaaatctgaatgaatctgataaagcttctgcatctgctactgctgtgccatatctagacaagacagattttctaaagcttcaaaatggcagtgacattcgtggtgtggctgttgatggtgttgagggagagctagttaacctcactgaacctgttgctgaagcaataggagctgcttttgctgcatggttaatggagaaaaagaaagctgatgcttctcagcatttgagagtttctattggccatgattcccgaatatcagccaaattattacagaatgcaatttctcgaggtcttgctggtgctggcctagaagttgtccactatggattagcatcaacaccagccatgttcaatagcacactcacgaagaatgaagcatttttgtgtcctgctgatggatctattatgataacagattgtggacatggcacaacaacaaagccttatcccactaggtacatggatcacatgacgtcattcaacgcggttaaaaatcaaacaagtcatctgcctttcaacaggaatggattcaaatttttcacaaatgctggtgggtttgggaaggccgacattaaagatatcttagagcgagctgcagacatatacaatcaatttacagaagaaagtttgccaaattcagagagaaaagcttcactatctattaagaaagttgattacatgattgtttatacatctgatttagtaaaagcagttcgcaaggcagctggaaacataggcatgactttgttgaagtacttttataataagaaaccattggagggtttccatatagttgttgatgcaggcaatggagcaggaggcttttttgcagcaaaggttctggaacctctgggggcaataacttctgggagtcaatttttggagcctgatggcttgtttccaaatcatatcccaaatcctgaggacaaaacagcaatgaaagctataacccaagcagtccttgataacaaagctgatcttggaattatctttgatactgatgtggacagatctgctgctgtggatttcactggccgtgaattcaacaggaatcgtttaattgccttaatggcagctattgttcttgaggaacatcctggaacaactattgtcacagacagtgtgacttctgatgggcttaccacgtttattgagaagaaacttggtggaagacaccatcggttcaaaagaggttacaaaaatgtgattgatgaagctattcgtttgaattctattggcgaggagtcacatttggcaattgaaactagtggacatggagctctcaaggaaaatcattggcttgatgatggtgcatacctaatggtcaagatcttaaataaacttgcttctgcaagagcttctggaaagggtggtggaagcaaggttttgactgatctaatagacggacttcaggagccagcttttgctgcagaactgagattaaagataaaccaaaaccatccagatcttaaaggaggagctttcagatcttttcgggaatatggagaagctgtgctgaaacatttggagaattcaattggctctgatccaagtctgctcaaggctcctgtgaactatgaaggggtccgagtttctggctatggtggatggttccttcttagattatcactccatgatcctgtacttccccttaacattgaggcacctagtaatgacgatgctgtgaagcttggacttgctgtgcttgcagctgtaaaggacttcgcaggtttagacacatcagccttgaacaagttggtaggagcatcataa

SEQ ID NO: 77922 - DNA, 2241 bp, Glycine max
  Peptide Sequence Number=SeqID_169607
atgggtattccgcagagggagaggaaaatggaagggtggctctatctcattcgcgccaatcggtttggtcagcattattcacgtaagaggtacttcatcctcaaaggcaatgccctccgaagcttcaagatcaaacccacttctcaaatggaggagccaattaggagtgcaataatagactcctgcattcgggttaatgacaatggaagggagactatgaacaaaaacgtgttgtttattttcactgtatataatgccacagatcaaagtgataagcttaagttgggagcaagtagttcagaagaagctgcaagatggatacgtaccttgcaggatgctgcaatgaaggggtgcccaagtccagcaaagaatttagtggcttgtcacaagaaaaggcgttcaagtttgagaaacggaggctcaaaaagcacagattggaaatactccaacttgaattttcaatcgtgcatatacactgaagcaatgaccgctgatgttattgctccttcaccatggaagatttttggttgtcagaatgggctaagaatgttcaaagaagccaaagattgggattcccgtggaagtcattgggtgggtgaaaacccagcaataatggcagttggtgtggttgatggagcttcagaggccatcttccatactcttatgactcttgatccctcaagatcagaatgggacttttgtatttaccgaggcaatgtggttgatcacattgatggtcatacagatattattcatttgcagctgtacaatgattggttaccatggggaatgaaaccaagagatttgttgttacgaagatactggaggagggaggatgatggatcatatgtgttattattccattctgtgtaccattccaagtgtccacccaagaaaggctatgtccgagcttgcgttaaaagtggaggatttgtagtgactcctgttaacaaaggaacacagtccgttgtgaggcacatgcttgctgtagattggaagttttggaaattgtatttgcgccccgcatcagcaagatccataaccattcgtatgcttgaacgaattgcagcactaagagagttgtttagaacaaaaggaggaaactactcctctgaacctcttgcaatgacaaaagatatagggttgcctcttggtgtaaaggaggatattaagactgaagtttcacaagagaaaaacaagtttgaggaaccacctcttgttgtcatggaagatgaagtagaaccttctggccgtagaagtttaatggggttgaatgattctgatgagttctttgatgttcctgaaccaacggagtatgatcactttcagaatgagtggcatgctgacttgtcttcagaacagatgagtatgtccatccccagaatgacatcagctgctggtttcgttaaaaaattgcacggccttgcagttcagaaaaaggggtatatggatttgcaagaagctgcaatggaggaaagtacatcatgctcttatggagccactctccaaaaggattcaagttgtgcttcaccctgcacctgggctgcttctgatccatctttgtttttggttcgaggagaaaattatttacaagaccatcagaaggtgaaggcaaatggcaccttgacgcaaatggttggtgcagattggcttcgttctgacacaagagaagataacttgagtagtcgtcctggttccatagttcagcaatatgcagcaaaaggtggtccagaattcttttttgttatcaacatgcaaatgcccggaagtcctatgtattcccttgcactctattacatgttgaaaactcctttggaagacaatcccttgttgcagagctttgtggatggagatgatgcttataggaactcaagatttaagctgataccatatatatctaagggatcatggatagtaaagcaaagtgttggaaagaaagcatgtttggtgggacaagcgctagaaatgctttatatccgtgggaagaactatctagagattgatatcgacgttggatcttcaaccgtggcaagaggggtggctagcctagttcttggatacctgaacaatctggtggtagaaatggcatttttggtacagggtagcacaccagatgagctcccagaagttctccttggaacatgtagactaaatcatatggatgcatccaaagcatttctggagttttctgctggggctggtcaatttgcaaaagcacttgttcctcactttcctctctag

SEQ ID NO: 77923 - DNA, 148 bp, Glycine max
  Peptide Sequence Number=SeqID_169608
gcaggcgcaaggcgaaacaccacaacagcctggggatggccaacaacaggcaacaaatgcaccgccgccacctccagagccccttagctcatccacaaaatggcgtccagctcaagacgttaaagaagcgctactaggaggcaaccta

SEQ ID NO: 77924 - DNA, 546 bp, Glycine max
  Peptide Sequence Number=SeqID_169609
atggccacaatggtggaggccatgatgatcatgaagaagataatggaagccaatacgattgcagttgccgctaccagcgctgttgctaaggtgaacccgatgctcccatctgatctcaaaccaaatgaatcatccaacctcagatatggtgggcaaagatttgggaagtatagacggccccatgatgtgcaaattcaaaataagcacgccttcccaccatatggctcgcctcccaaggaggatgtcaataactccgctcccatactcattgaaagccaacaacctcaatctgaccatgcacatgtctctcaacccatgggggaaacacatggaatgccccaccaaaatctagccaacttcgagccttgcctcggatatgccactgaagggttagcagttggtaggtatactcctgcaaaacattttggagggccctcagtatcacccacaaccacaccccttgcattccacaccgggttaaaaccctcatgctatggcagaaatgggaaagtaagatcatctagaggaaaggctcaggtctattga

SEQ ID NO: 77925 - DNA, 436 bp, Glycine max
  Peptide Sequence Number=SeqID_169610
tgctaaagttgatgtctcgctaagcgagctaaatgcgcttagcgagtgtcatccgctaagcgaggcatcaacgcgcttagcggataggaggaatctagaagggaatctatcacgcaggcacgcgctcagcgcatcatcagctcactcagtgagtcgtttgtcacctttcaggcttagcgcgagtttggcgctgagcgaaaattcacttactcgggctaagcgcgacgtcgagatttgtgagtttttgagtgattgcaagattcctagaggtggaggagacatccccactcctttgattaggttaccgtatgtccggacacagagtgatgaaatcctccctaggaagggaccagtcactagagccatgagcaagaggctccaagaggattgggttagagctgctgaagaaggccctagggttctgatgaacctcagg

SEQ ID NO: 77926 - DNA, 240 bp, Glycine max
  Peptide Sequence Number=SeqID_169611
atgacaacaacatatacctccgaaccctacactggggcaatgacaggcaccatgcatgagcttcaagcgaacctaggggcagacaagaagtcctcactcgataggttgaaaacccaaaagggtggcctaggcaaaaaaagagcaatgcaaacaagacatgcacgaggtttaccaagctctaggttgggcaacgatgatgtaaaaaaaaaggtagaaagaaaatccgccaaatgtgagtga

SEQ ID NO: 77927 - DNA, 490 bp, Glycine max
  Peptide Sequence Number=SeqID_169612
ttaccttcacttcagaggaccacacgtcctcaccttgagaggactacacgtcctcaccattagagggctgcacgccctcacctccagaggactacacgtcctcaccttcagagggctacacgccctcgccatcagaggactgcatgtcctcaccttcgtagggctacacaccctcacctttagaggaccacacgtcctcaccttcagagagctacacgccctcgccatcagaggactccatatcctcaccttcgtagggctacacgccctaacctttagaggactacacgtcctcgccaacagagggctgcacgccctcaccttgagaggactacaggtcctcgccttgagaggactacacgtcctcaccatcagagggctgcacgccttcacctccagaggactacacgtcctcgccttgggtactagttaccctcacctccagaggactacacgtcctcgccttgggtactatcgccctcacctttag

SEQ ID NO: 77928 - DNA, 354 bp, Glycine max
  Peptide Sequence Number=SeqID_169613
atgcccttttgcgagcgagcgaggcgaggctcacgggtgcgctttccaaaggaggaaagatgcgcggagtcgccaccaacgcttatttgtggaaaacgtcggaaaaaccgaaggaaaccagtcaaaacaaaaattctaagttcgggagttgtatttacgtttgaggaaggtattagcacctctcacgtcaacaaaagcggggctcttgctcctatgtatcctccattgaagaggaaatcagacctatgtagttctttcttaagggcgaatcaagcgattctttttacttggaaggtggtcattttaaggcgttggaccttaaaaatgatccatttacttggtaagaaaaactga

SEQ ID NO: 77929 - DNA, 378 bp, Glycine max
  Peptide Sequence Number=SeqID_169614
gattcctgaacacaagggatgggttgtccctgtgtggttcagactttgtaatggattttacaaagatagtggaaatctcaagtgggttgcttgagtactggacgccacaaggtccaacacacgtggcatttgagttgtaccacttggggtatggtgactggaagaccttctcgggtatggccaccacaaaatggttttccaataatgagggccataactcggaatacgccatgggaataggagagaactcgtctctcggggggcgtcgtgtattgtatagctcgcgccaggagtcgtattattggctggccggggtccttctacttgagttgggagggaacttccggctcagatcgaaaagttcgggtggttgtgtcg

SEQ ID NO: 77930 - DNA, 1007 bp, Glycine max
  Peptide Sequence Number=SeqID_169615
acataaccgctgatgaacgcgccgagcgcggagccaaaggtgagcgcagaggtcaccagcccttcggtaaatggcgtgagatcgagaccgccctgcgcggcgggcagcgtcatgtagggcagcgcgccggaaataatgccggctgccgccatcatctgattgagactgcgaagaattttgcttgctatcgtccatgggtgattcaagacctggtcaatgacgggataaaaaggaggtttgagtatagtcagaaacgagaaagtgtgaggctggtcacgattcttaccggatggcgactgaataaaattctgcaccgccctgactgctcagcgcaggtttgcgccgcagccgcgccctcgcactgcgttcaaaccctggctggcctgctgcaatcccgcccccgacagggggaaaattttctgctaatgtacgctggctggttaatgagaaacacgctaaggcgtaacgcagaaaggcagctttttcgcgagcgcggcttcaacaatgtttcaacccgcgatctgaccaatacgctgggcatatcccgcagccatatctaccactatttcaaaaactgggatgcgctgaggctggactcgattgctttcatgctggatgaggacgttgccgctttctctgtagagagcgaaaagagggatgattcacagcatgacaccttttttcgtgcgctggtggattatctcctgccagacggaccggcttctcactggttgatctacctcgagttgtggccgctggcggcaagggataagcaatttgagcagctgctgctctccagcacgcagacgtggacggcgatcatccgtcagggcttatccggccaggcatttagccacctcagcgaagcaggtaaagacgaggtggcgcgtaatcttcacgccctgattgacggttactcaagcgcgcttattcttaactactctgcggataagcggacacatttttttcttgagataatggccgccttgcagaaactttgtcgctag

SEQ ID NO: 77931 - DNA, 1365 bp, Glycine max
  Peptide Sequence Number=SeqID_169616
cgtaacctgcaacggatgcaacagaaagccgatgccgccggcgtcgcgctgcgtccccatattaaaacccataaaagcgtctggatcgctgaacagcagcgccagctgggtgcgcgcggcattaccgtgtcgaaaccgagcgaaggcgtggcttttgtgctcggcggggcacgcgatgtgctgctggcctatcccgtggtgcacgccgccgcgctgaccgaactgctgcagctggcggcacagcatcaggcacgcattacctgcatcgcagattgcgcggcgggcgtgagcgccattgccgccgcccatcagcagcagccggactgcgcgctggcgatcgccattaaagtggatgtgggtctgcatcgcgttggcgtcgatccgcatagcgatagcgcgctgacgctggcgcagcagattgtcgccagcggattgcccttcgccgggctgatctcgcatgcgggtcatgcgtacgctgcgggtcatgccacggcgatagctgaggtggcgcagcaggagatcgcgctgatgcgtgacctgcaacggcggctgctggatgccggctttgttccttgtcccatctcggttggctccacgcccacggcgctggcggcaccggtagccgctggcagcgatgaaattcgtcccggcaattatgccctgctggatctcactgcctggcgtctgggcttgtgtgaggcggatgcgctggcgttaacggtcgtgacgcgcgtggtggccgttaatccttattacgccatcattgatgccggctccaaaatgctgagctcggacaaaggcccgcacggcaccaatgccagcggtttcggcatcgcggtggacgagcatggccatcagtatgaagtgcagaagttgtcggaagagcacggctttttaacctatggcgaacatgcgcctgcggttggtgccctgctgcgcatcttccctaatcacagctgcgcggtggtggcgcaatccgatcgcttcgtgctgcgtcaggccgacggcagcgccggactgcatgacattcaggggcgtggccgcgatgtttcaggtttaatttgtcgtttacctgccccgcggaggctccatgctgccatctcagacagtgacgctcaccattcccccacgctgacgcaggaaggccagtactggaaagcgaaaggcccggaaggcacagtgaagattcgtttcactccctataacccgtttggcgtgatggatcactggattgacaccggcagcggtaaagagatttatatgccgatgcgggtcattgccaacgagcagggtgccgaagtcgtcatggtggtttatcgccagccgctgatgtctgacgagaagttcgccggggatgttgcctgg

SEQ ID NO: 77932 - DNA, 299 bp, Glycine max
  Peptide Sequence Number=SeqID_169617
aactagtggatcccccgggctgcaggaattcgatttttgtcgaccaccccacctttgctatcatgacccaagagtctggtagcaggcagagacaccttctggttatccgcacctcgtcattcggagaccccgagttcgattggcaagcagaggccaatgtggtcatctgcgccctttctggagatgtcagcatctcccggtctgagttcctcatcataaatggaggatacgtaggagcaaaagccccgcttttgttgaccacccttccttttgttatcatgacccgtgaagtcaagtga

SEQ ID NO: 77933 - DNA, 1252 bp, Glycine max
  Peptide Sequence Number=SeqID_169618
atgagaaacaaccgtcaaagatcctccaacctgtcgtctgccgccaaggcagcgcagattcccagaaccgccattattgaatccctggaccaggaaggccgtggtgtcacacatgtggatggcaaagtgatttttatcgaaggggcattgcctttcgaagaagtcaaatttgtctctcaccatgttaaatcgacctatgaactggcaaccacggtagaggtgatcaaagcatccagccagcgcgtgacgccaggctgcgcctattttgggacctgtggtggttgtgccatgcagcatctggagttttctgcgcaagtggctgccaagcagcgcatgctggaagatgatttatggcatatcggccgtgtgcgcccggaaaaaattctgccacctattcaaggcacgccatggcactaccgccataaagcgcgcttacgtgtacgatatgtcgagaaaaaaggtggcgtgctggttggttttaatgaaaagggcagcagttttgtcacttttatggatagttgcgaggtgttgacgaagccggtctctgacctcatcgtaccgctgaaacagttgatcggtcagctatccatcaaacagtcattgccgcagattgaactggccgtgggtgaagatgccacagtgttagttttccgtattctggaggcgctgaccgaggccgatattgccttgatgcaaacgtttgaagagacgtatggtgcgcaggtttggacgcaaaccaaaggcccagataccgtcaagcctctatttgagcatggcgacaagctgcactatagcctgccggaatacaatctggagtatcccttcagcccgaccgagtttacccaggtcaacccggccattaaccgtgtcatgatccgccgcgccatgcagttgttagagccaaaagccggcgaacgcattgccgatttcttctgtggactaggcaattttacgctgccaattgcgtgtagtggtgccagcgtgtatggggtggaaggttctcaggcgttggtgaaacgtgccatagaaaatgccggtttaaatggtgtggaaaacgttgagttcgccgagtctgacctgtttgatatgacggcagaatctttgcagtcgctgggtgcttttgacaagtggttggtggacccgccgcgcgacggcgcgattgaactgattaaagccttgccggatgccggagacccagcgtcgggacatgcgccatcgcgtatcgtctatgtctctgtaatccgtctacgct

SEQ ID NO: 77934 - DNA, 1158 bp, Glycine max
  Peptide Sequence Number=SeqID_169619
atgccggtcattagcattgcctggtggcttgcgccggcagcagccacacccatcagcaggctggcggtggagatgatgccatcgtttgcgcctaacactgcggcgcgtaaccagccgctgcgttgtaaaaacctgcgagtgagttacatcaaatctccgtctacaacaggcaaatcgcttagaataacggttatgcatattgaaatttccattcctgcgcaaacgctgaccttgtttgatgacaatggcggacaagtgacacggtatgccgtatccacggccgctaatggggcaggctgcgtcaagaacagtggctgcacgccactgggtgcacacatcattcgtgccaaaattggtgctggggctgctgaaaatacggtgtttgtcgggcgccgtccaaccggggaaacttttacgcaggatttaaaggtgcaattcccggagcgcgactggattttaacccgcattctttggttgagcggtaccgagccagcctctgggcttctggctactagtggtcattgcttggtcatgtggtgggattttggaacccacaccggattgacctcaatgccattctggcaatggcctagccagcagcactggttagggacagatgatttgggtctcttttatggtgacgctggtgtgagtgaccatgacggttgggctaagtatcgggctgggcatgctgcggcgattgcttttgccgcggtgctgggcgccggaattaataacctgattcttgcattgtgcctcactggctgggtgacctatgccagattgtcccgtggccagtcattggccttgcgccagcgcctgcatgtgctagccgctgagtcacttggggcaggcagtgtgcgggtcatgttgttgcatatcctgcctttactgatttccatcctgctggtcgaggctgcgtacagcatggcgagtgtgatgattgccgaagcctcactctcgtttcttggcctgggcatacaagcgccgaatgcttcatggggcgccatgttacgcgatgccgtgcgctttatgctggtggcgccacattatgtgctcactgtgggtgtatgcatgatgagtttgatcctcgccatcaacctggggggagatgtgttacgtgacaagctggatgtgcgtagcgaaaggcaggtatga

SEQ ID NO: 77935 - DNA, 114 bp, Glycine max
  Peptide Sequence Number=SeqID_169620
atggctattgcaaaaattgagaaccgttattacaatgatcctttgacgaaaggattagctagagacaaagtccataacacttctaaaagaatgagactattgcccttactgtga

SEQ ID NO: 77936 - DNA, 1101 bp, Glycine max
  Peptide Sequence Number=SeqID_169621
atgctgatcggcattccggattacgacaactacgtcacccatatgcaaaccaaccatccggatcagccgtacatgacttatgaagaattcttccgcgaacgccagcaggcccgctacggcggcgacggcaaaggcggcgcaataatggcaccgattgcagtcaccctattaaccggttttctcggcgcaggaaaaaccaccctgttgcgccacatccttaatgagcagcacggtttcaaaatcgccgtgattgaaaatgaatttggcgaagtttccgttgacgatcaattgatcggcgaccgcgccacgcagattaaaaccctgaccaacggctgtatttgctgcacgcgctccaacgaactggaagatgccctgctcgatctgctcgacagccgcgatcgcggcgagattgccttcgaccgactggtgattgaatgcaccggcatggccgacccagggccgattattcagacctttttctcccacgaggtgctttgcgaacgctatctgctggacggcgtgattgccctggtcgacgccgtccatgccgaccagcagatggatcagtttaccattgcccagtcgcaggtcggctacgcggaccggattctgttaaccaaaaccgatgtcgccggcgacaccgaaaagctgcgtgaacggctgacgcgcattaacgcgcgggcgccgatttataccgtcatccacggcgatatcgatttaagccagctctttaataccagcggttttatgctggaagagaaggttgtcagcgccacaccgcgctttcattttgtggcagaaaaacagaacgacgtctcgtcgattgtggtcgagctcgactatccggtggatatcagtgaagtttcacgggtgatggaaaacctgctgctctccttcgccgaacaactgatgcgctataaaggcatgctgtggatcgacggcgagccaaatcgcctgctgttccagggcgtgcagcgcctctacagcgccgactgggatcgcccatggggcgatgaaacgccgcacagcacgctggtgtttatcggcattcaactgccggaagaagaaatccgcgccgcgtttgccgggctccgtaaatag

SEQ ID NO: 77937 - DNA, 276 bp, Glycine max
  Peptide Sequence Number=SeqID_169622
atggagtcattgaagatgtttggtgaagatatagtagaggatgctgacattcctctcattcttggctgcccattcatgtctactacaagctgcatggtagacatgggaaagaagatgctgcagatgggcatagaagatcagaagatcagcttcgatttgttccatgaggacaaagatccacctagccaaaatgtctgtctgaaagtgcatgtgatggtggaaaggagacccgagaagaaggtccttgaagtaggaactttgctagatcctggataa

SEQ ID NO: 77938 - DNA, 321 bp, Glycine max
  Peptide Sequence Number=SeqID_169623
atggcatctaagaaaagaaagtcccttgcatcttcatcctctcatatcagatttgacagatcaagattccattctcaggaagcttgggatagatataacaatattgtggtgctgaggaaactactactagagagaaatgtagtagtatattgcactgagtttgatgagttcaaggaggaactcgagagaaggaaatgggatgaggagctgactagttttgctgatggcagcatcgatgttgccattgtgaaggaattttacacaaacctctacgacccggaagacaagtcacctaagcaggtttgcactcctgaggcctaa

SEQ ID NO: 77939 - DNA, 566 bp, Glycine max
  Peptide Sequence Number=SeqID_169624
atgggtgaagtagaggaggtgcaagagcagatgaaggccgacatggaggccatgaaagaacaaatggccacaatgatggaggccatgatgagcttgaagaagataatggaagccaatgcggttaccattgccgctaccagcactgttgctaaggtgaacccgatgcccccatctggcctcaaccaaatgaatcatccaaccttagctatgacacatgaaattccccaccgcaatctagccgacttcgagccttgcctcggatatgccactgaagggcaagcatttggtggtatacccctgcaaaacactttggagggccctcagtatcacccacaactacacctcttgcattccacaacaagtaaaaaccctcatgctatggcagaaatgggaaagttggatcatctaggggaaaagctcagggccattgaaggaggtaaagattatgcctttgctaacctagaagagtacttcctagtacccaatatcatcacccctcctaagttcaaggtgctggactttgacaagtacaaggggactactttccccaagaaccatctaaagat

SEQ ID NO: 77940 - DNA, 510 bp, Glycine max
  Peptide Sequence Number=SeqID_169625
atgaagcacttcactgacaccctcatcagtgccaacataggaacaaaagctggtaccgggccccccctcgaggtcgacggtatcgataagcttgatgcaaaaccaagaacgaatgatacagctaccataagaagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 77941 - DNA, 67 bp, Glycine max
  Peptide Sequence Number=SeqID_169626
gaagaagaagaaggaaagaaagctcctgatcagggatcgaaggaaaacagaagaaatgtgcagaaag

SEQ ID NO: 77942 - DNA, 336 bp, Glycine max
  Peptide Sequence Number=SeqID_169627
atgcctaggcaggcgcagggtgatgcacctcaggccgcagacgcaccgccaccacctcatcaggccgatcccgttggatcactaggcatggagcgttatctacagcacttggttcgccagcaggcggccaaccaccgggggcaggggcagggtttcgctccttttgcatgccctactccagagcagtttggggctgaggtcgcatggcccggagattggcccgaggcccaggcaggggaggagcccgcaggatcccccggtgaggcagaggaggcccgtatggatgaagaaatgacagacttgcttggtttcttgggaggaagcatagccacatga

SEQ ID NO: 77943 - DNA, 842 bp, Glycine max
  Peptide Sequence Number=SeqID_169628
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcctcgcgctcagctgcttcacgctctgcagcccacgagcggcgacttcctcagcttcacgctcagcggcttcacgtgcggccgcttcctcagcctcacgcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 77944 - DNA, 351 bp, Glycine max
  Peptide Sequence Number=SeqID_169629
atggaatgccccagggctcctccacgatatgcacatgttgtgttcgattcgtatcctcagaaaaatggaggtttgagggaacctagcaggggttatggctaccattgcattatcaagtggtgtttagcattggttgtgtggaaggtgggttttattgtcgatttagggatggcctttgtggataactgggcggtgggtaaggagaaggtttgttattggctgagtaatgacattgttgggttggtgggaaatttggctgtattggaatgggagtcacagcccgggcttctccttcatcctcaccctcttcatttgccccagttttctcattcatccaagcaggatgactaa

SEQ ID NO: 77945 - DNA, 953 bp, Glycine max
  Peptide Sequence Number=SeqID_169630
atggctacttcacctgtgtcgcctcctccccctcctccttcttcttctcctcctcctcctcctccttcacaagcatcaacatctccgtctaccgtcgacgtcacatatgagacctggaaggaagtccctattgctcaaaaggatttgatatgggaggatattcaggcggaattagaaatccctgaagcttctgacaataggacggacagtgtggctgacactgtctgtgaaaaatacggcattagcaaggataaatggagccagttttgtaagacacgcagagacccttcttgggaggatgtgcgaaaaaaggcacaggccatccagaagcaaaacactgccctccacgtgttgtcttgtgggggttatgaatatttagaagaaaaactcataagtgagaaaacaaaaaagaaactggaggaagttgctagaggcaaggatgtcgtcatcgacccttcttctcccatcagacaccacgtgaagtggaagatggcccgcacgaagaaaactgggcagatgacgtctgagtcagcaaaggaaatcgctcaaaagattataagtcattttcaattaacaattgcaactatcattgtttattatgtgaatgccttcaacaaatatatgtcttttgtacaggattctttggaggagcaggcgtcacaaggatcgttcgtccctcatggacgtcaggatgtcctgactgctgccattggacctagagcaactgacccaacaaatcagggaccagccggaggagtcgatcacaaaaaagtgactcagcagctcttggcatccttcagccagatgcagtcccagcttcaatcacatatgcaatcacagggacttgtactgcctccaaagcctgaggttggtccctcaaggcctcatgtcagcacaaagagaagttatgttgatccctcagggaacgatcctaagacgggtgactcagacaa

SEQ ID NO: 77946 - DNA, 627 bp, Glycine max
  Peptide Sequence Number=SeqID_169631
atgccatatccacgtcgtataattcctcttaattccatcacacaacagatgctcccgtgtggccctatcccattcaagaagaccgtcttttatggtagcttcatacgtcaggaaagattcccagacagagaaatagccgctacaatcactgaattgatatatggtttacagaaaagtgacaccctattagcattagcttgcaagaaactcacagcatctccaaaagataggttatatgatttggaaggaaaaggcgttgaattagttccagtggttagaactgtggacaagggtcatcatttggccagtgttcaaccatgggttgttagggatgtttcagatttacttttcagaaaatccatgaggctgaagttagagcattctttgatgtgttacaaggtggatttcaaggataacaagccagtggacctagagaaatacactttcagcctaacaggaaggaagcctattagtttggaagagaaaaggaagcttggtgaagggtatattccactgctgcaaacctctatactagagaaaatggagacacttacatcacatttttgtgaaacactattggaactttatgttagtaaccccaagctattcatcattacgacgaaatga

SEQ ID NO: 77947 - DNA, 468 bp, Glycine max
  Peptide Sequence Number=SeqID_169632
atgggcgatggacttcgattgcaacgcgaagcaaatcaaagagtccatagcgctgccattaggctcgaacctaaactcgagattcctggttatggttgcgaagaccacttcttagagctcaacacagttaaccattcgtatgagggaaacgaaaattggtcttggtcttggcaccgtgaaactcacgtgcagcggtgtcgtatgcgcgagcaacttcctcggcggtgtcaaagcggcgacgagtttggggagggaggtggagatgacggtgagggtgacggagagtttgagaaagtcgaagtggttgttgtttgggattttgtcgtcatcgtcgggttttggggtttgaattcgaaaaagaggaaggaagaaaaagaaggaagcaatgtgaagccatggaatgttgagtgttgttacattctcattttcaaatataggtttgttggtgcaaccattactgatggatga

SEQ ID NO: 77948 - DNA, 438 bp, Glycine max
  Peptide Sequence Number=SeqID_169633
atggctaggttttcacatggtctcaatagggagatccaagacattgtagagttgcaccactatgcctctttggaggatctcattcatcaagctatcaagtgtttgagaaatggtcacattgcctcccaatgtcttgataaaaggactatggttgtgttgggtaatggggatattactagtgcatcttcttctagctcttctagttcttctagtgatagtgggagtgaatgtgatgtagagtctctggaaggtgatcttttgatggttaggaggttaatggggagtgtgtgtaaggatagagatgaaagtcaaagggagaacaattttcacactaggctagccatcttttacttggaaggtcttggcagtttgtcataccctaatttcgtccggggactattgtttgatggcatgcaacctttggttgaccgcttcgag

SEQ ID NO: 77949 - DNA, 436 bp, Glycine max
  Peptide Sequence Number=SeqID_169634
atgcaaagtaaatcttctgcaggtgatttagttccactggatttggaaattgaagccacttgtagaagaaacaacacagaaagaagaaggaaaatactaaaggacattacaacatcaccaattcttgaggaacctcaatcatccgagtcatcttctatctttctacagacaagggaatctgaaatagggtcacctgaagccaacataatggttgaagatcaacctagaagagtgacccttgaaaactactctagttttgttgtgctgcaatttttcactagtatagcgtggccagaggttcaagcacataatattacttatcctcattctttaatacaactaatacagggcaatttatttcatggcctaccgaatgaagacccgtatgcacacctagcgacttacattgaaatttgcaatacaatcaagattgcag

SEQ ID NO: 77950 - DNA, 198 bp, Glycine max
  Peptide Sequence Number=SeqID_169635
atgtctcctccacctctagaacctcacagtcactcacagactcatctcatgctctcaagacaacttcctcttcaagctccattctctgcaggtgttgagggaagaagccctaagattcatgaacctctggatttgaggtccaacctttttcaagggggagggaatgctgcaatcctacctcccaagggcattggatag

SEQ ID NO: 77951 - DNA, 234 bp, Glycine max
  Peptide Sequence Number=SeqID_169636
atgagcttagcccagatagccttcggcttagcatgcaactttcaatcaaaaaaattgactaagttacctgggcttagcaaatcagccttgcttagccataggcatctcaataggaggatgagtgttcatcctcaaaagatgaactcgcttagcgcggtaggcatatcaaacatgcaagcgcgcttagcgcaacaaacacatatattcaaacatgcaaacacatatattcaatga

SEQ ID NO: 77952 - DNA, 277 bp, Glycine max
  Peptide Sequence Number=SeqID_169637
atggggaaggaggttctgaaagcccaagtggagaaggacaaagcccccgagtggagaaggatgaaggcccaagtggaaaaggatgaaggcccagagacttatcaaggtaatccttgtggcgtctaccctgacttatcttccttcaccggaagtggcatctaccctgacttatcttccttcactggaagtggcgtcatccaaatctccgtagcctgtatcaagcaatccgctcctagtaaggatcacatcataagtacggccataccagcgctaagcg

SEQ ID NO: 77953 - DNA, 192 bp, Glycine max
  Peptide Sequence Number=SeqID_169638
atggacgaggttcacgttgaagaaattcaatctatcagcatcgtacagggtggactccaacaatgttgttggcaggatgacattaccactgttccattccacagcagaggagtcacaggaaaattttggcgttttccttggcatttatccaacaaattgttttctctggtcttgaccgtgttgattgagtaa

SEQ ID NO: 77954 - DNA, 681 bp, Glycine max
  Peptide Sequence Number=SeqID_169639
atgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccccagtcggctttatttgaaagaaaaacaagaaaaccggcacactaggtcgaatgttgaagaaagggcacagaatttcaaaggctctcaccattgcccaactatttgggtggagctgagaaggagacacattcaactgctcaagcagagcacactagaaagcggtcaaggggagaatgagacccaggacctcaaacaaacacctatacataaagaagaaaggcggactaccaaacaccgccctcaagaacgagaagtcgcaagcctgaacgactatcttgcaggagccctcaaggcttgctag

SEQ ID NO: 77955 - DNA, 354 bp, Glycine max
  Peptide Sequence Number=SeqID_169640
atgaagacattgtggaagacgcaataccttgaagaattgaagaaagtgaaggaagaagaagagggattgcaagcggaaggcaaggaagcaagagcctacatggcacattcaaagacaaatttagtgtctcgtgaagtttcaaatattcatttatccctcccgtcttgtttggctcttcctacaactagccaagatctaaaccccaatctctctatcttctgggaagcgcccccgatagtggggaaggccacttgtggtggagtattgagggatcactctgaaactgttgtttttgccttttctaacagtactcggacttgctctatcaagcttgctgagttgtgggctatatag

SEQ ID NO: 77956 - DNA, 480 bp, Glycine max
  Peptide Sequence Number=SeqID_169641
atgcaatgtcaatgcacacaattgagggcattccctgtaccgcctgtacgctcgtttttttcaaaattggatctccgtgatatagcgtacgagatcatcgttgaggcttgtcggagtttgggatcaaagcaattgacgttcgcagcgagggagattgggagtgtgcgtcagtgtcggcattgtattgtggtagctgacttcgacggcagtgaacaagatgaagacgggggtggaggaattagaagagcaaccagtgcggggaggcccctgcaacaccaagggaagcgcgacgacattgaggagaaagggggaagggaaaagaagaagggggagggatcatggaaggttggtggcgaagaagaggagggggttgtggtggttgggggaggaggagaagaggaaagatatgtgaagggggagaggggaaagagaaaagagaaaagtgaagggggaatgggaagagttttgtgtgtgctttga

SEQ ID NO: 77957 - DNA, 249 bp, Glycine max
  Peptide Sequence Number=SeqID_169642
atggcgtctatcctgacttatcttccttcaccgggaagtggcgtctaccctgacttatcttccttcaccgaaagtggcgtcatccaaatctctaaactggccaaatacaggctaatggcccaagtggagaaggccaaaagcccaagtggagaaggacaaagcccccgagtggagaaggatgaaggcacaagtggagaaggaagaaggcccagaggcagagacactatcaagactattaattgttgttga

SEQ ID NO: 77958 - DNA, 390 bp, Glycine max
  Peptide Sequence Number=SeqID_169643
atgatttttacaaggttgaaagaaatctcaaggaccgcaggtcgcttagggactggagagcgatttccgaatctaaagcatgattcgaatgaccctacaacaaaagttgatgagaagatggacctctttgttcacaacaaacttgaagagaagaagaaaaccaagcttttgaagtcaaatttcatagaagaatataatgatgctgcaaacaaaaaatggactaagaaggctgtacgcattgttgtttcaaatgatataatttctgttaagcaaggagatgcaaatgcttgtctacttgacggtgatgctccatacatgggagaccaagaccgaagtttgaaagaaaaatctgaaggaggggtgttgatagttgacatttttctaacataa

SEQ ID NO: 77959 - DNA, 255 bp, Glycine max
  Peptide Sequence Number=SeqID_169644
atggctcctaccatggtaggagttggaaagggtcatgaccaagtcagaaagtgtcgtaatgcaatagctgtcgaaaaatttaaaatcagggatgctactaatggtatcagagcaaatatctctccggtacagtgtggttcgaagatgaatcgggtagaagttggtggacatgtaacaccccgatcgaatcacgctagaatgagagagatccagaggttatacaggtatgaaactgtgcaattgataatgacttaa

SEQ ID NO: 77960 - DNA, 681 bp, Glycine max
  Peptide Sequence Number=SeqID_169645
atggctacaccacccagctctcctcctcctactggtgcagcatcacaatcgccatctaccttgaagcgaacaagaaaagccacacggttaagatcattggcgactagaccagttggggccaagagaccactggtccatgtcgatcctgcaaccgggaaggtcaacggtccctacaacaagaagttaagaacatatttggggatcgtcacttgtgataaggttgatgtgacatacaagaattggaaccaagtccctactgctcagaaggatttgatatgggaggatattcagactgaatttgatatccttgaagcatctgatctaagaacaaaaaagaaaatacttcagactatgggagagcggtggagacaattcaagtctgatttgatgttgaaatgggcacttgtagccgacaaggaaagtgtcaacaacactgtatgcgaaaagtacgacattagcaaggacaagtgggcccaattttgtcaaacccgcagagacccattgtgggaggcacaggccatcaaaaagcaaaacacagcccctcacgtgttgtctcatgggggttatgaatatttagaaaagaagttaatggatgagaagagaaagaaaaaactggaggaagcttctcaatccggaagcactggcaccgtgattgatcctccatctcccattagacgacat

SEQ ID NO: 77961 - DNA, 438 bp, Glycine max
  Peptide Sequence Number=SeqID_169646
atggctgattttatgaccttgatcagaagattgaactcaaattacataagactaaggtgttttgacctttataaactgcactcatgggttggagggttaacagagtttggagatggaagaaatcagcagagtactagtgaagctgttaatgcatattatgctgctaccttgatgggtttggcttatggtcacatgcatcttcttgctattggatcaacactcacaacattggaaattctaagtggaacaaatgtggtggcatatgaaagagggagtgcattatgtgcaactgcaaagtatgaaacactgactaaagttatattggctgtcaagaaagctgaactaccaaatcttgacagtacaaaccaggtagcaatagccattggtttcattgtctatgaaacaaaatcctacacctggaacgggagatggatttag

SEQ ID NO: 77962 - DNA, 675 bp, Glycine max
  Peptide Sequence Number=SeqID_169647
atgactgcgttggctgtttcagtgtgttctgggttaggtgcacatgctgttatatggggcaagatacctggttggacaactcgagattataaatgtcatttcacatgcctaccgcgacctccctgtgccctcattgacgcctaccacgacaacctttccctgattccctcacctctccacaaactcttccgacaaccactcttcattgaacttcaagtttatgtcaaacccgatcgacaacctcaaaaccttaacaaaactctttccacaaccctccaattacatcatctgcaaagtaaagattatgttcatcaatctaaagcacacgagcaacaacgatttgagggtttcgtgttgagctattttgtacaaagcctcaggttgatctcattgccattttcgtctccccatcgcaagcgctaccacactcagatccaatgcgctcgctccctccccattttgggattcaactcctcgtgggttcatttctacaagatcgcacctatgctagagaaggggcttgcaaaaagaagggggagaaggaaagaaggaggtttggtgggtgacaatggtgcttgtggtgaggagccaacagaaatcaccccggacagtgatgtgcaagatagcgtcgaggttcacaaggaagagaattggatgaggaatgatagggtgtga

SEQ ID NO: 77963 - DNA, 57 bp, Glycine max
  Peptide Sequence Number=SeqID_169648
ttgtcattcttggattgtttgctgttctcggccaagaacatagcgcaagtgcagcca

SEQ ID NO: 77964 - DNA, 198 bp, Glycine max
  Peptide Sequence Number=SeqID_169649
atggcgagttcgctgcgcaacgcccacgtagcagggaaaccgccattcgtgttggcgagacgtgcagacttgctttgcagtgcaggtttgctttttcaggccgtagacacgtttttcagcagtgagacttgctttttcagagaaaggggagttgcaattgccattggcgagttaagggcaagttgcaactgccattag

SEQ ID NO: 77965 - DNA, 96 bp, Glycine max
  Peptide Sequence Number=SeqID_169650
atggttggttgtagagaaaaggttgttggttgtagagaaaaggtattgtattgtcatcatcaaaaagggggagattgtagatgcaattgcttttga

SEQ ID NO: 77966 - DNA, 846 bp, Glycine max
  Peptide Sequence Number=SeqID_169651
atgcaatcacaaggacttgcactacctccggagcctgaggttggtccctcagctgctcgtgtcagcacaaaggaaagttgtgttgatcccttagggaaagatcgagacacgggtgactcagacaaatgtgggttgtacatcgaagaaaatcctccccgcctggttgccctaggaagagtttatgagggatccacaatcgttcacaacatccttttattgcatgatcaagtgaaggtcgatgttgaggaggttaaagatgcagatgctcccattcctgtacccattgatgagggagttgtgggaccagcaaaacttgcagataagccggatcatgaggttatgtgggatgctaccgtgttcgggttgtttaatcaagacttccccttgtacataaagcatgaagatctgtctgaaatagcacatgatgcggggaattccgatgtgtatggattcctcgagccacattccatccagagatctgggcaatcgcaatttgaatcgaaaagttacatgaagaattggatgcaaaattcaaaacgggatgtctacctaggagcttacctgaatgggccaaacaactaccttaaaggaataattaacaggccagtgttgttttccaatacatttgcattagcattactcagcaacatcaatattgtaatgttccttgtattcaacagtgctttgaaagaacttgacgatactccacaacctaactccgaggttggggataggtggattgttgttaaatattttgatgatgttagaccattggaagcagagagattgaaggcgcttcgcatccaatgggcacagtattatctcaaagttagaaatcaaacttag

SEQ ID NO: 77967 - DNA, 132 bp, Glycine max
  Peptide Sequence Number=SeqID_169652
atgacgtctattaggaaatgttcgattggcgtcatccggctaaaggcccaagtggagaaggacgaagacccaagtggagaaggacaaagcccccaagtggagaaggatgaaggcccaagtggagaaggatga

SEQ ID NO: 77968 - DNA, 329 bp, Glycine max
  Peptide Sequence Number=SeqID_169653
atggctcatgagcatgaactggatcccacgaatgtgagaaatgggagaggagggaatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 77969 - DNA, 198 bp, Glycine max
  Peptide Sequence Number=SeqID_169654
atgattatgaggagtcaagacttttatagtagtcaagaagagactacttcttctccttcctctggtggaaatgaagatgaagcaaggggtgaagagtctagtgaggaagtctacccccatgaagaaggtgacctcctaatgcacaagattagtttccaagttgaacctcattatcagtccccacccaaaaccttataa

SEQ ID NO: 77970 - DNA, 316 bp, Glycine max
  Peptide Sequence Number=SeqID_169655
atgggtcagctccagcaacaagcgtttcacaaagcttacggtaaaatctgggacctagccatggcagaagtctccacagtggccattgcctccctcacccagtattatgatcagcccgttgagatgcttcacctttggggacttccagctatcacccatgatagtccaaatctcggcacaggaattagactgcggaaagcaagtcgaaaatggggcggttggaatactgagaaaatgtttggaggccactgggcctcgttcatagacattctcacactgttgatcttcggaggagtcctctttccgaatgtggatg

SEQ ID NO: 77971 - DNA, 875 bp, Glycine max
  Peptide Sequence Number=SeqID_169656
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatataaatccatgcatctatggcctactgattttcagcaaagtgccaagactgttcagtggggaaagaacagctggatagctacatacaaaagaatgaagttggtctatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 77972 - DNA, 354 bp, Glycine max
  Peptide Sequence Number=SeqID_169657
atgggtgccaagcacctcacaaggaccaaagaaaggtcgcatgtcatcaagcaaaggtccccggacgaaattaggatattgtctggtccaaagacctttctgcatatttcttctattttcttccaatctttgatcaggaattttctttctttttcctttctctcaatctttgattgggaattttctctttgttttcttccgagagcaaggattgacattcgcaccctaggtcaaggtttatgggataaaggggatgtcccacattatttccatgacacaaaggcaacaatgatgatttggaaattttatgcaaaactagtcatgcatgcacctatggggacactcaagtgttga

SEQ ID NO: 77973 - DNA, 456 bp, Glycine max
  Peptide Sequence Number=SeqID_169658
atggcagaatcgtcgaagaagcgaaagggatcatcctccaccaccgctgttgctagccatcgccaccacggaccatctgaagcacccacaacacctattcatccttccttatcatctctaagatcatccactctgttttcttcagatgatcaacgtctacggtacctttctcaattttcttctaggatcattctagaccctaagtacctagacatagatttcttgaatgatgagacatttgactgttatcaagtgtttcaaaactccggattgattgatttcacgtctttaaaattgccttactatcctgaacttgttaaagttttttactgcaatttaaaaattcaggatggtattatttcttctgaggtgcatgccagtcaaggtgcaccttttgagggcaccattgttgatgactgtaaattcgattattctagtcatgatgctcgccgtatg

SEQ ID NO: 77974 - DNA, 603 bp, Glycine max
  Peptide Sequence Number=SeqID_169659
atgacattgaccatcccagagcttttcgtgaggccttatcaggttacatgggatagcaccgtgtttagggactttcatccatatttcccgctctacataaagctcgaagacctcttcaaaattgcacacggtggtcaatgtctcagcatatcagtgttacagttgtggattctgtatctcactgaaacaagtatgcgagcagggaattataatatctatggattcctcgagccacagtcccttcagaggtgtgggcaattgcgggttgagtctgaaagttacataaagagttggatgcagagttcaaaacgcgaagtctatcttggatccttcctaaatggtgctttaaaaggtcttgatgatgctccacagcctaaatcaaaggctcctactaggtggattgtcgtcaagtgtaatagacaaaaaggaagtactgagtgcagctactatgtcatgcactggatgtccaccatcattttaggaagttttaggaataactgggaagcgtattttaacgatcctagaccattggacccaaagagattaaaggcattgtggatccagtgggcacagtattatctccgagttagagatcagacttag

SEQ ID NO: 77975 - DNA, 234 bp, Glycine max
  Peptide Sequence Number=SeqID_169660
atggcgaatcaagaggagtgggtcccgtttatggatgtattagcattgctaatctttggggttgtcctctttccaaacgtggatggtttggtggacctagccgcaattgatgctttccttgcatatcaccatagcaaagagagccaggcagaacagtcaattggtttccacgatggaaagaaggaaatgaaggtgttctcttctcatgtggaagctacccaaacatcccgttga

SEQ ID NO: 77976 - DNA, 815 bp, Glycine max
  Peptide Sequence Number=SeqID_169661
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatatgcatctcattgattgtcaattaacgcgggtcaaaactgcaaggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 77977 - DNA, 345 bp, Glycine max
  Peptide Sequence Number=SeqID_169662
atggtgaggtacgcaccttcaatctttgctgatttagttttcacttacgaaaggatcgaagtgggtctgaaaagaggcaaatttaatcatcctgcttggacgaatgagaaaactggggcgaatgaagagggtgagagtgaaggggaaacccatgttgtgactgctattcctatacggccaagtttcccaccaacccaacaatgtcattacaacccttctccttacctaccacccagttatccacaaaggctatacttaaatcaaccacaaaacccaccttccacacaaccaatgctaaacaccacctttagcacgaaccaaaacaccaaggaaggaattttgtag

SEQ ID NO: 77978 - DNA, 264 bp, Glycine max
  Peptide Sequence Number=SeqID_169663
atgaatgaaaaagtaaaggtcaaaagagacaaaaatcttgaggtgctaaagggagcatttgcgctcagctcaccatttgggctcagcgtgcatccaacgctaagcgcagcttcagcgctgcttagcacaataaaagaatttggcagagcatcaatttcaaggttgtgcgctaagcgcgagatccgcttgctaagcgcgatggttgtctttagccaggctcagcgcatgactggcactaagcccaaatccactaactcacgctaa

SEQ ID NO: 77979 - DNA, 441 bp, Glycine max
  Peptide Sequence Number=SeqID_169664
atggcgccaccagcatgtcgaggggccgccctcggccggtccgaccgaacctcgctcgtgggggaatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 77980 - DNA, 471 bp, Glycine max
  Peptide Sequence Number=SeqID_169665
atggcaaagtcatttattgggcatccatatgtgggtcgactgactaaagatgagaagatttttgttgttgatatgacaaagtccatagtgaagccaagaaatattcttttgacgttgaaggagcacaatgccaacaattatacaacaatcaaacaaatttacaatgctagaaatgcttatcgttcttccacaagagggatgaaaagtgtattctcggatgctacgaacttgttatgttggtttcacattggcaagaatgtgaaggcaaagtgcaaaaccctggtgggtcaaaaaaatgcatgggaatatgtgatggaggcttgggggagtttggttgactgtccatgtgagagttattttgatgagtaccttaagaactttgaaatggcttgctctctgtggcctatgtttgccgactatgtgtgcccaacatgggtgattctgcacaaagaaaagattgttaaaacatga

SEQ ID NO: 77981 - DNA, 588 bp, Glycine max
  Peptide Sequence Number=SeqID_169666
atggatatgaatgtggggtacctcatctcccaccagatctcactcatagcacagtatgactcctcgaggcttggctttcctgccctaatcactgctttatgtaaagcccggggagtccactctgattccttgacccatgagagcctaagttctaccattaatttggcttacattaagaagaactattggaatctcaatgatccaacagtaactttcagaggacccaggaaggccagaggaaagagatctgagacctcttccacaacaccattagagataggaggtccttcttcttctacacttcctccctcttcctccaaagagatcccagtgattcctcccgcacccacacagatttcactaccagctcctctctctgcaggtccaacatattttattttcactcctcagatgcttcactccatgttccagagcatccatagagggcagtccatcatcatgcagagccttcagagcttgggcttgccctccattataagcatggaggagtttgacgcacaggtggcctggctaggacaccatctttcttcctctggagggggtggggcctccatagcccacgagctt

SEQ ID NO: 77982 - DNA, 123 bp, Glycine max
  Peptide Sequence Number=SeqID_169667
atgaccacatttaaggttcccaacaagaaattcactatcctaagtccaatagctcttaaggtggttcgtcccttgcttcttgactcaaattcttcaagggatggcatcaatcctcctttctaa

SEQ ID NO: 77983 - DNA, 207 bp, Glycine max
  Peptide Sequence Number=SeqID_169668
atgtcggtgtcggccgaacgacaactacggaaatattcgatcggcgtgatgagaatcatgaaactggccaaatacaggctaaaggcccaagtggagaaggacgaaggcccaagtggagaaggacaaagcccccgagtggagaaggatgaaggcccagaggcagagacactattaagactattaattgttgctgaaggcccaaactaa

SEQ ID NO: 77984 - DNA, 350 bp, Glycine max
  Peptide Sequence Number=SeqID_169669
ctgctaaatccggaagcactgacaccatcattgatcttccatcttctatcaaacgacacgtgaagtggaagatgacccgcaccaagaaaactgacgaaatgacgtttgaggcagcaaagaaaattgatgacaagattgtaagattccttggagggagcatgccttacagggttcctttgtcgcccatggacgacctctcgcacgtcttcgtttatggctcccaaagccctggagcagttgacgcaaaaaatcagggaccagctggaggaggactcacagtgcctcctgagcccgaggttggtccttcaactgctcatgtcaacacaaaggagagttgtgttgatccctaa

SEQ ID NO: 77985 - DNA, 312 bp, Glycine max
  Peptide Sequence Number=SeqID_169670
atgacgttgctgcttagcaacattctccccaaggaccataactcagacttccccctgccgaagtgtcagttagtctatgccatcctaacacaggtgagtgtacatgttgctcagctgatctctaatgctatctaccagtttgcagggattactcctccaagacacccagtggacccgaaaaagtccaacagggccctgggatttcctgctctaattataggtgatatgaatggcagtggaatggagaaggaagagagagaggagacgccacatcaaggagaagatgagtctagaagaagctcaccaccatag

SEQ ID NO: 77986 - DNA, 270 bp, Glycine max
  Peptide Sequence Number=SeqID_169671
atgttgtggaagcttgggaggattgatgtggacctggtgttgagaggaacgaggataagggctacgtgggagtacgtgagctcagttggaggtgggcaacaggggatggtgggtttatacgtgatttgtggatgtggagaattgttttgcaccatcgcccgaccgccacctagtaccacatgtgatggagtggtacctggagatatgtcgcgggggtcaggagaccttggggacgtcaggtggggtgctattgccgaaaaccgagcttga

SEQ ID NO: 77987 - DNA, 177 bp, Glycine max
  Peptide Sequence Number=SeqID_169672
atggagaaaggaactttcacttgtttgattgactatcatctccccttgctcattgagccattaaaatcaatggcagcggaatggagaaggaagaaagatgattggagacgccacttcaaggagaagatgagtcaagaacaagctcactaccataggaagccatggataagagcttga

SEQ ID NO: 77988 - DNA, 145 bp, Glycine max
  Peptide Sequence Number=SeqID_169673
atggcagaatcttccaagaagcgcaagggttcatccacctccgctgtggcacatagaacatcacgtcctggagtcaccggagcttccccagcaccaattccaccatccttgccatcctctacactgttttcatctgatgaacaac

SEQ ID NO: 77989 - DNA, 129 bp, Glycine max
  Peptide Sequence Number=SeqID_169674
atggggtcggaccaagcgccatcttttaaaaaaaggttctatcatgtcaaagtcaagaatccagagctagccagcttgcgaaaactagggcagcggatggatcaagttcaacgtcaagctttcagcaag

SEQ ID NO: 77990 - DNA, 429 bp, Glycine max
  Peptide Sequence Number=SeqID_169675
atgggtaacgaagagggagtgcaagaacaaatgaaggccaacatgtcggctttaaaagatcagatggcttctatgacagaagccatgctaaaaattcaaaaatcaatagaagacaatgctacggcggtcgcttccaacacaactagggaagcgaaaccggtgctacaacccgcaatgaactcgggccgggacagaagcgcgacgagtttcaatcggaggtatagtcctcaagcctacccttatggcttgcctccagacttcactccccgtaccgctccagacgatttgagccaagcccctaccttcgaagggcaactccctcctcatgctgactatcctctgcaggaagatgatgaaggagatgcccatttaggccctttacttcccccaagggaaccggcccccatgagttgccccagccaaacataa

SEQ ID NO: 77991 - DNA, 156 bp, Glycine max
  Peptide Sequence Number=SeqID_169676
atggcagctcatccaaacgtgctattgcttcaacctgaagtaaccttgctcgcccaggcgagctggggacttggatcaaatccttcaagtgaaaattacgagcatgacaagcatgatgagtttgctactataaatgatcttgagtcacataaatga

SEQ ID NO: 77992 - DNA, 300 bp, Glycine max
  Peptide Sequence Number=SeqID_169677
atgcagagccattctgaggtagtcattttgaggttcaagaattctaaagttgattacgtcaacaagactgagtacaagttcaattgttggggtgttaatgttttgtccaaggttagactgagtggcattcttcagtctttcattctgatgtttctcatcaatgcttctcatggacaacttcaattttcaacagatttgcatcttccttatgtgatattcaaagtcaaggtctttatcattctgatgttgactctactagagcttcattttgactttggatgctccccatgtagcctttga

SEQ ID NO: 77993 - DNA, 270 bp, Glycine max
  Peptide Sequence Number=SeqID_169678
atgtctagtcttagatcccttaccttggacagtggtggggctgttcgtgaagccgttgttcgaggcaatgggggagcagaacaagggggtgtaggcgggggcggcggtgtgcatggccaagatggtggagtgtggcggtggcggcggaggaggggaggcggtgctggtggtagcgtttcagaagctgtgtccgaggatctgcaagctgctcaacagtctcgtatccgagttgtattgaagtcgtgtctagccttaggaagccatatctaa

SEQ ID NO: 77994 - DNA, 798 bp, Glycine max
  Peptide Sequence Number=SeqID_169679
atggcattaggtgtttcaaagctccctatgaatatgatcatggaagtattgctgctgatatttctgagctactctgtagcatactcctcatctgcgtttgagtctacaatgcacactaataattgggctgttttggtctgcacgtctcgcttctggtttaattatcggcatatggccaataccctgtcattgtataggacagttaaacggctaggaataccggatgagaggattatactcatgctagcagatgacatggcatgtaatgctagaaacaagtaccctgcccaagtttttaataatgaaaaccatatacttaatctgtatggggataatgttgaggtagactatcgtggctatgaagtgacagtggaaaactttttacgggtacttactggacgtcatgagacatctgttccaaggtccaaacgacttcttagtgatgagggaagtcatattcttctgtatatgacagggcatggaggtgatgagtttttgaagtttcaggattcggaagagcttcaaagtcacgatttagctgatgctgtgaagcaaatgaaagagaagcgcaggaggataatgagtcctccttatgcttatgcattggaagaggaaatcactggaacaaagctaatcgtgtccttgacaaatagactcacgaacaaggactctgatttcttatgcttatgtattggactaagaactcatttttggctcatactcataatgggaattgttaggtttaaggagcttctgataatggtggacacctgccaagcctctactcttttttcccag

SEQ ID NO: 77995 - DNA, 3228 bp, Glycine max
  Peptide Sequence Number=SeqID_169680
atggctcccaaaactgggaaaaccaagccgcacaaggccaagggagagaagaagaaaaaagaagagaaagttttgcctaccgtcatcgagattacagtagaaacaccagacgaatcacaagttaccctcaagggcatctccacggacaggatcctagacgtgagaaagcttttagcggtacacattgagacttgtcactttaccaacttctctttatctcacgaggtgcgaggcacgaggctgaaagacacggtggaaatcgtatccttgaaaccctgccatctgaccatcgtccaagaggactacacggaagagctcgctgtcgcacacattcggcgactccttgacatcgtggcctgcaacacctccttcgcctccgcaaaaccccccgccggcaagtccaaagaccctaccgaacccggttcagaaaatggatccgaaactaacccgaaatccaaacccgtggatccgaattcggatccggccaatgccaaaagcgacaaagctgacgctgacatctctatgtgtccacctcccaggctcggacagttctacgatttcttttccttttcgcaccttacgccgccgtttcaatacatacggagatcgaatcgtcctttccttgaggataaaacagaagatgatttctttcaaattgatattagggtttgtagtggaaaacctactacaattgttgcttctagaataggattctaccccgctggaaaacgtccgctcgtgactcatactttggtgggtctccttcagcagataagcagggtgtttgatgcagcctacaaggcactaatgaagacattcacagaacacaataaagatgtttttaccattatagtggtgtcatttcagtttggcaatcttccttacggttttcgtgcaaacacatgggttgtccctccagttgtttctgacaatccatcagtctttccgccacttcccatggaagatgaaacatggggaggaaatgggggtggacaaggcagagatggtaagcatgaaaatagacagtgggccagagattttgcaattctagctgcaatgccttgtcaaactgcagaggagagacaaattcgagataggaaagcttttctacttcatagtttatttgttgatgtatcagtcttcaaagcagtttctgcaataaagcatttagtagatattaagcaaaactctttcagtaattcagctttgccaacttcatatgaagaaagaattggagatttaactattaaagtgacaagagatgtatctgatgcaagtttgaagttggactgcaaaaatgatggaaatcgagttcttggattgtctgatgaagaactagctcagagaaacttgctgaaaggcataactgctgatgagagtgcaactgttcatgatactcctactttaggtgcagtgcttataagacattgtggctacacagctgtggtaaaggtctcaggtgacagagatttggaggggagtcctaattccttggaaattgatattgaggagcagcctgaaggaggtgcaaacgcattgaatgttaacagcttaaggatgctgttgcataggccatctacaccccaatcatctaatgcaattcaacgaatccaaagcacagatattgaatgttcacattctactcggtcattggtaaggaaagtcctagaggaaagtttactgaaattgaaggaagaaaccactagacacagtaagtctatcagatgggagcttggggcatgttgggtacaacatttacaaaatcaagctactgggaaaactgagccgaaaaaggcagaagagggtaaagttgaaccagctgttaaaggtcttgggaagcaaggtggattactaaaggaattaaagaaaaagattgatatcagaaactccaaagctgaagtaggaaaggatatttccccatgtaatggcaatgacataaacaagccagaagccactaaacaggaattagagagacaagatgaagaaaaggcaactatatggaaaaaactgctatctgatgctgcatatacacgccttaaagaatctaaaactgatcttcatctgaagtcacctgatgaattgatggaaatggcacataaatattatgttgaaactgcacttccaaagctggtggcagattttgggtcccttgaactctcacctgttgatggaaggacgttgactgatttcatgcataccaggggcttgcaaatgtcttccttaggacgagtggttgagcttgcagataaacttcctcatgtgcaatctctatgtatacatgagatggttgttcgagcctacaagcatatcttgcaagcagttgttgcagcagttgataatgtttctgagttggcttcaactatagcatcatgcttaaatatattattgggaatgccatcacctgaaactaatgatgaagatattactagttgtgacgaactgaaatggagatgggtagaaaacttccttctgaagaggtttgggtgtcagtggaaggatgaaaatggtcaagatttaagaaagtttgccattcttcgtggactctgtcataaggtggggcttgagctggttcctagggactatgaaatggatacagcatctccttttagaaagacagatattcatgtagcttgttcatctgctgatggccgcacacttttggaatcatctaagacttccttggataaaggtaaattggaggatgctgtcaactatggcacaaaggcactctcaaaattagtgtcagtttgtgggccttaccatagaatgacagcaggagcatatagtctcttggctgtagtgttgtaccatactggagatttcaaccaggcaactatctatcagcaaaaggcactagacattaatgaaagagagcttggactggaccatcctgatacgatgaaaagttatggggatcttgctgttttctattatcgactccaacatacagagttggctttaaagtatgttaatcgtgctttgtatcttctgcacttaacctgtggaccttcacatccaaacactgctgccacctatattaatgttgcaatgatggaagaaggattggggaatgtccatgttgctctcagataccttcatgaggctttaaaatgtaacaaaagattacttggagctgatcatatacagtttaaatttatacaacaacaacaacaacaacgccttatcccactaggtggggtcggctacatgaatcaacttccgccataa

SEQ ID NO: 77996 - DNA, 924 bp, Glycine max
  Peptide Sequence Number=SeqID_169681
atgacgtcaacaacggggcaaggagtggtggcacggacactcaaaattgcaaaaacagcacagaggaggaagaagatgagtgaacagtacacgcatttggtcggattttttatttttgcggcgatgatggtgcttggaggttgtctgtcgaacaagttcaaggcaccggcgatgaagttgctcacgatggggaaggaaatcaacggttctcgtcctgccaccacgggattcttggattcacatttgagacacatattggtacaacccatcattcatgagctgagagatgatggtgcaaagacaattcctatatggccatggttcgttttcttagctggaggaatgggctgtttggcttctagtactctttcccatcttctggcctgccactcaaaacccttcaacctgtttttttggcgtctagattatgcaggaatctctcttatgatagtgtgctccttctatgctccaatttactatgtcttttactgcaatccctacataaggactttctatttgacctcaatatctgtgcttggagtcctagccatcatcacccttcttgccccttcactctcttcccgtcacttacgaccctatagagcatctttatttctttgcatggggttttcaggtgtcattcctgctgttcacactctagcaacccattacgaccacccgcatgttgttgttgcgctcgggtatgagcttctaatggcaattctatacactaccggagctgtgttctatgttactagaataccagagcgatggaagcctggggcatttgatattgcaggccacagtcatcagatttttcatgtttttgttgttcttggggcgcttgcacacactctagccacactacttgtaatggaatttcgacagggatcacccacctgtaacactcaacattgtcaatag

SEQ ID NO: 77997 - DNA, 603 bp, Glycine max
  Peptide Sequence Number=SeqID_169682
atggatcacgtagctgatgaggtccacgaacagcctgaagaagcagctgttgatgatgaagttgttgatgccgaggaatgtcctgagttgaagctaccttcccatggaaggaaggttcagaaatttggcaggcctgctgcagagattgaaggattagttgtgactatcaccctcgatgatgtggcatctttgcttcatctgcccatcacaagtgtcttctatagcttcaagactcttcatattgatgaagcggtgttattgttagtcgaattacttgagattgtaacacacgtgcatgtggtgttcttgaatgtgtttcgcgacctcacccaaagtggaagttacgcatggggaactactacccttgtccatatgtacgacaatttgaatgatgcgtctaaaagcagtgtcagacaacttgcaggatatatcacactattacaggctattgatgttgaagattatcatgagaggaaaccacgtgtctgtcgctggaagtctgcggaatggagaaggaggaaaggtgattggagacgccacttcaaggagaagatgagtcaagaacaaactcaccaccataggaagccatggataagagcttga

SEQ ID NO: 77998 - DNA, 348 bp, Glycine max
  Peptide Sequence Number=SeqID_169683
atgagggacaaaagggtcttttcattgagtttccgagaccctaactcgcacaggctagcctgtggctcgcctggggccccaaattacttcaacctgaaggaaccagctcgcctgggcgagcgtgaaggggagctgaggaaggggttccaaggttcagaagtggagagaattgagagaattaagaaagaagaagaagaaagaagaggaaatgaagctgaggcagctaagaaagcctacattgcttgggacgataatgattcatctgaaggctctgagaaagaagagatcaacctcttaacaaagaactatgaaagcgaagaagatgattctcaagaaatcaaagactaa

SEQ ID NO: 77999 - DNA, 834 bp, Glycine max
  Peptide Sequence Number=SeqID_169684
atgacattggcatcttcattccccactccacaggttcacgctttcgacaaccccgccagaagtagaagtcaccttcacatcattaaacgcaacaagccccaccgaaccctccactttctcttaatcccaacctctcccccctcctccgcgctcctcttctcctgctcctccttccccctcacccactccgacccaatcctccagtttcgccaccaccacctcctctccaccgacggcaacttcgtggtcgaagacctcagcgctgcggttgaggaggacgcgtctccggccgccgcaaggatcttcgtccaggagccgccgtggctgttcctgaagggtttgctaatgcaggaagaggagatgagacagaaggggaaggagagggagaagtataatttgctgcgaaggaggcagattgaggcggagactgaggcctgggagaggatggtggaggagtacagggaattggagagggagatgcgggagaagatgttggcgcccaatttgccgcacgtcaaggcgctcctcttgggctggttcgagccgttcagggccgccgtggaggccgagcagacggctcaccacgcccgccccaagaagcagcaggactccattgccccccacgtcgacgacttgcccgcagataaggtggccgtcattgttatgcataagatgatggccatggtgatggagagtgaggaaggctgtgttcagcttgttcatgctgctattcatattggcttggctctagaacaggagttgtctccattcgaagttgttcctggctcgaacatgattgcttccattggaggatacctgatgtctagaccataa

SEQ ID NO: 78000 - DNA, 558 bp, Glycine max
  Peptide Sequence Number=SeqID_169685
atgaggtcttcctcatccataaacaagtcctcctcgatagatgtatcctcctccaaatcttcaccttcatcctcaaaaacaagattcgccaagtctaccctgggtggtacccaagactcatgtaacaccaatcatggagacatcgatgcaaagaaggtagccttagtgtccttagatgaagaatcagatccgacaaaggacatcacgtcgtccataaacagtgaatgggactcaaatgggatgacgacctttagcataggcacgacaaaatgtaaggaccaagcccaaggaattttgggggctgcaccttcaaaacccaaggaagataagggtaagaccatagagaaatccacccctaagactagttcccgagcaaggactagcaagattaaatgcttcaaatgtcttggtagaggtcacattgcctctcaatgccccataaagaaaaccataattatgaggggtcaagacatttatagtagtcaagaggagactacttcatttcgttcctctagtggaagtgaagatgaagtaagggatgaagagtctagtgagtaa

SEQ ID NO: 78001 - DNA, 165 bp, Glycine max
  Peptide Sequence Number=SeqID_169686
atgggatttctgatgctagaagaaggagatgaagatgcacaaaacaaaagaggacccctaacgcaaaagatggcattaggggccatggtagctcgcctaggcgagctgtttcttcaacctgaggtaaccttgctcacccaggcaagctggttacttcacccctaa

SEQ ID NO: 78002 - DNA, 471 bp, Glycine max
  Peptide Sequence Number=SeqID_169687
atggttgctagttgtcacaacatggttctgtgtaacacagacccaactgctcatgctgcggtgacagcaataagagaggcttgtaagaagcttaagaagatagaacttgcagattgcgaaatatatgcttcttgtgagccttgtcccatgtgctttggtgcaatccacctttctcgaattaagaatcgtgttggtagcttcaacgaataccgaaaggtacacaataagtttcttgctagtgctaggaggttcatgactggtttggccttctggactattcttggcaagaatctagacaaagaggctattcgaccagccaagctttgtgcttctttcaagttcttgagacttctcatatctaggatgcattatgttatactttcggagttggccgaacacttcctccaagtctttgatatgtgttggcaaatcattagacttgatgaacatgtcatcgacatatacttctag

SEQ ID NO: 78003 - DNA, 597 bp, Glycine max
  Peptide Sequence Number=SeqID_169688
atggcgcgttgtctgattctcatgggtatccgatgtgtaatcaggtctgccccgtgtctgcttgggtacctatacccaacgggttggggtggttcttgtcggcgcattgaggttttcgttcccagtcagtgctccgattattcctcaccaccgcctccgcatacgagcctggattcattctcgggtatggttgtcttcgtcggggtgcctcattttcattttgctcgtcgtgttccattcgtttggcttttgatgaaaatctcccttatgttgcccaactttgctaaaagtggatttggtgctttcggggagatggagtcatggcaaagtgaggcagctgattacctcaattgtagcttgttgacactccctttcacataccttggtgttcctattggagcaaatccgagaagatatcagacatgggatcctatcatctctaagattcctcataaggtggtggataagttagtaagacttcagaggaattttatatggggtggtgatcagcagcagaggaaaatagcttgggtcaattgggagacgggtgctggactcaaaatatggtggttggaggggcttgagcgaaggaactag

SEQ ID NO: 78004 - DNA, 1182 bp, Glycine max
  Peptide Sequence Number=SeqID_169689
atggcacctttgagcgaaggggaagcagcagagcattttgcagagaagggtcttgcaggggaagaaggacaggagagaggcaaatttgttgtcgttgatcaagatattccatctttctttcctttcttctattgtgtgatttgggttcttaacaatgaaaattatgatgaagcaaaattagcaagagaaacagcaaatggaaaagttatgatggaggaagaagttgatcctttgatcaagaaggagaaacacaaggaacacaaagtgaaaaatgtgggctgcaaagaccattttcttgataatccaataccaaagttgatcaagaaagaagtcgaagctggtgatgcagccaagcctcattcttttcaagattcagatttccataaaaagattgttatgatgaaacaaaaatcatcgttggacccagatttgatcatgaaggtggctggaacatcaatggtgttggaatcttggaatgtcaacttgttgggtgagcctttagcattaaactttgttgtgtctatggatgatagctcgacaatggggccaagacagaagggatgtacaaaggcagtcatgatgattcatgttatacggagtccatccttgtccccaccaccaccgaagttgccgtacctgagtttgcataaagtggccagtgggtttgcaattgattccctctggaagaacaccaaagaggcacatcctgttagtgtcaatgatttagttttgaaggatgagaaagagagcaaaaacttggagttcaactgggtggctagatttatactgctaaacttggatgcatgtatagctgatgacacgttaatagagaaaaggtggaaaaagattgcagtaacacctatggagtggaggagcaaagtgtttgagatggtttgcggggagggtgaaggtgatgtggcaacgcaaccaagagtgggaggtgacgcttattcggactcccttgcctgcaaagtggagttctttgacacagtggcagaggacagggcaatgcttgttgatgagggagttgatattgaggagaataggaacaacaaagaagcagtagaggaggaagaggacgatgatggtgatcagcgctttatgaggttgttggcggcggaggtagacatgaagtcaccagtctcagaggcccctgacaacaatgatgtcggttacccataa

SEQ ID NO: 78005 - DNA, 378 bp, Glycine max
  Peptide Sequence Number=SeqID_169690
ataagaacatctcttcagcttttggctttgcagagggagggaagcgcagtatctgtcaagaagcagagaagtgcatttcctccaaactttgtacattcattggatagttcacacatgatgatgactgctctagcttgcaatgacgctggattatgttttgcaggggttcatgattcgttttggacacacccatgcgatgttgagaaaatgaatcagattctaagggaaaaatttgtggagctttataacatgcctatacttgaaaatttgcttgagggcttccagactacatatccaggattggctttccctcctttgccaaagagaggtgattttgacttacagaaggttcttgattctccatacttcttcaactga

SEQ ID NO: 78006 - DNA, 420 bp, Glycine max
  Peptide Sequence Number=SeqID_169691
atgcaacagggacagacagatattctcatagctaggttccctgaccctaactatggtgtcaaaatgggtttttcaaaggaagcgcaaaacatacaatggtggttccaaagtcagaaaagatgtaaagacaagctaaaactaacaaggaacaagcatagaatcatggttacctcaaggaaaaccatgaaggtcaaatcgggcttcgttctcaaccgaaaccgcgaggcaagtttggaagattcagcttcggttgaagggttcctcttggtgtggggtttcaatggagcacaatggtgtttgtggtggctattggtggctgtgggtgatggtgaaagagcttgggacgttggaaatggttttggaagaaagaaggagaaggaaatggcgtttttccaaggctacacaaaaagcaaaggctga

SEQ ID NO: 78007 - DNA, 786 bp, Glycine max
  Peptide Sequence Number=SeqID_169692
gcacccctctctttcaagaggattcgcggcatgtcaagccctggcgggatacttaacgcgttagctacagcattgcacgggtcgatacgcacagcgcctagtatccatcgtttacgggctaggactactggggtatctaatcccattcgctcccctagctttcgtctctcagtgtcagtgtcggcccagcagagtgctttcgccgttggtgttctttccgatctctacgcattcaccgctccaccggaaattccctctgcccctaccgtactccagcttgacgctttacgcccaatcattccggataacgcttgcatcctctgtcttaccgcggctgctggcacagagttagccgatgcttattccccggataccgtcattgcttcttctccgggaaaagaagttcatgaccctcccagtgtggctgatcatcctctcggaccagctactgatcatcgccttggtaagctattgcctcaccaactagctaatcagacgcgagcccctcctcgggcggattcctccttttgctcctcagcctacggggtattagcagccgtttccagctgttgttcccctcccaagggtaggatcgaactctccatgagattcctagttgcattacttatagcttccttgttcgtagacaaagctgattcggaattctcttccattccaaggcataacttgtatccaggcgcttcatattcgactggagttcgctcccagaaatatagcccccccacccctcgtgctcgaactgataacttcaccacgtcaagttga

SEQ ID NO: 78008 - DNA, 225 bp, Glycine max
  Peptide Sequence Number=SeqID_169693
atgggtggaggacggatgaacgaaaacgcaatttatgcagctccgaaaaagggtttagaatggagaattgcactaagcaatcactacgcatggctccaagctcgtgggttgaggacggatgaacgaaaacgcaattcatgggactccgaaaaaggattgagaatgcagaattgcactaagcaatcactacgcatggctccaaactcgtgggtggaggacgcatga

SEQ ID NO: 78009 - DNA, 341 bp, Glycine max
  Peptide Sequence Number=SeqID_169694
gagatattccacatcctgccgcatatcttcagcgtcagcgagtcggatctgattctgacgctgctttcgctggtcgatatgacgctggtgggcgggctgctggtgatggcaaagagaagctcaactggcttggcaaaatggatgcgacatcgctgaaaaacaaggtggcggcgtcgattgtggctatctcttccattcacctgctgcgggtgtttatggatgcgaagaacgtgccggataacaagctgatgtggtacgtcattatccatctcaccttcgtgctgtccgcctttgtgatgggctggctggataatatgtcgaaggttgagaagaaatcttga

SEQ ID NO: 78010 - DNA, 540 bp, Glycine max
  Peptide Sequence Number=SeqID_169695
atgacagcagctccgtataccctacctcttgcagattttcaacgttttgaggccatgcttcggagcatacatcaggggcaaattattttactacaaagcctacaactggtagcgcctctagactccatcctgacgatagagcaatttaatgaatgggtagcctggccagggactcagcctcctcttcatagggaagatgaagatctcgccgctcaggtaccccatcagtcagaggatgagtcattagagtcttccactcctgagcccttgataaggaaaagaagggtagttgtaacccaggaagctgtagccacctctgaaaagtctcttgaagctacttcggagcttctggcactagtggcagataccacttctccacaacaggcagcaaacccttccacgcctgaggatcaaaccaccccagacctatctctgaacacctctcctgtagctactcatgtacttcatttgttggaagaggaggaggttttgtgcaggagtagtgtagttgctcgtcctgaagcatctggaacagtttaa

SEQ ID NO: 78011 - DNA, 957 bp, Glycine max
  Peptide Sequence Number=SeqID_169696
atgacggaagggtgtggtgaagggttttgccttgcaaaccttcccggtgatgcttttagtctatgggggaacttctttgaggcaaagaaacaaatgatggctgatgccaagtttgcggggctgcttggtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaagtctggtttgttggtgattggaggggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctgggtaaaactaacctgtctcacgacggtctaaacccagctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccggcccagccaaaatccccagctgacaat

SEQ ID NO: 78012 - DNA, 444 bp, Glycine max
  misc_feature (433)..(433): n is a, c, g, or t
  Peptide Sequence Number=SeqID_169697
ttctatttctcgatggaggcaagggatataactcagcggtagagtgtcaccttgacgtggtggaagttatcagttcgagcctgattatccctaaacccaatcgaactccagtcgaatatgaagcgcctggatacaagttatgccttggaatggaagagaattccgaatcagctttgtctacgaacaaggaagctataagtaatgcaactaggaatctcatggagagttcgatcctggctcaggatgaacgctggcggcatgccttacacatgcaagtcggacgggaagtggtgtttccagtggcggacggctggaaacggctgctataccccgtagctgaggagcaaaaggaggaatccgcccgaggaggggctcgctggggaattttccgcaatgggcgaaagcctgacggagcaatgccgcgtgaaggtcnaaggcctacgg

SEQ ID NO: 78013 - DNA, 1837 bp, Glycine max
  misc_feature (94)..(94): n is a, c, g, or t
  Peptide Sequence Number=SeqID_169698
atggttaacgggcgctataccctgccgggcattaacggtggcagccctgaagtggtcaaaccggaaaccaccatcccgctgcatcagtcgctgncggttctggacggcgtctggctccccgtgcctttcctgcgcttcaacccgccgcggacttttgtggaagggccggataactgggcccgcgtacaggtgcgcaagcttgacacccccgacacggcaggcaatacccaccgcgtgaccctggcgcttgacagccagattgccggacatgccacgtccgccctctccccggtagagaacgatatcctgaatgggacccgctttgccctggcatggcgcgatgcagaagttgaaaatttcctcgatcaaacctggattgacggctggctgcgcgaggcgtttacccagtatgccgatggcgtagaaaaccgttccgagcgcgatctgcagcaggcgatgcgcagttttgaatatcaggcgcactggcttaacctgttgaccatgctcggtgaacagctcaccgtgccggaagtcaaatttgttacccatacgctcagcaccccggccattccggtcgacctgatcctcgacgtggggaatacccacacctgcggcgtgattattgaagaccacggcgatgcgaacgatggtctacgccagaccgccgaactgcaggtacgctcattaagcgagccgcaattccttaatgagccgctgtttaccagccgtcttgagttttcggaggcgcgttttggcaagcagcacttctcggttgaaagcggtcgcgaagatgcctttgtctggccgtcgattgtccgcgtcggtgatgaggcccgcaagctggcgatgcagcgtctcggaaccgaaggtaacagcggcatctccagcccgcgtcgctacctgtgggatgaaacaccggtggtacaggactggcgctttagccagatgaacagcaaaacccagcgtgaaccgcttgccaccgcgttcccgctgatgaacctgatgaacgatgacggcgagccgctcttcacgctgccgcaggatgagcgactgccggtcttctcgccgcagtacagccgcagcacgctgatgacgcacatgctgtgcgaactgctggcgcaggcactggggcagatcaacagcgtcgccacgcgcctgcgtctgggcttcccggcgtcgccgcgccagctgcgtaccctgatcctgacgctgccctccgccatgcctaagcaggagcgcgaaattttccggcgccgcatgttcgaagccatcgccattgtctggaaagcgatgggatggcacccgcaggatgaggattttgtcacccgcaaacagcaggaaaaaagcgtggtgccggtgccagaaatccagatggagtgggacgaagccagctgcggtcaactggtctggctgtataacgaagcaatatctcgctttggcggtcagacggaagccttcttcgcctcccttgctcgtccggaccgtgagcctgaacccggtgcgcagccgggccgggcgttgcgcgtcgcctccatcgaccttggcgggggcaccacggatatggcgatcacccattaccagctggatgacggctccggcaataacgtcaaaatcactccgcagctcctgttccgcgaagggtttaaggtggcgggcgacgatacgttactggacgtgattcagcgctacgtactgcccgccctgcaaacgcagctgcagaaatcgggcatcgctgatgcttctttgttgatggcgtcactgttcggcgactccgggcgcattgatacccaggccgtacttcgccagcaaacggcccttcagctctttatgccgattg

SEQ ID NO: 78014 - DNA, 252 bp, Glycine max
  Peptide Sequence Number=SeqID_169699
atggccaagttcgacccagacatagtcctggaattttatgccaatgcttggcctacacaggagggcgtgcgggatatgcgatcttgggtgagggtgctggaggagggccaggagtctgagtatatggccagaggaggaatcgggccgatgggtttgatgaggagaccatcgcccagttgctgtgcataccgggacaggattttgcctggaccactgccgggagacgagtacaaatcatgcgtaccagcatga

SEQ ID NO: 78015 - DNA, 324 bp, Glycine max
  Peptide Sequence Number=SeqID_169700
atgtcagtgaaaatcctcatcgggcgcctaggagtacatgacaagacaaaccacacactagcaaggaaaccagttagggtcacgttgttttgcaagaatgctccaaccatatgggatcaacataggcttaaaggagcactcaaaccgggtgtatttaccctcaaggcctacactccgaagagtccatcagggcctctccctcctaatttaggatccctacacatgttcattctaatcccaattgcgataaacgcatctcttacttctaaacgggctcacgtgtgcattgtgacaacaatagcgcaatctttaacggtttcctga

SEQ ID NO: 78016 - DNA, 294 bp, Glycine max
  Peptide Sequence Number=SeqID_169701
atggagcggtatctacagcacttggttcgccagcaggcggccaaccaccgggggcaggtgcagatacatgagtgtctctaccagctcagcctcagtcagcagggccagggtttcgttccttttgcgtgccctactctagatcagtttagggctgaggtcgtatggcctagagattggcccaaggcccaggcaggggaggcgcctgcagaggctcccggcgatgcagaggatgcctgcatggatgaggagatgacggatttgctcggtttcttgggtgggagcagagccacatga

SEQ ID NO: 78017 - DNA, 501 bp, Glycine max
  Peptide Sequence Number=SeqID_169702
atggataacgaagagggagtgcaagaacagatgaaggccgacctattggccttaaaagatcaaatggcttctatcacgaaggccatgctaaagcttcaaaaaactatagaagataatgccacggcggccgcttccaatacagctagggaagcagaaccggtgctacagctcgtaataaacttgggccgagacaaaaatgcgacaggtttcaatcggaggtatagtcctcaagcttacccttatggtttgcctccggacttcactcctcgtaccgctccagacgatttgagccaagcccctaccttcgaggggcagctccctcctcatgccgactatcctctgcaagaagatgatgaaggagatgcccatttaggccctctacttcccctcaaggatccgaccccccatgagttaccccaaccaaacatagtctgccacgtcccgtctccatccgcacccgttaaggaactcgttccctttgcctcaacgaagcccacgtag

SEQ ID NO: 78018 - DNA, 836 bp, Glycine max
  Peptide Sequence Number=SeqID_169703
ccgtgctgaccttctacgatgggcgttatgatgcatcggtgcaaaacgatcaggccgccaccgctatccagacgcgcgccgatgccattatcgtcaaccctatggattttgaggccaatatcgatatcgtcaccaatgccaacgaggccaaaatcccggtggtggtcaccaatgcgcgcctgaacacggacgcgatgacgtctgaagtggtgtctaacgacgagttggggggatatctggaagccaaagccgtactggacaaactcgactgcaagaaccataaggtgaacgtggtgattatcgaaggcccgaaaggcggcagcggtgagatccagcgcggcaagggcaatgataaagcgatagccgagtgcggcgccggccaggtcaccgtgcttgaacgcaaaacggccaactggtcacgcgcggaagcgcagccgctgatggaaaactggctgcagaaacatcggggcaaaatcaacggcgtgattggccaaaacgacgagatggcgctgggcgctatcgaggcgattaaaggcgccggcctgaatgtgaaggacttcgcgattgccggcgttgacggcgtttccgacgcgattcatgcggtgcaggccggtgaaatggtctctatcctgcaagatgccaaaggccagatgcaggggtccatcgacgtcgcgctgcgcgccgtgaaaggtgaaagctatcagccacagtcggatatctggaaacagtacgccaaggatctgaaatgggaaggcggcacgcagaagcattattacattccgtggaccgtcgtcaccgcagagaacgcccaatcgctgttggacgcccgtaaataa

SEQ ID NO: 78019 - DNA, 160 bp, Glycine max
  Peptide Sequence Number=SeqID_169704
gctcgatcgtgttcagcaaaacgcagagacaaattatggtcattctgcgtcttgtatcaaccaagaggaacaagttcgacagtatcgggaagatgtgtcggtactgatcattttcaaatttttgcaggttccgctggcaggaaggttcactggccgaaag

SEQ ID NO: 78020 - DNA, 393 bp, Glycine max
  Peptide Sequence Number=SeqID_169705
ggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccaggcgaattggagctccaccgcggtggcggccgctctagaactagtggatcccccgggctgcaggaattcgatacgattgatgttatggactggtgtgag

SEQ ID NO: 78021 - DNA, 726 bp, Glycine max
  Peptide Sequence Number=SeqID_169706
atgacggtgaaaacctctgacacatgcagctcccggagacggtcacagcttgtctgtaagcggatgccgggagcagacaagcccgtcagggcgcgtcagcgggtgtttgacgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttgatccccgaggctaccacgcatctagtatgcatactgaggcaagatttcacccgtgccgctgcaaaaagacgagtgcggatcatgcgcaccaacatgaccactttttcatggatatggatgacggatcgtgcccacaagacgcccagtgggcccggagaagtccaacaggtccctggggtttccagctctgggatcgcgcctgcaagacacccagtggacccgaagaagtccaacaggttctacggagtacctgtcacctccagcaagggcatcaggccccctactaatcgagctttcatcaagaagtactgcgtctccaggcaagcacagggcgaaacaccacaacagcctggggatggccggcagcgggcaacagacgcaccgccatcacctctagagttcacctcatggccgaccaataggcaaccaagtccagagccaaag

SEQ ID NO: 78022 - DNA, 675 bp, Glycine max
  Peptide Sequence Number=SeqID_169707
atggttcatggcccatgtggaatttcaagagctgaatctccatgcatgaaagaagacaagtgcagtcgtttctatcctaaaatgtttcaaccatatacggttttagatgcagatggttatcctgactatcgtaggagaaacaatggtcacacaattgagaaaaatggtgttataattgataacaggtatattgtaccttacaatccaaaattgctcaaaaaataccaagcccatatcgatgttgaatggtataaccaaaacacttctatcaaatatttattcaagtacatcaacaaaggatatgacagaataactgttgttttgattcatgatgataatgatccaattcgttatggtagcactcataatgatgagatcaaagaatatctagattgcagatgttggcagcttaggaagaaaggttacaccattggcaggttactatgggtcccaccaattacaggaaaattattttacttaaggatgatgcttactgtttgcaaaggacctacctcatttgaggacttaagaacagttggtaatgttcaatatcctacatatagagaagcatgtctcgtcatggggttattgcaagatgatcacgaattcattgaggcaatcaaagaagcaaaacactggggctcagcacattatatcaggaaactatctgtgtag

SEQ ID NO: 78023 - DNA, 159 bp, Glycine max
  Peptide Sequence Number=SeqID_169708
atgaactcgctaagcgagcatgctgcactaagtgagttcatcagtactcattgtcctttaaggagcttagcgcatatccttgcggcagatgttcagcttagcgggcgttgtccagctaagccaattctgcagaagctgaatttctacaacttccgctaa

SEQ ID NO: 78024 - DNA, 174 bp, Glycine max
  Peptide Sequence Number=SeqID_169709
atgggtctccgcatcaaaatggagaatggagaattggcgcacagcgctacgcaagaacttcccggggctccagactcgaagtggagaatggagaattggcgaatagcgctacgcaataacttcgcggggctccaactcgaaggtggaggatgcatgaacagagctaggcaatga

SEQ ID NO: 78025 - DNA, 240 bp, Glycine max
  Peptide Sequence Number=SeqID_169710
atggaggcaatgtttactacctcaaaagattggaaggccgtttccaatgactcctccacggcttccacatatggcatagaggacgggcaacttaccaagacgtcttcctcccccgatacaatgaccaaatgcccctccactactaacttcagtttttgggaggttgatctctcccctttcctctcgacggctgtcgtcgaaggcacaccatggaacttggccttagatgggaagcgttaa

SEQ ID NO: 78026 - DNA, 372 bp, Glycine max
  Peptide Sequence Number=SeqID_169711
atgatggtggcccgggtgatgttggggtatggctacgagcccgaaatgggttttggcatgaacaacgatggcagaaccagcctggtaagcaccagaggaaatcgcgggaagtttgggttaggctataaacccacgcaagcggacataaggaaaagggccccgccctgccacatcagtaggagctttataagtgcggatctaggacacaaaggccaattcgttgcgatatgcgaggatgactctccgattcgttgcgataggccagttccaaggacaattttcctctgccgcacattgatatcctcgtggataatacggccaatttcgctctgttttccttcatggatgggttctccggttacaatcagataa

SEQ ID NO: 78027 - DNA, 370 bp, Glycine max
  Peptide Sequence Number=SeqID_169712
tgcttcaaagagtccgaaaggcatggaattccgtgcaagaaaggataaggagcttagaaagagcagcaacgatgttattggtggatatcatcaatggttgaaggcttggacgcaatggaaaacttggctcccgcaactaaagatttcaagtgaggaagaggctgaaacccctgaggagagtgaggaagaaaagttcaaggcgacaaccaatagggtcaaaaaagagtgtgacaagccgagggacgtcaacatgcgaacacaagctttagagggccaaaagaggcgagttgagggtggaaggtatgatattagaggacaagttaaaggcttgacaaagatcgaaaaggtgcttgtccgaacagttgagtaa

SEQ ID NO: 78028 - DNA, 1103 bp, Glycine max
  Peptide Sequence Number=SeqID_169713
catggaatgcagtgcaaagaaaggataaggagcttagaggaaacaacaatgggatcgccggcggctatcacaagtggctgaaggctcggacgcaagagataacttggctcccgaagctaaagatttcaagtgaggaagaggctgaaacccctgaggagagaaaaaaggtgcaagccttaaaggcgaaacttgaaagaacacaagtagtcaaggaaaagttcaagacgacaaccatcagagtcagaaaggaatgtgacgagctgagggatgtcaatgtggccacggttgaagcggtcgagagagaccagtcgagagtcgaaggtatgatattagaggtcaagctaaaggcttgtcaaaggtcaaaaaggagcttgtccgaacagttgagtaagacggaagagaacatgtgggctatcattgaccagtacaaagagaagctaagtttagctgctggccatgagcaaagattaaaggacgagcatgcaaaagtattggctctccaagcagaaagggaagcaagggagagagtaatagattcattgcacggagaagctatgatgtggatggataggttcgcttccaccttaaatgggagtcaagagcttccaaggctgctagccaaaaccaaggcgatggcggacgtgtacccaactcccaaggaagatgtgcaagagaaaatgaaggccaatatggaggccatgaaggatcaaatgacctccatgatggaggccatgttaagcatgaagcggatgatggaaagcaatgcggctgcagccgccgccactagtgctgccgctaaggcggatcctactcatccatctgcaataaaccaatcaaaacagtcaatcccagacatggtgggtcatagaggagaggtgccaacaaccccaacttgtaggggacgccgcgaagagcctcgagatcatgttcgggttgactttgacccataccctacgttcgccactaagggaccgacgtgtagtggtatacctaagcccaacaccgcgggggctcctcaacaccgcctgctgcaacctctgcatttcttagtagggagacttcctccggcagtggaaggaagggagaaattggatctcatctag

SEQ ID NO: 78029 - DNA, 387 bp, Glycine max
  Peptide Sequence Number=SeqID_169714
atggcagagagctcatcaaattcagggaagggacaaaatgtggttgaagacaaccaagccgtaaatgaaattctatttaaagatgagttgcagctagagttcataatgagcgtgggcattgtgaaagactttgagttgagcatgccatatatgacaaaactgagcaattacaagtggaacctatgcttgcccgtgcaagggttcgaagacatcctcttagggttctttaaagaaggtgaagatgttagagaggcaatttcagtgaccgtgtatgacaaaggttgccatgagtttgatatgatgctcaagaaaatgggtaaaggattccaaccattactatgtgccaaacctgagggtggttcattttctgcgaccaacagtgcttga

SEQ ID NO: 78030 - DNA, 750 bp, Glycine max
  Peptide Sequence Number=SeqID_169715
atgccattgatattaaggcctccgaggaatacaatatgtggggcttgttacgaaggagttaggagcataatcaacatgatgagcaatgttgaaagtgagaaagtaaaggcaatggctaatccaaatcaaaatagttctccagtttcgcggcgaaattcgaaacagacggagcagtttaatcaacaaaaagaagacatggttttcctcagaggctttgttgcagccttcaaagcacagattcacacggatatattggtcagtccaggcaggaacggtccacctatacctgcacataagtccgttttggcagcaagatcagaaatatttaagaacatgctagagtgcgatgaatgcaaggcagcaccaagtaacgccataactatacccgatttgaaccatgaagaactagagtctctccttgagtttctgtacagtgggacattgaatgtggaaaaattggagaaacatgtctacgctttgtcacaagcagctgataagtatgtgattccacatttgctgaaacactgcgaacgatatctgctgagttcactaagcacttccaatgctcttgagacactagaaattgcggatacttgttccaaccacaacttgaaggagacaaccttgaacttcttagttaaaaacattgagcacatggtgtcctcacctaaatttgaagcttttgtccataggagcccacatcttactgtgcaactagttacaagggcgtttgtgaatggtgccaaataa

SEQ ID NO: 78031 - DNA, 600 bp, Glycine max
  Peptide Sequence Number=SeqID_169716
atgtgtacttgtgttgtatgttctagacttctagtagtaaatgatgagctaaccattgaggaagaagctgagaggaaagtcggatggctattgaagacgatattttttgtgactgcaggggtagcaggataccatttctttccttatatgggagataatttgatgcaacagtctgtttcacttttgcgtgtcaaggatcccttgttcaaaaggatgggagcttctagattggctcgttttgcggtagatgatgaaagaaggaagaagatagttgagatgggcggagctaaggaactcttaaatatgttaagcactgctaaagatgaccgtacacggaaagaagcattgcacgctcttgatgcattgtcacaatcagctatacctgatactttccttgtcagcatgttgatttttaagaatccagttcaaataaactacttcattgttatagatgaagctcttgcatccttgcatcatgccggggccatttcagtaattaggtctgcaccaaattcacttgaggatgcagaagttgagagattcaagttgagcttgatgaaaaggtttcaagatctcagatacgatgatgtgtcatcatga

SEQ ID NO: 78032 - DNA, 276 bp, Glycine max
  Peptide Sequence Number=SeqID_169717
atgttttctgtttgcaactatgagactgagaaggtttttcttgttgcatgttaccatcaggttgtggaagtgaaagtcggtttgcactgtgaagattgtatcaagaaaatcctcaaggccatcaagaaaattgaagatattgaaacgtataacgtggacacacagctgaacaaggtcatggttacgggaaacgtcacaacagaacaagtgatcagagtccttcaaaagattggcaagaatgcaactgcctgggaagatgctgaaaccaataagtga

SEQ ID NO: 78033 - DNA, 2367 bp, Glycine max
  Peptide Sequence Number=SeqID_169718
atggccgctgcatctgaaattggaaacaagtcaatggtatgccaagatccccacagttttggtcaccttgatatctggaaaggaggcaacccattagaatcccccagttgtcttctctatatgcaggtctctttgatgaccatggtcacacagtttatggacgcatgtctcaagtcactaggtcaatcctccattgtatcccagattatgggtggagtgctgtttgggccatcaatgttggggaacaaaaagattctggggctagccttatttcctacgaagggcgctgtagtgcttgacacagtttcattgtttggtcttatgttcttcttcttcatatggtgtgttaaaatggatattgccacattaatgaagactgaaaaggtggccatcactcttggtatttctgtattcgcatttacattgataatccctactggactggccttcctgatgatgaaatacattgcgatggacgggagcctcgcaaaggcactgccatttctagctatgtcgcaaaccttaactgtgttcattagcatagcagtgctcttgaccgatctcaaagtccttaacactgatataggacgcttaacgatgtcagcagcaatgtttgctgatgtagctggctttatcttgacagtgattctgtttgcaatactgcaggatcagagtggtagctttgtgagactagcatgcatccttctgtccatagttggagtctggcttcttgttatatttgtaatgaggccaacaataatttggatggtaaagcacccaggtcgaggttcggttaatgaaatctgccttgtttgcatctttctcttagttctcttatctgcatttgtcagtgagttaattgggcagcattttataatgggacctatacttttaggcttggctgttccagaagggccacccataggaacagctttgatgagtaaattggagacaatctgtacggcatttctttatccaatctttctcgctgttaatggactgcaaactgatttcttcaaaattgataagcagtctctgtggattgtgtgtgtcattctgattgtcgctttctttgtaaagattggtgctgtcatgttgccaggatactattacaatctacccttgaaacaatgttttgtcattggcctctttctaaatggaaggggtatagctgagcttgccacttacaatatgtggaaaagaggcaagttaatatcggaacaagagttcgctttgatggtggcctcgattatagtagtaaattgtatcctagtaccactcataagatacatatatgatccttcagaactatatcagaccggaaaaagatgcacaattcagcatactaggcgagatttggagctccgagtgatggtgtgcattcacaacaacgaaaatctccccatgatcctgaacctcttagaagcatcctatgcaagcagagagagcaggattgaggtaacagcattagtcctagtggagcttcaaggaagagccaggcctatcctttttgctaatcaagaacaaccccatgatgagatgcgctcaatgtcttgcaatgcaagtcacattgacaatgcattgaggcaatacgcacaacagaacgaaggatatgtatctgttcaatccttcacttcaatctccacctttgaaaccatgtatgatgatatttgtaaaatctcactagacactggatccaacattttgatcttgccattccacaagaggtgggaaattgatgccaccgttgagatttctcataggaccatccaaaccatgaacattgaagtcctcgaaagggcaccatgttctgttggaattctagttgataggggcatcttgagtccttctccttcactcttgatggctagagcagcattctatgtcgctgtgttcttcatcggcggccaagatgacgccgagacattagcctatgcttccagaatggaaaattctaaagatagaaaacgtgacagtgatcttatagatgagtatagatactacaatgcgggaaatcaaaggtttgagcttatgaatgaagtggtgaaaaatgggatagagatgtcaacatgtattagaagattgatagattattttgatctagtgatggtgggaagggagcatccagacagtgttatttttcagggacatgatcaatggagtgagtgccaagaactaggggtaattggggacatgctagcatcaccagattttgtgaccaaggcatcgttgttggttgtgcaacaacagaaaataagagggacgcttgttaaacacaatgtcaatgcgaatccagtgcctaatcacagagatcagctcgtatatgatattccaaatgatacagtggacaagtatgacagagtgtag

SEQ ID NO: 78034 - DNA, 1971 bp, Glycine max
  Peptide Sequence Number=SeqID_169719
atggcttacaacttccctgatgtgttttgctggattcagagtcttccaccaatctcagaatgggaaacaagttccatgtccttaaacatatgttcttcttcaagctcatcatgccaaccacactgcaacattcccatccatctttggacctctaaacctttcaagccaagcagcaccactattactaataaaacccacaataataataagttaatagatgatgaagaaaccatttccaatctctttgttaatttcattcaagccatccttctttatggctccaacaaaaacagcactcccttcctcagatttccaaaccttgactccatcacttccaacaacttttcagatgttttcaatctttctttcttcaccctcttgttcctagtttgcatatatgaagctcctgctgcagattttcgttctgggtgtattagcaacttgaaagaccacttgacagttactaactgggttggggaacttgaagcacataacaaccccttcagaacaccgtgccctttgttttcttatgcattttcaacaattgggttgtggaaggtgcagctttattgtcccctcttggtcatggatgttgagaattcaaaaagcaatccagctagcgagaggcttcaattctccctcagatatcaccatgtggaaggtgttcttcagttcaatcacaaagtcttgatcaaagaggagtgggctgaaatcatggtggacattgacaacataaggtgtgatgttataaaattggtgaatgagtcccttatgagccaacgaggggtaggtgcagctgaaaaacattttccttcgagaatatcattgcaacttacaccaacactccaagaccaagtgttgagcctatcagttggcaagtcctcagagaaccctcgaaaagaaattggtgttgacaaaagcgtggaagcttcatttgaaccatccaatcccttggcacttaaggtgtcagctggagaatcctcaaccgttagtttgaagccttggaaattcgaggaatctgtttatggatacagtgcaaatttgaattggtttcttcatgatagtgttgatggcaaagaagttttctcatcaaagccttcaaagtttgcaatgcttaacccaaagtcatggttcaaaaaccgatactctagtgcttaccgacctttcaacaaggaaggaggggttatatttgctggtgatgaatatggagaaaaagtgtggtggaaagtggacaaaggagccatagggaaaacaatggagtgggagataaggggttggatatggttaacatattggcctaacaaacgtgtaacattctacaatgaaactaggagcacatccgtcggtctccattcttcaataaacaaaaaccagagagaggaagagaagaaagccttgatgggagaaatcaaggaggagtgcacgagcctcgacaagagcgagcaggagaaacagttgcatagcaaggtctcgaaggtggcgctatactcgagcggggagagcaaggcaatcgcgaaactcgaagtcgccactaatgggttgtgcgaagagaacgtcatcgacgaaggtggctacagaattgtgtaccatggcttgtttcccgatggcaccaagattgctggagacctggatcttatttgcccaaaggtatttggagcacctggaggctcacattatgctcattatcatttggttggaagaaggacggcccgtagagagattcttgctgagatgggatatgagttcacagtaatgactgcagacattgatgagaaaggtattaggagggaaaagccagaagatttggtaatggcattagttgaggcaaagagatgctcagcattatacatcggtctttcagttgtgatcgatgtagaatgtttatcattttacatcggttattcaacgaccgtcgtagaaaacttagcattctacatcgatcctgcagttgtgaccgtcatagaatgctaa

SEQ ID NO: 78035 - DNA, 360 bp, Glycine max
  Peptide Sequence Number=SeqID_169720
atggccaacaaggactcctccaatgagaaagacaaggactcctccaatgagaaagacaactactccaacctcattaaccaaaaccacccgcaagcctatgtccgttcatcgccatcgcaatctcgtcaacccagcactcgtgttgaatgtgtatgtccagttggatcaagtggtcacgcattaaacacaggatgcatgcttagtgtgcttgctcatgacagctgtcttctaatgtggctttttgcgttaagtgaattacttaagttgaatgattttgactcactaagcgaggaggttgagttgagcatgacaattcagttcttcaatcctctttcatgcctctgctacaattttacataa

SEQ ID NO: 78036 - DNA, 153 bp, Glycine max
  Peptide Sequence Number=SeqID_169721
atgactaaagcacgtcaaaagggggtacggaaagaaaaggaaggagaagcttgccacccagctcgcccaggcgagctaggttgcttcctccagaaggcacctcctggaaggcccaagtgggtctggttgctatttgcaccccccttttactaa

SEQ ID NO: 78037 - DNA, 659 bp, Glycine max
  Peptide Sequence Number=SeqID_169722
atgcctcctaaggtgtctagctccttcgacagaggaggaagatccggtactaaaggaaaagatgttatattggctctaccagagccaataaccaagaaggcaactacatcatcttctgggtcacctactcagactgggtcatcaacccagaaaggaaagcttgaagggtcattgacccagataaaacctgagtcatcaactcaggaatccccaaaaccaacaacaacaaaacagattgtggctgactatgcctggtcaatacaaactctcctggccttagaagacataggcctcaccagagtaccaaaattggccaaaaagacctgggcagcaatggcctcagaatcagacgatgattctgaaatagacctacaaaaacaaatccaaaaggccaaacagaccaaaactatatttccagaagaagtccaacagggattccaacaattcaccaagctcttcaatagcaaggaatcaagaattccggcagatttaaaatatggaaaaaccgaaaacagcaaacaatatccaccattgcagagacatgcctttgtaaagtggtggtcacaatttgatacctcaaaggctgctccagaacaagtcaagaactggtttcagagcaaccctgagtttctcaagcctgctgatccagagacatcatt

SEQ ID NO: 78038 - DNA, 213 bp, Glycine max
  Peptide Sequence Number=SeqID_169723
atgttgctggttgaggtccttgacactgcattcccgacctcaatgattcgaccatctaaggttgggatgattcctccaccctggattgtacctgttgctggagagcataagcttcaagctattcaattgcttcagattgttgcacaaaagggcaaaggtctgtgtggtggtcggcagaggagcataaaccatagagtctggcgacaggtgtag

SEQ ID NO: 78039 - DNA, 480 bp, Glycine max
  Peptide Sequence Number=SeqID_169724
atgtttcaccaaccagaacagctgtggaataggatcctgatttctaaatatcagggctggagaggattggatcaggggcttcacaaacagcatttctccacgtggtgggctgacctaaaggcactcaatcaagatcacaatatgactgttgtctctaaacaattctgctggaagatgggtaggggtgatcaaattttgttctgggaagatgcctgggctgaggatggaattccactcaaagatcaatttccagatttgtactcaatttcctctcaaagaaatcatatagtggctgatatgggatcctttacctggaggttgttatgggatagacttcccactaaggacaacctggccaagaggcaaattctaattaataatgatctatgccctttctgccacaacaagcctgagtctgctccccatttatttttcacctgtgacaaaattcaacctttgtggtgggaattcctatcctag

SEQ ID NO: 78040 - DNA, 201 bp, Glycine max
  Peptide Sequence Number=SeqID_169725
gctcatcttggtggtgaagctccttcttccatggcttattccctagtggatggcgcctcctctcacctcttctcctttgtcttccgctgcatctccatgggttcctccccttttgcatgccctacttcggagcagtttggggctgaggtcgcatggcctagagactggcccgatgcccaggcaggggaagagcctgcatga

SEQ ID NO: 78041 - DNA, 177 bp, Glycine max
  Peptide Sequence Number=SeqID_169726
atgtcaatgtcggccaggaaagatgaccgatccaagtctaaaaagaagaatctgatgagaatcatgaaacaggccaaatacagtctaaaggcccaagtggagaaggacgaaggcccaagtggagaaggacaatgcccccgagtggagaaggatgaaggcccaagtggagaaggatga

SEQ ID NO: 78042 - DNA, 392 bp, Glycine max
  Peptide Sequence Number=SeqID_169727
atggcgtcatttgcagggactactcagaagtgcaaagcatgtgagaaggctgtgtatttggtggatcagctcactgctgacaacaagatctatcacaaatcatgtttcagatgctaccactgcaagggtacccttaaggattctgaccttaatgtgcggaagccagttgaacatagtagtgatgcaaagcttgcaggtgaatccgatccattgggagagttgatgaagatattgttttatgtgtaccagaatccagtggaagtgccgtgggaggcgaaccaatttggacttcctgagattggggcaaaattttacatcacacatgcagatctagcagaaataatatcaggtgacaagtgtttaaacatagcgatactacaattgtggaccat

SEQ ID NO: 78043 - DNA, 405 bp, Glycine max
  Peptide Sequence Number=SeqID_169728
atgtctcttgccactctctttggaaaacttcaacaacatgaaatggaactggtgagacttcatcaccatgaagagaatgatataaagagaaaaggaataacactcagaacctcatcatcttttattcaagaagaaagtgacaaagaggacttgactgaaacagaagaagatgatgatgatttcagactctttgtgaaaaggttcaataaatttctgagaaacaaaagaaataaaagaaaatcaaacatcaatacaaagaagaaagaagaagactcttccttagccccatcatgctatgaaagtaatcaaccttggcacatgagatccgattatcttgtctttgaaagaagaattgaaaaatccgacaagaggaatctcaaagaaaagaaagaaaagaaagcatag

SEQ ID NO: 78044 - DNA, 372 bp, Glycine max
  Peptide Sequence Number=SeqID_169729
atggctcaacctccacctcgtgagaggactcttagggagatgactgcatctgatttcacttatgaaagcttgtgcattcaatatcctgatgagggtgttccatatgttctcaagactggaataatacatttgctgcccaagttccatggtcttgcagcccccggatgtccaagaagatcatatctttctaaaggattttcctcattctctggagggctatattgtggcaaaagattgactatactaccttactcccagggacttagcaacatggagaaaagtatgattgatgcttccagtggtggagctcttggtgatatgatccctgctgaggctaggaatttgattgagaagatggtttccaactcctaa

SEQ ID NO: 78045 - DNA, 174 bp, Glycine max
  Peptide Sequence Number=SeqID_169730
atggtgcaaaaaggcttgtttagtaatgaagaaggggttttaagcttgtgtgaagatatagacagaaaaggacttagaaatttttttgcaattgtctatctgctaagcgcagaccctgcgctaagcgctcagtcttcacgcgctaagctgagtttgctctcgctaagcgcatag

SEQ ID NO: 78046 - DNA, 351 bp, Glycine max
  Peptide Sequence Number=SeqID_169731
atgtgcctcagtgtgcttctttcttgtcctaccacgtttgggatagggtggtgcacggtagctgagagagttgggtctgctttggcagccgaactaacagtggcggcggtggccgcgttattctccattagctgtctcattcctagcatggcatccatcatggaagccatttgctctttcaaagccgacatgttggctttcatctgttcctgtacttcctcttggtcacccatcatcctagatttggatctggtcgacaaaagcggggcttttgctcctacgtaccctcctttggagaggaaatcagacctacgtagttcttccttacgcgtgaatcaagtgactctttga

SEQ ID NO: 78047 - DNA, 159 bp, Glycine max
  Peptide Sequence Number=SeqID_169732
atgggattgaggagcaaaatcttcttaggcaatggtcaaatgccaggctggatccaaaggcagagaccaatcaaggtaaacggtaacgcggccacagttttctacgcaatgtcgtttcctgctttcaggtacttagggacggacgcaagtagaggctag

SEQ ID NO: 78048 - DNA, 270 bp, Glycine max
  Peptide Sequence Number=SeqID_169733
atggaaattcttggtggtgaagctccttcttccttggcttattccctagtggatggtgcctcccctctcctcttctccttttccttccgctgtatctcaatgcctccacagaagccccacaagcaagcttccatcaagtgctatcagagcgcaagagctttttgtgtcgagggaaggagcccagagtttgaggaacctcgggatttgaggtcaaatcctttgcaagatggagaggatgaggcaatcctaccccccaagggtattggatag

SEQ ID NO: 78049 - DNA, 557 bp, Glycine max
  Peptide Sequence Number=SeqID_169734
atggaagcatgttcagcagtgggagacctattgcaacaaatgatagaccaaggccggctggaagtcggcgacgaggggggtgaagagcagcacatatgcatgcaatccgcagatgaggaaggtcttagaaagcctaaatctttggtgatacatttcaccagagacgcagctccccaaacgccccgacaaccctcggtagttagacctattccatttccatacaaaaacagccacgcaattccgtgggggtatgcgcctccaagcgaaaggaatgaaggagtcaccgacatcagcttgttgtcggccaaagtaacaaatatcacggagttgagcggcatgacccgcagcggtcgcgtgttcgcaccccctgacctgcccgcaaacgctgaagggaaggcaaagatgacggaagggaaaaatgtcaaagtgatccccgttccggacgaggatgttccaatgaaaggtctttctgagagaagggatggctgtgacaagaaagaagtatcgctcgaggaggccggcgagtcctccgcattattcaacaaagcgagttcaag

SEQ ID NO: 78050 - DNA, 787 bp, Glycine max
  Peptide Sequence Number=SeqID_169735
ggctacacgcctccacctcaaaaggctacacgccctcatctcaaaggactacacgtctcacctcagaggactacacgtcctcgccatcagagggctgcacgccctcaccttcagaggactacacgtcctcgccttcagagggtcatgtaccttcaccttcagaggactacacgtccttgccttcatagggctgcatgccattacctttagaggactacacgtcctcgctttcagaggactacacgtcctcgccatcagagagctgcacgccctcacctttagaggactacacgtcctcgccttcagagggtcatgtaccttcacattcagaggactacacgtcctcgccttcaaagggctgcatgccctcaccttcagaggactacctgtcctcgccttcaaagggctacacgccctcaccttcaaagggctacacgccctaaccttcaaagggctacacgccctcatcttcaaagggctacacgccctcaccttcagaggactatatgtcctcccctttagaggactacacgtcctcgccttcggagggctacacgccctcgccttcagaggactacacgtcccccttttcaaaaggctacatgctctcgcctttagagggcgacacgtcctcgccttcagagggctgcgctctccctcgccttttgagggctacgcatcctcacttttagtgggctccatatccacacctgtcgcaacctacccttttacaggcgagcgaggcgaggctcacgggtgcgtcttccaaaggaggaaaatgcgttga

SEQ ID NO: 78051 - DNA, 626 bp, Glycine max
  Peptide Sequence Number=SeqID_169736
ggtttagattggctctccaagttgaaaattatcaacgtggagaactttgaagctccggaagaggatgaagaagtccaagctctaaaattagagctaggaaaggcaagactcgccaaagaaaaattcaagttagtcgctacagacatcctgaaagagtgtgccgaattacgagaggaaaatgcggctaccgcaagagccctcgaacgagaaaccaagagggctcgcaaggaagagcatgatcaaatcacgcgcctacagctgctttttggggagaccctggattcaagtgctaggagtggtcccttcgatgcttcaccagaaattgaaattcgcggttggtggactcttggtgatagtgtcacgcgaagaagatatgttggtgagctgcccctcctccgtaccatatgtagaagcagcggaggaataattggaaacgactttccaatccttcgaggtggcacagttacgagcccggaatgggtctgggcaaggacagccatgggaattccgatgtggtcggcattagggggaacccgtacaaatatgggttggggtatgaacccaggaaaccgggaagaaggaatgcaccgtcaagacttcaggcagatagggcatggcccggccat

SEQ ID NO: 78052 - DNA, 291 bp, Glycine max
  Peptide Sequence Number=SeqID_169737
atgactaaagcacgtcaaaaggcggtacggaaagaaaatgagggaagagcttgccacccagctcgcccaggcgagctacgttgcttcctcctgaaggcaccgcctcctggagaacttcccggaaggcccaagtgggcccgattgaactttacggattgcgcactaacacttccttttgacttccggcatgtctcggaacttcatgaattgcctaacgatgggtgccaagtacctcaaagtggtcaaacgagggtcgcatcccaacaacggatggtccccggacgaaattag

SEQ ID NO: 78053 - DNA, 348 bp, Glycine max
  Peptide Sequence Number=SeqID_169738
atggcgggagagaaaggaaacaaaataagacaaaagatcgtggagttgaagaagaaggcagaggaagccactacacccagtggttgttcattcatgaacttggacaaattcattaaggagagaaatctcatgtacctagctgcaatagctgattctcaaccacaaccatctccattggctggtcagcagcaaggcatgcacaaccaacttggcatgagcttcagtggaagtcaaggcctccacatgctgcaaagtgaagccactaatgttggaagcaatgcaaccataggaaccggaggagggtttccagaatttgtacgcatcggtagtggcaagcaagatatttga

SEQ ID NO: 78054 - DNA, 126 bp, Glycine max
  Peptide Sequence Number=SeqID_169739
atgaagactaagaacttgtcacaacagtgttgggctttgctcgtctgcaatgagattatggtactcaaccaagaacctgtcgaaggggacacaacaggcaataatgtcagaaaatcatgcttctaa

SEQ ID NO: 78055 - DNA, 354 bp, Glycine max
  Peptide Sequence Number=SeqID_169740
atgaaacatacctccaaactcgaaagtggaggacacatgaacgaaaatgcaattcatggggctccgaaaaatagggggagaatggaggattgccttgagggtccgcacttaggcaatcatgaaacacagctccaaactcgaaaggggaggacgcatgaacgaaaacgcaattcatgggctcctaaaaagtgggagaatggacgatttgccttgagggtccgcacttacgcaatgatgaaacacatctccaaactcgaaagtggagaacgcatgaatgaaatctttatttcatcggctcctaaaaagggtgataatggaggattgcctttagggtccttactcatgcaatcatga

SEQ ID NO: 78056 - DNA, 363 bp, Glycine max
  Peptide Sequence Number=SeqID_169741
atgaccctgagcctaaacagtgttatctcctgctaccttgtcttaggttgtaggagagcatcatctgcagggagcttggttcaaagcaaatttgtcccaaattttgggagtaattatcaagctgtctgtagaatatttccattggatttaatgatgaaatctgtgcaatttcaggttaaaaagaggctaagtcgtgaagtgctaagagtgacagttaagcttagctcatcagttgggctaagcgcgcatccatcgctaagcgaagctttagcacacttagcgcgacaggagaatctggcaaagcatcaatatcagtgtgctaagtgtagcagttgttatcatccaggctcagcgcataactag

SEQ ID NO: 78057 - DNA, 288 bp, Glycine max
  Peptide Sequence Number=SeqID_169742
atgtatttgagcaaaaataggcttgaacacaagaggttacatgatttggtgtttgtcaaatacaaccaacaattgaagcaaagatataatgcaagagatgaaattgatccaatttctcttaatgatattgatgtgtgcaatgaatggctcgtgggagagatggatgaagataatgataatgatgctgaaaatgatttggtatttgaagatgatgatgcactaaattgggcaactgtgtatgaggcttcgggggttggagagtgtaggatgtatactaggcagaaataa

SEQ ID NO: 78058 - DNA, 102 bp, Glycine max
  Peptide Sequence Number=SeqID_169743
atgaaccaagatgctcagggacgggtacgagcaggcactaggctggtggtcagcagatcatcatcccgcaactggctctgcatgttgaggaggccctattaa

SEQ ID NO: 78059 - DNA, 672 bp, Glycine max
  Peptide Sequence Number=SeqID_169744
atggatgattcttatgaaaggaagagaaacagactaactatcaaagagttcttgtgttttaggttgcattctaaaaaagatgaagcacaaactttactgagtaagtatccatctcctgtagatattgatcgtatcatatcagttgagataccagattctattgaacaaccacaactctatgagtgtgtcaagaaacatatgatgcatggtccatgtggtaatgcaaaaaggcagtcatcatgcatgaaagatggaaagtgttctagatatttcccaaaaaatagcaagctgagactattgttaaccaagacgactatcctatttataaaaggcgtaatgatggctcacctcaacatagaatggtgccatcaatcaatgtttatcaagtatttattgaagtacattaataaaggttatgatcgcataaccgcagctcttgtgcctgttgaaaatgaagatggaacaactgaacaatctgttaatgaaattaagcattatcttgatggtagatatatttctccttgtgaagcttgctggagaatattttcattccagattcacaagagatcacctgttgttgaaaggttgtacttttatttgcctggtgagaattcagtcatatttgaagatagtgatgacattgatgccttgctatccaagccaattcgttaa

SEQ ID NO: 78060 - DNA, 288 bp, Glycine max
  Peptide Sequence Number=SeqID_169745
atggaagctattgaacaatggaagctattgagcaattcaaatggtcataacttttcacttgcaggtcctattcaggcgcataatactatgtcaagacacaaaattgaaccgcggaatctctcgagaaattcaaaggtcataactttactcggatgtccgattcaggcgcataatatatcgagatgctcgaaattgaacaacggaagctctcgagaaattcaaatggacataacttttaactcggatgtccgatttaggcgcatcacatatagagacgctcgaaattga

SEQ ID NO: 78061 - DNA, 297 bp, Glycine max
  Peptide Sequence Number=SeqID_169746
atgctgattttgcaaccctttgatcctgaaatagatagaacctttcatagattagttaggcatagtgtgcatcctaatcattctatgcattttgagcattctgagtattctattgctagtgattctgaatattttgattttgagcatttgactactaattttcatactaagaacatggctcaacctccaccacgtgagaggactcttagggagatggctacacctatttcacttatgaaagcttgtgcattcaatatcctaatgagggtgttccatatgctctcaaaactggactaa

SEQ ID NO: 78062 - DNA, 165 bp, Glycine max
  Peptide Sequence Number=SeqID_169747
atggttggattaactcaacataacaatgcaaagcctgttgctgattccagcttttccaaggctaaaccagaacattctttggactcacaaatcaaaccgccagaagcttccaactacaaggcaaggttgaggagggcagattgcaatgccaaggtgcatccctag

SEQ ID NO: 78063 - DNA, 861 bp, Glycine max
  Peptide Sequence Number=SeqID_169748
atggccccgaggaaacttgcctcaaagagatccaggaaggataaggcggccgaaggaactagttccgctcctgagtatgacagtcaccgctttaggagcgcggtacaccagcagcgcttcgaggccatcaagggatggtcatttctccaggagcaacgcgtccagctcagggatgatgagtataccgatttccaggaagaaataggtcgccgacggtgggtatcactggttacccccatggccaagttcgatccagaaatagtcctcgaattttatgccaatgcttggccaacagaggagggcgtgcatgacatgaggtcctgggtgaggggtcagtggatcccgtttgatgcagatgctatcggccagctcctgggatatccgttagtgctggaagagggccaggagtgcgaatatggccagaggaggaaccggtctgatgggttcgatgaggaggccatcgcccagttgctatgtataccggggcaagattttgcccggactgctgccggaagacgggtgcggatcatgcgcaccaacataaccaccctgactcagatatggatgactctgctgctcagcaacatcctgccaccgatcataattccgacctccccatgccgaagtgccagctggtgtatggcgcccactaggcaccctttggacccagataagtccaacagggccctgggattccccgcactgatcacaggactctgccagtcgttcggagtccccgttgcacctaccaaggtgattcggccgcccatcacccgggtttttattgagaagtactgtacccagagacagggtcagggtgatgctccacaggccgcaggcgcgcccccaccacctcattag

SEQ ID NO: 78064 - DNA, 543 bp, Glycine max
  Peptide Sequence Number=SeqID_169749
atgaatctgttctgctcttccatttcttccacagcagtaacggatcatcattccaaggtacgtaaaagcaccaaaaggctcgccagtattccaaggaaaagccaacttcgtgtcccttgttcatccagattattgcctatcaatcctaagcctcaaaatggtgaagttcgcagaaaaggctccaatattcaagttaacaacctatgtggtacttcatcatccactagatatctcctcagtgattgggtttccgagtctgataaaatcccttcacactcacacaagcccacactgcagaaccagattgtggttttgagggtctcattgcattgcaaggcccgtgcaggaaaagttacaaaacacatttcaaaaatggaaggagtaacatcattcagtatagacatggaggcaaagaaagtaacaataatcggacacgtgacaccattaggggttctggcaagtgtgtccaaggtgaagaatgcacagctatggccatcttcaacatcatctttgccatcattgtcttcgtcaatgccgaggtag

SEQ ID NO: 78065 - DNA, 294 bp, Glycine max
  Peptide Sequence Number=SeqID_169750
atgagactgttcgatccatggcctgtattcttcaagcgagaatggaagcgtaactggcccttcttggttggattcgccgtcaccggaactctcatcaccaaactttctcttggtctctctgctaacgtccttctcctcctccttcttcgccaacctccaaaattggatttttgttctgagtctgatttcccttttcgcagaggaggaagccacaaagtcaaaattcgtccaggcacacaagagttcaatgcatgtatttgctacaatgtccggttcttcgtgtgccacgaatag

SEQ ID NO: 78066 - DNA, 1431 bp, Glycine max
  Peptide Sequence Number=SeqID_169751
atggaggaggatgcaagtcttgaatatgatatatttgctgcagttggatggattttggattatacttcactggatgtaagaaatgctacaaatttggaattcaacctaatccctaacagcatgcctaaggcttcttatgcacatcataggacatcattatttgtcaagttctttgcaaatcttcattgttttgttcccaacatatgcgaaggttggttctttgtcaatattcccaaaatttctaggccaaatttgattgttttacaggtcatggagtgcttgcaaatggatttatctaacttgctgccggggttttcttttgcttctgatgctcctaaagctgccattgctagcaagaacctccggggatgcccgtcatctttaactggaaaagaacatgccgatcttaataagaagggtggcaacttcaaggaaggaatgtctgagaattctgcatttccagacatggaccaacataataccagagctgaagacacaaatcaaggcaagggcctaaataggctaaatcaggtagatgataaaggcatagctggtaaaactgcatctggaggagctagagaaatggacaaggatgctcagaatgttgaaacaagtggttcagatagtagttctgcaaaaggaaagaatgttgttgataatatggataatggagagctttcaaaatcgaatgagcgtcttaaaagaactgcagttgaggaaaatccagaggatgaaaagattgaactttcacaaaggagaaaacgaaaacgaacaataatgaatgataagcaggtgatgctgattgagagggcactcaaagatgagcctgatatgcagcgaaatgcagcttcacttcaatcatgggctgataaattaagtgggcatggttccgaggttacatcttcacagcttaaaaattggttgaacaatcgaaaagctaggctagctcgcacagctagggatgttaaagcagcagcaggtgatgacaatcctgtcccagacaagcaaagagggccagtacctgggtcctatgactcacctggcagtccaggtgatgtatcacatgttgcgagaatagcttcaggtgataataaatccgagccttctctggctctggctcggtttgttgatattggttctccagaatttggtcattgcaatgcaggtcaatatgttgtgctcgttggtgtacgacaagacgaaattggcagaggaaaagtgtttcaggtgcatggtaagtggtatgggaagagcttggatgaattatccgcccatgttgtggatattagtgagctcaaagctgataaaggcatgcggctaccttatccatcagaagccactggcaacacatttgcagaagctgaaactaagttaggagtcatgagggtgttatggggttcaaacagagtttttgcattgccacctgaatga

SEQ ID NO: 78067 - DNA, 690 bp, Glycine max
  Peptide Sequence Number=SeqID_169752
atggagcccgatgtggtggttgatgggaagctttctcaaacttgttaccttatggcccttgattcttgctataatcacttaagtcacaaatatgagaaacaagagggaaaacaattttgtatttctgatgcagaatactttgtatttcactatccatacaacaagtttgagaagaagtttgggcaatcatctgttttcatagcttcaacactcttggaagatgggggtgttccaaaagcagcaagttctgctacactcttgaaagaggccatccatgtaattagttgtggttatgaagataagacagaatgggggaaagaggttgggtggatatatggttcagttaccgaagatattttaacaggtttcaagatgcattgtcatggttggagatctgtatactgcatgccaaaaaggcctgcttttaaaggttcaactcctataaatctctcagaccgtctgcatcaagttcttcggtgggctcttggatctgttgagatctttttcagtaggcattgtcccatatggtatggctatatctcttacataaactcagttatttatcctctaacttcaattcccttaattgcctattgtgcattgccaactgtctgtctgctcacagggaagttcattgtccccgaggttaaacatgattttacatcggtgctgacgtcaccaccgatgtag

SEQ ID NO: 78068 - DNA, 246 bp, Glycine max
  Peptide Sequence Number=SeqID_169753
atggttttgaacggtgtacttcttggaaacaattatggggtggcagctcgcgtggctagtgatatgatgggttctggcatatctcatggtggcgatcttgaaggtgggttggagcttggggggcctacgccattggtgctagagagatcaccgacgacgacggtggttgtcggagagtggtggaggtgccgtgagagactccgggaaggagagtacaaagaagaaagaaggaaggcaaagttttga

SEQ ID NO: 78069 - DNA, 1803 bp, Glycine max
  Peptide Sequence Number=SeqID_169754
atgagaatcttggttactggaggagctggattcattgggtctcacttagttgacagattgatggaaaatgaaaaaaatgaggtaattgttgctgacaactacttcactggatccaaggacaacctcaaaaaatggataggtcatccaagatttgagcttatccgtcatgatgtcacggagcctttattgatcgaggttgatcagatctaccatcttgcatgccctgcctctcctattttctacaaatacaatccagtaaagacaataaagacaaatgtgattggcacactgaacatgcttgggcttgcaaagcgagtaggagcaaggattttgcttacatcaacttcagaggtatatggggatcctcttgtgcatccccaacctgaaagttattggggcaatgttaaccctattggagttcgtagttgctatgatgaggggaaacgggtggccgagacattgatgtttgattaccataggcagcatgggattgtccaatgtccaggaacacaaactcgaagtttctgctatgtctctgacctggttgatggccttatccgtctcatgggaggatcaaacaccggaccaatcaaccttggaaacccaggtgaatttacaatgactgaacttgctgagaccgtgaaagagcttattaatccaggtgtggagatcaagatggtggagaacactcctgatgatccgcgacaaagaaaaccagacatcacaaaagcaaaggaattgttgggctgggagccaaaggtcaagttgcgtgatggtcttcctcgtatggaagaggattttcgtctgaggcttgaactgcctcctatgatgggaggagtgtcgggcggcgacgacgacttcgttcaaatccaccaaccgaacaagcccggcgaccctttcatcatcaccttcaattgccccgacaaaaccggtctcgcttgcgatatctgcagaatcattctcgatttcggtctctgcatcaccaaaggagatgtttcaaccgatggagtgtggtgttactttgtgttatgggttattccacactccgtcttgcttcctatcacttgttcttatctgattctcaaagaacgacttcaggaaatttgcccgccttgtttagcctccttttatatcattcagcaaccttccagatcttctcctgtctatctgttgaagttctgttgtctgaaaagtccagaatatgaatataatcagggtatctcttctctgtctcctgcattagccgaggagctagagttatcagataatcaagttcgttctcaagctcttacccctgatatgactaagttgaagaaagccaatgtagcaatagacaattacttaagcccagctcacacgctagttcaaatacgatgtgctgatcacaagggtcgtctttatgacattatgaggactttgaaggacatgaatatgaagaacgatgggaaaaagattttggatcgggagaagcagagtgcactctgctctcatttgaaacaagaaatgcttcatccattgcgagtaatcattgcaaaccgaggaccagatactgaactgttggtcgctaatccagttgagctatctggaatcggaagacctcgagttttttatgatgtcacatttgctctcaaaacacttggaatttgtgttttctcggctgaagtaggacggcattcaacttcagagcgtgaatgggaagtgtacagatttctcttggatgagaactgtgagtttcaattaacaggtgttgctgctagaaataagattgtaaatagggttcgaagaaccttaatgggttggtaa

SEQ ID NO: 78070 - DNA, 1680 bp, Glycine max
  Peptide Sequence Number=SeqID_169755
atggacgtatcagagaggaatttggatggagagaacagtgtaagacgaaggagcagaaaaaaatctatgtctgggactgcgagtggagcacgagagcataaggagcaattgcagaaacttcaggacaaggatcctgaattttatgagttcttgaaagagcatgacaaggagttgcttcaattcagtgatgatgatgtagatgaagatgtgggtactgacacagaagatggagacctacagctagatgaggaggctagtgaggatgagattcaagagaaggaacaaaaatcctctaaggaagttataactacttctatggttgatttgtggtgcaaatcaattcaagaaagtgggagcttgagtgcggttcgttcactgatgagggcttttaggacagcatgtcactatggtgatgatggggggaatgaatctatggcaaagcttagtgtaatgtctagcactgtattcaacaaaataatgttgactgtacttactgaaatggatagaatactaagaaatttgttgaagcttcctgcttctggtggaaagaaagagaccataacagatttagtggccacaaagcattggaagagtcatggccatttagtaaagtcttaccttggaaatgctctccatgttttgaaccaaatgactgacacagaaatgatatcatttactttacgtcggctgaaatattctttgttgttcttggctgcttttccttcactcctaagaaaatacattaaggtggtccttcatttctggggtactggtggaggtgcccttccggttgtttcgtttctatttatgagagatttatgtatccgtattggatctggctgcatagatgaatgcttcaaaggaatatataaagcttatgttttgaattgccactttgtaaatgctgtgaaacttaaacatatccgttttcttggaaattgtgtcattgaacttcttggcgtggatcttccaactgcatatcaacatgccttcacttacatccggcaactggctacaattttaagggaggcacttaatacaaagactaaggaatcttttcggaaggtttatgaatggaaattcataaactgccttgaactttggactggggctatctgtgcctacagttcagagtctgactttaagcaacttgcatatccattgacccaaataatttctggggtagcccgtctagttcccacggccagatattttccccttaggttgagatgtgtaagaatgctgaaccagattgcagcttctacacattcttttataccagtgtctatgcttcttttggacatgctggagatgaaagaattgaatagaccccctacaggaggtgttggcaaagctgttgacttacacagtatactgaaggttagcaagctgaccctaaagacacgagcatttcaagaggcatgtgttatttctgtggttgaagagcttgctgaacacttggcacagtggagttattctgttgcattcttggagttgtcttttattccacttgtgaggttgcgtagcttttgcaaatcgaccaaagttgagaggtttcgaaaagaaatgaggcagcttatacgccagattgaggctagttctgactatgtgaatggaaagcgcctgtcaatttccttttttcctaatgaccctgcagcagcatctttccttgaggtttga

SEQ ID NO: 78071 - DNA, 933 bp, Glycine max
  Peptide Sequence Number=SeqID_169756
atggttttctcttctattccggtctatttagatcctcccaattggcagcagcaacaacaaaatcaacaccaagcaaatggaagtaacagtcctcatgagctgcttccgccgctgcctcagccgccacaggcccctcacgtgggggttgaatccgagcaaatccggtccggtctgatggcggatcgggccaagattccggcaccggaaggagttctgaagtgtcctcggtgtgaatccaccaacacaaagttttgctacttcaacaattacagcctctctcagccaaggcacttctgcaagacatgtaggcgttattggacaagaggtggtgctctcaggaacgttcctgttggtggaggatgccgtaggaacaaaaagaacaaaaggtctcgctccaaatctccggtttctactgagaaaccatcacttcccaataatacaagtgcaatccctgagcttattggtcgtttcccacaacctttcatggcctctcttcagagtatgaaccgctatggtgtagggattaacacaggtgttaacttgcgtgagattcaagcacagaacgcttctcaaatggagtttcaaattggaggtcttggcaatggttcaagcgttgctactgcaggaggaggtggaggaggaggagtggagcagtggcggtttcagcagtttcctttcttgaatggttttgagtcaacttcagctgcttctaattcctacccttttcaaagtgaaattgttgaaggtttggttggagatattaatgccacaagttctaggattactcagctgccagcacgggttaaaatggaatataacggtggcttgaatttgtcaagatctcctttgaatgtctcagaaaatagtaaccatttctattcatggacggatttatctggtcttgcatcttcttcagcgagtcatctcttgtaa

SEQ ID NO: 78072 - DNA, 534 bp, Glycine max
  Peptide Sequence Number=SeqID_169757
atgaatccggataagttaagaacatatcacgtacgccccaccctttcctcctctggcatcctcagtccccacgagcccttcactttctcctaccctacatccctctctgtggagttctccttctccgtctttagcaacggccacgacctactcctcgtgctcgctgtcggtgacaacatatcaaactacgtcggtgtggagttcgacaagtccaaggacaacaacatcccctcagttgttatgctcgctcggttgttactctccatgcgcaaatttatgatgcagtggaggttgtggccccctctcgtctcaaagaagtatgaggtgaaagtcatcgtgaagaccttaattctccaaggctgtgatctaattaagtggaagggtcccaaacttaccttaagctttttgcaatgcaacgttgttgctagaaacttcaccaaagaggcacaccctgagcaaaaggatgacctcgttttgtgggatgaggagtttcacgccctccgcacaacgtgttcaaagaccattgttaactag

SEQ ID NO: 78073 - DNA, 2151 bp, Glycine max
  Peptide Sequence Number=SeqID_169758
atgcattgcattgcagcacggcagaaagagaaggctacaagttcagtaactgagttgctgcaggccatgaagcgcccccgagcattaagtgaatccgcaagccgtccctccatcagaaaatcaggatctagatcttcagacgaagaaaaattagaacaagaacaagaagatgacaaagagaaagcacaaaaaacattaagaagaatatctgagagtggagcttcatttggacgcaagtccgaaggatcaggaaatagaatttcaatggaaagaatcagtgaactgcccgaaaataaacacagaaactctcaacgacgttctttcatggggttcaggaggaaaagtcagtccaatgatgaaagcatggatagtgaagtcattgaggacgagagctctgagagtgaggatgatgagaggcctaatagttttgaattagatgacaaagaaaagcagagggaaaagcgaaaaggtcttgatcttgctaccacgcttgaacgtattgagaaaaacttcgtcattactgatccaaggcttccagacaatcctataatctttgcatcggatagcttcttagagcttacagaatatagtcgtgaagaaatcttgggaaggaattgcaggtttctgcaaggacctgaaactgatccagcaactgtgaacaaaattagagaggcaattgacaaccaaacagaagttaccgtgcaactaatcaattatacaaagagtggtaagatttctctgttcaatccaggaaagaagttctggaacctgtttcatttgcaacctatgcgtgatcagaagggagaagtgcagtattttattggtgttcaacttgatggtagtcaacatgtagagcctcttcacaactgcatcgcagaagatactgcaaaggagggagaacaattggtaaaacaaactgcagaaaatgtcgatgaggcagtgagagatcttccggatgctaataagagcatttggcttcaattgtggcatgaccatccttttggcgctctccagaaaccagatgatttatggacaaatcattcaaaaacagttcacccgaaacctcataggaaggatgaccctgcatggaaagctatccagaaggtcctagaaagtggagaacagataggcttaaagcatttcaggccaattaaaccattggggtcaggagatactggcagtgtgcatctggtggagctacgtggaactggtcaatattttgcgatgaaagctatggataagggtgttatgctcaatcgtaataaggtgcatagagcttgcgcagagagagaaattcttgacaagttggaccacccttttctacctgcattatatgcttccttccagaccaaaacacacgtttgtttgattactgattattgtcctgggggagaactattcctgcttcttgatcggcagccgactaaggttctcaaggaagatgccgtgagattttatgcagcagaggtagtgatcgtattggagtaccttcattgccaaggaataatatatcgagatttgaagccagaaaatgtgttactccagagcaatgggcatgtgtccctaacagattttgatttgtcatgtttaacatctagcaagccacagcttataattccagctaccaattcaaagaagaagaaaaagaagaaacagaaaagtcaagaggttccaatgtttatggcagaaccaatgagagcatcaaattcttttgttggcacggaagagtacattgctccggaaattataactggttcaggtcacacaagtgctgtggattggtgggctctaggtattctaatatatgaaatgctttatgggtatacgccattccgggggaaaacaagacaaaaaacatttgcaaatattcttcacaaggaccttaaatttcccaaaagtaaaccggtaagtctccagggaaagcagctaatttactggttgttgcagagagatcctaaagacagattgggttcacgtgaaggagcaaatgaaattaaacgtcatcctttcttccggggtgtcaattgggcactagttcgttgcatgaaacctcctgagcttgatgctcctctcttaccggaaactgaagaagaaaaagaagccaaagatatacatcctgggctagaggatctgcagacaaatattttctaa

SEQ ID NO: 78074 - DNA, 174 bp, Glycine max
  Peptide Sequence Number=SeqID_169759
atgggtcaacagccagtgaatgcaaggattgaattggtcagaaacagtgagaatggggggtcaatatcatttaacaccttactcactggctctccgtcttcttctacagattcctcatcagatttagacactgaggtcagtaaaacattaaccaaaattatagtatatgggtaa

SEQ ID NO: 78075 - DNA, 414 bp, Glycine max
  Peptide Sequence Number=SeqID_169760
atgtctggtgtttgggtttttgacaagaaaggagtggcgaggctcataacaaacccaacaagggaatccttcgagcagaaagagccaagacaacctggtacagccaccgcacccggtgcaagaccaagagtcttggtgtatctcccaagcaaccaggtcattcgttcctacgccgaactcgagcagcgactcactgaactcggttggactcgctaccgtgactcggaccgctctgacctcatccagttccaccgctcagacacctcctcccaccttatctccctccccaaaaacttctccaactttaagcacttccacttctacgacatcgtcgttaaaaatcgctctttctttcaagttcgtgaccccactatgcaataccaagactattgtgacaacgatatttcaagttaa

SEQ ID NO: 78076 - DNA, 1989 bp, Glycine max
  Peptide Sequence Number=SeqID_169761
atggtgttgcagaagaggttagactatagcttttatggctatcaggtgccaaccaagcgccgagctacccgattagctaagaggagggttacatttcaaagaaggttggaagacaatcagatgtgtgcatttgacttattggccactgtagctgacaatttattgcaagagaaacagaatccaaccacatccagtgatagatcatcggaaaaggatggggatggatttcctaaagaggaacgccaggatgcaaataaaccattcaaaactgagctttctgatgaagcaagttgtgacagaaaatgtcagcttgaatttgttaaagaaggaagctcaaatgcaaatagtttcaaagttgagctttcggatgaaggaagtagtgacagaaaatgtttctctaatatttcttcacaagtctacaatcaaaattgttgttcgaaggaactccccgaacatgaaattgatggccatttatgcattgcttctatagtaacaagttctagttgctcagagaagattgttgctgagacactggtggatggaaaaggccacaatgggatggaaaaattagctagcaaagttgaattaggttcctgtggatatctagagagtaggggttgcaagttagatggtgatgttagtaaagtaaaagacgataagtttgggaaggttcccattgatactgggactgggttgtgctgttttgaggataccttggatgaaaaacctctagcactgatcagttcatgtggcaatgccaagatgtccgggtatgatgacagcatgcctcagagctcatggtccaaaggttgtgacaatgtactggtagatagtagagatgatgacgaaaacttttctgggggtacaagaattggtaaaggagaagggatggaaaaaggaatagagaaaatgatgagaaagaagagaggattccctaggggagagttctcagctttaggtagtggatttggaccttcgtactcgcgcttagcacgctctgctcgctcagcgcagttatcaatgcagatcatggaacatcatccttgggacactctgcattacgatctagagattcttacgatgtctttcttttatccagtgaagcttaggatcaaatcatttagagtgcccgagctttttatcgagattccagaaactgcaaccgttgggtccttgaagaggacagtgatggaggcagtgactgctgtacttggaggcggattgcgtgtgggtgtgattctccatggaaagaaggttagagatgacagtaaaactctacttcagactggaatttctcatgataaccacctggatgctttgggcttcgccttggagcctaattgttcacgaaaccgaccatctgcatgtgctacaacagattctctccacattcctagtgcagatatgcctcagcctttaatagggtacccttcaagtcctgctgtaattcatcagaggattcagggcttttctaacatgttagccaagcatcaagcaaccagttcaggtaaccttgttgaaagtgatcatgattcagcaccttctcctatcaacacatccggtgaaaaatatttgtcagattcaaaagaactaattactgttcctgaaatgggtatggaggcactagctgtgctacctgtgcatcagaagtcaaaacgaactgagatcgcacagcgccgaattcgtaggcctttttctgttactgaagtggaagcactggttcaagcagttgagaaacttggaactggaaggtggcgcgatgttaaacttcgtgcatttgacaatgcaaagcatcggacatacgtggatttgaaggataaatggaaaacactggtgcacacagcaagaatatcagctcagcaaaggaggggagagcctgttccccaagaacttttggacagggtcctaactgctcacgcatattggtcccagcaacagactaagcaacagcttaagcaccactcaacaaaaccttgccttctcctttag

SEQ ID NO: 78077 - DNA, 267 bp, Glycine max
  Peptide Sequence Number=SeqID_169762
atgaaggtgaatcaattagagcatataactatagaacctgatgatgaaccaaaccaagtagtatctcgtagactcagacaatctccaactgatccaaagaaaatagcttttctgtggaaggttgatagcaacatccaaataacagaacacatagagactgcagcagtcccaaactacacaacagacaacaaagaggaattcacagctatgaatagcagaagcaaacgtgacactcacaggcccaaataccttgcagattacgtgtga

SEQ ID NO: 78078 - DNA, 252 bp, Glycine max
  Peptide Sequence Number=SeqID_169763
atgaagaaggaagacacagtgaagctgatcagtgccgaaggttttgaatttgtggtcgacaaagaagctgcaatggtttcacagaccatacataacatgcttacttctccagggagtttcgctgagaggcagcacggcgaagttacctttcctgagatcagcaccaccattctcgagaagatttgccagtacttttattggcatctccaattcgccagcgcttggttctcggttaaaaaagattttccatga

SEQ ID NO: 78079 - DNA, 381 bp, Glycine max
  Peptide Sequence Number=SeqID_169764
atggaagacaaagcgaacatgatgatcataaagaggagtagtagagggggaggatgccctacaaggttacagaagcatgctccggcttctcttgacactgataaggttcttgttgatcgtccttcaaacccttttggggaggcttcaagggcaataccattgttatctccactcgttctttctccacagccaacttatgcagacattactattcaagttggaacatcagagaagaatgagagtgctgcatgtgcatcatcctccactccgagtccaaccacaggctgggaacatccagctatcatttcatttcccgagccatcatctactttgtgtagtttcttccaaaagcaatgcgtatttctgaaccatccccggtga

SEQ ID NO: 78080 - DNA, 2415 bp, Glycine max
  Peptide Sequence Number=SeqID_169765
atggctgcaactccttccaaatcctttcaaactccctccaaccccaaactccgatccaaatccaatcccaaatcctcgccggctgtaacccccgacactccacaaaccctacatattcgcagatccacgcgtgccaagtccctcctcttcgatgctcccaagcctccccacagtccgctccaaatctcgctcacaactccgaagcggaggacgcgacgatccattgttgaggaggattccgccgaagataaagccacacccagcaaaatttcacctaaaaataaagctccggtcgtcgatgcgtcgaagaagaagaatgggaagagctcaattgaatttttctttgctccggtaacaccagcttcatcagaaaaggcatccactaggaagagggagggtgaggggggtgttgtttccagagctaaaagggggaaatcggaaaatcgtgaaaagagtgcaaaattgcctcagaggcgcgtgtattacaaaaaagtgatttacgatggaggcgagtttgaattgggggatgatgtttatgtgaagaggagagaagatgctagctccgatgatgaagatcccgaaatggaggagtgtaggatgtgtttttcctctaacgatgaggtcatgattgagtgtgacgattgtttgggtgggtttcatttgaaatgcttgaggcctccattgaaggatgttcccgaaggggattggatctgtgggttctgtgaggctcgtaagatgggtaaggaagttcagttaccaaagcctccgaagggtaagaaactagttagaactatgagggagaagctcctttccagtgatttgtggtctggtcgtgttgaaagcatatggagagaggtagatggcaactattggtgtcgggtgcgctggtatacaatcccggaagagacttctgttgggcggcaacctcataacctgaggagggagctatatcgaactaatgattttgctgacatcgagatatcaaataaaggagaattgggatgtcataataatgaaacagttgatgcagctaacgcttacattataaggatgatcctcaggtcaggcataatgttcaagatggaatctgtccttagacattgccatgtcatgacccccaaagaatatgctaaagctagcaatgagggagatgatgttttcttatgtgagtatgagtatgacatccattggcacagcttcaaacgtcttgctgacattgacaatgaaacagagaatggtgaagagtctgacagtgatgaagactggaatgttggcaaggaatcagactccgatacagatgaagatgttgaatatgaagaagaaaatattaaaaatgcacaatctcagccatcaagaagccatcacttagctgcaaatctgtacaagggacggttctttggacttcaaaagataggcacaaaaacgattccacagcatgtaagatctcacaaacagactgatcttgagagagcaaaggctacactgttgttggcgtcactgccaaaatctttaccttgtagaaataaagaaatggaggagataactacattcatcaaaggtgctatttctaatgatcaatgtctggggcgttgcctctacattcatggtgttccgggaactggcaagacaatgagtgtactgtcagtaatgagaagtttgaagtcagaagttgatgcaggaaacatcaaaccatactcttttgtggagattaatggtctgaaattggcatcaccagagaatatttataaggttatttatgaggcactaaatggccacagggtcagctggaaaaaggctctccacttgctaaatgagagatttgtagaaggaaagaaaaccagagatgaggctgaccagccatgtattttgcttattgatgaacttgatcttctagtaaccagaaaccagtcggttctgtacaatattcttgactggcctactaagccacattccaagctaattgtcatagggatagcaaatactatggatcttccagagaagttacttcctcgtatatcaagccgaatgggcatacagaggctttgctttggcccatataattatcagcagcttcaagaaatcatttcaagtcgcctcaagggaattgatgtatttgaaaagcaagctgtagaatttgcttcaagaaaggttgcagcaatctctggagatgcacgtcgtgctttggagatatgcagacgtgcagccgaaatagcagattatcgtgttaagaagctaatttctaatcctgattgtgttactgcaggaaagggacttgttggaatggtagatgttgaggcagccattcaagaaatgttccaagcacctcatattcaaggcttacacagtgaacgaagtcttgagacatataagctgcctggaccagtcattataggacacagtaaagaagtaaaatag

SEQ ID NO: 78081 - DNA, 3048 bp, Glycine max
  Peptide Sequence Number=SeqID_169766
atgggatcgttgaagacggaggaagatctgaaggtgtctaatgaggctatcttatatgttaacggagttcgcagattgctgtctgatggattagctcatttcactcttctcgaacactatgctatcaatgcttgcttagcacctctatattctgtagaaggcatgcatgtgattacagtggagggattgggaagctgcaagcgtggactacaccctgtccaggaatccctggctcgggctcatggttcacaatgtggattttgtactcctggttttgttatgtccatgtatgcattattacggtcaagtcaaacaccacctagtgaagaacaaattgaagaatgccttgcaggaaatttatgtcggtgcactggttacagaccaatatttgatgcattccgggtctttgcaaaaactagcaatgacttatatactggggtttcttcattgagccttgaagaaggaaagtctgtttgcccatcaacaggaaaaccctgttcatgtaatttaagcaatacaaatgataaatgcgtaggtggtgataatggatatgaacctacttcctataatgaaatagatgggaccaaatacacagaaagggaacttatttttcctcctgaactgttgttaaggacaccaacctcattaaatttgactggatttggtgggctaatgtggtatcggcctttaacacttcaacatgtattggatttaaaagccaaatacactgatgcaaagttgctagttggtaatactgaggtaggaattgagatgagactaaagagaatgccgtatcgggttctaatttctgtaatgcatgtgccagaattaaatgttttgggtgcaaaggatgatggcttagagataggtgctgcagtaagactatctgatcttatgaattttttcaaaaaggttgtaactgagcgagctgctcatgaaactttgtcttgtaaggcttttattgagcaacttaaatggtttgctggaacacagataagaaatgctgcatcagttggcgggaatatatgtactgccagtccaatatcagatctgaatcctctatggatggcagctagagcaaaatttcgaattattgatgctaaaggaaacatcaggacagtcctggccgaaaatttcttcctcccgggttaccgtaaagtgaatttagcaagtggtgaaatcttgctgtcagtattcctgccttggaataggacttttgagtttgtgaaagaatttaaacagtctcatagaagggatgatgatattgcaattgtaaatgcaggtattcgtgttcatcttcaggaacatagtgaaaactgtgtggttgctgatgcatcaatattttatggtggggtggctccatattcacttgcagcaacaaaaactaaggaatttctcataggaaagaattggaaccaagatctgttgcaaaatgcattgaaagtcctacaaaaggatatattactcaaggaagatgctcctggcggaatggtagagttccggaaatctttgactctaagtttcttttttaaattttttctgtgggtgtctcatcaaatggatagcgtcaaagagagtataccatcatcccatctatctgctgtgcactcagtccaccgaccaccagttactggatctcaggactatgaaatcaggaaacgtgggacttctgtgggttctccagaggttcatctatctgcaagacttcaggttacaggagaagcagaatatgctgatgacacaccaatgcctcccaacggtttgcatgctgccttagttttgagtaagaaacctcatgcccgaataattaaaattgatgattcagaggccatatcttcgcctggatttgtgagcttatttctggccaaagatgtaccgagtgataataaaattggaccggttgttgctgatgaggatctctttgctgtagattatgtcacttgtgtgggacaggttataggagtagttgtggccgatactcatgaaaatgcaaagattgctgcacgaaaagttattgttgagtatgaagagctcccagccatcctttcaatacgggatgccatcaatgctagaagttttcatcccaatacagaaaagtgtttgagtaaaggtgatgttgatcactgttttcaatcaggtcagtgtgaccgaataattgaaggggaagttcagatgggaggtcaggaacacttttatctggagccacatagcactttgatatggacagtggatggtggaaatgaagttcatatgatatcatctagtcaactgttgtggttggagagcccaaggctttataaaccccacattagattcctatacttccagcgtgggactcaagtcccataccttgctcctcagaagcaccagaaatatgtttcccatgttcttggccttcccatgtcaaaggtagtttgcaaaacaaagcgaattggtggtggatttggggggaaggagacaagatcagcctttattgctgctgctgcttcagttccatcttatctgttaaatcgaccagtgaaaatcacactggaccgagatgtagacatgatgataactgggcaacgccatagttttctagggaagtacaaggttggatttacaaatgaagggagggtgcttgcgctggatcttgaaatttataacaatgctggaaactcactggatctgtcgcttgctatccttgaacgtgctatgtttcattcagacaatgtgtatgaaataccaaatatgagggtaatggggagagcttgctttactaatttccctagccacactgctttccgtggatttggtggtcctcaaggattgctcattgctgaaaactggattcaaaggattgctgtggaactcaagatgagtccagaaaagataagggcacgcaaagaagttgacgaattcaatagtcacaaccgctggaggaagcgtggcattgctatgattcctaataagtttggtatatcctttacgacaaagcttatgaaccagtttctggcacaagactgggtagctgctgtcagggagcttcagagcttatttctaacctag

SEQ ID NO: 78082 - DNA, 1053 bp, Glycine max
  Peptide Sequence Number=SeqID_169767
atgactcatccctactgctctaatgacttgaatgcttggtttgacctcaattctccatgccttttttccaattcttcatcaccttgctccaataacccaccattctactttcctactactaatattagttaccgtcataactgcacaaataatggcatctcttttactcagcatattcaatcttctcccagctcctttcctcctccaaaagaagcacttactctccttaacctaagccccgcaagaggtgaagatcttgatcttgaatcttccttcagtgccatgaaagtcaacaaagagaaggagaaagaattactaagcatcatgtcttctaataataactctttggatgatgaaactgtgacggtggctttgcacttagggcttccaagcactactgctacttcatcagctgatttaacttcaaacatgtactcagaaaaagaagaaaaagccacttttgcttctgagtattctccgactagaattaacaagggtcagtattggatccctacccctgctcaaattctgatcggtccaacacggttctcatgccccctttgttgcaagacgttcaacagatacaacaacatgcagatgcatatgtgggggcatggatctcaatatagaaaggggccagagtctctaaggggaactcaaccaacagcaatgcttagactcccttgctattgctgtgcacaaggatgcaagaacaacattgaccatccaagagcaaagccactcaaagactttaggaccctccaaacccattacaagagaaagcatggaatcaagcctttcatgtgtagaaaatgttgcaaagcatttgctgtgaggggtgattggaggactcacgagaaaaactgtgggaagctatggtattgctcttgtgggtccgattttaagcacaagagatctctcaaagatcatatcaaggcatttgggaatggacatagagcttatggaatcgactcatgtcttgatcaagatgatgaaccgggctcagaaattgagcaggaaaataatgaatctttaatttccaatcatagttga

SEQ ID NO: 78083 - DNA, 255 bp, Glycine max
  Peptide Sequence Number=SeqID_169768
atggatcatgggggtaggggcttgtaccatgttaacatcgaccctttgagggaagtggaaaataccttgcacatcacaacatcgtcattggagtacaggttgacctgggtggtaaatgtgcctaagtgttcgtttggatccgaggtgccatcatatctttcaatgttcagggaattccatgttatgggtagagggatggggagtgaggtggagttagtggtggtgggggtggtggaggtgggtgctggattataa

SEQ ID NO: 78084 - DNA, 2085 bp, Glycine max
  Peptide Sequence Number=SeqID_169769
atgcataaaccagcagaggcactagactttgctctcaaggagacttcacccaacataggtgcgggtgctgtaatgagggacaagctttcctgtacctatgacctggttgaacaaatgcagtacctctatgttagagtggtgaaagccaaggatttgccagggaaagatgttactggtggtgtggatccctatgttgaagtgaagcttggaaactacaagggccttaccaagcactttgagaaaaattccaatcctcagtggaatcaggtttttgccttctccaaagaaaggattcaagcttctgttctggaggtggtgatcaaagacaaggatgttgttgtggatgacttcgtagggagagtgatgtttgatattaatgaaatcccaaaacgtgtgcctccagatagccctttggctccacagtggtacaggctagaagataggaggggtggcaaagccaaaggagagttaatgttggcggtttggatgggaactcaagcagacgaggcatttcctgatgcatggcattctgatgcagcaactgttggtcctgaagctgttgcaaacataagatcaaaggtttacctttcacctaagctttggtatgtcagggtcaatgttattgaggctcaagacttggtaccaagtgacaaaacccggtatcctgaagtctttgtgaaggctaatctgggggttcagtttttaagaactagagtatctcaaagtaaaaccataaatccaatgtggaatgaggacttgatgtttgttgctgctgagccatttgaggagcccttggttctgactgcagaggacagggttggaccaagcaaggatgagatcctgggaaggtgtgtgattcctttacacaatgtgcaaaggaggttggaccacaagcctgtgaacacaaagtggtttaatctggaaaagcatgtggttgttgaaggggaacagaagaagaaggagatcaagttctcaagtaggatacatctgagggtttgcttggaaggtggctaccatgtgttggatgaatcaacacactatagtagtgatcttaggccaactgcaaagcagctgtggaaggctagcattggaattctggaagttgggattataagtgcacaagggttgatgccaatgaagacaagagatggtagaggaaccacagatgcttattgtgtagcaaaatatgggcagaagtggatccgtactaggacaattgtggatagtcttgctccaaggtggaatgagcaatacatttgggaggtttttgatccatgtactgttatcacagttggggtttttgataatggtcacttacatgggggagacaaatcaggtggatcaaaagattcaagaatagggaaggtgagaattaggctatccactcttgaagctgatagggtgtacacacactcttatcctcttttggtactgcacaattcaggtgtgaagaaaatgggagaagtgcaattggctgtaagattcacaagcttatctttgataaacatgctgtgtatgtattcacagccattgttgccaaagttgcattacatccatcctctatctgtgattcagctagacactcttaggcatcaagctatcaagattgtgtcaatgaggttgagcagggctgagccaccactgaggaaagaggtggtggaatacatgctagatgtagattcacacatgtggagtatgagaaggagcaaagctaatttcttcagaataaccaaagttctaggagggttgttagcctttggaaggccaagacaccctcctcatatggacacaagactatcacatgctgatgctgctcatcctgatgaactagatgaagagtttgatacattcccaacttcacgatcatcggatatggttaggatgaggtatgatcgcttaagaagcattgccgggaaggtccaaactgttgtaggtgacttggccactcaaggagaaagtagttctctatgtcactcccttccaagttgtgttccttctaattggcttctatttgctaaggcaccccagattccgccagaaacatccttcagtcccattcaactacttcaagaggttgccagctag

SEQ ID NO: 78085 - DNA, 510 bp, Glycine max
  Peptide Sequence Number=SeqID_169770
atggggaccgcaacagcaggaggatgggaatggcacctagagtggagaaggttttttagggaagtggaggttgatatagttgcaaaattaatgaaggacattgaggctgtgacagtgcaagtgaatcagcaggataattgggggtggagaatactgcctctttggtgggaatcactgacttggctgaatataaaggctgttttcccaaaatcacctagagaccatttccttcaacatgaccatggttatatcaagggttttatctatcagcgatggcaaatatggtggacttccttaacctggtgcatttggtttcaacgaaacagaattatctttgaaaatgaaaggtttactgatcagaagttgatggaggatgccattttctactgctggagttggctcaaaaatctggaaaaaggatttgatattccttttcactcatgggaaagcaacataagggttggttttgtaatcggggggggggggggggattgttctataggtttttga

SEQ ID NO: 78086 - DNA, 1086 bp, Glycine max
  Peptide Sequence Number=SeqID_169771
atggcgacgaagcagcttccgcagatcgccattctgggagctggtatctttgtgaagactcagtaccttccgagactctccgagatctctcatcttttcattctgaaatccatttggagccgcactcaggaatcagctacagctgccgtagacatagctcgtaagcattttccccaagtagagactaagtggggagataacggttttgatgacatcattcacgatggatcaatcgatgctgttgccgtggtcttggctggacaaaatcaggttgacatctcactcaggttgctaaaggctggtaaacatgtccttcaaggtacaagtgaattggaagctgcattgtctagctacaaatctatttcttctgatgctcccggtcaattaatttggtctgtggctgaaaattatcgatttgagcctggcttagtagagtgcaagaaactaattgctggcattgggaaaatgatgagtgtccaagtcattattgaaggatcaatgaacagttcaaacccctatttttcaagctcttggaggcgcaatttcactggaggtttcattcttgatatgggtgtgcatttcattgcagggttaagaatgcttgttgggtgtgagattgtttcagtttcagctatgacatctcatgtggatttgaccttacctcccccagataatatatcatctgtctttcatttggagaatggatgttcaggagtgtttgtaatgaccttgtggcgagttgttggcttgaatggaaccctgcaagttgagcgtggattccaaggacaacatggttacctggtaggatccgagctttactttaaaatcactgaagttgcaacctattttaaccaaagcactgtttcattttatggtaccgatggacaaaacaaaagctcttttttcccattcagtggagtaactgaagaattaaaagcttttattaatgatgtatctgaaatcaccctcaagcagaagcggaatcagtttgtgactgagcctcgcctctcttatgtcgaaggtgcaagagatgttgctgtgttagaggcaatgcttgaatctggagctaggcaaggatttgcataa

SEQ ID NO: 78087 - DNA, 1350 bp, Glycine max
  Peptide Sequence Number=SeqID_169772
atgagtttgacagcaaatggcactgtcttctgcatggaacctgaacataaaatgacaggtcatcacttttgtaatcttagaaaccaagttgatgttattttcccgcgagtatcatcagacggcaacatgaaattgcggcattcgctatctgttgaggacaaaagttacgctgttaattcgtttcatctttttgctaatgtgttggtagctttttggttgttcctggtggcaatctctttctttctcttgagcaaagatgtcaatgtttttggcggttttagaggaaaacatgcagagaaagtttcttcatctgacagaagaaccatctcaaatgcaaccacagaggatgatacaaatgatacgtttagctggagtgagctatgcaccaagtgtgatgcttactgtgagatttcagattttgataagccaagttacatgcattctttacttagtcttgaaggtgaagattctgagtggctctcagattcaatgccttatgggctttcatatgaggacccttcaacacctcctagttacaagtgtgatgcttactatgagatttcagattttgagcaaggaagttacttccactctttactcagtcttgaagatgaggattcagagtggctctcagattccaattcttttggatggtcatctgagaacccttcaactcctcttaactccaagtgtgatgctttttctgatattttagatttgaacaaatcaagttacatgcatcccctaatcagtcttgaagatgaagactccgactggctctcagattccaagtcttgtggattttcatctgagaattcaactcctcttagctacaagtatgatgcttactatgagatttcagatttggacaaagcaagttacttgctttccctactcattcttgaagatgaagactctgagtggctctcagattcgagtagttggagtattgtggttcctccttcagtctctactagctcctcattcactggagtacagtgtggcaactcagaagaagagttcagtgctgatgaaccacttttttggccatttgaagggaaactcaattggaattctgaggaaccttggagcaatgaagctctatgcattgtgaactatgaaacgtcaaagttaagcatgtgggctaaaagttcagcaaagatagtgcctcttcttgagtgtgaacattttgattcaaacaaggaccagcttcttttgggaaaagagtattttgatttgtgtcaagagcttaccattgagacattggtggggctcaaggaatttgatggacatgaggggcttgattcggaattcgatgatgtatctctgctggacgaatatctccaataa

SEQ ID NO: 78088 - DNA, 591 bp, Glycine max
  Peptide Sequence Number=SeqID_169773
atggcgttgaacaatggcgtccccgccaccggcaccggcctcatcgtcagcttcggtgagatgctcatcgacttcgtccccaccgtctctggcgtgtccctggccgaggcccctggcttcctcaaggcccccggcggcgcccccgctaacgtcgccatcgccgtgtcgcgcctcggcggcaaagccgccttcgtcggcaagctcggcgacgacgagttcggccacatgctcgccggaatcctcaaggaaaacggcgttcgcgccgacggcatcaactttgaccagggcgcacgcaccgccctggccttcgtgaccctacgcgccgacggggagcgtgagttcatgttctacagaaaccccagcgccgacatgctcctcaagcccgaagaactcaatctcgaactcatcagatctgggagaatccgtgaggtcacgcgcgtgagggaacacgtgggcttagggtggacgatggattatgcgcttggtggtgttatgtatttgactgttgctggtttggatttctgcgtttgtttagtcaccgtgctatatcttgctgtgttggctttgaccaacactcccacgcgattctag

SEQ ID NO: 78089 - DNA, 1710 bp, Glycine max
  Peptide Sequence Number=SeqID_169774
atggagttgtggaaaagctggggcagtaaatttgcggaaagtgagttccatcgtgcgcgacattggggatccctgcctttcgcagtcgcctgtaaagtattcttcatggagcaggtaaacagaatgcttaagccagacaaatggcaagccatgtccgatagtgaaggaaaggtgtttggtttccggaaggcactaaaattgattgtattagggggtgtagatccatcaataagacctgaagtttgggagtttttactaggttgttattcgttgagcagcactgctgagtatcgaagaaggttgagagcagctagaagtgtcggaactggttcgttggcatatgttgttggatccaaattaatggatctgaggacttcatccaaagatggacggaaatcgcaagctaaaatagaagaatcaacttataatgataataatgttgaagtaggaaaatgttatgataggaacattatttgtacagaaggagaaaattcaagccattgggaaagctccaataatggggttgacctagttagcttgagagtatgcactgataatgcagcatgcgattcttctggtcaacgaaactccagttccccaaagttagggggagaagtagaggaatcagactgtgtaactgaatgtagttttgattttcctcctttatcggtcactaatctgtttgagaagagtggtaaagataaaaattcaggcacagagcatggggataaacttcctgctccaggccaatcaagatttgaagttgacagtatgcgtagctttcgaattaataacaatgtagatttagttattgaatcgaattgccaacaacctcttgctaccttacatcccatggactctgaaattggaattgcttcacctgatgaggaagaaccagaacttctgtctgagaatcaagtttatgaagcacagatggtaactcaactgaaaatatcagatgtaccacagccagcaatgataagatccccaatttctcaaggatggcctatcagtgaagagagagtatcagaatggctttggaccttgcataggatagttgttgatgttgtgaggactgatagtcatcttgaattctacgaggacacgagaaatttagctaggatgtcagatattcttgctgtctatgcatgggttgatccttcaacagggtattgccaaggtatgagtgatttgctgtctccctttgttgtaatctttgaggataatgcagatgcattttggtgttttgagatgcttttaaggagaatgagagaaaattttcaaatggaaggcccaactagagtgatgaagcagttgcgagccttatggcatattcttgaactgttagacaaagaaatgtttgcccacctgtcaaaaattggagctgaaagccttcattttgcatttcgtatgttgctagttctctttcgaagagagttgtctttcaatgaggctctttcaatgtgggagatgatgtgggcagctgactttgatgaattcatggcttatgatttagaagagaactgtctggaagcattggagttacatcttcctagagactcaagcaatggtatgagagaagaaattgcagatagtgatggtggtagtgtgaagaatggttcacatcgctctcatcccataccttttgtggcttggcaaggaatatctggcctagaagtcatcaagttcaaacgagcagtatttccttaa

SEQ ID NO: 78090 - DNA, 1701 bp, Glycine max
  Peptide Sequence Number=SeqID_169775
atggtcatagtcaatgtcaccaacggcctagtatctacagtagtgattatagtcttgattttcccagaagttgcatcacaagcactctcacccagtgattctgttgcagataatgtgtcagaagccattatacaaccggataatactattagagtggaccctttagatcatttccaaaaatacagaggaggatttaacatcacaaacaagcattattggagtgtaaatctctattgtcccttttcgtttctaaattctgcgatcttcactggagtatatggatatgcaattggggtgctctgcattttgtgtggaatcgtgtgtggaacttttttggcaatatccacggcttgtcacaaaaatgacggaggaagaaggatgaagaaggcaagagttaaaatagtcttccaaattgaaaacggaatggtcatagatttatcacaacttggacacggtggacatagatacaaagaaaggcatgagctgtgtaatattagtaccatagacaagtttagttttgaaagtaacagtgaaagtgaccagtacatttacttgatagctgcaactgggctagttcttgctgggagtgcaaggttccattctgaagcaaaaaattcagttaatattataatcaagacagcgaatgaggcatcagaaacgatacacaacacaacaggagtgttaaaagacatggaaagtaacttcatggaagccaatgtcaaagctgatgcttctgtaaatcttgactctacaactgagagacttgatgatgcatctgcaaacattgaaaaacaagctaggaagaataggcgtcttatttacaagagcttgaaactagtgtttataattaccacggtgattataagcttgaacttggctgctgtaatagctttgtcagtttctggagtactgaggttaaggcgggcactatacctgcttgttgtattatgctggctgatgacagtgatatgctggctattctttggagcctatttcttcttggaaaaattttctggtgatgtatgcacagctcttgacagctttcaagaaaatccctataacaacagcctaagctcaatcctcccttgtgatgaattgctctcggcaaagtcagttctatctgatgtcagtgctggaatctacgtccttgttaataaggtgaatgcaaacatatcagccatgcaggcaacatcagctgtgaatcttgttcaagtttgcaaccccttctcagccccacccaagtattcataccagccagaaaactgccctgctaacactatacgaataggagatatcccaaaggttttgaagcctttttcttgtctaaatgtgactgatggaacctgtgacaatggagatttaatacccggcagtgaatacatgagagttgaggcttacacaagttcaattcaagacctactgaacgtgtatccgagtatggaagccttgttgaaatgccaagtggtgaaagatgcattctctcaagtccttgttaaccactgcaagcctttgaagaaatatgctaagatggtatggctaggattgctgtttcttgcagtgatcatggtgttgttggttgtgctatggactataaaagctagtcatgagcaccgttatcatctttcagatggttctgtggagcctcatagtgcaccaaccaaagccttggaatcgggaccaattaaagagattgagatttga

SEQ ID NO: 78091 - DNA, 1383 bp, Glycine max
  Peptide Sequence Number=SeqID_169776
atgaagaacgaccacaacaacaacgccgaacacaacaaagacactaccgttggaatcctagattcccgattcaaccagaccctcagaaatgttcaagggttactcaagggtcgtaacattcctggtaaaatattattaagccagagggttgaatctccagattacacaagcttatcctcaccaacttatataaggagctcctcatacagtgaaactggcacaagtgaccagacatctgagacagtagaggaggaagttcacagtacaagtaaaccatttggtattcccaatgagaataagttgaaaatatcagcatccaatgtagagagctcatctgaagaactccggaaatcttccatgggtgcaagagctacagattctgcaagagttatgaagttcactaaggtgctttcagagacaatggttaaattagagaaattgcgtgaattttcttggaggggtgttccagattatatgcgtcctacagtgtggagacttctcttgggatatgcaccacctaattcagatagaagggagggagttttgaaaaggaagcgccttgagtatcttgactgtgtttctcagtattatgatattcctgatacagaacgctcagatgatgagatcaatatgcttcgccagattgctgttgattgtccaagaactgtgcctgaagtttcattctttcaacaacagcaagttcagaaatcattggagcgtattctgtacacatgtttcctgatttttgctagggcaattcgacatcctgcaagtggatatgttcaggggataaatgatcttgttacgccatttttagttgttttcctatcagaatacttggaagggggcatagataattggtcaatgtctgatttatcttcagatgaaatctctaatgtagaggctgactgctattggtgcttgtcaaagttgcttgacagtatgcaagaccattatacatttgctcaaccaggaattcaaaggcttgtttttaagttgaaggaattggtcaggaggattgacgttcccccagatcctgtttcaaaccatatggaggagcaaggattggaatttcttcaatttgctttccgctggttcaactgtcttctaatccgcgagatacccttccatcttgtcactcgtctttgggacacatatctagctgaaggagatgccttaccagacttccttgtgtatatatctgccagttttcttctaacgtggtctgacaatctccagaagcttgatttccaagagttggtaatgttccttcaacaccttccaactaagaactggactgaccaggagctcgagatggtactttctcgtgcatttatgtggcacagcatgttcaacaactctccgagtcatttagctaactga

SEQ ID NO: 78092 - DNA, 1060 bp, Glycine max
  Peptide Sequence Number=SeqID_169777
atgtttggaatcatcggaggaaacaagggtcacaagataaaggggaacttggtgattatgcgaaagaatgtgttggatatcaacagcatcaccagtgttaagggtgtcattggaaccggcattaacatcattggaggtgtcgtcgacaccgttactgctttggcgtcccacatctccatccagctcatcagtgccaccaaggctgatgttgctcgccaatatcttgaatgccgagaaatcacacatcagaaagtggatgtgcgtgttgactcgacccaacccgaccctaataggttcaagtccactcacttcttattgttgttcatggtgaacacaatcaccctctccttgctccaacatgtgctaacaattccgtccatgaagttttggatactcgacattgtcgttgtcgctatccttgatttcgattccataaaccaatccaaattccctatcaggattatcgacttcattgttgtttccgtcaatagaaacttccgatccgaaaaggaagaaggagaagaggaggcagaggttgaggtcagcatcgagggcagagtcaacgacacaattaatggtggtggcgctgagttggacgagagtggacatgggaaaggtaaagttggaaaggctacaaatttaagaggacaagtgtcgttgccaaccttgggagctggcgaagatgcatacgatgttaattttgaatgggacagtgacttcggaattcccggtgcattttacataaagaacttcatgcaagttgagttctatctcaagtctctaactctcgaagacattccaaaccacggaaccattcacttcacatatcttccaagcgagacaccagctccacttttgaagtacagagaagaagaattgaagaatgtaagaggggatggaactggagagcgcaaggaatgggataggatctatgattatgatgtctacaatgacttgggcaacccggatagcggtgataaatatgcacgccccgttcttggtggttcagccttaccttaccctcgcagaggaagaaccggaagaggaaaaactagaaaag

SEQ ID NO: 78093 - DNA, 2320 bp, Glycine max
  Peptide Sequence Number=SeqID_169778
atggtggtggaagctggtaattgtgagagaccaggtactttgttcccagaagaatgcattgagccagttgggagtcaacagtgtgattatctatgtaggataggggaagctttacttggtgctttgtcggctcttgtcatggacccccgcaaagagagaataaagaatgggtgcctgaagattttggaaggaataaattcaatgtctttggtaaatttagatgaccagcaagtccattccttagtgatgatgagagaaatagcacgtggggttgttgatgatcgagatagaaaggttactaaaagtgatgtgatcactgcattgcgccacagcattgagaaaatggttcagtctggttcctttgaaggattaattcgtggcttggatgaccagagcatgcatttagtcatgaggatgaaagaaattgcaaatggggttattgataagcaacctagagttgcaataactaggcctgacttacttgctgaacaagttggatttgtggatgaagggatgagagatagtcccgtggttgagtcaaccaagatcagcaatgggtatgttccgattggcggggcacagagcatgactaatgaagatgagatgttggatgtggaacatgttttaagatttgaaaatgggatagatgaagttcacgagtctttgttaccttgttttcagcagtttcttctgtggccacctgatgattgtgtcaccttagagtgggttcaggacatgatggtcatccttgagcaggcttcacagaagatgttgccatctgaattctgtcatatcgtgccggccattttggtggacaaattggcagatgctgcttgcagtattttatgtaaagaaccaaactgtgtggagattaattgtcaaggagaagattcaaaagtaattgtagtaggcgatgtacatgggcagtttcatgatttaatgtttcttttcaagcatgcaggggttccctctgagaaccggatttatgtttttaatggaaattatgtagataagggagcttggggaattgaagtatttttgttcttgctggcttggaaggtcttgatgcctcatagagtatatctacttcgtgggaatcatgaatcaagatattgcactgcaagatatggttttaagaaggaggtgtgggccaaatatggtgatcaaggtgaagatgtctacaataaattcctagcatgttttaaggagcttccattagcttcagttattgccaattgtgtttatactactcatggaggacttttccgtagtatacacgcagccccttcacagaaaccgaaacgaaataaaacacacagggtggatctcggctctttagctgagttatctgaagttaaaagatcttttgtagattgcccttatgaaggtcctaatatattattgagtgatgttctctggtcaagaccatctaacagggatggtctgagggataatacaggtcaaaagttaggtttattgtggggtcctgattgcactgaggcattcttaaagcagtacaatttaaagaataaatcaggtctattccagtattttattgggttcctcattgtttatcatggtggagtgtcagactggagtggttccagtttgccattcctattatttacaggcttccagtctcctcagaagtctgcacttctatcttcacaggattcacctgtctctcttgctcatcttggaccagacgcaagggctggtagagatgatgattttggggacatgctaagtggatacagcatagatcatgatggagaatcgggaagactgtatactctttttagtgctccagactatccacagtttggtaaaaggagatataacaataagggggcatatgcagtgttgaagtcgcctgattttgccagcccttcgtttcactcattcaaagcagcagaaagaccaatggtggatccttactttgattttgatgccaattatatggaatcgagtaaactagactcttctcaaagtgcctcaacctctaccctttctgctcctcaaagattttattcagatgggatgagacctgagtttgactttggggcattaggcatatacaatgccccaggttggagggttgagcttcctgatggttcaggaggtactcaagctgttgaggttccaagggcaccattggcggaaggattgcctctgcctccaaacatacaggagccacacaaggctgcttatgagtatttgtttgagctagttgctggcctgaaacatatgattgtaacaagggagactgagaacagggcccctgtgtctgctttgagaagtagaactaggaaacgagaag

SEQ ID NO: 78094 - DNA, 234 bp, Glycine max
  Peptide Sequence Number=SeqID_169779
atgctgagagtgagaggactgaacaacagaaaatggatgagtgagtacactgaggtgtgtcacactgcaacaattgtaggccttataatggatcctttgttagctcactctgggatgggatcggttggaaacgtgtcgcacatgcagggtcgtggggcccaccctgttaacagatgcacttcgatatacgcagatgaagaaagtttttcaacggggttggttggtgacacttga

SEQ ID NO: 78095 - DNA, 267 bp, Glycine max
  Peptide Sequence Number=SeqID_169780
atgtttgttccagagacccatatgttctttcttgcagtgtttggatttgtttgtacatttggagcttggctgaacctaacatgccaagaaatgcttgtgaagatgcacctgcatgactgcacgaatacacttactgaattaaactctcttcagggaagcattggtggtgttgtggatttggccacaatcatttggcttctcggaagctccaattgtcgtccttcagggatgttttactatcatagctcctggtttgatgatgtctga

SEQ ID NO: 78096 - DNA, 147 bp, Glycine max
  Peptide Sequence Number=SeqID_169781
atggcagtgccagagatcaaatacttccaaggcggggtttcatgggaatcgaaagaagtaggtgtcatgaaatggctagctgaagaggatgaaaaggataagattattatattatttttagaaggcagaaaggatgagattatgtag

SEQ ID NO: 78097 - DNA, 1317 bp, Glycine max
  Peptide Sequence Number=SeqID_169782
atgtcagctctcaggggtggtgctaagataggaatttgggtattatggggagtcccacatcaagtagtatggaatgcttgttggactgttgactttggtactggtgaagatccttggcctatattcaagttacaaaaggagttcaatgccccaggaaaatcaccacctttgtcagctgaattttacaccgggtggcttacacactggggagagaaaaatgctcagactgatgctgattttacagcagctgctcttgaaaaaattttgcaaaaaaatggttctgcagttctctatatggcccatggtgggacaaactttggattttataatggagcaaatactggtgtagatgaggctgactacaaacctgatctcacttcatacgattatgatgcaccaattagggaatctggtgacgttgacaattcaaaattcaatgctattcgaagggttatagccagatatagctcagtacctcttccatctattccctctaataatgaaaaggcaagatacggaccaattcacttacaaagagaggctttcgtatttgacatgtttgatttcaccaattccaccaatgtgtttaaatctgaaaccccaatgtcaatggagtatgtgggccagttacatgacagagctcaagtatttatttcatgcccctctgaagaaagtggtgcaaggccaacttacattggaactattgaaaggtggttaaataacaaagtaactcttccggatattaaatgccattctaagatcaacttatttattctggttgaaaacatgggtcgtgtaaattacgggtctttcatctttgataggaagggcattctgtcttctgtttatctggacaaggaacaagtaaaagggtggaaaatgttccctattcctttgcacaacctgaatgaaatgtcaacctacaatcccatcacgcaagttgcatattctgcattcagtggcatatcatcattcagaaaaaagttgatttataagaatgggaatacttcaaaagaacctgctttttattcgggccacttcttaattgataaatcaagtcaggtcaaggatacatttatatcattcaacaattggggaaaaggcattgtgtttgttaatgacttcaatataggaagatattggccgttgagaggaccacagtgcaacctctacgttcctgctccactccttaaacaaggagataactttttggtaatactagagttggaatctccagaccccgaacttgtggtgcacacagtggatgagccagacttcacatgtggctctagtgggacgagtctccatcagctgtaa

SEQ ID NO: 78098 - DNA, 1338 bp, Glycine max
  Peptide Sequence Number=SeqID_169783
atgaaggagaaagagaaggtggaggagaggtacactcagtggaagtctctggttcccgttctctacgattggctcgccaaccacaacctcgtctggccttctctttcttgcagatggggtcctcagctagagcaagccacttacaagaaccgccaccgtctctatctttccgaacagactgatggcagtgttcccaatacccttgttattgccaactgcgaggttgttaaacccagggttgctgctgctgagcacatctctcagtttaacgaagaagcacgctctccctttgtcaaaaagcacaaaactatacttcatcctggcgaggtgaatagaatcagggaatttcagcaaaacaataagatagtggccactcatacggatagtcctgaggtacttatttgggatgttgaaactcaacctaatcgtcatgctgttttgggggctaccacttcccgtccagacctggtattaactggccataaggataatgctgaatttgctctggctatgtgcccaactgaaccctttgttctttctggagggaaggacaagtgtgtggttttatggagtgttcatgatcatatttcaactttagcagtagaaacagcatccaatgttaaacagggctctaaaactgggggcaataatacaaaagctacagaaagcccttgtattgaaccaaggggcatttaccagggtcatgaggacactgttgaagacgtgcaattttgcccatcaagtgcgctggagttctgtagtgtaggtgatgattctcgccttatactctgggatgcacgcgttggatctgctccagttgttaagtttattggccttttgaatcctcattctaatttttgttgctttggatccagttctgctgataatacaattcacatgtttgatcgtcgaaatcttacaagtagcggagttggatcacctgtctataaatttgaaggtcatgatgcagcagtcctctgtgtacagtggagtcctgacaagtcatctgtatttggaagtactgctgaagatggtattttaaacatctgggaccatgacaaggttggtaaaacaacagactctgctgattcaaaagcatcaaatgctccccctggtttattctttcgacatgctgggcatagggacaaggttgttgacttccactggaatgcatctgatccatggacaattgttagtgtttctgatgattgtgaaagtagtggtggaggtggcaccctacagatatggcggatgatggatctaatatatcgaccggaggaggaggtgctcactgagctggataagttcagatcacatatttttggatgcaactcatga

SEQ ID NO: 78099 - DNA, 2694 bp, Glycine max
  Peptide Sequence Number=SeqID_169784
atggttatgtgcttgaagctgaagctcataatgtggaatgtggcactgcttctggctttttctctcattggttctgctaaggcctcagtgtcctatgactctaaggctatcaccattaatggccagagaaggatcctcatttctggatccattcattacccaaggagcacccctgagatgtggccagatcttattcaaaaggccaaggacggaggcttggatgtgattcagacttatgttttctggaatggacacgaaccttcacctggcaagtattattttgaggggaactatgatctggtgaagttcataaagctggtgcagcaagcaggcctttatgttcatctcaggattggtccttatgtctgtgctgagtggaactttggtggtttccctgtttggctaaagtacattccaggaatcagtttcagaacagacaatgaaccatttaaggttcaaatgcaaaaatttaccacgaagattgttgatttgatgaaagcggagaggttatatgaatctcagggaggtccaataattatgtcccagattgaaaatgaatatggacctatggagtatgaaattggtgctgccggtaaagcttacactaagtgggcagcagaaatggctatggaacttggtactggggttccatggatcatgtgcaagcaagatgacactcctgatcctcttattaacacttgcaatggcttctattgtgattatttctctccaaataaggcttacaagccaaagatgtggacagaagcttggactggctggtttaccgagtttggaggtcctgttcctcatcgacctgctgaagacttggcattttcagttgcaaggtttatacagaaagggggatcatttataaattattacatgtatcatggaggaacaaatttcggtcgaactgctggtggtccctttattgctacaagctatgattatgatgcaccacttgatgaatatggattgctcaggcaaccaaagtggggtcatctgaaggatttacacagagcaataaaactctgtgaaccagctttagtatctggagatcctactgtaacaaagattggaaactatcaagaggctcatgtctttaaatcaatgtctggagcctgtgccgcattccttgcaaactacaaccccaaatcttatgcaacagtggcatttggaaacatgcattacaacttgcctccttggtctataagcattcttcctaattgcaagaacaccgtttataacactgctagggttggttctcagagtgcccagatgaagatgactcgtgttcctattcatggtggtctctcttggctatcattcaacgaagaaacaaccacaactgatgatagttccttcacaatgactggcctgttggagcagttaaatacaacaagagatttatctgactacttgtggtactccacagatgttgtgcttgatcccaatgaaggatttctgagaaacggaaaggatcctgttcttactgtgttttctgctgggcatgctttgcatgtttttataaatggtcagctatcaggaactgcatatggaagcttagaattccctaaactaacatttaacgagggagtgaagctcagaaccggtgttaacaagatctctcttctaagtgttgcagttggactcccgaatgttggtcctcattttgaaacatggaatgctggtgttcttggcccgatttcattaagtggtctcaacgaagggagaagggacttgtcttggcagaaatggtcttataaggttggtcttaaaggtgaaaccttgagtcttcactctcttggtggaagttcgtcagtggagtggattcagggatctttagtttctcaaaggcagccattgacttggtacaaatactctttcgttattattattataaatagtattataataatcatagaggaagcagagaatgttccttatggaaaaaggacatgtttcactttctttttattcctcaaccccacactatcctttgtttttagcatgggaactcctaatgtcatgccatgcacttaccagacaacatttgacgcgccagatgggactgcaccattggctttagacatgaacagcatgggcaaaggtcaagtgtggttaaatggacagaatcttggccgctactggcctgcttataaagcatctggtacttgtgattactgtgactatgctggaacttataacgagaataaatgcagaagtaactgtggcgaggcttctcaaagatggtatcacgttcctcaatcatggctaaagccaacaggaaatttattggttgtgtttgaagagctaggtggagacctcaatggaatctctttggttagaagggatatagatagtgtatgtgcagatatttatgagtggcagccaaatcttataagctatcagatgcaaacttctggcaaagcacctgttagaccaaaagttcatttatcttgtagccctggacagaaaatctcatcaatcaaatttgctagctttggtactccagtaggttcttgtggaaacttccatgaaggaagctgccatgctcacatgtcttatgatgcctttgaaaggaattgtgttggacagaacttgtgcacagtagctgtgtcacctgaaaattttggaggagatccatgtccaaatgtcttgaagaaactctcagtggaagctatttgttcctga

SEQ ID NO: 78100 - DNA, 510 bp, Glycine max
  Peptide Sequence Number=SeqID_169785
atggaggaaaaacctaagctcctcttccatggaacaattcaagctaccatcttcaatgccacaccttactcaccttcgtttcccttcaattgtgtatgtacaaatggaaagcctgcttatgtgaccatcaacatagataacaagaaggtggcgaaaacgactcaagaacgtgaatatatggaaccaagctggacaaagctactaagcaatgggaaatttcaagagctgagggatgctacattcccacaaaggtctaattgccaggttaaactctatcatgatgctcaccattcctctactttccaccctccttttgatctatgtggagcaccaagaaagctgtgggaagatgtctataaagccattgaggctaatgtcccccttgtgcaggttagagatcctcaaacagaaatcccacatgctagggagataaagctaggtgagctattgaagaagaaggcagaggaaggagtggctgtgagggttaacaaaattgtaaagaatatttaa

SEQ ID NO: 78101 - DNA, 369 bp, Glycine max
  Peptide Sequence Number=SeqID_169786
atggcatcaaagattccccagttacaatcaaaggtgaaccaagcatcacaagcagcgaaaaaccatggagcttcatactacaggctattgttggatcagaataaacactatatccaggatccacccaccattgagaagtgtcaatcattggccaaacagttgttttatactcgcctcgccagtattcctcatcgttacaattcattctggaaggaattagatcatgcaaagaaccttgtgaagaacaggcaggacctaaacatggagaaagttggttttgctgcgttgtttggactggagtgttttgcatggttttggggaggtgagattgtaggcaggggatttacattcacgggctactatgtttaa

SEQ ID NO: 78102 - DNA, 1602 bp, Glycine max
  Peptide Sequence Number=SeqID_169787
atgacgagcatttcgtatctaaccaacactctgctgccactgcacatccgaaggtttcggccttctctatccactctctcttgctctctggcctcagatgtggaccccactcccaattcctacttccccaagcgcggccaaaccctcgaactggtgtgcgagtcccttgccttcaaagggaagggcctctgcaaggtcacccaaaccggcttcgttgtcctctgcgaccgcgcccttcctggcgaacacttcatcggccgcgtcacccgcaaaaaaggcaattacgctgaggtaactaaggtcaagaccataactcctcctcgtgacattgtcgatgctccttgtgtctacgctccttattgcggcggctgcaagacgcaaaacttgtcctacgaggctcagctcagagccaaggaggagcaggtacgcgacttgctcattcacgtcggaaagttttctctccaacatctccaactgcacgccgttctgaagcccattgttccttgtcgtattcagtttcattacaggaataagatggaattctcgtttggtccccaaagatggttgcctaaagaatcactgcaagacagaatcgttgatgatgatactaatgaaaattatgcgctgggcttgcatgctccgggtttctttgataaaattctaaatgttgacaactgcttactgcaatctcatcctgctaataaggtacttgcagctgtccaagaatgttggagagatccacaacttggtttttctccctataatgttcattcgcacaagggatttcttaagcatttgatgctgagaacgggaagggatgtaacaactgatcagcctgaagttatggtcaactttgtgacctcttcctacaagccagagctgttgaagttcctagttgataaagtttccgtatttcctgaagtggtaagtgtcattaataatgtaaatacttctgttggcaacacatctgttggggaggaagaatacactttgtatgggaaatctagcattacagagaccttaagagggcttacattccaaatatcagccaactctttctttcaaacaaatacttatcaggcagaggttttatacaagcttatagaagattgtgctggagtcaagggtgacgactcagaaattgtccttgacctgttttgtggaacaggcaccataggtctgacgcttgcaagaagtgttaggcatgtttatggctatgaagtagttcctcaagccatcacagatgctcgtcttaatgccaagataaatggaatacaaaatgcaacatttgtccagggagatctcaataaaattgatgagaattttgggaagaattttcctaaacctgacattgtcatttcagatcccaatcgcccaggaatgcacattaagttgattaaattcctgctaaatcttagggcacctcgcatagtgtatgtctcttgcaatcctgccacatgtgcacgcgaccttgattatctttgtcatggtgtggaagaaaagaatatagaaggatgttacaagctaataagcttacagccagttgacatgttcccacacacccctcatattgagtgtgtttgccttctggagcttcagtaa

SEQ ID NO: 78103 - DNA, 345 bp, Glycine max
  Peptide Sequence Number=SeqID_169788
atggtgttatcagcgtctatcaccattcctccgagcatgagatcacacccaatatataaagctgttggtaacccaccgaagacatattcatggagattggttcagctgaatctcttgttagattcatggagactggttcagctgatgaatctcttgttagatcggcatcaattaatgtgtttagatcgagctaattcggtttctaaagtgtcctttagttcagttacaatcatattcatgactgacctttcgttgggctttggagaaagacaagccattgctatctttaccactttccaagctgagttaatgtcaaaatctcctcttaaccttagtccacaatga

SEQ ID NO: 78104 - DNA, 507 bp, Glycine max
  Peptide Sequence Number=SeqID_169789
atggcagatcagtttcgagatcttgttgtcgaatctgagaaggagcgagttgacgctggtgagatcaccgaagagaaggaaggagttgccaaatggtggctttcgagtgagggaactacagggagtgagtatgaagccgtcgcaaatggtggtggagacggtagacccattgtggttggtggcattctttcagcagtagtctttttcattgcattgggtattgtactgaatatcatttggagaaggagatgcaacagaaaaccagcattaaagcaagctgtgagatcaaatgaagagattgtgctgaagacaaacaatacacagtacacatactctcagatattgactattactgataacttcgacaaaatgattgggaagggaggatgtggaattgtttatcttggttccttacaggatggcacacaagttgctgtcaaaatgctcttgccaaaatgtcctcaaggatctcagcagtttcagactgaggcatgcttctcgccatag

SEQ ID NO: 78105 - DNA, 204 bp, Glycine max
  Peptide Sequence Number=SeqID_169790
atggaggtgttgaaagtgcttaagcattgtcccaatctccaacatcttgtcatcgatcaggggagggtggcaattctcactgtgttcctaaatgcatctcatcgcatcttagaacatgttgtgtttataagtatggtggctacgaaacagtatttgaatttgaaagatatatcgtgcagaatgcaagactactacaagacatga

SEQ ID NO: 78106 - DNA, 279 bp, Glycine max
  Peptide Sequence Number=SeqID_169791
atggtggtaatagagcaggaggagagtgagcatccaaacgccaaccctttcaatgccagcaacgacccaaccgacggcttccaaactgcagttgacgccgatctcggcagtgacggcgaaggcagcggatcctactgtcgggaagaacagaatcacgccgagaaacagcagcagacggagcaagagccagaacacgttgttcctcggagcaccgaatcatccgagaataatgccaagatcaatgaagaagaatcgagattggttcggtttcgaaattaa

SEQ ID NO: 78107 - DNA, 279 bp, Glycine max
  Peptide Sequence Number=SeqID_169792
atgggaagttcattggtggaaatccaagttcccgggcagaagcttgtgaacggagttccattccccgctgtggtgtctcctccacctgcaactgcaagttcggttcctctcagggactccgtcaaaacccaaaaagctttccttgaatcattgttcttagccgcgtgggttttaggagaagacgacaaccctaactctccaattggccgtggcttgaaatcaaccttcttgaccaatcacaagaccctcgctcaacaaagtggaaatagtttagattag

SEQ ID NO: 78108 - DNA, 123 bp, Glycine max
  Peptide Sequence Number=SeqID_169793
atggagaggttagaatccactgtgtggaagacactgttgaaagcagctagcatggctactaaaggaaacttttcctctgtccgtcaaaattttatccgaatgcatgagacaagatccttgtag

SEQ ID NO: 78109 - DNA, 275 bp, Glycine max
  Peptide Sequence Number=SeqID_169794
cttcggtgaaggtgaaggtgccggtattcattactgcagtggttggttcatcggcggtgacatacgagaaatggaagcacgaacgcaaaagggacaacgcgcttacctcgacgtcgatggagcaacacaaccagaagaagaacacgcaaagcccaggtgaagagcacttccaccatgccgccaacaatggtgaagaagcaagaaccacgccgccgggaacaatcgaggttgcggaagcaagaaccacgcgcagtaggaagaagaagatgaactga

SEQ ID NO: 78110 - DNA, 453 bp, Glycine max
  Peptide Sequence Number=SeqID_169795
atgctaaacaacttcgaatccgcgattcaaaaggaatcctccaagattcccatgcctggcggcgagatccacccgctcacgcgttacgtcatgaactacatcgcgttcctgggcgattacggcgacgggctcgcggagatagtcggcgattggcgtaaaaattcgttgccggagtgttactaccgaagtcccgatcgcgagggaaagaaagggtcatcggagatagctgaacggatggcgtggctgatattagtgctcctctgtaagctggacagaaaagctgaactctacaaagaggttgcactctcttatctgttcctggcgaataacgtgcaatacgtcgtcgtaaaggtccgcaacacaaacctagggttgatccttggggaggattggttgacgaagcacgagttgaaggtgaaagagtatgtttccaagtacgaccaagcatcttga

SEQ ID NO: 78111 - DNA, 366 bp, Glycine max
  Peptide Sequence Number=SeqID_169796
atgactgttgtcgtcgtcatcaccgtcaccctaaccaccaccaccaccagagtgatcgtgatcatagtggtcatggcagcgatggtggtggttatagtgatgatcttgacattttcattgcatatagaattcttacaagcaatctcagttcctatcccagaaaaagaaactaagatatgtttctacagtctaaccgttgggatcttgaaaataataacttttggtctcccgctaagcgaggaaggcgcactaagcgtaattccaaccgaggggaattgcgttgagcggcccaaagctgcgctaagcccaattccaactgagaggaagtgcgctgagcgcctagagggtgcgctaagtgagccctag

SEQ ID NO: 78112 - DNA, 1038 bp, Glycine max
  Peptide Sequence Number=SeqID_169797
atgggtgttaagcgtctcaaagtgatcaatcaagatctgcacgccgacaagaattgtccccggacgaaattaggatatgacagtgcggataatcgtaaggtgtctctgcatgctatcggactctcgagtcgctggatagcaaaaggtgcaaataaccgtaaggtgtctccgcatgccaccagaatcttgggtctctggatagcaaaaggtacagataaccgtaaggtgtctctgcatgccaccggactcttgggtcgctggatagcaaaatgggtgcggataaccgtgaggtgtttctgcgtgtcatcaaacttgccgtctccggatgacgaggtgcagataaccgtaaggtgtctccgtgtgtcatcggacttgccgtctccggatgacgaggatgaccatcttggtctctgcgtttcatcggacttgccgtctttgaatgacgagggtgcggaaaactgtgagacactgaggtctccgacaaagggagcagatgactatattggtctttgcgtgtcattggacttgccgtctccggatgacaagggtgcagataaccgtgaggtgtctccatgtgtctcagacttgccgtctccgaattacgagaggtctctgacaaagggtgcaaatgaccatgttagtctcttcgtgtcatcgggatttccgtctccaaatgacgagggtgcagataaccatgagggtgcagatgaccatctttgtctctgtgtgtcatcggacttgccgtctctggatgacgaggacgtggataaccatgagatgtctccgcgtgtcatcagaattgccgcttgccgtcttcggatgacgagggcgtggataaccatgagatgtctccgtgtgtcatcggacttgccatctctagatgacgaggatgaccatattggtctctgcgtgtcatcggacttgccgtctctggatgacgagggtgcgaataactgtgaggataagggtaaaaattgctaccctgggtcgaggcttagggccgacggattgaggttttggcctaaaaaggctttatag

SEQ ID NO: 78113 - DNA, 120 bp, Glycine max
  Peptide Sequence Number=SeqID_169798
atggaggttgaggaaccttggctggggttatggccaccattgaattacagagcaggctttgtgtctgatttagtgatggcctttgtggatgattgggtggtgggtaatgagaagggctaa

SEQ ID NO: 78114 - DNA, 354 bp, Glycine max
  Peptide Sequence Number=SeqID_169799
atggcaacatcaccaaacaatcatacaacagagatgcacatgacatttagaaggcggttatatctctcaatggtttctagagatatcattccctttgacatcaatgttgtggcggtagggactaccagcgacaacatatcatcaaagagaaaaactctagatgagggcgacgcgaaggctcatgggagcgtcttccaagggaggaaaacgcgcggagtctccaacaacgtttatttgaggaaaaagttagaaaaaccgaaacatggtctaggaactttaagtatgaaaggttcagaagttgtttttacgcacggggaaggtattagcacctcacgcacccatcacaagggatga

SEQ ID NO: 78115 - DNA, 354 bp, Glycine max
  Peptide Sequence Number=SeqID_169800
atggcgtggattgatttgtttgtggccattagctatgtcatagaacatgcaagttgttccgggcacgcgaaacagaaaagcttcagtagtagtaacacattcttcacctatgagggaagtcacggcctctccaaggatggaggagaacgtggtgtttacaagcgcgacgatgcacaaaatgaacattcgaaggtagtagtaaacgggctgagcaaatcgaaatctcatattccaccaaagtctagaaagagagaatcttcaatcactattgccacaaatatggaggaagaggtggatccttacaaggttattcctttcaacatgtcattttctaaatgcttagtggagccttag

SEQ ID NO: 78116 - DNA, 198 bp, Glycine max
  Peptide Sequence Number=SeqID_169801
atggaagagcttgaagatgctatgatctacacatcgaggccttggatcttcttcatcaatggagtccttagcttcttgaagatcatggcagtggaacggagaaggaagaaagatgattggagacgtcacttcaaggagaagatgagtcaagaagaagctcaccaccataggaagacatggataagatcttggaggtag

SEQ ID NO: 78117 - DNA, 459 bp, Glycine max
  Peptide Sequence Number=SeqID_169802
atgttgccacttgcgtacatactcatagctcttcatgcattgttgcaattaatcctctttagagccaaaaacaacccaccatgtccattaggtcctagaggccttcccataatgggcaaccttcaccaactcgatgtttcgaagctccatttccaactgaggcagctctcaaagacctacggtccccttttctccatccgaatcggcttcaagaaagccatcgttgtttcctctctgaaacttgccaaagaagtcctcaaagaccatgatctcgatgtacgcaataggcctccctcgctcggcactctaaaattaacttgcaatagccttgagcaacgactactggagagaaataaaaaaaatttgtgttgtccatctcttcagtggccatgtgcacgcctaatattcattaagactctagagatcttgccaggatctcatacaagcaaccccacttaa

SEQ ID NO: 78118 - DNA, 801 bp, Glycine max
  Peptide Sequence Number=SeqID_169803
atgatggcacatcacataagcatccagagggtgaacaatcctccatttaagatgatgttgttgttgacccctctctatttgatgttcaaccagttcgccaggagacttcaactgttcaatagtttgaaagaagcctatgaagaactgagacaatactccttaagaaaaaaaagcgaactgagtccaatcttgacatggacaatgaatgaagcaaaactccaacctaagattgattggacgcagttccctcttgaagttgaagaagaggaagttacttgtcccccgtccaagcaccaagaaccttatgtcacatctaaggcttttgagaaggatccaccaacaggtattgaagttcttcctccaccaaagtggaagcaacttcatcccaaggtattcaagccttcatctttaacagcacaacgcaaggatgtctacaaaatttcttctggagcctacatacaaaaggttagctacgacaaggacaccatttgttggttttactatggacatcaagccctctccttgactaaggataatgatgcaacttgtactcatatgtgtcgcaatgtgcccttcgcgggcgagcgagggcgaggctcacgggtgcgctttccaaaggaggaaagaggcacggagtcgccaccaacgtttatttgtgggaaacgtcggaaaaaccgaaggaaaccggtcaaaaataaaattctaagttcgggatttgtatttacgcttgaggaaggtcgacaaaagcggggcttttgctcctacgtaccctcctttggagaggaaatcagacctacgtag

SEQ ID NO: 78119 - DNA, 753 bp, Glycine max
  Peptide Sequence Number=SeqID_169804
atggtcaacacaatcaagattgagaaattcactgggaagaatagcttcaacctttggcgcaccaagatgcgagccttgatgaaagaacatgtcatttgggctctctctttggttctttatgaagtttattggaagcaagattgtccaaagaaagcaaagaaatattttgttgccgctcttgttcaaaatgactcctcatcggaaaacgatttgattcttaagaagtttggtggtaacactctcataggtaatgatgctccttgtaagtctatcggtataggtattgtgagacttcaagacccctatggagctatagagatggagtcaaaggattttgagtctggtctccatctaaacattctgagtagagatgtcgtctttgacaaaatctatatgttaaattctaaatctgatgaagatttgggcaaggctgaggatgtggcaactctagacatggagttagagcaactcgatgtcaaaacttcctttctccatggaagactagaggaagacattttgatgcaacaacctgaagattttgagagattcgatgagttctctgtctctcatgggtacatcaaaagtgatgtagctccatgtgtagcttgtaggccttggatcttcttcatcaatggagtcctttgcttcttgaagatcatggcaacggaatggagaaggaagaaagatgattggagacgccacttcaaggagaagatgagtcaagaagaagctcaccaccataggaagtcatag

SEQ ID NO: 78120 - DNA, 443 bp, Glycine max
  Peptide Sequence Number=SeqID_169805
atgggagatgttcaaaagaggttcactcatatagtgaatcatctcaagggcctagggaaagtgtttggggaagataagctgaatgtaaagatactaaagtctcttaatagaacatggcaatcgaaggtcatgataatctctgactccaaagatctttcctccatcacacatgttgagctattaaaaaaattaagagaatatgaaattgacacgacttggatgactgaagaagtggctaaggagaacaagagtagaggcttagtggtaaaatcctccatacgatctagtgatgagagtgatgaagaaaatggaaaagggcgacgcgtgactcgcgggatgcgtgttccacgaaaggaatacgcgcggagtcgccaccaacgtttatttgaggaaagcgtcggaaaaaccggaaaagacgagatctacgaactttttagtgaaag

SEQ ID NO: 78121 - DNA, 618 bp, Glycine max
  Peptide Sequence Number=SeqID_169806
atgggtgaagtagacgaggtgcaagagtggataaaggccgacatagaggccctgaaagagaaaatggccacaatgatggaggccatgatgagcatgaagaagaagatggaggtcaatgcggctgcagttgccgctaccagtattgttgctaaggtgaacttgactcccccatccgacaacaaccaaataaatcatccaacctcggatagggtaggtcaggggggcaaagaattgggaagtacgggcgccccccattttgtgcaagttcaaaacaggcatcccttcccgccatatggcttgcctcccaattatacaccacccaatgtggtgcacactctcgatgagaatgtcaataacttcagtcccacactcattgaaagccaacaaactcaattagatcatgcacatatccctcaacccatggaggagacacatgaaataccccaccataatctagtcgacttcgagccttgcctcggatatgccattgaggggcaagcagttggtggtgtacccctgccaaacacttcggagggccctcagtttcgcccacaacgacaacctttgcattttgcagcaggaagatccctcctgctatggcggaaaaagggaaattag

SEQ ID NO: 78122 - DNA, 411 bp, Glycine max
  Peptide Sequence Number=SeqID_169807
atgggatctcaagctcagttcgccatttttcaacattcagtactatgtgtaactggacccaaccgtgataaagaaagaatgctccaacacggcggttcattgaggagacaatcctcagagtttgtcgcaacctacccttcggcgggagggcgacgcgagactcgcgggatgcgtgttccacgaaaggaatacgcgcggagtcgccaccaacgtttatttgaggaaaacgtcggaaaaaccggaaaagacgcgatctacgaactttttagtgaaaggttcgggagttgtatttacgcacggggaaggagagaaacgttaaggcatcggaccattaacgatctcttggggtggtcgacaaaagcgggacttttgctcctacgtatcctcaatgaggaactcagacctacgtag

SEQ ID NO: 78123 - DNA, 675 bp, Glycine max
  Peptide Sequence Number=SeqID_169808
atggtgtggtgtctccaatcacctttcctccttcttcattccgctgtcattgatcttcaagaagcaaaggactctattgatgaagaagatccaaggcctacaagctccacatggagctacatcaaaggacaacctttaatggttaaggaggagtgtaaggaggtaagtgtcttcttcaagaggttagctaagaaggaaagtcattttgtaataaagacaaacattaaagaaacataccttcttagacaacctccacatcttgtcctttgtaaaaagacacttgtcagcactgccacacctcttcggcttgaggttattcctcatgtaaatgagttattggatgaaggtattattaggcaccaaatcccaaaaataggtgatttgatgaatgtgttaagtggtgcaaccctcttttgtaaaatcactcatgcacccaccatcttcatgatttgtgtacatagggactcattaggtagtgatcaagaggttcccacataccctaagagaataacggtcattcctttgtggcccaccccatcaagtgttgagggaagaaacctagagtttcaagaacctctagatttgagggcattggatataagactcaaggaagattgggtcagagatgctaaagaaggtcatagggttctcatgaaacttagggtagatttctga

SEQ ID NO: 78124 - DNA, 321 bp, Glycine max
  Peptide Sequence Number=SeqID_169809
atgtctcaatttcaaggtagcaagcaaagacgactcgtggtggccattgatggtcgtgggtggtggagaagaagtgagttgatctcattgagtgaattttctcctagggttggaattgcgcttagcgcgcttgtctctctaattagcgaaatttcagggtgttaccaaaggtatctgatggggaacttctccttcaagaataacattgagaataaaaaggtgcgtatcaaaagtctagggatcttctttgataaccttctagaagttgaggtggtggaagaattcaaaaaggaagaggcattttcccaataccttgattga

SEQ ID NO: 78125 - DNA, 234 bp, Glycine max
  Peptide Sequence Number=SeqID_169810
atggggagtgaaaaatgggattgtcatcatcaaaaaaggggagattgtggaagcaatgacttccaagattattttgatgatgccaaagaatcaaaagttaagcaagttccaaagaatcaggcttcaagaatcatgtctcaaagaatcaagattcatgaacaattaagtttcaagtttcaagattcaagaacaatcaagatcaagattcaagactcaagattcaagagaagttga

SEQ ID NO: 78126 - DNA, 294 bp, Glycine max
  Peptide Sequence Number=SeqID_169811
atggaaggagtagttattgttgtgtgttatgatggtgatgtggtatcaacttctaagggggtattatttgaaagtcctaatggtcctaaagtcataaaaattagtgaggaaatgtcactttctgctctgaggaaagcagttacagatgccatcgaaagtgatgactgtgttgagtacgattgtatggagcttaaagacgacaatgaaatggggaagatgtttttcatcttttcacaatttagttctaaaggtccaatcaagttgtatgcaatggttggccgatctccaaaataa

SEQ ID NO: 78127 - DNA, 330 bp, Glycine max
  Peptide Sequence Number=SeqID_169812
atgccttccaagattattttgatgatgtcaaagaatcaagagtcaaacaagtttcaagaatcaagatcaagattcaagaataatcaagatcaagattcaagattcaaagcgtacatctacttgggttgttatactgagaacaagagagggtacatctattatggatttgttcaagtggagcgtacatccacttggttgttcaaagagaacaagggagggtacatcccttgtggatctttgcttgtgaaggattttacaaggttattggaaatctcaagaaccggtggttgtttggggactggatgtaggcacgggttgtggccgaactag

SEQ ID NO: 78128 - DNA, 213 bp, Glycine max
  Peptide Sequence Number=SeqID_169813
atgacagatcaaggttcacttctccagaggcctagtaaaggtgagggtcagaggtcatctagtgaagttgacgaagatgccctcaacacattcttgaagacccctgtgatcattaaggagggggaaacattatctgcttattctaggtttgcacttctgaggcctgatcctcaggaattggcagccaagctctatatcctaggggggatttga

SEQ ID NO: 78129 - DNA, 288 bp, Glycine max
  Peptide Sequence Number=SeqID_169814
atgataacaaaagatgatgacaaaggtgatgacaaaaagctcaaaggtcaatcaaagaatgagttcaagaagttcaagatagaatcaagaacacttcaagattcaagaggaaagttgaattcaagaatcaagaatcaagattcaagagatcaaggttcaagactcaagattcaagaatcaagaaaaggctattcaagaatcaagaaaaagcttaatcaagataagtatgaaaagggtacatcctttgtggtacaagtagagggtacatctacttgggttgttgactga

SEQ ID NO: 78130 - DNA, 327 bp, Glycine max
  Peptide Sequence Number=SeqID_169815
atggtggcgatagtggtgaataatggtcgtgatgatgatggtggtggtggtggaattgtgatggtgatgatagtagtgtggaatggtagtggtggtggcaacggtgtggtggttgtggcggtggcactggcagtggtagtggcgatagcaatggtggaacggtggtgtggaatggtggtggtggagatagcaaaggcaaggtgtggtggcggtggaatggtggaagcgacaattgtgaggtgtggtggtggtgacggtggcaatggtggtggtggtgattgtggtcgaatggtggcgagggcaatgacggtggtggtggtatggtga

SEQ ID NO: 78131 - DNA, 291 bp, Glycine max
  Peptide Sequence Number=SeqID_169816
atggcggcaatggcatgggaggtgaaacgcgaagttcacttgggaggttcgaggaggttcacggcaacaatcatgacaagaatgaagaagatgcagaaactcaagaagatgcagaagaatgaagaagcacaaaggtttgaggaagaagaaacatacggcgcgggagagagagagagcacaaaatttcgtgctcttctcttcctctcccttcattcacctccttcttcctctaagctgttatccatggcctcctatggtggtgagcttcttctagactcatcttctccttga

SEQ ID NO: 78132 - DNA, 479 bp, Glycine max
  Peptide Sequence Number=SeqID_169817
atggggacaaatcaaaacggcaaaaggttttataaggtcaaggttaaaagtctagatgtcactagcctcaaggaattaggacgattgatgggacccctccaaaggcaagccttccgcaaagtgtacgggaagattctagatttggccgcagcggaggtttttacggaagctgccgtatccctcgcccaatactatgaccagccgttgagcaaaggagttggatcgcacgaagcaaactcggaacgacgtagtgggcctcagaagtatttggaaggtaaggcaagggatatggcaagccaagagaagtgggggccgtttccggatattttagctttgctgatttttggggttgtcctcttcccgaacgtcgacggtttggtggacctagccgccattgatgctttcctcgcctatcaccatagcaaggaaagtccagtggtggctatcttggcagatttgtttgacacctttgaccggag

SEQ ID NO: 78133 - DNA, 456 bp, Glycine max
  Peptide Sequence Number=SeqID_169818
atgtacaactatcatgagaaaggaagagctcctaatcttgaaagtgtattggtagtcttcatgacataccaagctagctctaaagcagaaggattgtctaatatggatgacctattaatgcaattcaaagatactgtagattcaatgcaacaagcctttaaaagaattgaaactcagattggcaagttggtagatgacatgactaaagttgtggtcagaagagaagaacaatatgcagagattgaagcacatcaagaaagcattcttcaagttaccacaatccatcatcaattgatcaacgaagaagaaaaggatgaagtctctagtactccaaaatatctctacatggcaactgttggctatgttgtagggaaagataaaggtcgattggaactcagtgtggaggatcataaaatctattttgacctctttgaagccatgaacactcaaatatag

SEQ ID NO: 78134 - DNA, 573 bp, Glycine max
  Peptide Sequence Number=SeqID_169819
atggaagccatcacaaacggcatgatgaacatgaatcgccagcggcatcagcaccttgtcgccttgcgtatgatattttcccatgaaactgccggaaatcgtcgtggtattcactccagagcgatgaaaacgtttcagtttgttcatggaaaacggtgtaacaagggtgaacattatcccatatcaccagctcaccgtctttcattgccatacgaaattccggatgagcattcatcaggcgggcaagaatgccgtaatatccagatgaacggtccggtgaaagttgaacctctacgtgccgatcaacgtctcattttcgccaaaagtggtcaaggctccctggtgctccagtggcttctgtttctatcagctgtccctcctgtttcagctactgacggggtggtgcgtaacggcaaaagcaccgccggacatcagcgctggcaagctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 78135 - DNA, 216 bp, Glycine max
  Peptide Sequence Number=SeqID_169820
atgccaatctccccctgcaaaagtatcggttggtctgtgtcgtcccgacatggggatcgcacccacaagacacccagtggacccgaaaaagtcgaacagggccctggggtttccagctctggttacgggcctctatcagtcctacagggtgcccgtaccccccggcaaggtcacgtcatcataggtaagtatgcacattgctcaactgatttctga

SEQ ID NO: 78136 - DNA, 207 bp, Glycine max
  Peptide Sequence Number=SeqID_169821
atgatcaacgatggtgagttaatccaatcggaattacctccaacaacacagtaccaattgccaaaggtcaaggaaagtaatgataaacctgtcattgccacaccctttaaaataaaggatgtcaatgaagacatcacctcaaaagacatcaaaggcctaatggaacaggctaattacaccaacaaatatcttcaagtattaggataa

SEQ ID NO: 78137 - DNA, 60 bp, Glycine max
  Peptide Sequence Number=SeqID_169822
atggttcaaggcaaatttgtcccaaatttgggggagttagtatcaaggtatgaaagctaa

SEQ ID NO: 78138 - DNA, 156 bp, Glycine max
  Peptide Sequence Number=SeqID_169823
atgaaccttggaaccctttactcagcctccctcacccctatttatagtaaaaaaggggacttggtggacttccagctttcccaggcaagcaaggttacttcagccctaagccatttgggggcccaggcaagccagaggctggcctgggagagctag

SEQ ID NO: 78139 - DNA, 192 bp, Glycine max
  Peptide Sequence Number=SeqID_169824
atggctgttgtaattcatttttgggcactgatcgcgatgacagcgcagttgatccatgatcgcgtcgtgatggagtgcctagagggtgtttgggagaccctcaaagacaatgagaggtgccaattctatggcacagttcgactcactgctacttcgctagtacatccggagcaacccgcacgcacactttag

SEQ ID NO: 78140 - DNA, 240 bp, Glycine max
  Peptide Sequence Number=SeqID_169825
atggcacgcaacgtgtttgctccatgcccctatttaaagggacctatatgggagggaactaaaagggcttttagtgataattccaaaggtggtcatatctctcttgatggcctaggatcttcttcatcaatggattcctttgcttcttggaagataaatggtagcggaatggagaaggaagagagagaggagacgccacttcaaggagaagatgagtctagaagaagctcaccaccatag

SEQ ID NO: 78141 - DNA, 639 bp, Glycine max
  Peptide Sequence Number=SeqID_169826
ggtggacccttgggtactagtaccctcaccttcggaggactacacgtcctcccctttagagggccacacgcccttgccttcagaggaccacacgtcctcgccttcagagggctacacgccctcaccttcagaggactatacgtcctcgccttcagagggctgcacgccctcgccttcaaaggactacacgccctcgccttcagaggactgcacgtcctcacctttagaggactacacatcctcgccttcagaggactacacatcctcgccatcagagggctgcacatcctcaccttcagaggactgcacgtcctcaccttcggaggaccgcacgtcctcatcttcagagggctacatgtcctcgcctttagaggagtacacatcctcgacttcagaggaatacacatcctaaccttcagagggctgattcacgatgtcggatacaatgtccaggacatcctgcctgaaaatactggaattgctaaaagcattgaagctgcaggatcccacgatgtcggatacaatgtccaggacatcctgcccgaaaatactagagttgctaaaagcattgaagctgcaggatccacgatgtcggatacgatgtccaggacatctggcccgaaaatactggacatataa

SEQ ID NO: 78142 - DNA, 501 bp, Glycine max
  Peptide Sequence Number=SeqID_169827
atgtgcattgtaagcagcgtcatttctgcttatcctattcgagcttccactccaattgttacctctccactttccattcctcgcaatgttatcaacgctcatcaagccattgccaacccctttgtgccagaggttgtgaaagcagtggatgccttgcattcagagttccgggctgtggataatttggttgcgtgcaataccacccgtgtccttaaagctttccagaatgctcgagttggatctcatcactttggtggttccactggttatggtcatgatgaacccgggggccgtggagctcttgaccaggcttttgcagaaatttttggggctgagtcagctattgttcgttcacagatgagccttggctcaacagtagctattttctcatatctggatatcatgggttcatatcctagaaacatcttcattgcttgtgggatcaaaattgcatgcatctaccctccctgcaccccactaggtgggagccttgtgctctag

SEQ ID NO: 78143 - DNA, 61 bp, Glycine max
  Peptide Sequence Number=SeqID_169828
gtttgacacagaagatttcttctgggggcttcttgaggaagacattaaagaaagacagtag

SEQ ID NO: 78144 - DNA, 159 bp, Glycine max
  Peptide Sequence Number=SeqID_169829
atgcatattgttgtggtaagacaggggcaggatcatcttgagctaccttctggggtagagacaaagctagaacagcagaaaccaatcaaggtacatagggacggatgcaagtggggatggggtcacgaccgaccgatcgttgccccttctctgcgctaa

SEQ ID NO: 78145 - DNA, 284 bp, Glycine max
  Peptide Sequence Number=SeqID_169830
tgtgcgtatctgggctgcaacagcttgcgctggatgagatctatcattctcctgaaaattctgcacttaaagatctaaaagataaagatgtcctggacattgtatccgacatcgtggatcctgcacaatctgttaaagctataacagatttatgtgtccagtattgtcgggcaggatgtcctggacattgtatccgacatcgtggatcctgcagcttcaattcttcattggacattttatcttgccttgtgcattgtgcagcccgatctgattccttgacataa

SEQ ID NO: 78146 - DNA, 1605 bp, Glycine max
  Peptide Sequence Number=SeqID_169831
cggctgcgggcagagcgtggccggcggcggcaactgccgcgctttttcgagccagaaatcggcgtcgcgctgccaggccggcgcctcccggtaagcctggtattccgccaccacgtcgctgaacgccgtgaaaggcgtcggttccagcgcgtcgccgcggcaaatatgggtgtaaatcgccgccacgcggcgagcgatggcggtgaagctgaaaccgtccaccagcagatggtgatagcgctgataccagaaccagcggttatccgccaggcgcatcaccacatggcgatacagcggtgcgccgctgccggcgcgcagatcgctcgccagatcgatgtccatcagcgcgcgcgcggcggcttcgggatccggcgacgtcgtcagatcgacaagttccggctcgtgcaccgccagcgcgtcatccagccattgcaccggcacgccgtcgcgttccgcaaaacgcaggcgcagcatgtccacctcgcccaggccctggatgatggcctgcagcagaggctctacggcaatggggccgttgagttcgatggcgtgggccaccgcgtaggcattgcgatgcggggagatttgatcggcgacccagatgccgggttgcgccgcgaccagcggccattcgcccgcaagcgccgggccgctgagagagttagggaatgtcttgccaatgctgttccagccactcggtgcacgcggctttccatcatgtgttcctcgtgccgtcgccgatgccggataagcggtggcgaaagcggaggcccagaccgcctgcagcccgtcggtcaggccgctgcgccagcacaacgcgtcgtgcccgccttccaccacccggtagtgcacccgatggccggcgtcgctcaggcgagccgccatttcgccgctgacccgatgcaccagcttttcctgcgaaccggcttccataaataccttcagcgcaccgtggttgcccaggccatgccgttccacctgctgcatcagccagcaggcgtcgtcggggatgctcggcagctgcagcatgtcgcgccgcggccaccagtaggaaccggactgggtaattaccgcgccgaagcactgcggccagcgcagcccggcatacagggaagccaggccgccaaagctttgccccgccaccaccgtatcggccggtttgtcgctgtgcggcgcccagtcggccagctgcggcatcagttcttcctgcaccgccagccagaaatcgtccttgcagaccggcatctgcttcgcccagaactgaccgtcgagcaggatagccaacggacgctcggccggcttgctgtcgccggtggtgtagatccaaacgtcgcggctgttgcccaggcgctcgctctgccagcgcccgctggcgatctcatactcgtcgaacgaacgccataccggctgcggcggcgcatccggcatgtgcaggccggagacgctgtggccgctggcgctttgccaggagcgatacgggttgagcagatcgggggtggcgctggcgaacacctggtgccaccagtggcgcaggttgtgcatgttggcgtgcgcatcgtcgccgctgaacgccggcggccgctcgtcaaagcagggaataaagca

SEQ ID NO: 78147 - DNA, 378 bp, Glycine max
  Peptide Sequence Number=SeqID_169832
atgtaccctcccttgttctctttgaacctagtggatgtacccttcactagaactgatccacaagagatgtaccctctattgttctcagtcaaacccaaggagaagggagacataaaagaattcaggcggttagtccttcgttcttttggaaaaaggagaagagagacacaaaaagaattcaggcggttagtccttgacgaattctttttggcaaagggagaagagaatggaaagatgaatagcacaagttttcaaggtttggaaaaccagaaaacttcagaaagcttttggtacaaagaagaagaagaagttcaaagagattcaaggctagtaaaggattgtaagaaattgattggaaaactattcaagattgaatga

SEQ ID NO: 78148 - DNA, 310 bp, Glycine max
  Peptide Sequence Number=SeqID_169833
atggcttacgaacggggcggagatttcctggaagatgccaggaagatacttaacagggaagcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcatccgaccgctgcgccttatccggtaactatcgtcttgagtccaacccggaaagacatgcaaaagcaccactggcagcagccactg

SEQ ID NO: 78149 - DNA, 505 bp, Glycine max
  Peptide Sequence Number=SeqID_169834
ggccctgggatttcccgccttgatcacaggactctgccagtcgttcggcgtccccgtcacacctagcaaggtgattcggccgcccatcacccgagcttttattgagaagtactgcacgcagagacaggtccagggtgatgcaccacaggccacggacgcgccgccacctcatcaggctagtccggccggatcatttaacacgaagcagtatttgtggcatttggttcgccagcaggcggccaaccaccgggcacatgtacagactcatgattgtctttatcagatgagtctcagcctgcagagccagggctttacttctttttcgtgccctactccagaccagttcagggcagaggtcgcatggcctggagattggcctgatgcccaggcaggagaggcaccagcaggggcaccagcagaggctcccgacgaggcagatgaggcccgcgaggatgaagagatgactgatttacttgatttcttaggagggagcgatgccacatga

SEQ ID NO: 78150 - DNA, 413 bp, Glycine max
  Peptide Sequence Number=SeqID_169835
atgacaaacaaggagcgtcgtaacaagagagaattacaagaactggcaagagttcaaggcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 78151 - DNA, 255 bp, Glycine max
  Peptide Sequence Number=SeqID_169836
atgactaggagtaagaccaaacagtcagtagataccctccaacaaatggtatcagacatacttaacaaggccaaagtggagaaggatgaaggcccagaggcaaagcttctctcagggttccttgttgaaccaatctcagacttatcaaggtatgacgtctaccctgacttatcttccctctctggaagtggcatcattcaaaactctgtaacctgtatcaagcgatctgctcctagtaaggatcacatcacctag

SEQ ID NO: 78152 - DNA, 213 bp, Glycine max
  Peptide Sequence Number=SeqID_169837
atgagccttgcggtttttggagatggtgaagtagcatatccatttgtagaagccatacctacaaggaaagtcaatgcacaaaaatattgggtttgcacatgggtacgtcaatccgtgaatcgggtcgtctacaatctaaccatggtggtgaatgacaacgatgaagccatggtgatgtttgggggatgtgaatgggaaggctatgagagttag

SEQ ID NO: 78153 - DNA, 387 bp, Glycine max
  Peptide Sequence Number=SeqID_169838
atggctcttcaactggaaaaaaataaagagacattcaagaagaagggaggatcttcattcaaatctcatgaaaaaggtgttgcccttggtaaaaataattctaaccctactcctacttcttcaaagtcaaggaaagggaagaatcaaaagaattctcaagcggttagtcctttgaatcttttgtcaagagggggaagggagaatcaaaagaattctcaggcgattagtcctttgaatcttttggcaatagggagaagggatgaaaagatagcacacttttgttttctgcaaaattttcacttgcagaaaaacaaagttttgaaacaaagtttagaaagctttttggcaaagaaaaagcaatgggcaatggttagagaaagattgtga

SEQ ID NO: 78154 - DNA, 225 bp, Glycine max
  Peptide Sequence Number=SeqID_169839
atggaagtggatctttctcagcaaccgcacagtgaaaaagtggaagaaaaagtggtaagtgaagaagagaagaaatcaaatgaacaagccactaacaaagagctatcattgcatggcctggggacaagcctatttttcaggaggaggatgaagacatggcagatcctgttgattatttcattgaaggagactgagctccttaaccatgatcatcaaggagaataa

SEQ ID NO: 78155 - DNA, 246 bp, Glycine max
  Peptide Sequence Number=SeqID_169840
atgcataaggcattacgggccaatgcacctcttccttaccctcaattggtcactctttttctccgtcattttcaaattcctcttgatgatgaaccttttgttcaagtcaagcgttcctttgctataggtgctggtgcagtcacttcttttggttaccgaatagatatccgtctcacacaacttgaagaagatgtgggatatattcgtcagagctttgatcttccaccaccaccaccactttcttag

SEQ ID NO: 78156 - DNA, 741 bp, Glycine max
  Peptide Sequence Number=SeqID_169841
atgattatgaggggccaagacatttatagtagccaagatgaggctactacttcaccttcctctagtaaaagtgaagaagcaaaaggggaagaatctagtgaagagatctacccccaagaagaaggacaacctttaatggttaaggaggagtgtaaggaggtaaatgtctcctccaagaggttagctaagaaggaaagacattttgaaataaagacaaatattaaagaaatttcccttcttagacaacctccacattttctcctttgtaaaaagacacttgttagcattgccacatctcttaggcttgagtttattcctcaagtaaaggagttgttggatgagggtttggttcgcaagagattaaatccttgtgctttgttggtgcccaaaataggtattattaggcaccaaatccctaaaataggtggtgtgatgaatgctttgggtggtgcaacactcttttgtaaaatcactcgtgaacccaacatcttcatgatttgtgtacatagggactcattaggggttcccatgaaccctaagagaataaaggtcattcctgagtggcccgctccaccaagtcaccactcattgaggccattggagcttgtaggcctaggatcttcttcatcaatggattcctttgcttcttggaagatgaatggcagcggaatggagaaggaagagagagaggagacgccacttcaaggagaagatgagtctagaagaagctcaccaccatag

SEQ ID NO: 78157 - DNA, 66 bp, Glycine max
  Peptide Sequence Number=SeqID_169842
ggtgcagggagtaagattctggtgaggaaccgccgagccgatgtgatgacgttggcgttattttag

SEQ ID NO: 78158 - DNA, 378 bp, Glycine max
  Peptide Sequence Number=SeqID_169843
atgtcgttcgcaccgtccttgacggttgaaagtgtccatttcttagtcaaaagcttcagggatttcaaattccgcttgaaaaacaataaattaggttttattgtgtcatatgtcacgccgaccttatcacgagcgacattccccaaatatgttcttaatttcttcttgtggggaccgtcggccttgccgatagcaggatcgacgttgaccacaggtcattctgccccaggtggtctagtggccaatgatcgtagccgtgtcgccttgcgtgtccgcttcaacgtagatggagatgctgatgcgtctacaggaggaggaggtgtagatgcaattggctttgatgttttgatgatgatcatgatggtgtgttgcaattga

SEQ ID NO: 78159 - DNA, 510 bp, Glycine max
  Peptide Sequence Number=SeqID_169844
atgggggagcgagaattggaaccactggaaatcaacgatgaggctggaccaatcgctagagaccctgggaagaaggcaaatgaggctttgattaagaagagtgaaaaagagaagtttgttaggattgttggggcaagagatattaggttgaaggtcgacgacaaccgcggacacgccgctgtagaaaccgaggatgcctttggactggaaggttttcacaattgtgtcgcgagtgtttttgtaaatttgtgttgtgcccttggtctacatcttggttttgatggcgtcgagggggaggaggcagacgtaagtgaaggcgctgacgaggccactcgcggcggtgtcgatgaggacatgatcaaggacaaagagggttttgaggaggggctttgggctgggctttgggctgggccgggcccatttggaggtggaggcgaaggggagagtggggggaggccgagagaggatgagaaggtgtggtgtacttgtgttgggtgtaatgaaatttag

SEQ ID NO: 78160 - DNA, 1398 bp, Glycine max
  Peptide Sequence Number=SeqID_169845
atgggtacatcgcctcaccaaaaggatgaagggggcgttcgtcatacctctgctactgcaacattggatgatgtcgtcggtgcaataaagcatttgactcaaacgctggaaaacatggacaaccagaacagaacaagactgaatgcaatagaaaacactaaccacacaatgttgaaggccatctgcaacttcgtcaggcaagaccagcatgagtcaacgaaagatgctatggacgatgtagcaatgagtggaacccaaaatacttgtgtcaatgatcaaagacttccgtgtgaaaaccctaagaagccggtgtccaccccgacagtaaagtcgacgaaaaacgaggcatactcgaaatcgacgggaagttttaaaaatattgaaacaatattcataccaggcgacgatgatgatgaatttatcaacccgttgccaatgggaatgaagggaagtaaaagcagctactcgtctccgagaacactaaacctttcaggaccgaaccaggtcaacaccacagataactcctccccaccggaaccattcatgagcaactacgttactggactgacaacaaaggacatgccctgctgcttcaagccaactgtggacatgaatcttacatttgaggagacacaggtttgtgcgtatgtgttcaaccctaatctggaccccagcgggaaggaaattctatatagggtaggaaacaacttgggcacacgacaaacctttcattcgttgtgtcccaataagccagtaagggaggagataatactattcatgtgtttgaaggttgcttacagccaactgtaccgcaccaggagtgtttggtgtatgccaccagcctttgcggtggacgtcattaatggaagtccagtggaaactctgattgaacattatggaaaggattggatgcctccattttcggacttgaagctcatttacattccaattattcaaaattcagcccattggtatctcatggtcatagacatgaatgacagaaacatttatcatctagattgtgacctcacaagtcaaactgcatatcaacgcaaagataccattaaaatcatggcaaatgtgatgcttagtgttctggaaattgtgtttccaacacaagaattcgttattggctttgatggaatggattgttgggatattattgaagctagaggaattccaaattgtggatccagtgagaaatcaacattatgggtccttgaatggatgcaaatggaggagtcttttgtcagtcttttgtatggagtgctagaagaaaaggccgttagaatgaaggtggcaatgatcctgctgttagggacacataaccagtgcaggggagagttgattacaaatgcagagcgcaactggcatgactccatccatggcaaacactga

SEQ ID NO: 78161 - DNA, 840 bp, Glycine max
  Peptide Sequence Number=SeqID_169846
atggcatccttcagccagcttcagtcacagatgcaatctcaggcacctcctgagcctcttgttggtcctggtccctccattcctcgggtgagcacaaaggggagttgtgttgatccctcaggaaatgattctgagacgggtgactctgacaggtacggcttgtacatagaagcagatcctgcccgcctggttgccgtggggagagtttatgagggatccactcttgttcataacactcctttgttgcctagccaagtaaagttgagtgtggacgaggttaaagatgcagatgctccagttcatgtacccactgctgaggtagctgtgtctccgccaaaaccacctccgaagcccgatccggaggtcgatgatccgctttatctgatgacattgaccatcccagagcttttcttgaggccttatcaggttagatgggatgccaccgtgttcggggtcgttaatccatatttccccctatacataaagcacgaagacctctccaaaatcgcacacggtggtcaatgtctcagcatatcaatgttacagttgtggattctgttccactgcagcggacattggcagatggtggtcatcctgcccaaggaacacttagttgtctggttttgttcattgcataacaggccagacaactaccttaaggggattattaatagtgctatcaagggtcttgatgatgctccacagcctaaatcaaaggctcttgctaggtggattgtcgtcaagtattttaacaaccctagaccattggagcctgagagattaaaagcattgcggattcaatcggcacagttttatctccaagttagagatcaggcctag

SEQ ID NO: 78162 - DNA, 792 bp, Glycine max
  Peptide Sequence Number=SeqID_169847
atggagtatcaatcttttggaagagtcccaacagcaaaaggggctaacataatgcaggcattgaagcactcaacaaacaatacagagaactatagcgatcaaaccaagcttgatgaaggacatggagttcttttgttgggggaaaaaaagatgccatcacggttagatgaaatggcttttcctgactcaggaaatgcagattttgcagcagaagctaaagagtcaagtaatggtaggaatgatgagtctgatggagccaaggaagataaggctcaacaagagttattgaggcagaaatatagaaaaatgtgcatgaatggatgcctcgttttctccgtctggttccccccacgtgcgattgaagagccaaagcttccctggactacttttctgctttcctcaaaaggttttttcaaaagcaaaggaaacaatcagccccttttggagaacgacggtggtgccatggaaaggagttcgtcatcgtacaccttcgaggcccgaagtcgcgtgttttgtctgtgtaacatagaggctccactagtgacatcgtggactgaggaaaatccagggaggcgtttttatggttgtggtctatacaaggatataggtacgaaagggtgtaatttttttcagtggcatgatccagttggcaacaatcgacaaaagaaaatcattgtagggttgatgaaggaggttgatgaattgaagttgagggaaaaggatttgcaaaccatgattagtgagatgaagatgaaggaaaaatgtttatggattgtattggttgtttgttga

SEQ ID NO: 78163 - DNA, 402 bp, Glycine max
  Peptide Sequence Number=SeqID_169848
atgtcagtgaaaaacctcgtcgggcgcctaggagtacatgataagacaaaccacacaataggagaccagtcagggtcacagtgttttgcgagaatgttccaaccatatgggatcaacataggcttaaaggagcactcaaaccgtgtgacccccaaggcctacactccgaagagtccgtcagggcttctccctcctgattcagctagcgatagtaacatctctagcggtttcctgagattctttcagttattccttcctctgactgctccgatagaattcccaagcgtcagagagacggagaagagattgaaacctccacttatactgtcttcatgcgaatcctttttctccctcaacgaaaactatcttgaaaatcccaacggtgaaagtgtgcgcaattaa

SEQ ID NO: 78164 - DNA, 171 bp, Glycine max
  Peptide Sequence Number=SeqID_169849
atgtcagtgaaaaaccaccctgggacacttaggaggagaccagtcagggtcatagtgttttacgagaatgctccaactgtatgggatcaacatagggttaaaggagcactcaaaccgggtgacccccaaggcctacactccgaagagtccatcagggcctctccctcttga

SEQ ID NO: 78165 - DNA, 639 bp, Glycine max
  Peptide Sequence Number=SeqID_169850
atggaagaagaacacgcgacaaaggtgccactaccggacgctttccttcagttcctggagaccaacgggctcgacccttccatttacactgctattgattccaccccacgatacattcgggcataccgagaagggaagatatatggaattgatgcagcttttggagctgtagttatggctttaaatacctggggatcatgttctcgacctgtgtgctactcctgtactgagcaggtgagtctgggttggaaggaagagtggatgtgttcaaggagtggacatctagaagaccatggaaagagaggaaaaaggcaaataaaagtggaaacacttgacattgtcaaagctttattagacaagtctctcactacaggctttccagctgccagaccaatggaatctgactttcctgcgaaagccttgtatttaaactgcccacaactcaatgatcttaatctaaattcttgtagaaatttgcatccaggtagtcattttacgccatgctctattgccattatcagccagaaatttgatgcaacattacagatcatccagatgtatggcctaggctttgtgagcactggtggatttggtatgccttcatactttcctttctttctttataccttgctatcatag

SEQ ID NO: 78166 - DNA, 849 bp, Glycine max
  Peptide Sequence Number=SeqID_169851
ctggtgattggtaaagaggtggcgacttcgctctcaacgcgcggaaccgatctcaaagtggaacgcgtggtggtcactaacgagaaggtattagggaagaaaatccgcgatctgcactttaaacaacgctatgacgtcgtgatctcgcggcttaatcgcgccggggtggagctggtggccagcagccatgccagcctgcagtttggcgacattcttaacttagttgggcgtccacaggccattgacgcggtggccaatgaactcggcaacgcgcagcaaaagctgcaacaggtgcagatgctaccggtgtttatcggcattggtctcggagtgctgctggggtctattccgctgtttatccctggtttcccggcggcgttgaaactggggctggccggcgggccgctgattatggcgctgatcctcgggcgtatcggcagcatcggcaagttgtactggtttatgccgccgagcgccaacctggcgctgcgcgaactcggtattgtgctgtttctggcggtggtggggctgaagtccggcggcgattttgtcgacaccctgctccacggcgaggggctcagctggatcgcctacggtattttcatcaccgctatcccgctgctgacggtgggcatactggcgcggatgctggcgaagatgaactatctgaccctctgcgggatgctggcgggctcaatgaccgacccgccggcgctggccttcgccaacaacctgcacgccaccagcggcgcggcggcgctctcctacgccacggtttatccgttggtgatgttcctgcggataatcacccctcagctactggccgtgctgttctgggggctgagttag

SEQ ID NO: 78167 - DNA, 324 bp, Glycine max
  Peptide Sequence Number=SeqID_169852
atggataaccatcaacatggaaatcatagtgatacagcacaaaccaggataaagaaaaaaggtaccaggcagcacaaagttaatgatcaggctcagaatattgattctaatattcgtgattcatcagaggatgagagttctgaatcaacacaaggctctgcttcagtttcttcacctgaaaatcaaaactatatgtcctcagctaatgagcctgcaattaatagagaagggtattctgatcttggtggccaactcatacatggagccactgtaatgcaaatatgtggtatgatgaaagaatctcaaaacgtgaaagaactataa

SEQ ID NO: 78168 - DNA, 426 bp, Glycine max
  Peptide Sequence Number=SeqID_169853
atgaagcacttcactgacaccctcatcagtgccaacatagataagcattcatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 78169 - DNA, 1153 bp, Glycine max
  Peptide Sequence Number=SeqID_169854
gctgttctgcgcgccccgcccgagataaatcgtgccgccgctgttgttggtgaagcggctgctgtcgctggtgagcagcacgccggaagtggtgccgcgcgcgctggagccgttgacgcccacattgatattgccgctgttgctggcctgcgcattggcatcaaggcggatgcccgccacgccgttggtcagattgctgccggtggtaccgaggttaagcacgccattgtttgtgaaatcgccgccattttgcaccgttaccgccgtggcgttgttgctggccgcgccgacgccggtgccatcaatacggttgaggaagccgccgttgatgacgccgctgctgctgttggtggccgtcgcgccatccagcgccagcgcggtgccgcggctcgccagtttcccgtcgatggtggcattggccccgctggccacgcgtaccgcgccatcgctggcccctaccacttccagcgttttaccggcggcgacagtgacctgcgaaccggcgccttcggcattgatcaccacgcggctacctatcggctgcgtcacttcatccggcgcagtggcgctgacgttatagacaatatcgccgttggtgatagtgaccgcctgattgaacgcgctgagggcggtggttttgccgtccagcgtctgcacgctaaagctgccgttataggtggcgaggttttgtaccgccaggctgtcggtcacctggccgccggaaacgttggccgcagaaccgttaaaggtgatgcggttgttgttgttccagttgagggtgccgccgttactgacctgaaacagcgtggtgtttttggccgccatggtccaggcgttggtgctggcgctgctattggcgttagcctgaccaatgctgacatccagcgaactgccgctgccgctgacatcggcgatgcgcgcgtcgatatactgattgtcattcacgttttgcagatccggtaccaccgtgctggcggtaaccggtgcctgcgccaccaggctggcggaatcaaacacctgaaaggtggtgttgccgccggtagtgggatccggcacggtgatggcgaggtattgtgcgcccgccgcgatggtcacctggccgagcgtggtgttgaccgccccgtcaatgcccggctcaaacgcctgattaccg

SEQ ID NO: 78170 - DNA, 249 bp, Glycine max
  Peptide Sequence Number=SeqID_169855
gacagagagcttaggggaagcagtaatggaagcatcggcggctatcataagtggctgagagtccggacacaaggattggattggctcccaaatctaaagactatgagagatgatgcggttaaagcttcggaagaaagtgatgaggggctttatagggcagcaatagtgagctcaagctccgaagaggtgaaaggaatcatcacgggtcaaaggcatgatcttgaaggacgagctaaaggcttgccttag

SEQ ID NO: 78171 - DNA, 315 bp, Glycine max
  Peptide Sequence Number=SeqID_169856
atgaagaagaagattgagatgatgaagaagacttttccttctttgttaagaaatttcagaaattcatcaagaaaagaagaattgacaggcgtcagaatttcaataatggaagaaaatcacaagatgattctcaagtccttaggtgttacaaatgcaaccaaattggtcacatcaaggccaactgtccttcaaatgaagaatggtcggagaaaagtgaaaagagaagatttgatgaaagaagaactaagaaagcatacattgcatgggatgataatgattcatccgatggttgagaaaaggagattaatcttctaa

SEQ ID NO: 78172 - DNA, 309 bp, Glycine max
  Peptide Sequence Number=SeqID_169857
atggtggttttttcaagtgttgagagagttagcggttcggtgaaggtgaaactcttatcgggtggtgtgttttttcggtggagaagaaggtcttccctaagaagcttgcggaagaacttcttccgtaagaagcttgcggaagaacttcttctttttgctaatatggtgtcgcaacctacccttcggcaggagggcaacgcggggctcacgggtgcgtctttcaagaaaggaaaatgcgcggaatcgccaccaaggttgattcgaggaaaacgtcagaaaaaccggaaaggtgtggtctacaaactttaa

SEQ ID NO: 78173 - DNA, 399 bp, Glycine max
  Peptide Sequence Number=SeqID_169858
atgtattgtcggaagatgggggcatacgtaaaagatgaggaattgttgatacattccttccaagaaagtcttactggggtagctgttacctgctttgcggatttggtcttcgccagtgaaaggatcgatgtgggtccgaaaagaggcaaatttagtcatcctgcttggacaaatgagaaaactgggacaaatgaagaggatgaggatgaagtagaagcccatgctgtgactgccattcctatatggccaagtttcccaccaacccaacaatgtcattactcagccagtaacaacccatctccttacccaccacacagttatccacaaaggccatccctaaatcacaccacaaaacccacctactacacgaccaatgctgaaacaccacttttagcatga

SEQ ID NO: 78174 - DNA, 507 bp, Glycine max
  Peptide Sequence Number=SeqID_169859
atggcaatgatggtggcccaggtgatgttggggaatggctacgagcccggaatgggtttaggcaagaacaacggcgacagaaccatcctggtaagcaccaaaggaaaccacgggaagtttggattaggctataaacccacgcaagcggacataaggaaaagtgtcacgggaatgaagagcagaagccaaggacacgaaggccaagtcattgcgatatgcgaggatgactctctgagtgagtcagatttggtacgaccatgccctcttagtttccaactaggaaattggcgagtggaggagcgcccggacatttacgcgacaagcataatatccgactacgagtccctcgaaggtactaatacctgggacccgaccatcaatttcaagcaaaaagcgggtcagacagagagtgaagaggacgaggatgtggaacttcccctggagttggagaagatagttgcccgtgaagaccaagagatggggctcatcaagaagagacggaactag

SEQ ID NO: 78175 - DNA, 216 bp, Glycine max
  Peptide Sequence Number=SeqID_169860
actcatcttctccttgaagtggcgtctcctctctctcttcctttctccattccgctgccattcatcttccaagaagcaaaggaatccattgatgaagaagatcctaggcctagaagctccaatggagcttgcatcaaatctgctggcttagcgagccatccgctgagcacaccattcccttggctgagtgtgaggaagaatctggaagaaggatga

SEQ ID NO: 78176 - DNA, 209 bp, Glycine max
  Peptide Sequence Number=SeqID_169861
acttatcaaggtaatccttgtgacgtctaccctgacttatcttccttcaccggaagtggtgtctaccctgacttatcttccttcactggaagtggcgtctacccagacttatcttccttcaccggaagtggcgtctatcctgacttatattccttcaccggaagtggcgacatccaaatcttcgtaacctgtatcaagcgatccacccc

SEQ ID NO: 78177 - DNA, 348 bp, Glycine max
  Peptide Sequence Number=SeqID_169862
atggcctcgagaaagcttcccgcaaagaggtccaggaaggacaccaccggaaagggctccagtgctgccccgcagggagagatagcctacaggcattgggcaccgcttgtgacacccatggctaaattcgatccaaagatagtcatggagttctacgctaatgcctggcctaccgaggaaggggtccgagatatgcactccagggtgaggggccagtggattcctttcaatggagatgccctcagtcagttcctgggacacccactgatcttgggagaggaccaacaatatgagtacagccagaggaggagtcaggcctctggctttgatgaggaggctatcgtgtag

SEQ ID NO: 78178 - DNA, 258 bp, Glycine max
  Peptide Sequence Number=SeqID_169863
atggaggattgggggaattttctccaccgaatcctggaggaggattctgaggattccgctccgattaaagtgttcctcttggtgtgggggttcggcggctcgtggcagccactggtggttgtgggtggtggagaaagaggtgttagggaatccacttttctcgctcagcatgcaaattcttgctcagtgcaacttcctctgcactatggctcgctcagcgggccaattcttgctcaacgcaattccctctcgggttga

SEQ ID NO: 78179 - DNA, 850 bp, Glycine max
  Peptide Sequence Number=SeqID_169864
atggcgccgtaccagaagctgcgcgccacgctgtatcaggagatgctgggccgcatgaaccctgacgatcgttcggtgccgtatcagctcaacggctatcgctatcaggaaagctacgccgccggtaaagatttcgcgcggtatcagcgccaggcgctgaccgccgacgcgccgtggcaaaccttgctggacgccaatcagcgcgcggccggccacgcctactatcgcctgggggcgatggacgtcagccaggacaaccgccggctggcggtggccgaagatctgcagggccgccgccaataccgcatctccctgcgcgagataggcagcgaacgctggtcgccggaaacgctggaaaacacctccggcaacatggtgtgggccaacgacaaccaaaccctgttctacgtgcgcaaccacccgcaaacgctgttgccataccaggtctatcgccatcagtacggtacgccgacggcggaagataagctggtgtaccaggaaaacgatccggcgttctacctcagcctcggccgctcgtcctcgcgcgattacctgattctgaccatcagcggcaacaccacctccgaagtgcgcctgatcgacgccaaccagccgcagcgcgagccgcagctgttcgccgcccggcagaacggccgcgagtattatctcgatcactaccgcggcgagttctatctgcgttccaaccatcaggatccgaactttggcctgtaccgcacggcggcggcgggcaaaccctggcagacgctgatcgcgccgcagcgcagcacgaggtggagagcttcagcctgttccgcgactggctggtggtgcagagcgcgccaacgggctg

SEQ ID NO: 78180 - DNA, 819 bp, Glycine max
  Peptide Sequence Number=SeqID_169865
atgagtttacctaacatcgctgaagtaaaatccttcctgctggcgctgcaggatcacatctgcgcgcagctcgcccaggccggcgacggcgccgcgttcaccgaagaccaatggacgcgtgaagaaggcggcggtggccgcagccgcgtgttgaccaacggcgcggtgttcgaacaggcgggggtcaacttctcgcacgtctccggcgccaccctgccggcctcggccaccgcgcaccgtcctgagctggccgggcgcagcttccaggcgatgggcgtctcattggttatccatccgctcagcccctacgtgcccactagccacgccaacgtgcgcttcttcatcgccgaaaagccgggcgaggcgccggtgtggtggttcggcggcggctttgatctgacgccgttctacggtttcgcagaggatgccgtgcattggcaccgcactgcggccgagctgtgcgcgccgttcggcgacgaggtctaccccaaatacaaacagtggtgcgacgattacttcttcatcaagcaccgcaacgaagcgcgcggcatcggcggcctgttctatgacgatctgaacaccccggacttcgaccactgctttgccttcacccgcgcggtgggccagggcttcctcgacgcctatctgccgatcgtggaaaaacgcaaggccttgacctggggcgagcgcgagcgtcagttccagctgtatcgccgcggccgctacgtggaattcaacctggtgtgggatcgcggcacgctgttcgggctgcaaaccggcgggcgcaccgagtccattctgatgtcgatgccgccgttg

SEQ ID NO: 78181 - DNA, 2086 bp, Glycine max
  Peptide Sequence Number=SeqID_169866
gcgaattcgccgacttgcgccagggctgcaagcagttttgtcagacgctgagcgagctgcagcagcagttcccgatgcgcgcctcggcgcggtgatcgctttcggctacgacgtttggcacgatctctccagcggccagggcgcgcaagagctgaagccgttcacgccgctcggcaaagggctggcgccggccacccagcgcgatatgctgatccacatccagtcgctgcgccatgacgtcaacttcacgctggcgcaggcggcgctggcggcgttcggcaacgccatcaagattgaagaagaaacccacggtttccgctgggtggaagagcgcgatttgagcggcttcatcgacggcaccgaaaatccgcagggcgagcagcgcccggcagtggcgacgatcgccgaaggcgaagaggacgcaggcggcagctacgtgctggtgcagcgctacgagcacaacctgcgccagtggcagcgctttaccaccgaacaacaggaacagattatcggccgcaccaagcacgacagcgaagagctgccggccgaccagcgtccggatacctcgcacgtcagccgcgtcgatctgaaagaggatggcaaaggcctgaaaattttgcgccagagcctgccttacggcactgccagcggcaagcacggcctgttcttcatcgcctattgcgcgcgcctgcacaatatcgagcagcagctgctgagcatgttcggcgatctggacggcaaacgcgacgcgatgctgcgtttcagccgtgcggtgaccggcagctactacttcgcgccatcgctgacgcgcctgctgaatgactcagtgataaggtgcagaatgaaacaaaaccgggttaaaaatctcgtgctgaaaggttggctggcggctgcgctgttggcgagcggcgccgcgtcggcggcggaattgctgaacagctcttatgacgtttcccgtgaattgttcgtcgcgctgaatcccggctttgaacagcagtggaatcaacagcatccgaacgataagctgaccatcaaacaatcgcatgccggctcgtcgaagcaggcgctggcgatcctgcagggtttgcgcgccgacgtggtgacgtataaccaggtcaccgacgtgcaaatcctgcacgatcgcgggcagctgatcccggcggactggcaggcgcgtctgccgaacaacagttcgccgttctattccaccatggcgtttctggtgcgcaaggacaacccgaagggcatccatacctggaacgatctggtgcgcgacgacgtgaagctggtgttcccgaacccgaaaacctccggcaacggccgttacacctatctggccgcctggggcgccgccagccaggccgacggcaacgacgcggccaagacccgcgccttcatgacccgctttctgaaaaacgtgctggtgttcgataccggcggtcgcggcgcgaccaccaccttcgtcgagcgcggcttgggcgacgtgctgatcagcttcgagtccgaagtgaacaacatccgcaagcagtacggtgaagacaagtacgaagtgatcgtgccgccggtcgatattctggcggagttcccggtggcctgggtcgacaaaaacgtcgagcgcaacggtaccgaacaggcggccaaagcctatctgaactatctctacagcccggcggcgcagcaggtgatcaccagcttctactaccgcgtgtatgaccagaaagctatggcggcggcgaaggggcaattcccggacacccaactgttccgcgtggaagaccagttcggcggctggccacagcctcggcagcagcctgttttatacctgtttgatcctgctgttgccgctcaccgcgctggtgatgcagctggcacagatgagcctggcgcaatactgggaagtgatttccaacccgcaggtggtggcggccctgttcaacgcggtgttcggcatgctgatggcctggatcctgacgcgctaccgttttcccggccgttcgctgctggacggcctgatcgatctgccgttcgcactgccgaccgcagtggccggcctgacgctggcggggctgttttccaccactggctg

SEQ ID NO: 78182 - DNA, 330 bp, Glycine max
  Peptide Sequence Number=SeqID_169867
atgggaaagggaagaatcaaaagaatctcagactgtgttgttttgaattctttgacaagggagaagggagacacaaaagaattcaggcggttagtccttcgttcttttggaaaagggagaaaagagacacaaaaaggtggccttgttcgtgctcgtgcgcttagcgcaagctcagaagtggcctcaagagatttctcagaagtgactgcagcttcttgtgtttcatctgccttcttccttctaaccaagggatctggagtggtagtcttggatgactcatcctccatctgttgtggtacctgggctgtgggacctgcatcttccctgtga

SEQ ID NO: 78183 - DNA, 213 bp, Glycine max
  Peptide Sequence Number=SeqID_169868
atgggtgccaagtatctcgaagcggtcaagcaaaggttgcatgccatcaaacaatggtccccagacgaaattaggagagatttcttcttcttctcttcattctatttctcaaaagggattagagaccgagagtctcttgttgtaaagaaatctgaacacaaaggaaggttgtccttgtgtggttcagaacttgtaaagggatttgcaagatag

SEQ ID NO: 78184 - DNA, 567 bp, Glycine max
  Peptide Sequence Number=SeqID_169869
atgagatgcggagggtgtacgattactcttcaagacgtctctgtattattaggtctgcgtgttgatggagcaccattaattggtcagactaatcttgattgggctgaattgtgtgaagaattgttgagcgtcagaccacaggaaggtgaacttcaaggcagtgtgatcaaattaagttggttggcgcaccattttttacagataaatattcatgacggtaacgtagaacatctacaaagcacctatgcatgggcacctgccgtgcttgcttatttatatagagagatgttcaacaccgccgattacaaaatcaaatcaatcagaagtatgtacatcttaatccaaatgtgggcatggaaacgctgcacgactttgactccaaagaggactcctcctgtaatagaaaataaaccactcagacacaggtggctgcgacgtggaaaccagcatattggcaatgatgatctcatagtttttcatcgtagattggatatcatgaaacgacatgagtttctgtgggagccttacacaacaactgttatgtcgacgttgcctctaatttgtttg

SEQ ID NO: 78185 - DNA, 222 bp, Glycine max
  Peptide Sequence Number=SeqID_169870
atgactaactgcctgagaattctttgtcccaagacattggagggtacatcctttgtgagaaggtacatctcttatggatcagttcaactggagggtacatccacttggtttttcaaagataaaaagggaggttacatcccttgtggatctttggcttgtaaaggattttacaaggttgaaagaaatctcaagaaccgcgggtttcttggggactggatgtag

SEQ ID NO: 78186 - DNA, 637 bp, Glycine max
  Peptide Sequence Number=SeqID_169871
gaatgtcattcttcatcacactgagtttgatgaattcactgaagaacttgagtgtagaaactggcacaaggagttgacaaacttcatggacagcagtagagccatctccattgtgaaggagttttatgccaacctctatgaccccgatgataagccacctaaacaggtgaatgtgagaggttgtttggtgaaatttgatgcaaacaccttgaactcattcctgaagaccccagaaatacttgaggaggggaagaactttcccgtatactccaggttttgttgctcaaagccagaaccacaggaatcggcagctcgattatgcatccctggaagggaattcgagttaaatgctgatggactaccactaaagatcttacggaagaatctgactacgctcgctcagacatggagctttctttctttctctaacctgagcctcggtccagctattaatgtggcttatgtgaagaagaactgttggaacccatatgacctctcaattacttttagagggccacgcaaggccaaggggaaaaggtttgaggctcccccatcttctaaggtggcctggccaggacaccagtcctcttcttctggaaagggtggagcctctgcagcccaggagcctgatacctaa

SEQ ID NO: 78187 - DNA, 237 bp, Glycine max
  Peptide Sequence Number=SeqID_169872
atgtctggcaagggtagaatgcttttgccagaggtccacctaataggggacagttttaacgatgatccttcccatcatcacggcggctccaacactatgatcgcttttctaatgtgttgcccccctactggtggcgtcatcgctgctaaaggtgggctcagcccaatctctggcgtttgtcccaaccctaaggagaatgaggttgagtctcctcattcctccttgcaacatcattga

SEQ ID NO: 78188 - DNA, 1548 bp, Glycine max
  Peptide Sequence Number=SeqID_169873
atgaagacaattcagtttaatgacgatacgccgttagcggctatcggccagggcacctggtatatgggcgaaaatccggcacagcgggcgcaggaaatcgctgcgctgcaggctggactggacgccggactgaaactgatcgataccgctgagatgtatgccgaaggcggcgcggaagaggtggtcggcgcagcgctgcgcggacggcgcgatcaagcctggctggtatcaaaagtttacccgtggaacgccggtgaggtcgatgcgattgacgcctgtgagcgcagtctgcgccgtctgcagacggactatctcgatctttatctgctgcactggcgcggtaatgtaccgctggaggagaccgtgcgcgccatgcaaacgctgcagcagcagggcaaaatccgccactggggcgtctccaattttgatagcgacgatctgcaggagctgtggagtgaagccggagggatgggctgcgcgactaatcaggccggacggctgcgtcaggcgctgtttgacgatgcgactttgcagcagattgcacaacagaagggcatcagcatcgctcagttgctgctgagctgggtgattcgccagccgggcgtaatggccattcccaaggcgggcagcgtggcgcacgtgcaggagaatgcggcggccctgaatatcaccctgaccagcgatgagctggcgctgctggatcgcgcctttccgccgccgcagcataaactggcgctggatgtgcgtgacgccaaggcgggcaggggtttctccggcacttttcatcggcttgttaatccgcgccgtctccacgcacaccatcgttttataaccatcattaggcatatcggccatgctgcaggacagtgccgggccaggattccaggtgacaacgtcactttgataatggtgatagacttcaatctggcgcttaccggcgcgatcgtgaatcacgctgcagtcttccgctgcggtatgaatgcgatcaacccgctcgggataggtttgtttcccgtccgctgcgctgccgatggcattgtcctgcaccttatcgatgtagctgttgccgagcccgctgacttcaacctgcgcaatgtccgccacctgaaaatagctgtgcagcgcagccgtggcttcataatcgccccaggcttccagctcaatctcacagtgttcagcaatgcggaagcgcgccagcagcgtgaaatcgtgcggccacagttttttcgtttgtgcattacttcccagcgtgaacgtcagcatgaccgcatcttcgttctcatcatgcgccgtcagcgtccacggctgattacgggcaaagccatgcgcaggttcacctgccggaccaaaccacggccagcagaccggcacgccgccgcgaatggctttgccgctgacgaatggcgtcttgtcgctgagccagatggcgggctgctgaccggccggctgccatgccagcaggtgcgcaccctgcagggcaatggcggcgcgtactttcggatggctgatcaccagaattggcaattcacccatctgacgctgcgacag

SEQ ID NO: 78189 - DNA, 578 bp, Glycine max
  Peptide Sequence Number=SeqID_169874
ggaacaatccagatacgggtgactcaaacaaatatgggttgtacatcaaagaaaatcttcatcgtttggttgcccttggaagactttatgagggatccacaaccgttcacaacattcctttgctgcatgatcaagtcaaggttggtgttaaggagattagagatgcaaatgctcccattcctatacccactgaagaggttaagttagtggggcagacacttaacaccttccttgcttggttgacacatcttgtcaagcgtttatcagaacaggtaaagtgggatgctaccatgtttggggtgtataatgacaacttccccttgtacataaagcatgaagatccatctgaaattgcacacggtggtcaatgtctcgacatctttattatacagttaaggatttttgcacattggcaaatggtcgtcattttgcctaaggaaaatgttgtcatctggttttgttcgttgcataatagaccagacaactacctcaaaggaataaataatagtgcattgaaaggacttgacgatactccacaaagtaaatccaaggctgctactagatggattgttgttaaa

SEQ ID NO: 78190 - DNA, 204 bp, Glycine max
  Peptide Sequence Number=SeqID_169875
atgaagcccagagccaagaaaggtgtctttatgggctatggagataaagtcaaaggattcaaaatcttgtctctatcagaaagaaaggatgtcacaaagcaggtgaattttgagagccctataattagaaacattagtcatcaaaagcagtttgaagcacttgatgagactgatcaggaacttcaaatgcaacctcaacattag

SEQ ID NO: 78191 - DNA, 381 bp, Glycine max
  Peptide Sequence Number=SeqID_169876
atgtaccctcccttgttctctttgaacaacctagtggatgtaccctccactagaattgatccacaagagatgtaccctctcttgttctcagtcacaacaacccaagtagatgtaccctctacttgtaccacaaaggatgtatcctccaatgtgttaagacaaagttctcaggcggttagtccttcgaaactttgtgaagggggaaataaaagaattctcaggcgggagaagggagacacaaaagaattcaggcggttagtccttcgttcttttggaacagggagaagaaagacacaaaaagaattcaggcggttagtccttggcgaattctttttggcaaagggagaagggaatgaccagatgaatagcacaagtttttga

SEQ ID NO: 78192 - DNA, 381 bp, Glycine max
  Peptide Sequence Number=SeqID_169877
atggtggacaactctgagtataagagggaagaaagatatcaaacaacagatttccctggaagaaattattgttctgatgcttcattatatgatgttaagctggaagggttcattcatgcttcactgttgacaggtcacaggcagtcaaaagaggaaagaaaggaaacaaaaccagtggtagataagaagggtgtcgcaacctacccttcggcgggagggcgacgcgagactcgcgggatgcgtgttccacgaaaggaatacgcgcggagtcgccgccaacgtttatttgaggaaaacgtcggaaaaaccggaaaagacgcgatctacgaacttttaagtgaaaggttcgggagttgtatttacgcacggggaaggtattag

SEQ ID NO: 78193 - DNA, 150 bp, Glycine max
  Peptide Sequence Number=SeqID_169878
atgaggaaggctgaaagggagaaaaggaaggctgaaagcgagaaaaggagggttgtttgcgatactagcagggtcttacggtggctaggtgtgaagtcaagtggggttgctggcaagttgttgaaatccaatggttggctagtccagtag

SEQ ID NO: 78194 - DNA, 225 bp, Glycine max
  Peptide Sequence Number=SeqID_169879
atgacactagcctatcattctttctcatcatcgaaacttgataggatgtcaattagtgctcccagggagaaaaaagaatcgtatgaagataatacaaatggaggcttcaatcccttctccgtctctctaacatttgggaactctattggagcagtcgaaggaaaaaactggaagaatctcaaggaacctctagagatggtgctatcgctggctgaagacacgtga

SEQ ID NO: 78195 - DNA, 858 bp, Glycine max
  Peptide Sequence Number=SeqID_169880
atggtcatattccccctttgtcgaagactcaaatgtctttcaaccgagactattgcagtctccctctgtcatccagagacagtcgagtccgatgacacacatagacaaattatggtcatccgcacccttttagctatccagagacaatcaggtctgatggcatgcagagaccatcatggtcatctgcatcatttttgctatccagagacaatcaagtccgatggcatgcgaagaccatcatggtcatccgcacccgttttgctattcagagacaatcaaatccgatggcatgcgaagaccatcatggtcattcgctttcattgttttcgagactattttagtctccttttccatccagagacaatcaagttcgatggcatacagagaccattatggtcatatgccttcttttacatttcgaagacgacgatgtcttcagtcattgcatgctttcaaaaggcgacaatgaccctcatttacattttgaagacaacaatgtctttagtcattgcatgctttcaaaaggtgacaatgacctccatttacatttcgaagacgacaatatcttcagtcattgaatgctttcaaaaggcgacaatgacccttatttatatttcaaagacgacaatgtcttctgtcattgcatgctttcaaaaggcagacaatgaccttcatttacatttcgaagagacgatgtcttcgtcattcatgctttcaaaaggcgacaatgaccctcatttaatttcgaagacgacaatgtctttagtcattgcatgccttcaaaaggcgacaatgccctcatttacatttaagagacaatgtcttcagtcattgcatgctttcaaaaggcaacaatga

SEQ ID NO: 78196 - DNA, 49 bp, Glycine max
  Peptide Sequence Number=SeqID_169881
atggatttgggaaggttccagattagtataccaggggatggctacccca

SEQ ID NO: 78197 - DNA, 327 bp, Glycine max
  Peptide Sequence Number=SeqID_169882
atgcaacaaggacaagcagatattctcatagctaggttccctgatcttaactatggtgtcaaaatgggtttttcaaaggaagcgcaaaatatacaatgggggttccaaagtcagaaaggatgcaaagacaagctgaaactaacaaggaacaagcatagaatcatggttacctcaaggaaaaccacgaaggtcagaccaggcttcgttctcaaccgaaaccgcgaggcaagtttggaagattccgcttcggttgaagggttcctctcggtgtggggtttcaacgaagaacaatggcggtttgaggtggctactggtggctgtgggtga

SEQ ID NO: 78198 - DNA, 513 bp, Glycine max
  Peptide Sequence Number=SeqID_169883
atgacatgtgcgtctctgctgcatgttttaactgagagtattaccttgattttgcgtctcgaccgtgacacaaaaccttgcgctttttcgccgtgtcgtgtcattatgcttgcgttgtatgtttggtcccgtcatgttgtcacgagaagccgaaagcaaagcataggatcaagtcaaacgcctccgctcaagaaaaggttctaccaagtcaagatcatgggtctagaggtcatgagtttacaagaattaggggagttgatagggcagctccagcggcaagccttccgcaaagcctacggtaagatctgggagttggctatgatagaagtctctacaaaggcgatcgcttccatcacccagtattattaccaacccctgggatgtttcaccttcgaagatttccagctagtgccgactatagaagagttcaaagaaattcttggatgccctctggaagggaggaagccttatctcttttccggattctacccttccatgtctagaatcacctga

SEQ ID NO: 78199 - DNA, 423 bp, Glycine max
  Peptide Sequence Number=SeqID_169884
atggctgaaagaggagaaggaaatagaccaccaaggaggactctgggtgactatgcttatcaacaaggaccaaaacattacaatagcatagtcattcctcctttcagcaataaggtcatggaattaaagccaacactgcttagcctaattggctcacatccttttgctagaatggatcatgaggatccatacacacatttatctaccttcatggaactatgcagtactatgggagcttataatgaagatgttaaagctgtctacctcagagcttttccatttttattagcaggcctaggatcttcttcatcaatggattcctttgcttcttcaaatatgaatggaaacggaatggagaaggaacatagagaggagacgccacttcaaggagcagatgagtctagaagaagctcaccaccatag

SEQ ID NO: 78200 - DNA, 1259 bp, Glycine max
  Peptide Sequence Number=SeqID_169885
ggccggatattcgagtttctttcccttatgtaatgcatcagaagaaatcagaggttcagatcgggaaagaaagcgtaggcgtctcttccgatttcaatccgcaattccaaaaacacccctaccaccgccaccagcaattctacccccaaatcgaaatcgacatatccccctccctcccaccacagcaacacaacaccgcgccgcagcgaaccacccccccttctctctccaaacagaagcatattttcaagccccagaatgccgccttcttctccgtcaccgtcgccgcgaagagcgccgcgttccgcatgctgcggcgcgtgaggcgccagcgcgcgttgctcctgctcgcgatcccgctcctctatctctacttcctcgtctcgcgctcgttcctcctcgacctcctctccgccatcgcgttctccgccgcgctcgtgttctctcttaacctcgctttccctttgccgttccgctcgattcgcctcaaggcggccaagaattctgcctcccgtcccgcggcggcgctgcctgtgttctggacgatcgggtcgcggcagaagacggagaagcgcgcggcagcgtcggggtgctgggtgcaggtgtttgggaacggagacgtttacgaaggggagtttcaccgagggaagtgttcggggagtggggtgtattattacagcaggagcgggaggtacgagggtgattgggtagatggaaagtacgatgggtatggggtggaaacgtgggcgcgcgggagccgctaccgcgggtgttactggcaggggctgaggcacgggtttggggtgtataggttttacaccggggatgtgtatgctggagagtggtccaatggacagagccacgggtgtggggttcacacgtgcgaggatgggagtcggtatgttggggagtttaagtggggggttaagcatggccatgggcattaccatttcagcgggaaaagtcttgctttggagtctcattgtcgtccgttgttgttgactgccggaaaattttccggcaaactcaggcttgcatttctgtcacatgctgccttcttgtcactggacagccgtagcatcgccaccagccctatttatcccttctctgcaactcccactatcacaactgagaaactcaactggaaaagctatcggtcttggtctgattcagttgagttgtggttttgtggtcaaggatactatgaccatatgaagaaggatgtgaatgaagttcctgttgagaatagagctcaatag

SEQ ID NO: 78201 - DNA, 651 bp, Glycine max
  Peptide Sequence Number=SeqID_169886
atggggaaggggtacctgcaaaaaggaattatgaagctcaaaaacatccgtgctcagggtccagggttaggatggagggctgatgaggactactcaatgccatgcatgagaggaagtgactctaggggttctgttcgacaacccatggtagagcgggaagtggttcccatcgaagattcttcatcggaagaggttcctcatgaggtctctgataatgggtcctccccttttgagaggttgataagctttgacaatgtgggtgaggatgatagtattaaggtgtccaatcttcttggtacttgcaagcttggagatcaagtttgtcctagtgttgtcttccttcagcatgtgatgcatttcaaaacaattgaagtcattgataagagccttggcgacatgatagtacctaaggagaattgtttcctagtgaactctactaaaaattctaccataaactgggatttcatagggccacgaggcttgtattgtaggttttctgagcacttgcttgatggggtggtccgtcttgacaatgatttggtggctctgaaagtagggcctaaggcgccgagcagaggttatggggttgaactaatggtttcttctaccattgaaaggtacaagagtaggggtgatccaggcttaggttga

SEQ ID NO: 78202 - DNA, 1122 bp, Glycine max
  Peptide Sequence Number=SeqID_169887
atgggcgattttgaatggcgacccttggtgaagcaacttggaattgctagtgaagacatgccttctcccctcactatcactcctgagtcttcaggggaggaaggaggtcaggctagagttgaccctccccgatcttctgaagctgacgatgatgaagttgtcaaggttacgctcgacgttcttccttccacaacaaccaagaggaagtgcaatgaaggggctagagggtccggtcagcataagaagtcaagggcccccttcagtctccgagctttgaaggaggctaccgagttgatgtccagttcaattatgtttgcctcattggttgttcctgttgctgttccggtttccactcctttttctttggtgctgctacttagtgttggtgtggcgacgactagtgtctcgtctcctcctccttcagccttgccaccctcagctccgaccgtcatgccttcgactatgccttcttcttctttgcgtccaagtgtttcgttggactgtgtatatacttcccaggaggcaaactcaattcggggtacaaaactcgaccgatgctgcgaaggtcttccttcaacggacttttgctatcttggaggaaaatgggcaaagacatatacagaggctttgaacaaaattgaatctttagaggttgacgtcatcaaatggaaggctactgttcgaactgtgttgcagccggagcgtcccaaagtagccactgccactgttgcccttgttgaagctgtcagcacgagactggacaatgaaaaggtgtttgaacattgtcaagattttttgaagaagaggaatcatttggcaagcaaggtggagcacactactgaagagaaagaaaagcttattgtgatagtggccaaatctgccaaggtgattgctgatctcgaagctcgactgaaagaattagagcttaatgaagtcatggagcagcacgagaaagggttctttaaggccatcaagcaggctaggttcttcattgagggtcttaacttaggtctttttgacccatttagggatgtgaaggatgatgaactacttgacgaggaagagattgatgttggggaggaggacatcaatgaagaagaaaatgatgggaccaatgtttag

SEQ ID NO: 78203 - DNA, 186 bp, Glycine max
  Peptide Sequence Number=SeqID_169888
atggaggccgacttgcctttaggttggaaaacactcaacctggagctttatgacagaactactgatccagatgaacacctggatgtgtgtttcgcttcgggatactacttgtttgtgtggatgcgaaatctaccggcaagtacaccgggtcgtcaagctcaagtactaaacaccgatgtctcgtga

SEQ ID NO: 78204 - DNA, 117 bp, Glycine max
  Peptide Sequence Number=SeqID_169889
atggatagtaggaataataaaaaattgaagaaaacaaatagacatgctaagaaaggaaagaaaagaactgagcagaagaggctagtgggttggcctaaaaggctgccggagtactga

SEQ ID NO: 78205 - DNA, 1245 bp, Glycine max
  Peptide Sequence Number=SeqID_169890
atggctaagcgacatctttgtgagctaagccaccaaaactcgaaaagagacaacacgagggctaagcgaccatatcacttagacaatcttgaagttttgacaagcgctaagccggccctactgagcttagcgcaattcattgcgacaatctttgggctaagcgcatctaatgcgctaagccactcgcaacttgttgcgctaagccagtttgttgctttgcctaagatggcttcaagaaaaaagaagagcactgcttctaggccacaggctcagaatgttaagatttatcatactgaattcgacgagtttaaggcagagttggagaggcgtaacctacataaacgcctcgccaaccttcaggagggaagcatagatgtggcggtggttaaagaattctatgccaacttatacagcccggaagaccagagccctaagcaagtgagggacggtgagacactgcctacctattccaggttttcgaggatgaggattgatcctcaagagtttgctgctcgtctctgcatccctgccaggttggtttacggcttagtcataggcatggacatgaagatcggagccctaatctcaggagttacctctgacagtctgacctatgagagcctaagcccgaccattaacttggcctacattaagaaaaactgttggaatgtggatgatctggcagttaacttcagaggggccaggaaggtaaaggctcgaccaacagatgttccttcttcttctgcaccaccagctcctcccacttctgccacgcctacaccagctacccatgactctcagcgctttgaagccatgcttcaaaagagggtgagggccccagtgcccaggagtagagatgaggctgacgaggctgtttttcctgagccaattgtgccagttatacatgagactgttgaagcaggtgagtcacaattgaaacaggaggttgctactcctgagaggacaccacagaccccaaaagatccaccctcaccagggatagaactatcttttgctcagcaggtagcagatcctcctacaccagtacatgagagaccagctaacccttctactcccattttagagataccagaggaccctaccacaccggccctgacactgaacaccactcttccagccacacctgagcttcagttttcagatgaggaggggggacgaattactactcctccggggacgccagtgttacatttcgatgatgaggagcaagatcaagatgaatga

SEQ ID NO: 78206 - DNA, 303 bp, Glycine max
  Peptide Sequence Number=SeqID_169891
atggcggagctcgaggacgctgccgcacgtgccgagagggatgagatgatcgggttcatgtcgtggaggattgaggatgagggattgggtgggagggagagggaggtgtacggtaagaaaagtggtttcaaaaagaagaagatgaaatggtggggtccactgctaggagcttggaagaagagggctacctttagcagttaccttaacgcttggattggtggtgggaagaagattgttgatcctcatgatgtatcacagttctctcgtatgctctgctatttgttgattgaaggtgttgcatag

SEQ ID NO: 78207 - DNA, 387 bp, Glycine max
  Peptide Sequence Number=SeqID_169892
atgggagatttcacatattcagtcaacgttgtacaacaaaacaaggtcaccaagtctctatctggaaatggcgtactccccaataaatttaaaggagaagcttacccttcctcttggcgggtggaagcttctccaaaacccctaaaccctctagttgggcttcgtcaaacaggccacatgactcgaggcagtgaatcaggaaaagtcactggaactcaacggagaagggcttggaagccaattgagaagcgacgacatccaatcaatcgaggcagagcttgtaaacacggagggacggaggtagtcagagaccagggcgtggatgccgggggaatcagaagactgaagcttggagatgagggaggattccgagggactcgtggttga

SEQ ID NO: 78208 - DNA, 541 bp, Glycine max
  Peptide Sequence Number=SeqID_169893
gaccatggctactccacctaccttgcctcctcctcctcttcctcctcctcttgcagacgcatcagcatctccaccacctggggtagaaagacctttggtcaacatcgatcctgctaccggcaaggccgacgtcgacgtgacatacgagagctggaaggaagtccctactgctcagaaggatttgatatgggaggatattcaggcggaatttcaaatccctgaagcttctgacagtaggacaaagaagaaaattcttcagactgtcggcgagcggtggaggcaatttaaatcggacttgactaggaaatgggcacttacagccgacaaggatggtgtggacgacattgatgtgcagaaaaaggcacaggccatccagaagcaaaacactgcccctcacgtgttgtctcatgggggttatcaatatttagaacaaaagctcatggctgagaagacaaagaaaagaaaagactggaagaagctacccagtccggaagcactgagggcatcattgaccctccatctcccattagacgccatgtga

SEQ ID NO: 78209 - DNA, 567 bp, Glycine max
  Peptide Sequence Number=SeqID_169894
atgacagatcttgtgagcgcggaagattatataaatctccgcgtgtcaacagatagcaaaaaggtttatacggataaccactcgggtatctccgcccgtcagcgtgactcaaaagtcagtatgacagatcttgtgagcgcggaagatgacgtaaatctccgcgtgtcaacgggcttgtcggccgcgattgacgaagggcgcagagacgacatagaaaaaaagaatgtttatacggataaccactcgggtatttccgcccgtcagcgtgactcaaatgtcagtatgacagatcttgtgagcgcggaagatgacgtaaatctccgcgtgtcaacgggcttgtcggcgcgattgacgaagggcgcagagacgacgttagtctctgcgtgctatcaggcttttcgtcttaagatagcaaaaaagaatgtttatacggataaccactcgggtatttccgcccgtcagcgtgactcaaatgtcagtatgacagatcttgtgagcgcgaagtggccgacaaaagcgaggctctgtgtccttgtatcctcccatgaggaactcagacctacgtag

SEQ ID NO: 78210 - DNA, 500 bp, Glycine max
  Peptide Sequence Number=SeqID_169895
atttggagattaaagctacttgcaggagacgaaacgcagagagaaatagaaattttttgcaggacttggaagtagcagtaattccaagagaagaacctcaatcttctgaggcatcttctagctttcctattctagggcaatctcatacagatttgcttgtggaagttatcatggctgaacagccatggagagtaaccctggaggactattcaagttcaagtgtaccacacttttttaccagcattgcacaaccagaagttcaagcacaaaccattacatacccatcatcattgattcagttgattcaaaataatttgtttcacgggttatcgaatgaagacccatacacatacctagccacatacattgaaatatgcaacactattcggctggctagtgtgcctgaagaagcaattcgattgagcttgttttcattctcaatatctagagaagctaagaggtggcttcattcttttaaaggaaatagtcttaagacatag

SEQ ID NO: 78211 - DNA, 99 bp, Glycine max
  Peptide Sequence Number=SeqID_169896
aactggcgatgcgggatgaaccggaagctgggttacggtgcccaactgcgcgctaacctagaccccacaaagggtgttggtcgattaagacctacatag

SEQ ID NO: 78212 - DNA, 1153 bp, Glycine max
  Peptide Sequence Number=SeqID_169897
agaggactacacgtcctcaccttcggaggactacgcgttctcgcattcaaagggctacccgtcctcctcttaagaggactacacgtcctcaccttcagagggctacacgcccttacctttagaggactacacgtcctcgccatcagaggactacacgtccttgcctttagagggctccaggccctcacctttagaggactacacgtccaccccatcaaaggactacatgtcctccaaatcagaggactacagatcctcactttcagaaaactacacgtcctccccttcagaggactacacgtcctcaccttcagaggacttcatgtcctcgccttcataggattacacgtcctcgccatcagaggactgcacatcctctccttcagacggttacacgtcttcaccatcagaggaccacacgtcctcacctttagaggactacacgtcctcgccttcagaggactacacctcctagcctttagagggctacgtgtcctccccttcagaggactacacatcctcgtcttcagagggctacatgccctcacctccagaggattacacgtcctcgccatcagaggactacacgtcctcccattgagaggagtacacgtcctcaccttcagaggactacacgtcctcgccttcagagggctgcatgtcctcgccttcagaggactaaacgtcctcctctttagaggattacacgtcctcgccatcataggatttcacgtcctctccttcagaggactacacgtcctccccatcattggactacacgtcctcgccttcaaaggactacatgtcctcgccatcagaggtttacacgtcctcgccttcataggcctacacgtcctcgccttcagagggctacacctcctccccttaaaaggactactcatcctcacctttagaggactacatgacctcaccttcagaggactatacatcctcgcattcagagtgctacacgtcctccccttcaaaggattgcacgccgtcgccattagaggactacacgtcctcgcctttagagggcttcattccctcaccttcagaagacttcacgtcctctccttcagaggactacacgtcctcgcattcgaagggctacacgtcctcgccttcagagggctacacgtcctctccttca

SEQ ID NO: 78213 - DNA, 372 bp, Glycine max
  Peptide Sequence Number=SeqID_169898
atggatgattttagtgaggatgagaatcaacagacctgtgatcacatcgatcaccaaagcgatgaccaaagcgatgatgagggtcttggcagaccaacaacacctctgtcacatccgttgcaatatcaccaacctagcttaggcgcatgcaattcaaagaggcataacaaattaattatcaatagtatcagagatcatcacacttgtctcgcgccaatgctcatacaagatcatcggcaactcgacaaacatgtcatagcacagatcatccaatcaattgtcaaaacaaactccaccctctccatcaagacgttgattgcagagatcaaaacgttcatgaattataccccatcctacaagaagacaggttag

SEQ ID NO: 78214 - DNA, 1169 bp, Glycine max
  Peptide Sequence Number=SeqID_169899
aatttgatgaattcaagattgagttggaaagaaggaattggcacaaggagatgactaattttctagacgggagcatcgatgttgctatagtgaaggagttttatgctaatttgtatgaccctgaagataaatctcctaagaaagtaagggttaggggtcacttgataaagtttgatgaggatgccctcaacactttccacaagacacctgtgattattgaggagggggagatcctatctgcctactccaggttctgtagactgaggccagatccacaggaactggcagctcaattatgcatccctgggaggggatttgagctaaatgcagatgggctgcctttgaagattttgtggaagaatttgaccacactggctcagacctggagcattttgtcattctctaacttggcccctacttcccacacttctaatattacattggatagggctaggctgatatatggcataattcagaagatggatatgaacttggggtacattatctcaagtcagatttctatgatcgcacagcatgactcctcacggcttggttttcctgtcctcatcactaccctgtgcaaggccagaggagtcacttttgattcattatcttttgaaagcctcagcccagccattaatttggcttatgtgaagaagaattgttggaacctcgatgaccccacagtcacctttcggggggcccacaaggctaagggcaagaggtcagagactccaccatcttctgctttccctacctcagctccttctacttctaatgtagctccatctactccagcttcatctttaccagctccagcttcagccccagtttattccggaccctccacattcagcttcgagactttatttcccatgttgcagagcctgcataaaggccagattataatcatgcagagcttaggtcagcagcagccagtgctgagcattgaggagttccttagtcaagtgacttggccaggagtccagccttctcctttgggaggggaggtagcatcaccagagcccgttcctcagtcatctccagctctagctcttgatgatccacagccattggcaccaacatcggtgcctaatcagcccattgttcaggatccatcagttgcaccagtgttggatcttaatgagcattcacaggatcattcctag

SEQ ID NO: 78215 - DNA, 240 bp, Glycine max
  Peptide Sequence Number=SeqID_169900
atggaaatcagtgttagggacttatcagcagaaactgaactcttcctgcagaatttgcacatagctactacagagagagaaacgaaagatattgagctggtagaggaggaacaggaacggattggtgctaatccttctagtgagacctccaataaatctgagaattataaggaggaagcacggaatgcaacacagaagcataaaccaaagaaggtagagagtgtcaacactgatgcataa

SEQ ID NO: 78216 - DNA, 171 bp, Glycine max
  Peptide Sequence Number=SeqID_169901
atggagattacatcatggcaattggcaaactcaagaataatggaatggagtaaaggggttgcaggaagcaaaaagcatgagacccatgcagctggtataatcgtgaaggaagatatcatcgtgctttctagaagatatgtaggtagtggaataagggaatatggttgttag

SEQ ID NO: 78217 - DNA, 600 bp, Glycine max
  Peptide Sequence Number=SeqID_169902
atgtcttccgccccggatcgaccggccgaagccgaccttgggtccaaaaagaggggcagtgccccgcttccgattcacggaataactcccacttatcctacacctctcaagtcatttcacaaaagtcggactagagtcaagctcaacagggtttttctttcccccgctgattcccccaagccccgttcccttgggctgtgtcggattccccttgtccgtaccagttctgagttgactgttcgacgcccggggaagaggccccgaagggcccgttcccaatccgtcccccgaccggcacgcgacgacccgctctcgccgcggaagcagctcgagcagtccaccgacagccgacgggttcgggactgggacccccgtgcccagccctcagagccaatccttttcccgagaggctgttcaccttggagacctgatgcggttatgagtacgaccgggcgtgggaggcactcggtcctccggattttcaagggccgccgggggcgcaccggacaccacgcgacgtgcggtgctcttccagccgctggaccctacctccggctgagccgtttccagggtgggcaggctgttaaacagaaaagataa

SEQ ID NO: 78218 - DNA, 453 bp, Glycine max
  Peptide Sequence Number=SeqID_169903
atgacgttgctacttagcaacattctgccccagcgaccgcaatgccgatctccccctgcggaagtatcagttggtctgtgtcgtcccgacatagggattgcgcccacaagacacccagtggacccgaaggagcccaacagggccctggggtttccagctctggttatgggcctctatcaatcctacagggtgcccgtccccccagcaaggtcatgccatcgtgacatagggatcgcgcccgcaagacacccagtggacccggagaagtccaacagggtcttggggtttccagctctgattacgggcatctatcagttctacggagtgcctgtcgcccccagcaaggtcatcaagcaccctattagccgggctttcatcaagaaagtattgtgccccccaggcaggcacagggcgagacaccacagcaacctagagatgaccggcagtaggtaa

SEQ ID NO: 78219 - DNA, 276 bp, Glycine max
  Peptide Sequence Number=SeqID_169904
atggtgaaagttggaacctcttacggaaagatcaacctttcattttcgccaaaagttggcccagggcttcccggtatcaaccgggacacccggatttattcattgtgcgaagtgatcttccgtcacagggtgctccagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 78220 - DNA, 298 bp, Glycine max
  Peptide Sequence Number=SeqID_169905
atgatacgcggagataccttacggttatccgcaccccttgccattcagacacagtcgtgttcgatggacaagcagagaccaaagaccaagtttggtcattctgcacacatgatacgcggagataccttacggttatccgcacccctttgccattcagacacagtcgtgtccgatggcacgcagagaccaaagaccaagtttggtcattctgcacacatgatacgcggagataccttacggttatccgcccccctttgccattcagacacagtcgtgttcgatggcaagcagagaccaa

SEQ ID NO: 78221 - DNA, 465 bp, Glycine max
  Peptide Sequence Number=SeqID_169906
atggtgaaagttggaacctcttacgtgccgatcaacgtctcattttcgccaaaaagttggccagggcttcccggtatcaacagggacaccaggatttatttttttctgcgaagtgatcttccgtcacaggtgctccagtggcttctgtttctatcagctgtccctcctgttcagctactgacgggggtggtgcgtaacggcaaaaagcaccgccggacatcagcgctggcaagtgtagcgggtcccgctgcgcgtaaccaccaccccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaa

SEQ ID NO: 78222 - DNA, 420 bp, Glycine max
  Peptide Sequence Number=SeqID_169907
atgtattatcctggtcatcaccaacatcaatcatatgcggaacctaatgtacctcgagtgcatgttcttggatttatgtcccaacatcatccatcacaagcacaatatcaatcaacaagtttttctggtcatgcgtctgaaggatgtcaacaaagttttcaaccactgagattctcatcatatatacctcaatactcatttcaagtctattatatctcaaatgttttttatggctcctcacaaatgtttgtcaccactttcaacactccaccatctacatataatgttgcaccatcgagtttttgttattgcccatcattacctactcaaatacgtgatatgagtcacgaatatgaggacgaggatgaggataacaacaataacaacgatgatgacaatgatgatgttgacagtttttga

SEQ ID NO: 78223 - DNA, 785 bp, Glycine max
  Peptide Sequence Number=SeqID_169908
gctaagcaccactttgcttctgtagtcagtcctttgaataaggctaagtgcaactgctgcgctaagcccttgttgtgtgtcaaggaggctaagtgcgccctgtgcgctaagcctgagcgtcattctggtgagatggcatctaagaaaagaaagtcccttgcctcttcatcctctcagattagatttgacaaatcaagattccattctcaagaagcttgggacagatataacgatattgtggtgccgaggaaactactaccagagagaaatgtagtagtatattacactgagtttgatgagttcaaggaggaactcaagataaggaaatgggatgaggagctgactagttttgctaatggtagcatcaatgttgccattgtgaaggaattttatgcaaacctctatgacccggaagacaagtcacctaagcaggtgagggtcagaggtcatctgatcaaatttgatgaagatactttgaacatatttctaaagacccctgtgattgtggaagaaggggagaatctctatgcttattccaggtttgcactcttgaggcctgatcctcaggagttggctgctaagctttgtatcctagggaggggattcaagttaaatgttgatggtcagcctttgaagattttaaggaagaacatgaccactttagctcagacatggagcgttctttccttctctaacttagttcctacctcccacacatctgatgtcacattagatagagccatgttaatctatgtcatcatcatggagatggatatgaatgtggg

SEQ ID NO: 78224 - DNA, 201 bp, Glycine max
  Peptide Sequence Number=SeqID_169909
atggaaaagcctgacaagaaaaatttcaaagataagaaaggaaagaaagcgtacatcacttgggaagataatgatatggattcatcaagtgatttagaaaacaaaattgtaaatctaggcctcatggccaaagactatgaaagcgaagaagagatgcattcaatgatttgcatagagaacctatcaaacttgccaaattag

SEQ ID NO: 78225 - DNA, 195 bp, Glycine max
  Peptide Sequence Number=SeqID_169910
atggtctttggagtgggaatgggatgttgtgtattgttaataggaaagcctcaatggcttgtgagaatggttggaggtcaactcaataaaaaggtgaaaaggaagacaaggatgagatctaatgaaaatgttataaaaactggaggtgtaacaagcaaaaaggccagaaaaattgaagagaagaagaaaatctga

SEQ ID NO: 78226 - DNA, 315 bp, Glycine max
  Peptide Sequence Number=SeqID_169911
atgggaggtgatgccgctgccactgagagtgccaccacagagcggaacgccgcaaatgcatttagaaaagttgcaactgttagccaaacatgctataagttggttttgttgaaaatgggaattcgtggtgtcactgtatctgatgtcaggggctttggtgctcagggtggttcaaaagagaggcagggaagctccgaatttccagaagacaattttgttgccaaagttaaaatggaagtagtggtgagaaaggaccagtgcaataaagcaaggtggggaatgagagattcgtcagttactgtctatatgctttga

SEQ ID NO: 78227 - DNA, 1287 bp, Glycine max
  Peptide Sequence Number=SeqID_169912
ccccaggataacggaaacgcgcgctatcacctgacgcgcgaaggcggtcacagccatcgccttattttacacaacgccgacgctaccgggcgcgcggtcgaaaccacgctggtcagccaggcgctcatccatcccaatattctcgttattgagcgtgccaacgcggtggacttaatcctctctgataaaattggcctgcccggaacgcggcgcgtggtgggcgcatggatctggaatcgcaatcgcgaacaggttgaaacctgccgcgcccgcagcgtggtgctggccaccggcggtgcggcgaaggtatatcagtacaccactaatccggatgtcgcttccggcgacggcatcgccatggcgtggcgcgccggctgccgggtggccaatctggagttcaatcagtttcaccctacctgcctgtttcatccgcaggcgcaaaactttttgctgaccgaagcgctgcgcggcgaaggtgcctggctactgcgcccggacggttcgcgctttatgccggatttcgatgcgcgcgccgaactggcaccgcgcgatatcgtggcgcgcgcgatcgatcacgaaatgaagcgcctgggcgtcgactgcatgtatctcgacatcagccatcagccggccagctttgtgcgtgcccactttccgatgatctatgacaagctgctgacgtttggcctcgatctgacacagcagccgattccgattgtgcccgccgcgcattacacctgcggcggcgtgatggtggatcagcatggtcgcaccgatgtcgacgggctgtatgcgattggtgaggtcagctacaccggtctgcacggcgctaaccgcatggcatcgaattcgctgcttgagtgtctggtgtatggctggtcggcggccgaagatattgtgcgccgtctgccgcagatgcgcgccgtcgatcacctgccggcgtgggatgaaagccgcgtcgacgatgccgatgaacgggtggtgattcagcacaactggcatgagctgcggctgttaatgtgggactacatgggcatcgtgcgtaccaccaagcggctggagcgcgctctgcgccgcattacgctgctacagcaggagattgatgaatactatgcgcattttcgcctctccaacaatctgctggagctgcgcaatctggtacaggtggcagagctgatggtgcgctgtgcgctggcgcgcaaagagagccgcgggctgcacttcacccgcgactatccgcatatgctgcccgaggcacagccaacggtgctgcagccggtagcctag

SEQ ID NO: 78228 - DNA, 372 bp, Glycine max
  Peptide Sequence Number=SeqID_169913
atgactatgcaaaacatgcagtttcaacaagagaccagagcctccattcagagcttaactaatcagatgggacaatttgctacacaattaaatcaacaacagtcccaaaattctgacagattaccttctcaatctgtccagaatcccaaaaatgtgagtgccattacattgaggtcgggaaagcagtgtcaaggacctcaaccagcaacatcttcctcatccacaaatgaacctgcccaacttcactctactccagaaaatgaggatgacaaaaatttaaaaaaagcagcatatccctcttccgttccctccaagagcaatttccaacaaaaaaatggaagaggcagagaaggagatcttggaaacatttag

SEQ ID NO: 78229 - DNA, 935 bp, Glycine max
  Peptide Sequence Number=SeqID_169914
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcaagagttggatccagtcgagatatcagagccgttcttgcgtttcattcgagaagcaagttgctcaaattgaccaatactggctcgcttttttcccagcattgcgccaggtcgaagtacatcatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 78230 - DNA, 1021 bp, Glycine max
  Peptide Sequence Number=SeqID_169915
cccagaggtccaagcttcaaagcaagccagagtaagaggacacctgatcaatatagatgtagacaacctgaatgagtttcttcagactccagtggagattgaagtcaggctctatattccccgcaaggggtttgttctgaatgttgagggccaaccatggaaactccttagaaaggatatgactacactggcccagacatggagtgtcttctcttactccaacttagctcccacatcctacacctcagatttgaacatggatagagccaggttggtttatggcttggtaacccacatggatatgaacatcggcgccctgatcttaggtcaaatctcttctattgctcagagtaactcctctaagctcggattttcagccttgatcactaccttctgcagaggtagaggagttacctctgacagtctgacttatgagagcttgagcccagccattaactttgcctacattaagaaaaactgttggaatgtggatgatctgacaattaacttcagaggggtaaggaaggcaagggctcgaccagctagtgttccttcttcttctactccacctgcttcttccacttttgctactcctacaccagctccttcaggcccatctgcccaggactctcagcgctttaagtccatgcttcagagaaccatcttgacagttgagcagttcatggagaaggtagcctggccaggaactcaaccttctcttgtgaggaaaggtggaggtcccagtgctcaggtaccacaacaggtagatcatgcatctttagaggccacaatccctgagccatttgtttttaaggaaggagggacacagcagctagcagaccctcctacaccagtgcatgagatgccagcagacccttctactccattattggagattctagaggacctttccacactagtcttgggactgactaccactcctccagccactcctatgctacattttatagatgaggagggcactcaggatcaggatacccagcaggatgaccagtcatag

SEQ ID NO: 78231 - DNA, 636 bp, Glycine max
  Peptide Sequence Number=SeqID_169916
cagcgacccggtgattccgcaggcggtggccgtacacagcgcgcaggccctgcaggcgatgggcctggaggtggaatggcacagctacccgatggcccaccaggaacgcctgggcgctgcctgagccatgtcaccggccagcgccccgccctggatgccggaactgtgccgcctgccgcggctggcggcgatgctcggcctggccgaactggtggtggtggtgctggccctggccccggatggcagccgccactggaccgtgggcgaactgctgtcggccagtggtttcgcgctgtggctggcgctggccgtaacggccagcctgtgcctgctgcggaacgcgttgtcgaggttgccacaggtcctgggggcggtctcggccatcgcactggcgacgctgatcgcggtggtctgcgcgggcatcgtacatgccctgtacgcggtacaggccaacgcacgcgcacaggccgacgcgctgcaggcgcggatccgcccgcatttcctgttcaacagcatgaacctgatcgccagcctgctgcatcgcgacccggtggtggccgagcgggcggtgctggacctgtccgatctgtcctgccgcgctgcggggcgggcgatggcctgatccaccctgcgtga

SEQ ID NO: 78232 - DNA, 405 bp, Glycine max
  Peptide Sequence Number=SeqID_169917
atgctggcgcggcagaaactcagccgagcgcgccgcgctgcaggctcatcagcagcacgaagccggcgcctttggaggctgggcggggatcggccttgtaaaccgcaagtccggccaccgggccgagaaagatcgaggccatcagcatcagccgcagtgcggagaacaggccgttggaaaaactggtggtcattggccggtcctcacaatacgacggggcaattggcggcgggcgccgagccgtgctggcatgcgattgccgcaccggcattcacgcgctggaaactgcggttcggattaacgacgagcgaggcgaaggacatggcgaagatcgccatgagaaacgcgaagattgccagtcggctgatcagctttgtcatgtccattcccctttatcggagttga

SEQ ID NO: 78233 - DNA, 282 bp, Glycine max
  Peptide Sequence Number=SeqID_169918
atgagagcaagttcagcatatgacaccggaatttggggtggatcctacaggctttttgctgcaaaattcccttttggttggtgggttttgtggtttgatttagggatggcctttgtggataactgggtggtgggtaaggagatgggttgttattggctgagtaatgacattgttgggttggtgggaagtttccatgtaggaatggtaatcgcagcatggatttctctttcatcctcaccctcttcatttgccccagttttctcattcgtcgaagcaggatga

SEQ ID NO: 78234 - DNA, 378 bp, Glycine max
  Peptide Sequence Number=SeqID_169919
atgactggcggaatgatcaactgcagcggcggttggggcagcgccatcgctaacgccagcgcaacccgcccgccaagactgtggccgaaaaaaatcagcgcgattggggttggcagagcggcgcttcgtgcgcccgctcctctcgaccggggtattgcacggcatagagttcgatgtcctgatgcaacgcggggctccatcgctgaaaggcagtggctccggcgccggcgtggggaaaagcgatcagccgcaggctgccctggcgtcccggcgtcagcggtttcaggccgaggggggcgttggggaagtgggtgcaatgcatggcgaaaatccgtattttcaggggtgccaaggaagcctgagcttccttggcgttaa

SEQ ID NO: 78235 - DNA, 510 bp, Glycine max
  Peptide Sequence Number=SeqID_169920
atgctggacgccgagttcgacgatgcgcgccagagcttgatggctgaagtagggcgcgcaggctgcggcgcggaaatcgctcggcgtctcgaccgctatcaccaaagcctgcaggtagtcgcccgacaacggcgccagcgcgtcatcgagcgccgcccgggtaatcagccaatcttcagaggcagcgctggcgttatagctctccgtggtcccgtccgcgcgttgcggcctgacgcgaatcagggtggcggcgatgaacggttcaagcggcaaatccgccacgttgtgcgtttcaggaagaatatggccgatgcattcggtgtgcgtgccgtggcagtgtggcaccaggctgatacgctcggcgttgcagaccccgccatgacgcacgctggcgacggtatcgccgtaactcagcggcgccgaatcggcgggggccacgccataaaggttgatcgggttatcggcgaagtccagcctggccgagagccgcagcggctctcggtagtcaag

SEQ ID NO: 78236 - DNA, 824 bp, Glycine max
  Peptide Sequence Number=SeqID_169921
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttggttctcagagcagtggtgatttcttatttaagcctgtctacattagatgggcatgcgcataccaccattctgtaagattccaagtggtgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 78237 - DNA, 684 bp, Glycine max
  Peptide Sequence Number=SeqID_169922
atgacattgaccatactagagcttttcttgaggccttatcaggttagatgggatgtcaccgtgtttggggtcttcaatccagatttccccctctacataaagcacaaagacctctccaaaatcgcacatggtggtcaatgtctcagcatatcagtgttacagttgtggattttgcatctcactgaaacatgtatgcgagtggggaattctgatatctatggattcctcgagccacagtccattcagaggtctaggcaatcgcagtttgagtctgaaagttacataaagagttggatgcagagttcacaacgcgatgtctatcttggagcctacctaaatgggttccactgcagcggacactggcagatggtggtcatcctgcccaaggaacatctagttgtctggttttggtcatactaccttaaggggattattaatagtgctttaaaaggtcttgatgatgctccacaacttaaatcaaaggcttctactaggtggattgtcgtcaagtgtaatagacaaaaaggaagtactaagtgcggctactatgtgatgcacaggatgtccaccatcattttaggaacttttaggaataattgggaagcgtattttaacgatcctagaccattggagccagagagattaaaggcattgcggatccagtgggcacaattttatctctga

SEQ ID NO: 78238 - DNA, 978 bp, Glycine max
  Peptide Sequence Number=SeqID_169923
atgatcgagtcaggcgcttcgcttaaaaagaggttctataaagtcaaggtcaagagcctaggagtcaccagtctgaaagagttagggcagttgatgggtcagctccaacgacaagctttccgtaaagcttacggtaagatctgggacctagccatggcagaggtctccaccgaggccattgcctccctcgtccaatattatgaccaactgttgaggtgctttacctttggggactcccagttatcacccacggtggaagagtttgaagaaatcctgggatgccctctgggagaaaggaaaccatacctcttctcaggattctatccctctttagctagaatttttaagatagtccaaatcttgacgcaggaattagaccaccgaaagcaagtcgaaaatggggtggttggagtaccgaggaaatgtttggaagcaaaagcaagagtcttggcaggtaaaggtgaatgggcccttttcatagacatcctcgcacttttgatcttcggaggagtcctctttccaaatatggatgggttagtggaccaggcagcgattgacgcttttctcgcctttcatgaccgcaaggaaagcccggtagtcgctatcttagccgatctatatgacaccttcgaccgaagatgtgaaaagaacagtacaaggattgtttgctgtactccggccctctatgccaccgctaatgcacagaaaaaagaggcaagttgggaccgactcttagcaagcaaagaaggagcgtctatcaactggttcccccgatggaaagaaggaagaatcgagattcttatttcatgcggaggatttccaaatgttcccttgatggggacaaggggttgcatcaattacaatcccgtcctcactataagacaacttggctaccctatgaggggggcaccactagaggaagacctcacacttattattgcacgaggtttcaatggcaccaacgcggaggcactttag

SEQ ID NO: 78239 - DNA, 483 bp, Glycine max
  Peptide Sequence Number=SeqID_169924
atggtaatgttacatactaattgtttttattcttcatgttgtttcatatttgctttgctggacattatagaagtgccctctttttaccaccaacaatgggcaccagaataccctgagtttgtcaactttagatatgatggaacaatataccaaatcaggctaaggcagcatcgggcaaaagtctactttgcggaagggctgaaagaattcagaaaagatttatcaatttacgaatttgtgatcattaaattcttggcatgcaacaacaaatccatgtttgatctttatttcgttccctcactggaatgccagacttgcggaaggctagaagttatgtcaagacaacatatttggacacttgaaatcacacaatcaattcttggtgcatcaggaccactgagactccccaattgtgccatgacacatgtaaattcctgcggtcaacacatgaccattcttagaagatttggacctccattatag

SEQ ID NO: 78240 - DNA, 225 bp, Glycine max
  Peptide Sequence Number=SeqID_169925
atggcgtgtagctctctaaaggcgaggacgtgtcgtcctctaaaggcgaggatgtgcagtcatctgaaggcaagggcgtgtagccctctgaaggtgaagattggctgtccttttgaaagcagtgataattcatgcaaccttatcctatctttcgtaaatctctccgggaactccctcaaagttcacttgaggctcatatatggtgcccctcattgccccatgtag

SEQ ID NO: 78241 - DNA, 308 bp, Glycine max
  Peptide Sequence Number=SeqID_169926
atggatgatcctgccataccattcacaacattaagttcgagaatcaccccgagtttaagaacccacaccattatgaatcttaccgaattaaagaatacgccggtttctgagctgatcactctcggcgaaaatatggggctggaaaacctggctcgtatgcgcaagcaggatattatttttgccatcctcaagcagcattcaaagagtggcgaagatatctttggcgagggcgtactggagatagtgcaggatggatttggattcctccgctcagcagacagctcctacctcgccggtccagacgacat

SEQ ID NO: 78242 - DNA, 531 bp, Glycine max
  Peptide Sequence Number=SeqID_169927
gctgatggagtgcccgctggcgcccgcgcggccggtacggccgatacggtggacatagtcttcgcagtcatccggcaggtcatagttaaagacatgggtgacggctgggatatgcaggccgcgagcggctacgtcggtcgcaaccagaatatcgagatcgccgcgggtgaactcttcgagaatacgcaggcgttttttctgcgccacgtcgccggtcagcaggccgacgcgatgtccatctgccgccagatggccccagatatcttcacaacgatgcttggtgttggcgaaaacaatagcgcggtcgggccactcttcttccagcagcgtctgcagcaggcgcattttttcgtcgttggaaggatagaacaactcttctttaatgcggtggccggttttctgttccggttcgacttcaacgtactcggcgttgttcatctgttcgaatgccagttcgcgtacgcgataagacagcgtggcggagaacagcatgttcaggcgctgagtggccggcggcatgcggcggaatag

SEQ ID NO: 78243 - DNA, 403 bp, Glycine max
  Peptide Sequence Number=SeqID_169928
atgaccatgattacgccaagctcgaaattaaccctcactaaagggaacaaaagctggtaccgggccccccctcgagcggactatgcggctttgaccagcaaggtctgcgagttgcccgcagcccgcattagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgg

SEQ ID NO: 78244 - DNA, 180 bp, Glycine max
  Peptide Sequence Number=SeqID_169929
atggttatccgcacctttcgtcaaccaggggcaaacgagctcgttggcacacagagactaacgtcgtcttctgcaccttttgtcatcccgagacagcgagttaggtggtttttacttttgtcatccagagacattcaagtccgacgacgcacaagattcttctctgctagacggggatga

SEQ ID NO: 78245 - DNA, 219 bp, Glycine max
  Peptide Sequence Number=SeqID_169930
atggcactgacattttgggatttggacagattgagaagacagcttccaattgtcccatctaattggttaagctctgaatggagtttctggtctcttgttgaaactgcatgttcttgtagatgcaaatgcctttggtgttttgatgatgatcatgatgaagaaaagcaaatgatgcaaatgattcaagaatacaagccacaacatcaagatgatcactag

SEQ ID NO: 78246 - DNA, 501 bp, Glycine max
  Peptide Sequence Number=SeqID_169931
atggaagggttagtggacctagcagcgattgacgctttcctcgcctttcatcatggcaaggaaagcccggtcgtcgccattttggccatgtatgacacgtttccacggggatgtgaaaagagcgacgcaagaattgtttgttgtgcactggctctctatgtgtggctggaaggaagaatcaggattctatcttcatgcgaaggatgtccaaatgttcccttgatgggaacaagggtttgtattaattataatcccgtcctcgccataagacagcatggctaccccatgagaggagtgccatcagacgaaagcatcacgcctttcatcgcacggggtttcggtgaccacaacgcgagggacagagagcttaggggaagcagtaatgggatcatcggcggctatcataagtggctgagagtccggacacaaggattggattggctcccaaatctaaagactgtgagagacaatgaggttaaagcttcggaagaaagtgatgag

SEQ ID NO: 78247 - DNA, 375 bp, Glycine max
  Peptide Sequence Number=SeqID_169932
atgccgggggtacttcagaaggttcataaggcatgggagttggtgcaaaagaaggacaaggaacttagaggcagtagcaacgggcccatcggcggctaccaaaggtggttgaaagcctacacacaaggtctcgattggctcccgaatttgagaaccactaaagggatggaggttgaaactccagaagaagacgaagagatacaagccctcaagatagaactcgagaaagcccaaacagtcaaaaaaaagttcaagttagtagctgttaggatccaaaaggagaacgctgaactaagagacgtcaatatagccaccaccaaggccttagaacaagagaccaagagggcccgtagggaagaacatggccagaactaa

SEQ ID NO: 78248 - DNA, 606 bp, Glycine max
  Peptide Sequence Number=SeqID_169933
atgatatccatcagagtcagaaaggaatgtgacaagctgagggatgccaacatggccacggatgaagcattggaacgagaaacaaagagggcccgaaaagtggaatggggccgaaacaagtttcgaggggctttatggggcagcaacagtgaactcaagcttcgaagggctgagagagaccagtcgcgagtcgaagttatgatattagaggataagctaaaggcttgtcaaaggtcaaagaggagcttgtctgaacagttgagtaggacggaagagaacatgtgggccatcattgaccaatacagagagaagttgagtctagttgctggccatgagcaaagattagaggacgaacatgaaaaagtatcggctctccaagcggaaacggaagtaagggagaaagtaatagattcattgcacggagaagctatgatgtggatggataggttcgctttcacattgaatgggagtcaagagcttccaaggctgctagccaaagccaaggcaacggtggatgtgtacttgcttctcgaggaagttcgtcggcttttcgattattgtcagcatatgatcgatttgatggcccacataattaggagctgctaa

SEQ ID NO: 78249 - DNA, 423 bp, Glycine max
  Peptide Sequence Number=SeqID_169934
atggcacctcatgactctattcctatagtaaagcagtttaatgagatggttgcctggcctgagacccaaccttctcttcataaggaagatgaaggtcccacagcccaggtacctcagcatatggaggatgagtcatctgaggccaccatcccagagccatttgatataggagaagaggcagaggagacacaggtgagacgagtagcttctaccactcctgagcaatcccttgaggctacttcagagccttctgcactagtggtaaacctaccctcacctcatcatgcagcagacccctccactcctcttctacagatgccaaaggacccaactacacctgtcatagctgtggacacttctcctcccactactccagtgcttcagctgacagatgatgaggatggtcagacacaggacacatag

SEQ ID NO: 78250 - DNA, 100 bp, Glycine max
  Peptide Sequence Number=SeqID_169935
atttatggaaaaaggctgtatttctgagagtataatcgacacaaccatagctctcaagcacaaagagtttctcccaccattgcctgaaccgattctctga

SEQ ID NO: 78251 - DNA, 657 bp, Glycine max
  Peptide Sequence Number=SeqID_169936
atgcaggagaacttcttccaaccagtggcatggcttgaagaccggccttcttctactgagggcaatgagcttgctgctactgctaaggtggagactgttgttgctactactgctgaggtggagcctgtagctgatattgctacagagactgaggcaagaccttctattgctgaagatcttaaacttgataaatttactctggatccttataagaggtttgcaagtcaacagcttgatgaggtattagcatcgtctgaagttcctgaaccttcaaataatgttaagaaaattgttaagaaaaaacctaataccaaagtaactaaaaaggtcagcaatgaagagaactctgatacttcagataaggagactgatgaagaagagagtgaggaagatgaatatgtagaagagagcttcaggattgaaatcaaatacttaacttctaaatatgtatttggaaatagcaaggaagaagcacaaattggtgttgatcgttctagtgcaacctctaataaatgtgagatttataaggaagaagcacggaatgcagcacagaagcataaaacaaagagggtggagagtgtcaatgctgatgcagaagcctttggtgatcactggaaaattcagattgctttatgcattctgaagttgaagcactag

SEQ ID NO: 78252 - DNA, 465 bp, Glycine max
  Peptide Sequence Number=SeqID_169937
atggtgggtcccacttctacaatgtgcagttgcggaaagtcttgggacattactatgtcagacataaagttgcttctccataccatccttagacaaatggccatgccgaggctcaaactattccctagaaggctcagatccaagtggtctagcccctttacaatcaaggacgtaaagctctatggtgcaatggagctgatggacccttcctcagccgacctgaaacacagttgtattgtaaatggtcaaagagtaaaggtttacaatggtggtgatattaagagattgaccaccatcatagaactccatgagccatgtgggaggaggcgtcatccactagagaataagccaaggaaggagaagcttcaccaccaagagagtgtcttagataagaagcttaaagaggaagcttcaatggaggaagagaatgagagagagaggggcatgggaattgaaggagattaa

SEQ ID NO: 78253 - DNA, 1359 bp, Glycine max
  Peptide Sequence Number=SeqID_169938
atgaacacaagtgatgacaagttaaaagttgcagcacaagaaggtgacataagccttctttacacactaattcaggaggatctacacgttttggaccacatggatttgacaccatttgctgaaacacctttgcatattgttgcatgtgttggacatctccagtttgccactgagattatgaggttgaaaccatcatttgcttcgaagttaaatcagcaaggattcactcccattcacctcgatatgcaacatggccaaaagagaatggtgcttcgctttgtagacatcaacaaagacctcgttcgagtcaaaggaagggagggcctaactccttttcattttgcaagtcaaaaaggagaaattgaccttttagctaactttctcttggcttgtccagattccattgaagatgtgactgttagatgtgagactgcacttcatattgcattgagatctcaacagtatgaggcttttcgagtcttagtcgggtggctccagagaacacgccagagaggtgcaactacattagaaaaaacaatactaaactggaggaatgaagaaggcaacaccattttgcacgtctcagcactcatgaatgactcaaaggcaattcgattgttggtaaagactaaggtggatttaaatgccaagaattgggagaacttaacagcattagacatagcagccaatgcagaggtaaagattgtgttagctaaggctggtgcaaagcatggttcatcaattactaatgctcccacctttcctgataaactaagatccaacatcacattgatggaaaaaataattatcttcatacttcgcattagaagggatataacagaagaccaacgcaacgcgtttctgatagttgctgctcttgttgcgaccgctacttatcaatcagcactgagcccccctggtggagtttatcaggctaacgccggcgataacaataccaactctactccttccctcaattctacagttgctacaactgcaacccacggtaatgctgggaaatcagtgatgactgttggcgattttctgaccttgtcaatttttaatacactttcgcttttggtgtcaattatgacaatgtttattctaactccaagtgggacagtaggtagtatattgtctgcgccaatgtttttgtttgtctcctgctatcttcattctatgaaggtgatatcacctgacaatgctacctcatttggtcattatattacggcatccttattcagcatcttgtacttggcagcatcttggtcaatggccaaagtgtacaagagacttcagcatcatgataagaatagggaaatgaaaacgtggaatagtatagcaggaaatagatggtag

SEQ ID NO: 78254 - DNA, 366 bp, Glycine max
  Peptide Sequence Number=SeqID_169939
atggagcatcaaatcttcgcacaaccttaccttcaaaacacaaccgtgttacgacccctccaaaaaggggtactcactggcttcggcggtgccgccacaagacgagacaccggacgaggtgacgggggtgcgggcaaacgccacagcaacgtcttcgaaattcaaaatttcaacgacggtgttttgaagtgcaccgtcttaagttaccagcgtgccacctacaaagacgggcacccacggccaacgtcgttgaatgtgtcacgcggcatgcacgtggcacataaaatgctcacttatttatggaattgccaccactactcctattacgacgtttttgacaaaaacgatgtggaacgcgcatcgtaa

SEQ ID NO: 78255 - DNA, 609 bp, Glycine max
  Peptide Sequence Number=SeqID_169940
atggcaacaccaccagcatcccctccgcagtccaatcaacagtcagaggcgatgtctaggaatactagacgatcgacacagcttaggatgttgactagaagaaccttggatcagccgcaacctattgtcaccgttgatgctgcaactgggcgaggatcgggcccccataaagagaaattccacagttatttaggtgttgtagctagagaaaaagttccaattgtacataacagttggaaggatgtaccggacacactaaaggagctagtatggaatgagattttggccaagtttgatatctcagaagccctagatgcaaagaaaaagatatgggaggaatttgcggcaacccgcaaaacccctagttggcagggaattaggaagaagatgcaggaaatccaaaagaataatgactgtccctatttgctttctcgcgggggatatgaattgctagaaaagaagctgttagacgagaaaatgaagaaaaggcaacatgacacattgatgactgaaaatccagcactcattgaggacccccccatctcccattcaaagacatgtcaagtggaagatggcccgcacgaatcgatatgggaagatgacatctga

SEQ ID NO: 78256 - DNA, 294 bp, Glycine max
  Peptide Sequence Number=SeqID_169941
atgggggaggaaagccgtaaagatttcagaaaggaagtcgctaaattacttatggatcaatctatcttggaagtcaagtatactacttggctaacaaatgtggtgatgggcgaggctcggctcgagggtgcatcttccaagaaaagaaaacactcgggagttgccaccaacgtttattcgagggaaatattagaaaaaccaaaaaaagggtctacgaattttaagaataagggttcgggagttgattacatgcgggaaggtatttgcaccccacacgtctatcacaagggatga

SEQ ID NO: 78257 - DNA, 318 bp, Glycine max
  Peptide Sequence Number=SeqID_169942
atgtcataccctaatttcgtccggggaccattgtttattggcatgcgaccttcgtttgaccacctcaaaatgtttaacacccatcgcgatggaatccgtaaagttctgagatgtttcggggagaaacctgccaaaaacacgaaaatgggagtgtatttagccaagtgggggaccattgttgatcacttcgaaaggcttaacactcatcgcggtggaatccgtaaagttctgggacgtttcggaaagaaaacagtcaaaaacacaaaagtgggggtgaacttatcaaacacgggaagtgcactcaggaaacttcactaa

SEQ ID NO: 78258 - DNA, 321 bp, Glycine max
  Peptide Sequence Number=SeqID_169943
atgagaggcaccatgcatgagcctcaagcgaacctaggggcagatcagaagttcttgcttggtagcgggaaaagcaatgcaaacaacgcatgcattaagttaggtgtcgcaacctacccttcggcgggagggcgacgcggggctcacgagtgcatcttccaagggaggaaggcgcacggagtcgccaccaacatttattttaggaaaacgtcagaaaaaccagaaaggttcagtctacggactttaattgcgaaaggttcgggagttgtttttgcgcacggggaaggtattaacaccccacgcgtccgtcacaagggatga

SEQ ID NO: 78259 - DNA, 490 bp, Glycine max
  Peptide Sequence Number=SeqID_169944
atggatcaatatttgtatcataggaggcctgggaccgttactcagataatgtgcttgccaggaacattctgccagaaagaaatgtcaagctttatatcaatgaacaacaagtttccgaagcaagttagggttcgagggcacctgataaaatttgatattgattccctcaacacctttttggagactccagtggttgtggagcaatgggagagctttccttcttactctaggtttgctagactaaggcctgatctgcaggagcttgcagcccaattgtgtatccttgggaggggatttgttctgaatgtcgagggtctactgtggaagctcttgaggaaagatcttaccactctggcccaaacctggagtgctttaccttattctaacttggccccaacatcccatacttctgatcttaatctggatagggccaagttagtctacaggcttataatgaagatgaatatgaacttaggttcacttatttctg

SEQ ID NO: 78260 - DNA, 312 bp, Glycine max
  Peptide Sequence Number=SeqID_169945
atggctcttgaggctaaggttggtccttctattgcttgtttcagcataaaggaaagttgtgtcaatccctcgagacaggacccaaaaataggtgactcagacaaatgtgggttgtatgttgatgaaaatcctccctatctagttgcccttggaagactttatgaggggtcgaccaccgttcacaacatccctttgggcaatgatcaagtgaaggtcggtgttgaggaagttcaagatgctaatgctcgcattcttgtacccactcaagaggttcagctactcaggataaatagggagctgagggaccgatga

SEQ ID NO: 78261 - DNA, 537 bp, Glycine max
  Peptide Sequence Number=SeqID_169946
atggggtcgaaccaagcacatgcttttaagaaaaggttttcatcaagtcaaggtcaagtatggaggttgcattgctcattgtattctttccttgaaatcagaactgtaatcatttttatcaaaaggaaaggacgtgctttacagtgcccttaccgaacgcatgtcagagctagagtaatgagtgaaatagaggaggtgcaagagaagacgaaggctgacatggaggccatgaaagagaaaatgaccacaatgatggaagtcatgatgagtgtaagaaaaatgatggaggtcaacacggctacaatcattgccacaagtactgccactaaggtggacccaactcacccatccagcaatcaaaacaagcattccttcccaccatatggcttgcctcccaactatacgccacccaatgttgcacatgctcccgatgagaacatcgataactccgcacccatacccattgagagccaacaaccacaatctgatcatgcacatgtcgctcaacccatgggggagacacatgaagcaccttga

SEQ ID NO: 78262 - DNA, 750 bp, Glycine max
  Peptide Sequence Number=SeqID_169947
atgatcggaaggttgcttgccagttcattggctcttgaaagccgcatccttcactatcttattgttcgtatcttactcccaagatcttcaaaccttgcacaggtttctgaagaagatcttatagtcatgtgggcctttcatactggccaaataattgattgggcacacttagtacggtattgcattcataaggcattgcaattaaatgctcctttaccatatccacatttagtcactctattccttcaacattttaacatccctcttgattctgaaccatatattccaatcaagagatctttcttgatcggtgctctgtggttgcgtcctttggttaccacaaagagcatgatggcttttgggttcgatggactccaaacctatgttggtgaaaggtttgatgctttggaacgacaagtggacatgcgatttgatgcaatggactcaaggatcacaaaggttgaagaagatgtcaccatcattcgtgactgccttgatttacctccaccaccaccatcagattgtcatcatcaaaaagggggagattgtggaagcaatgccttccaagattattttgatgatgctaaagaatcaagagtaaagcaaattccaaagtttcaagatacaagattcaagaatcaagtttcaagaatcaagattgaagatcaagattcaagactcaagattcaagaatcaagagaagactcaatcaagataagtactaaaaaagtttttcaaaacattgagtag

SEQ ID NO: 78263 - DNA, 930 bp, Glycine max
  Peptide Sequence Number=SeqID_169948
atggcatcaaagaagagaaaggcacctgccacaccttcccaggcctgggaaaggtacactgatattgtggtacccagaaagataatcccagagcgaaatgtggtaatctaccacactgagtttgatgagttcaaggaagaactggagataagaaaatgggatgaggaattgaccagttttgatgaaggcaacattgatgttgccattgtgaaagagttttatgctaatctttatgatcccgaggataaatcacctaagcaggtgagggtgagaggccatttggtgaattttgatgtagacactctgaacactttcttgaagacccttgtgataattgaggagggggaagagctgcctgcctactctagatttgcactcttcaggcctgatcctcaagagttggctgctaagctctgcatcgcagggagggcatttgagcttaatgttctttcttacttcaacttggtccctacctcccacacttttgacatcacactggatcgggccaagttgatttatggcattatcatgaagatggacatgaatctgaggtacctcatctcccaccagatttctatcattgcccaacatgacttctctaggcttggatttccagccttaatcataactttgtgtaaagctagaggagtcacatcagattctagatctttggagagccttagccctgccattaacttggcatatataaagaagaactgttggaatctagatgatccaacagtgacattcagagggccaaggaaggccaggggtatgaaacctgaggctccccctacttcagcaacaatagatgcttctactccttcttcatttgctttaccagatccttcagcaccatctactttgactccacatcttccacagttaccagcttcagctctcactcccttattagctcgtcctacatga

SEQ ID NO: 78264 - DNA, 238 bp, Glycine max
  Peptide Sequence Number=SeqID_169949
atggtagtggtaaaaatagtgttggtggtaggtggtagcaatggctacgaccacgatgatagtggtggtgatggtggtaattgtgctagtggtggcaatgataatgatgatggtgatagtgacaacgatgaagttaatggtggtggtgataaccgtggcaatgacaacaataatagtgctggtaacgatgccagtggtggcggaggcaacagtagtggttgtggtgacactggtggag

SEQ ID NO: 78265 - DNA, 537 bp, Glycine max
  Peptide Sequence Number=SeqID_169950
atggctatattggaattgaatgatttaataaccatgatggtagctataattggcaagctaagggagaatgacttagagcttgggagactaaaggatgaagaagttgacaagaagaataatgaattagccttaaagataagcacttcacatcatgaagctagtgatgaagacccttcagtaaatttggttgatgcaaatatgaatttgcttgttaaaaagttctccaagttcatgaaaaagaaaggaaaagacaaaggaaactttcaaaagaagagcacaaagaaaagtgacttcatcacccctaaaagctacacatgttttgagtgtaggaagcaaggccacataaaaggggatagtccaacctgcctaaagaaacaacaaggagatgagaccaaaagcaatgtaagtgactctttttccgaatctaatacaaattatgacaatcttcttgatgcattcaaagagttacatgaagaggccaagttagatggcatattgagaaatttattattttataaaaggaatcccatgatttga

SEQ ID NO: 78266 - DNA, 240 bp, Glycine max
  Peptide Sequence Number=SeqID_169951
atgattttccccttcttctcctctccaaacgccacccaaaccctaacacctccttctccaccacccacgaccaccggtggccaccacgaggcaccattgcttgccatcgaacctccacaccaagaagaattttgtaatcaaagcaaaatcctcagaatcctcctcaaggatttagtggagaaaattcccccaatccttcgttttgtagctcctctgagggtatttttacacttcctttga

SEQ ID NO: 78267 - DNA, 489 bp, Glycine max
  Peptide Sequence Number=SeqID_169952
atgtgggcctttcataccgggcgtcaacttgactgggcacacttagtcagatatcatatgcataaggcattgcgattaaatgctcaattgccatatccacaccttgtcactctcttttttcgccattttcaaattcctcttgattctgaaccttatgttccaatcaagagatcttttttaattggtactgctgtgattgcttcttttggttaccgcaaagagcatgatggctcttgggtcaaaaagggtgctcaacccattgatgatgaaggcaacctaccaattgaagataattcgtctcttcttcgaaggcttttggacaagttcgatggtcttcagacttttgttggtgacaagtttgatgctatggaattgcaagtggacatgcggttcgatgccatggaatcaaggatcaccaaggttgaagaagatgtctccttcatccgtacttgctttgatccaccaccaccgcctccatcatcatcttag

SEQ ID NO: 78268 - DNA, 672 bp, Glycine max
  Peptide Sequence Number=SeqID_169953
atgactgagagggagatgatcacgattatggtagatacgttgcctacgttctactacgagaagctgataggatacatgccagctaactttgaagacctcgtcttcgtcagagaaagaatcgagtccggactaagaaaaggcaagtttgaatatgcctccaacattgcccccaacaacaatagaagagccccggtggtgggcacgcgggaaaaggaaggagatacccacgcggtcaccaccgccctaacatggatgaaagtgccccaaaatgcccaaaactcataccagcacaaccatccgaacttttcgatccgagccggaagttccctcccaactcaagagggccccaacgttaagaccaatccactagccagtcatggaggggctagcataaatgccataaaaaaggatgggccatcaggggcaaagagattagaagatgtggctacgtctagacgattcatctaccagtcgctgcaagcagcatgcatggtctcttgtggcggagatgaaagcgaagaatatttgtttcatctcggggaatcacacgacatggaaacctgtcccgcggtggaagagttacttcaacggctcatggactgggggcagctcgaagtgtctaagggagatagggaagaaccacagatttgcatgcagtcgaaagaaaagaag

SEQ ID NO: 78269 - DNA, 309 bp, Glycine max
  Peptide Sequence Number=SeqID_169954
atgaagaaggcccatgatagaatgaaacaacttgcagatagaggcagatcggataggagttttcagattggtgacttggtttatttaaagaagtttaatggtactgctactgctgggaactttagtccttcacctttattggatacttctcaaaaggaacctgcagctatcattgacagaatgacagtcaagagaggaaattgtgctgtaaccaaagttttggttcaatggaaacatcaactacctgaagatgcaacttgggaattattttatgactcgaagcagaagtttcctcactttaatccttga

SEQ ID NO: 78270 - DNA, 893 bp, Glycine max
  Peptide Sequence Number=SeqID_169955
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatttccagagtgaccccggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 78271 - DNA, 177 bp, Glycine max
  Peptide Sequence Number=SeqID_169956
atgcaaaacagtggggtcaccctaagggttgaatctcaacactttgccagtgtacatgatgacaatccctgtgtagcttccatccctgactttgggttcattgaagaaatttgggagcttaactatgtcaaatttactatttgtgttttcaaatgtgtggaagcaatgtcttccaag

SEQ ID NO: 78272 - DNA, 750 bp, Glycine max
  Peptide Sequence Number=SeqID_169957
atggagtggaaagagatgttgtccaatggtgcatcagggacatttccaggcacctttttccctgatgtcttggccctcttgatgtcgggaacatctggttcgacatcatcatcagaatcagatgaggaaatttctttcctcttcttggaagggattgcaactttgctccttctggatgtggtaggagtgattggagtgctcttcttctgtgccatagttttgattcgtccagacctcttaatgggggttttaccctttcggctttgtaatctttctgcgatgccaggtgccaacttgttggcaaggggttcctcatcagattctacttcttccaggtcaatgaggtcacctggagcagagaggactttcagcatttggggcggaagatgttggaacatctttatcaacatcaggcacagaaacatttggggtggaagatgttggaacatcttcatcagcatcagggacagaagcatttttcaaaatgctactcacaatactgcggatcttcttgtccatctccgtgtctacttccctaggacttgttgcaaggctagggttttcagaaatcttcactccctgttgtcgtttggggaccagtttttcaggaacaggggcttgaaccaggaatcatttgtatgggttggatatggaattcaggttgttcctggtttgatggtgctttggtggatgatggagatgatggtacagagggtgaaccaggagatgaagtatcttttggtgaggtag

SEQ ID NO: 78273 - DNA, 432 bp, Glycine max
  Peptide Sequence Number=SeqID_169958
atggcagcgcaattcatccatgaccgagtggagatggagtgcctagagggagtttgggagacgcttgaaggcaatgcgaggtgccgatttcgtggcacgatccgactcatggctacttcgttggtacatccagaggaaccatcacgcacgcttcagcacactgtggagtggatattacctacacctactccatatctactagtggagccagtccaagtgatagaggtgacgtcatctgaggaagaccctgaggaggacccagaggagctaccttctgagcctgctgtggatgctcttgactttctagagggtgatgaggacccactccctgaggtggattctcccgaggacgtcatgtcggcatctgaggcagactctacggaggagagcggtcctggagggatagcgactagcggaggttcttcatcatag

SEQ ID NO: 78274 - DNA, 386 bp, Glycine max
  Peptide Sequence Number=SeqID_169959
atggcaacttcacctaccttgcctcctcctccttctcattcacctcctcctctttctcctcctcctgcagtagcatcagcgtctttgtctatgttgaagcagacatgcaaacccacacgagtacaatccttggccactagaccaccaggggcagagagaccagtggtccacgtcgatcctgcgaccaggaaagccgacggtccccaaaagaagaaattaagaacatatttggggattgtcgctcgtgataagtttaaatctgatttgatgaggaaatgggcccttgcagccgacaaggacggtgtggatgacattgtttgtgagaaatacgacatcagcaaggagaaatgggccaaattttgtcagacccgcaaagacccctcctg

SEQ ID NO: 78275 - DNA, 378 bp, Glycine max
  Peptide Sequence Number=SeqID_169960
atggctacagctagatgggtactcaaccatccagtttatggcattgtgatactaaggcttgggatttacacaagtagacccaatatttccaaattatgttctttcatcggttcaatgaatccattcattcttatctcgaacgacgttcctaaaggaaaactctacaaggtttcagaatttcaacaaacattatcgacaataacgaaacaaaagaggaaacataaaagagaatatgaatctgtggatcccacggtcatgtggctccgcatgccaccggactcttgggtcacggtaacaaaaggtagggtggtcgacaaaagcagggtttttgctactacgtatcctcaatttcgtgatgaggaactcagatctacgtag

SEQ ID NO: 78276 - DNA, 117 bp, Glycine max
  Peptide Sequence Number=SeqID_169961
atggccctctacaggatactaggctaccttgtagcgacgttttccacttgtccagcgccgggaagggacgacgatctgtcggtcgtgaccctatcctctatttgcatccgtctctaa

SEQ ID NO: 78277 - DNA, 252 bp, Glycine max
  Peptide Sequence Number=SeqID_169962
gcgcagggtgatgcacatcaggtcatagatgcaccgccaccacctcggcaggccgatccagctgggtcactgggcgtggaacattatctacagcatttggttcgccaacaggcggccaaccaccgtgggcaggtgcagatacatgagtgtctctaccgattcagcctcagtcagcaggggcagggttccgcaccttttgcatgccctactccagagcagttttgggctgaggtcgcatggcctggagactag

SEQ ID NO: 78278 - DNA, 279 bp, Glycine max
  Peptide Sequence Number=SeqID_169963
atgaggcttaagaatcaaggaagtcactcagtccattatgcaagccaccaagggaatcaaggagctgaaaagaaatttgtgaagaagcatgataaaggcaaagggtcattaaagataaatgacgactctttgcaaatccagaaaaaggtatcaaagggcaatagttgtcaattttgtaggaaatcaggacatttccagaaagattgtctaaagtgtaagtcttggttcgaaaagaaaggtgagcttaatgcttatgtaacatttctagagaaaggatga

SEQ ID NO: 78279 - DNA, 563 bp, Glycine max
  Peptide Sequence Number=SeqID_169964
ggcgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccaggcgtttccccctggcggctccctcgtgcgctctcctgttcctgcctttcggtttaccggtgtcattccgctgttatgggccgcgttttgtctcattccacgcctgacactcattccgg

SEQ ID NO: 78280 - DNA, 264 bp, Glycine max
  Peptide Sequence Number=SeqID_169965
atgccactttacactaagtttttgaaggatttgttcaccaagaagggtaaatacatcaataatgaaaacatcgtggtagaagaggaagatgctgaaatttcgttgatcttaggccgtcctttcatgttgatgactaagtgtgtggtggatatgggaaatggtaacctagaaatgagtgccaatgatcaaaaggttacctttaatctatttgacacaattaagcatccaaatgaccacaaggcctgttttaagatgagcagttga

SEQ ID NO: 78281 - DNA, 183 bp, Glycine max
  Peptide Sequence Number=SeqID_169966
atggatactagacatggcaagaaaattcgtacccgtgggtacccgtttgaatccgtcataactttgacggataatatccgagttgaccgggtatgggttcggtttcaggttttccctgataatcaaaagtcgggtacgggtacaggtatgaggatatgtaggggagtcgggatcagggattga

SEQ ID NO: 78282 - DNA, 519 bp, Glycine max
  Peptide Sequence Number=SeqID_169967
atgggtgaagtagaggagatacaagagaagatgaaggccgacatggaggccattaaagagaaaatggccacaatgatggaggccatgatgagcgtgaagaagataatggaagccaatgcggttgcaattgccgctaccagcgttgttgctaaggtgaacctgatgtccccatccggcatcaaccaaatgaatcatccaacctcaaatatgcacgccttcccatcatatggcttgcctcccaactatacaccacccaatgtggcatacactctcaatgaaaatctcaataactccactcccatactcattaagagccaacaacctcaatctgatcatgcacatgtctctcgacccatggaggagacacatgaaattccccaccacgatctagccaacttcgagccttgcctcggatatgctgctgaagggcaagcagttggtgctatacccctgcaaaacactttggagggccctcagtatcacccacaactgcacctcttggcattccacagcggataa

SEQ ID NO: 78283 - DNA, 474 bp, Glycine max
  Peptide Sequence Number=SeqID_169968
atgtggctaccaccaaagccttggaacgagaaaccaagagggcttgtagggaagaactcggtcggaacaagttccgaggggctctgtggggtagcaatagcttgctcgaggtccaaaagaagtttgtctcagcggttatgcgagacagagaccaacatgttagctaatatcaccaagtaccaagaagaactaaatctagccgcggtccacgagcatagagtggcggacgagtatgcccaactgtacgcgaaaaaggaggctagaggaaaggtgatcgactcgttacatcaagaggcaacaatgtgggtggaccgattttctcttaccttgaacgggagtcaagaatttccccgattgctagccaaggccaaagcgatggcggacacctactccgcccccgaggagatccacggacttctcagctattgtcagcatatgatagacttaatgacccatataattagaaaccgctag

SEQ ID NO: 78284 - DNA, 351 bp, Glycine max
  Peptide Sequence Number=SeqID_169969
atgccgatctccccctgtggatggatcgcgcccacaagacacccagtggacccggagaagtccaatagggccctggggtttccagctctggttacgggcctctgtcaatcctacagggtgcccgtccccccagcaaggtcatgccatcgtgacatagggatcccgcccgcaagacgccaagtggacccaaagaaatccaatagggtcttgaggttttcagctctgattacggacctttgtcagttctatggagagcccatcgcccccaacaaggacatcaggccccctactaaccaggctttcatcaagaagtattgcgcccctaggcaggtgcagggtgaggtatcatag

SEQ ID NO: 78285 - DNA, 462 bp, Glycine max
  Peptide Sequence Number=SeqID_169970
atgttcgtagtggaggggcatttggtcatagtatcgggtgaggaagacgtcttggtaagttgcccttcttctatgccatatgtggaagccgcggaggagtcgttagaaacgactttccaatcttttgaggtagtaagcattgccttcgtagattccctctctgggcagccttaccgatctgatacggcaatgatggtggcccgggtgatgttggggtacggctacgagcccggaatgggtttgggcaagaacaatggcggcataaccagcctgaacaaaggccaaagcccgcggttgggacaacaagccgaaggggccccgccctgccacatcagtagaagctttataagtgcgggtttaagacatgaaggccaagtcgccgcgatatgcgaggatgactccccgaggagatcgtatttggtacgaccgtgtcctcctggtttccgactaggaaattggtga

SEQ ID NO: 78286 - DNA, 490 bp, Glycine max
  Peptide Sequence Number=SeqID_169971
cctcacttttgagcgcctgatctcggtcaataagttggcctacatcaagaagaactattggaacctcgaggatctaatattttctattcgaggggctaggagggtgagggcaaggccaactgagcttccttctacttttgcagctcctactccagcatccacttcagtagccccttctgtcccagtggtggtgcctccaggatctattgcttcaatagagcaattcactgagatggtagcctggcctgggacccaaccttcttttcacagggaagatgaaggtcccacaacccaggtacctcagcaggtggaagatgagtcatctgaggccaccatcccagagccatttgttataagagaagaggcaaaggagacacaggacccgactacatcagtcctggctatggacacttctcctctagctactccagtattgcatctgacagatgaggaggatgttcagacacaggacacccaggaccagtcatag

SEQ ID NO: 78287 - DNA, 621 bp, Glycine max
  Peptide Sequence Number=SeqID_169972
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgtcatcacataggctcttcctggctgtgacagtgtgtcaggctttccatctcatgatgaccttgacagtactgaggaggattgagctactgtttgtcaggtttctccactgtgaagttatttttcctccttgtccatactgcatgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 78288 - DNA, 123 bp, Glycine max
  Peptide Sequence Number=SeqID_169973
atgatgcatgacatgggtcatgagggtgaggagaaagatgatgataacaacaacaacaacaatgataatgatgatgatgataatgatgaccatgatggtgatgatgttcctcaacaacattaa

SEQ ID NO: 78289 - DNA, 831 bp, Glycine max
  Peptide Sequence Number=SeqID_169974
atggtccaaaccttttctcttccggctccaatctctcaatggcctcaaggacaaggttttgcttctgggcttgtaaaccttggtgaaatacaagtttccaaagtcacaaggtttgagtttatttcgagcagcagtgttatgctagacacaaaaaaagctgttacattctttaggcctgtgggagtaccagaaagtttccatatccttggtcactattgtcaacccagtggcaagcctttgcatggttttgtacttgttgccaaaatttgctctcctcaaaatgctgatacgatacctcctctgaagaatccccttgattttaagctagtttggagtcataatgcagcaagtatggaaattccaagtgtatacttttggctacctgaacctcctgaaggttacaaggcccttggctatttggttactaacaaacatgacaagcctttgttggatgaaatgtgttgtgttcgtgctgacctcaccgataaatgtgaaccttaccgccaaatattcgctactggttctagaattccagagttttcatttcaggtatggagtttaagaacttgtgaccgtggcatgttagggaaaggtgtttctattggtacttttttctgcagcaatggctggaccatgggagaagagctactacctgttgcatgcttgaagaacctgaatcttgtgctaccagcaatgccagattcgcaacaaatacatgcacttattaagcattatggccctactgtcccgcaactggcagttgcggcatcccatccctctctcctctctccccctatcccgccagttccaaaggcgggactgcctacgtag

SEQ ID NO: 78290 - DNA, 1347 bp, Glycine max
  Peptide Sequence Number=SeqID_169975
atggagatggagagagttttgtgggttggcattgctataggacttgttttcagcaactgggtcgtaggatatgaacaatatcacttcaatgaaacagagttgtctttattagaggctcatgaagcttccttgtcctacgccgggaccgagagaaataatcttctgctggtaggactcacccttattcaaaatgctgctgctaaaggagcagtctgcttggatggaacattgcctggttatcattggcatcggggatatggatcaggagcaaatagctggcttattaatttagagggtggtggatggtgtaataatattagaacatgtgtttatcgcaagaaaacccggcgtggatcatcagatttcatggaaaaggagataccttttactggaatattaagtaataaggctgaagaaaatccagattttttcaattggaatagagtaaagcttcgttattgtgatggcgcctcatttactggggatagtgaagatgagactgcagaactgcaattcagaggacagcgtatttgggcagctgcaatggaagatttgatgtcaaaaggaatgcgttttgccaatcaggctcttctttcgggatgctctgcgggtggcctggctactattattcattgtgatgaatttcgtggtctctttccaaggaccaccaaagtgaaatgtcttagtgatgctgggttgtttcttgatgtgattgatgtatctggagggcatacccttaggaatttatacagtggtgttgtaggattgcagggagcacagaagaatctgccacaaatttgtactaatcaccttgatcccatctcgtgcttctttcctcaaaacttgattgccagtgttaagaccccgctattcattcttaatgctgcttatgattcatggcagatccagtccagtttagctcctccatcagcagatccccatggctattggcaacaatgtagattaaaccatgctaaatgtactggaccacaaattcaatttctgcaaggattcaggaatcatatgctgaatgctattaaatacttctcaagatcaaagcagaatggcttgtttattaattcttgtttttctcactgccaaactgagaggcaggatacatggtttgctgacaattctcctgttattaggaacaagtgcctattgagaagtttatccaaacatgacttaaatcctatagcactcactatagaacatcgattcacctgtagaaacattatggcaattgctctggctgttggagactggtatttcgatcgagcaggtgttaaggccattgattgtccttacccttgtgataatacatgccatcatctgattttcagatga

SEQ ID NO: 78291 - DNA, 1230 bp, Glycine max
  Peptide Sequence Number=SeqID_169976
atgaagaagctgattttaatactcatagcagcatttaccttcgtttctgtggctagatctgcgtctgatcatttcttcgaaaacgatggcgtttcactggcagttgctgcaacgcccggacctccacctctcatggtccccctcactcttattcagggagctgcttccaaaggagccgtctgtttggatggaacattgcctggttaccactttcatcctggatttggatctggggcaaatagttggctcattcaattggagggaggaggatggtgtaataccatcagaagttgtgtctttagaaaaactactcgtcgtggttcctcaaaatacatggaaaaacaactagcattcacagggatattgagcaataaagctgaagaaaaccctgatttctttaactggaacagagttatagtacgttactgtgatggggcatctttcagtggagatagtcaaaatgaggctgcacagcttcaattccgaggacaaaaaatatggcaagctgcaatgcaggaattattgttcaagggaatgcagaaggccaaccaggcccttttgtccggatgctctgcgggtggtctggcatctataatacattgtgatgagttccggagcttgtttcctacatctaccaaagtgaaatgtttgagtgatgcagggtttttcctagatgcggttgacatatctgggggtcacacactgaggaatctgtttggaggtgtagttaaattacaggaggtgcaaaaaaatctgccaaacagttgtctcaaccaactggacccaacttcgtgcttttttcctcagaatttgatcaaccatgttgaaactccattgtttctactcaatgcagcttatgatgcatggcaggtccaagaaagtttggccccacattcagcagatccccatggctcttggaatgattgtaaatcaaatcatgcacgctgtaactcatctcaaattcagttcctccaagacttcagaaatcaaatgctaaatgatgtgaaaggcttctcagggacatctcaaactgggttattcataaattcttgttttgctcattgccagtctgagagacaagatacatggtttgctgatgactctccactaattaacaacatgccaattgcaattgctgttggagactggttttttgatcggaaaactgtcaaagctatcgactgtgcttacccctgtgacaatacatgccataatctggtcttcaagtga

SEQ ID NO: 78292 - DNA, 546 bp, Glycine max
  Peptide Sequence Number=SeqID_169977
atgacgataaaaataccagtagttattgtaatgactatgactgtgacaatgtggatggtagtgacaatgacgatgttggtggtaatagaagtgatgaaggtggtggtgatcgttgtaacaattgatagtgataacaaaggtgacattgttggtagtggtagtgataacaatgataatggtgataatgatattggtgtgaagggagttgctacgtgcacccagcattattgctggggcacccagcaaacagtgaagtggcgaaactgcccttcaacaattattcttccggaagaaggttcttccggaaaacaatttccggaagaacgtcatccggaatgtttccggaagaagcttcttccggaagaattccattgtcttccggaagaagcttcttccggaaacattccggatgacgttcttccggaaattgtctgtgagtatttccggaagacacaaattattcttccggaagaagattcttccggaaactttccggaaaaattatttccggaaactttccggaagaaccttcttccggaagaataa

SEQ ID NO: 78293 - DNA, 1410 bp, Glycine max
  Peptide Sequence Number=SeqID_169978
atggtggcaagtgagctacaaggatttttcatgtccctgggttcaaagaagacatccttccaccgtgacaggaatctgccttcctctttcactggtagcagagtgaacttgcttcattcaaagagtgtagcatctggttttcgtctaggaaaatattttagtgttacacagagaaatacaaccagaagatttttggctacttctactcttgcagatgttgcaaatgattttatggcccttcaatcaccaatacttacaggaagagaagccaacccaaagactgttgcatcgatcatattaggtggtggagctggaactcgtctattccccctcactcaaagaagggctaaacctgctgttccatttggaggatgctataggctggtggacataccaatgagtaattgtattaacagtggaattaacaaaatctacgtccttacacaatttaattctcagtccctaaatcgccacattgctcgaacatataattggggaggttgcattaactttggaggtggttttgttgaggtattagcagcaactcagacacctggggaatcaggaaagaagtggtttcagggtacagcggatgctgatgctgatcataaaaatatagaaaacattctgatattgtgtggtgatcagctatatcgaatggattacatggaaattgtacagcatgtagatacaagtatttttggactatcagctcaagaagcaaggaaatttccatacattgcatcaatgggtatatatgtgttcaaaatagatgttctgctaaaagttctcaggggttgttatcctaacgcaaatgattttggatctgaggtcattcccatggctgcaaaagattttaatgtccaggcatgtcttttcaatggttattgggaagatattgggactataaaatctttctttgatgcaaacttggctcttatggaccagcggcccaagtttcagttgtatgaccagtccaagcctatttttacatgtcctcggttcctaccaccaactaaaatggagaagtgtgaggtaattaactctttaatttcagatggttgctttttaaaagagtgcacagttgaacattccattgtgggaatccgatcaagacttgattctggagtgcagctaaaggataccatgataatgggtgctgactattaccaaactgaggctgaaatagcttctcttttagcagcgggaaatgttccaataggcattgggaaaaataccaaaattgtgaattgtataattgacaaaaacgcaagaattggaaacaatgtaattattgcaaacaaagacaatgtgcaggaagcagatagaccatcagaggggttttatattcgatctggaatcacggtggtgttaaaagagtctgtaataagcaatggtacaatcatttaa

SEQ ID NO: 78294 - DNA, 486 bp, Glycine max
  Peptide Sequence Number=SeqID_169979
atggtgaattggagacgtgtgaagatgaatggatttgcatgcaaggaggaggcaaatgtgacagaagcagatttcttctttgctgggctagcgaatcccggagttatcaacaacgcaacggggtcagtagtcactgcagccaatacttcaaacccacctcacacacatcctcgtgccaccgagattctgttcgtgttggaaggagaacttgacgtgggtttcatcaccacagccaacaaactcatctccaaaaccgtaaaagaaggtgaagtgtttgtgttcccgaaagctttggtgcactttcagaagaacaatggggataagcctgctgctgttatttctgcgtttgatagccaactccctggcacattctctatagttgcggttttgtttaattctaccccaagtgtgcctgatgatgtgctcacacatgccttccagattgatactcaagacgttgacaagatcaagaacagtctttcctag

SEQ ID NO: 78295 - DNA, 2505 bp, Glycine max
  Peptide Sequence Number=SeqID_169980
atggcttcttctatcataggcgtttcctccatttaccaaacaccccctctcgaactataccagaggccaagcactgcttccacttcctccgttaggttgcaatctttagactccaagtctcacttcaacaacctcctccgagcccaccgccactccactggcccgggcctcaagcctacaccatctttcgtcccctccgccgtcgccacccccaactcctccctcctcagcgaagaagccttcaaaggacttgcccgcgaattcgaccaaaacgacgaccaattcacccgcgcctcctccgccgccgaatccgttaaccccgacgaactcgacatttccaagctcgacttgccctcgcgtctcgttgagtctctccggagccgtgggattactcaacttttccccattcagagagcggtgttagtacctgcactagaaggtagagatatcattgcgcgagcgaagaccggtaccggaaagacgttagcgttcgggattccaattattaaaggcctcactgaagatgagcacgcaccttctcacaggaggtctggtaggcttccgagatttttggtgcttgctcctacgagagagttggcgaagcaagtggagaaggagataaaagaatctgcaccttacctgagcactgtttgtgtttacggtggtgtttcttatgttactcagcagagtgcgctttcgcgcggtgttgacgtggtggttgggacaccggggagaataattgacttgataaacgggaacagccttaagctcagtgaggttcaatatttggttcttgatgaagcggaccagatgcttgctgttgggtttgaggaggatgtggaaatgattctggagaatcttccatctcagaggcagagcatgcttttctctgctaccatgcccagttgggtgaagaagttggcgagaaaatatttgaacaatccactcacaattgatttggttggtgatgaagaggaaaagcttgctgaagggataaaactttatgctatagcagccactgccacttcaaagcggacaattctttctgatcttgtaactgtttatgcaaagggtgggaagactatagtttttacacagacaaaaagagatgctgatgaagtatcattgtcattaacaaatagtataatgtctgaagcactgcatggtgatatatctcagcatcagagagagagaacattgaatggtttccggcaaggaaaattcacagtgcttgttgccactgatgttgcagctcgcggacttgacattcccaatgttgatttgattatccattatgagcttcccaatgatcctgagaccttcgtacatcgctctggtcgtactgggcgtgcaggaaaacaaggtaatgccattctgttgtacaccagtagccagcggagaacggttagatcccttgaacgtgatgtaggctgcaagtttgaatttgttagttcaccagctatggaagaggttttggaggcatctgctgagcaggttgttgccacactttgtggagttcatcccgagtctgttcagtttttcacccctactgcacagaaactgatcgaagaacaaggaacaagtgcccttgcagctgcacttgcacaactgagtggattctcccgaccaccatcatcccggtctcttatcacccatgaacagggatggattacattgcaactaactcgagattcagatagtagaagatatttttcagcaagatcagtcactgggtttctttctgatgtttattctgcagctgctgatgaagttggaaaaatccatttaattgcagatgaaagggttcaaggagccgtttttgatcttcccgaggaaattgctaaagagttacttaatagggacataccacctggaaacaccatttccaagatcaccaagctacctcctttgcaagatgatgggcctccaagtgatttctatgggaggttctctgatagagatagaagtagccgaagagggtcttctacttctaggggaggttttagttctaggggaggttcttcttctagggaccggagaggttttaaatcctcacggggatgggatggggaagactctgatgatgatgactttggtgatcgatctagttggagaggtggtagaaattttaaaactggcaacagctggtctcgagcagcaggtagaagcagtggggatgattggctaattggaggtagtagacgatcaagcaggccttcatcatcagacaggtttgatttggaggggcctgttttaattgcggagaatccgggcatcgtgcatcagattgtccaaacccttcaaacagacgaagcttttaagttcccacatatttatttttgggcaccactttgttcaagacgtgagctgcttgctgccactgtttttggcctaatgggttccggaaaattgaaagatgcttctcaaaagagttacagaattgatattaatttgcatctcacgtgttggcgtgatctccatagggacctctgtttttcgtcctga

SEQ ID NO: 78296 - DNA, 1254 bp, Glycine max
  Peptide Sequence Number=SeqID_169981
atggggattctggttccgcttttcttccacgtcgtcgctttcatttgcaccgttgcagctatcgctttggccgttcttcacatttacaggcaccttctcagttacaccgagcccacttatcagcgttacatcgttcggattattttcatggtcccggtttatgcactaatgtcattcttgtcccttgtaatacccgagagttcaatctattttaattccattcgggaagttaacttccaagagatatgggaaaaatgggtaaaggctgtttgtgattgcaaagtacctactaagctcaagggcaagctttattgtattgccatacagctattctctggtactgatggtaaatgttgggtttttaaagggataacaggaataaaggcgagcgtagcattagtgagaatgtggtttgtacacatacaaagaagactactggaagcactagtgaggagagtagattggtcttgtgaaaagggggagagaatattgggagaagttaagagggatcttatggcttcttctttcgtcagtaatttccaaacaatgcttaagaaaagtaacattcttccattgttgatgggactgagctatgaagcttgggtcatttataattttctgtcactgtgtctggcatgggttggtggtcctggagcagttggcgtgttattcttccttgctgcaaagtcaggattcatcgaggatgctgatgaagctgccttacttcaaaattttatcatttgtgttgagatgcttgttgctgccgtaggcctcttttacgcatttccgtacaaagaatattccagtgctaatataggtggatcccgtggtgtgacagctagccttgggcatgctttgaagttaaatgatttttaccatgatacagtccaccagtttgcaccaacgtatcatgaatatgttctctataatcacagcgaaggtgaggagggaactaagaagtacaggtcacgaacttctgttccaattggcccagagatggattctgtaagaaataaacatatgtctggagacaagttagatgacatacagctctcaagtttgtcttctaccagtagcactccttcaaattctggttccattcctgatgcttcaaattctgatgcaacgaattcttccttgcttgtggatatgtccaattctgtttcggaaccatacgacttgaccttcattgacttggatgtatccagttaccctgaagaggttcctgcggctgataaagctggtggtaggtga

SEQ ID NO: 78297 - DNA, 171 bp, Glycine max
  Peptide Sequence Number=SeqID_169982
atggagaagaggcaattgttcctgagaagctatcggttctgtagaaagaagagcctcaaagagagagtgaaaggaatcaaatgcggcttctattaccggaggagaagcttttcacgccttctcagtgcccataaccgcaaaattgtctcttcctcctcttgtttatgctag

SEQ ID NO: 78298 - DNA, 704 bp, Glycine max
  Peptide Sequence Number=SeqID_169983
atggaagaatcgtcaaagaagcgaaagggatcatcctccaccaccgttgctgttggccatcgccgccacaaaccatctaaaggacccatagcacctattcatccatccttatcatctccatggtcatctactctattttcttcatatgatcaacgtctatggtacaactctcaattttcttctaggatcatcttagaccctaagtacctagacacaaatttctttaatgatgagacatttgactgttatcaagtgtttcaaaactctggattggttgattttatgtccttaaaattgccttactatcctgaacttgttaaagtcttttacaacaatttaaaaattcaggatgatattatttcttctgaggtgcacggtatttctatgatcattgatcaatctctgttcttttcattgactaaattacccagtcaaggtgcaccttttgagggcaccattgttgatgactggaagattgattattctagtcatgatgctcgccatatggtttgtaatgaccaggctaaaatgaccggtagattgctggccggatcattaaccattgattgtcgcatcattcactatattattgttagaattttgcttccccgttcttctaatttggctcaagcctctgaggaggacttgattttgatgtgggcttttctttccggttgtcagatcgactgggctcacttggttag

SEQ ID NO: 78299 - DNA, 483 bp, Glycine max
  Peptide Sequence Number=SeqID_169984
atggcgcctaccaagcatcctctggacccggataagtccaacagggccctgggatttcctgctttgatcataggactctgccagtcgttcggagtcctcgacgcacctagcaaggtgattcgaccgcccatcacccgggcttttattgagaagtattgcacgcaaagacaggcccagggtgatgctccgcaggccgcagatgcgccgccacctcatcaggctggcccagctagatcatttgatacggagcagtatttatggcatttggttcgccagcaggcagccaaccaccgggcgcatgttcagacccatgattatcagttcagggcagaggtcgcatggcccggagattggcctgaggcccgggcaggagaggcaccagtagaggcacccgcagaggctcccggcgaggcagatgaggcccgcgaggacgaggagatgaccgatttgcttgatttcttgggagggagcggagccacatga

SEQ ID NO: 78300 - DNA, 279 bp, Glycine max
  Peptide Sequence Number=SeqID_169985
atgcatgccgggtcaggatttcgctcggaccgctgcagggaggcgggtgcagatcatgcgcaccagcatgaccacgttgacccagatgtggatgacattgctactcagcaatgtatgtcacctaccaagcaccctctagacccggataagtctaacagggccctggggtttccggcattgatcacgggcctctaccagtcgttcggagttcccgtcactcctagtaaggtgatccgaccgctgatcactcgggctttcattaagaagtattgcatataa

SEQ ID NO: 78301 - DNA, 342 bp, Glycine max
  Peptide Sequence Number=SeqID_169986
atggcagctatacaaatgaccagccttgtctctatgacgtgttgggcctgtttaagtctgcctctggtcatgggcccttcaagtgcttcatggtccttgccctttgttgtgtcctcatcactgtgttgggcctgtttaagtctgcctctggtcatgggcccttcaagtgcttcatgttccttgcccttagttgtgtcctcatccctagttgaggaggaagagaatcaggaatcagaatcagaacaagtgaataatgataaagccacaaagcaaggagccaccaaaatgaactatggggataacacttacccactttatgcagggttaaggacaaaagcataa

SEQ ID NO: 78302 - DNA, 180 bp, Glycine max
  Peptide Sequence Number=SeqID_169987
atgttggtgcgcatgatccgcgctcgtctttttgcagcggcacgggtgaaatcttgccctggactgcacatcctcgcctgcagagggctgcacgccctcgcctttagagggctacgcgtcctcattttcagtgtgctccatatctacaccttaagagaatataaggtcctttgcccttag

SEQ ID NO: 78303 - DNA, 480 bp, Glycine max
  Peptide Sequence Number=SeqID_169988
ggttcgattccggagagggagcctgagaaacggctaccaacatccaaggaaggcagcaggcgcgcaaattacccaatcctgacacggggagttaaaaagctcgtagttggaccttgggttgggtcgatcggtccgcctccggtgtgcaccggtcggctcgtcccttctgccggcgatgcgctcctgtccttaactggccgggtcgtgcctccggattctgatcctattgtgttggccttcgggatcggagtaatgattaacagggacagtcgggggcattcgtatttcatagtcagagataccgtcctagtctcaaccataaacgatgccgaccagggatcagcggatgttgcttttaggactccgctggcaccttatgagaaatcaaagtctttgggttccggggggagtatggtcgcaaggctgaaacttaaaggaattgacggaagggcaccaccaggagtggagcctgcggcttaa

SEQ ID NO: 78304 - DNA, 969 bp, Glycine max
  Peptide Sequence Number=SeqID_169989
atgtcactcaagcttgtttttcgtgggtatttcctgcctgtactattgctggctgtcaccagtcaacctgtggtggccgaggaggatctctgggcaaccatgcagaaaaccgcttctgctgcccgggagctcaattaccaggggttatttgtctaccagaatggagcggtgatacgctcagtccaaattacccacatctatgaaggtgggcgtgaatttacgcggaatgttgtgctggatggcaggccgcgtgaagtgtttagcgaaggcgatgatatcgtcattttcaatgccaagaatgacaaggttgtcatcgaaaaacggcgcgggcagaatttgtttcctgccatgctccccacacaactgtatccgctcaagcaaaactacaagctgaaatttgttggccaggaaagagtggccggacgcctgacgcaagtcttggatatgattcctaatgataacctgcgctatcaataccgtatctggtcggatagcgagtatggtttgctgcttaaaatgagcatgatggacgtgcaggggcataccctggagcaaataggcttcaaccaagtgtctatgctacagaccaaggaccttgattggttccagccgaaaatcgatgccaccaagccttatgtcatggatgacaccacggatttgacccatactgtggaaaacctggtcatacctaacctgcctgccggttacaaaaaaatagatcaaatccagctaaaagtgccgggcaggacgactacggtacagcaactcattttttctgatggcctggcgtctgtatcgttgtttgtcgagccaatgattaaaggtatgcagccgcgcataggtaagaaaaacatgggctcaactaacgtttacgcgcatgtgttgaatggttatcagctggttgtggtgggtgaagtgcccgcgcaaacagtagaacaaatcgcgcagcaagtgactttcaagaagtag

SEQ ID NO: 78305 - DNA, 3079 bp, Glycine max
  Peptide Sequence Number=SeqID_169990
atgatttacggtattggcacagatatcgtcgaggtcgagcggatccagtcttcactcgaccagttcggtgatgcctttgccaagcgtatcctggcagattcagagtgggccgattatcaatccagccaactgaaggcaagattcctggctaagcggtttgcagccaaggaagcttttgccaaagccattgggacgggtatccgtggagaccgcatgaggagtagtgatcacttcgtggatgtctcacgccgtttttccggcgtccgtcgcctgtatggcgaccaaggcctggctagtttgcaaaacgcccatgtgctggtgatcggcatcggtggtgttgggtcatggaccgtggaggcgctggcacgcaatgcagtcggtaaattaacactggttgatctggataatattgcggaatcaaacgtcaatcgccagattcatgcgctggaagacaaccttggtaaggctaaagtcaccgccatgcgcgagagaattgcagccattaacccccagtgtgaggtgattgaagtggaagacttcgtcacgccggataatttgtcaaaaatgctggcggactcaccggatatcgtcgtcgattgcatggatgacacaaaagccaaaattgcccttgccgcccattgcaagcagcataaactgccattggtcatggtaggcagtgcgggggcaagttggatgcgacacgtttacgcctggcggatttgtcacaggtacaaggcgaccgcatgctggcaaaggtacgcaagtccagggggaacccagatgcaactggatatccgtagtcacgagattgcagtggcccagttgcggacatcggctgttgtggctgccgtgttgtctgaagaagaggatgatcctgtgttgtttgaaacgctggatgcgccttttctggtcagcatggatcctttggatggttcttccaatttagcgattaatggcgtggtcggcagtatcttctcggtattacccaataccggcgtagcaaccctgggcgagcaggcttttttacagccgggtcaggatcagcgggcagccgcgtatatcatgtacgggccagcgactttgctggtattgacgattggccaaggcacgcatgtgtttacattggaccacagcaagcaggtgtttgtgttaacgcagcaaaccgtcaatattcctgaggagacctcagaatttgccatcaacgccagtaatcaacgctattggcaacctggcgtgcagcggtatattgcagaatgcctgcaaggtgccgaaggtccgcgtgcgcgtgactttaatatgcgctggtgtgccagtatggtgatggatgtacatcgtattttaacgcgtggcggtgtgttcctgtacccccgcgatagcaaacaacccgtgaaggccggtcgcttaaggctattgtatgaagccaaccccatgagcctgttagtgacgcaagccggcggggaaagtatagatgggctggaggatgttctggcgatacgacctagcgcctgccatcagcgcgtaccggagtgttacatggcattgatctcgctcaggcaattactcgaccacgccgcggaaaatagttatggttatccggcattcaatatcaataatatggagcagatactctccatcatgaaggccgcagatgaagtggatagtgcggtgattttgcaggcatcagccggggcaagaggctatgccggggagtcattcctgcgcaagatggtagaagctgccattgagcaatatccgcatatccccgtgtgtatgcaccaggatcatgggacctcacccaagatttgccagatggcgatccgtagcgggttttccagtgtgatgatggatggctctttaaaagaggatcataaaacgcctgccacttacgagtacaacgtcgatgtcacgcgccgtgtcgtcgagtttgcacatgcggtgggggtttcggtagaaggtgagcttggtgtgctcggctcactggaaaccggcatggctggtgaagaggatggtgtgggtgctgaaggtaaactggatgaatcgcaattgttaactgacccggatgaagcagccgcttttgtagaggcgaccaaggtcgatgccctggcgattgcgattggtaccagtcatggcgcgtataaatttacccgtccgccttcagatgatacgctgtcgattgaacgtatccgtgaaattcatgccaaaatccctaacacgcatttggtgatgcatggctcttccagcgtgccgcagtccctgctggaacaaatccggcactatggcggcaatatcaaggaaacctatggcgtgccggtctctcaaattgtggagggcattaaaaatggggtgcgtaaggtcaatattgataccgatatccgcttggccatgactgctgcgatccgtgcccatctggcgcagcatcctgaggactttgatccgcgacaatatttcaaagaagcgaccattgccgcgcagcatttatgtaaagaacgctttgaggcctttggtagtgccggacaagcgagtaagataaaggggttgttgaaccgcctcaagcaagaattacacgacctgcccggtgtggatactgccgcgcgttcacctcctggtatttcggccaaaatggtcgccgaatttggctgcacctataccattatcggtcactccgagcgccgggcccttaaactcgaaagtaatcaggtggcgaccaagcgcatgctcaatgcgctgcatgcagggttgacgcccattttttgcgtgggtgaaaccttggacgagcgcgatggcaatatggccgaactcatcgtccgtaaccagatgctgaatgtggtctatggcctggatgatgaggcgtttgcgctggccaaaaaatttaatatggtgatcgcctatgaaccggtatgggcgattggcacaggcgagcatgccagcccggagcaggcgcaacgcatgcacgcctttatccgcatgatgatcgccgaacgcgaccgcgagtttgccgaaaatatccgtattgtttacggtggcagtatggcaccccagaatgctggtagcttactcagcatgccggatattgatggtg

SEQ ID NO: 78306 - DNA, 657 bp, Glycine max
  Peptide Sequence Number=SeqID_169991
atggagttggacactcatagtgcaattctagctcaaaacaaagtcttgacgcaacaagttgaggcctcaacaaagcagataggccaacttcctcagcaatatcaccaaggtggaccacagaaaatgaatcaagctcaccaagttcaacgaatttttagatgtgatttctatggtggaagctacaaaggctatagaggtggctcaagttcgaatcagccttatggctggagaccacaaaattttggtcccactaacacttctttggtaggtccttctaacaactctaatggagattcttcaaataagggtccacaacaacaacaagctcaactagacagattgtccaagatggaagatactttaaaccagtttatgcaggataatgatgagaaaaagaataaaaaaggagttgaaaaagaaaacgagaaaaaggatgaagtggtgactagtgaagaagtggaagaaaaaatgattaacattcctttttctgaagtattagagcagataccaacatatgctaaattcatgaaggatttgcttatgaaaaagaaaagaattatggatgctatcattgcatggcctggggacatgcctatttttcaggaagaggatgaagacatggcagatcatgttgattatttcattgaagaagactaa

SEQ ID NO: 78307 - DNA, 198 bp, Glycine max
  Peptide Sequence Number=SeqID_169992
atggcgtcatccaatgcaatgaatattctcgactttgttgaggcgggcgaaggaaataatttaactaacgcatttcttcgccttgccaagaaaattaatgagaatcctaacccggtctgggaatccctcggcggtaaggtcatcgtgcctgccggtacctacagcatcactaagcagatcgtttttttaaagccaggg

SEQ ID NO: 78308 - DNA, 159 bp, Glycine max
  Peptide Sequence Number=SeqID_169993
atgtgttttcgtgaagaaaatccaagccgaggtgcttccgtaacgcttctgagacgtttccgtaagcgattttgtggaaattcttcatcgttcttcatcgttcttcggtcttcaaccgttgctgttaaaacaaaatctaaccgatcgttcatgctgtaa

SEQ ID NO: 78309 - DNA, 663 bp, Glycine max
  Peptide Sequence Number=SeqID_169994
atgccctctagctttgtggatcttgtattcgtgggcgagaggataaaagtgggcttgaagagaggaaagtttgattatgtctcccccgtcggcacaaacaatagaaggatcagggcagttggggcaaaaagaaaggaaggggacgcccatgccgtcacctcggcacctgcttggccaaagcctcagcaaaccttgcatggtactcaccagtatgctcaacaccacctgagttttttggcccgtgccggaaactcttccaactcagctcccgtccagccaaggacatcagcaccatcacaacaacaatgtcaatcctggcacgaattccagcatgggaagaaaccctccgataaagaagcttttagagttcaccccaatcccaatgtcatatggggacctattgccatcactaatcaccaaccagttggcagtggtgacccctggaaggatttaccagtctctcttcccaaagtggtagaaccccaacgtgacctgcgcgtatcatgggggaactccagggaattcaatcgagcaatgcatggccttcaagcacaaggtccagagcttgatcgaggcgagatggttgacattccaagaagatgggccaaatgtgaagacgaacccgctctccaaccatggaagattggatgtaaatgcaattga

SEQ ID NO: 78310 - DNA, 99 bp, Glycine max
  Peptide Sequence Number=SeqID_169995
attggaggtctattgatagaatttccttctggaaataaggagtttgctgaggccatttttcttgaagcttctaagctttatacaagaatgaagctctga

SEQ ID NO: 78311 - DNA, 420 bp, Glycine max
  Peptide Sequence Number=SeqID_169996
atgtggaccactggtctcttagcaccaactggtctagtagacaaggatcgtagacgtgagactttgcgtgtccgcttcacggaatacggtgaagctgatgcatcagaaataggaagaggaggaggaggaggagaaggaggaggcgaggcagaaaaatatcgacatcaacagttcattgtattcaaaaactataaaataaatattaaacttagattggagacacgaagaataaggcccttgccactaccacgaagatttgtagtaacccaaaccaagaaatcgatcattggggtcgtacatgatcctctgaacagtgtcgagggacaaaattatgttttatttgagattgagagtattttacatgcgcttggcttcgcggcctcaaaggattacacgacccaaggagttgcggtcctataa

SEQ ID NO: 78312 - DNA, 324 bp, Glycine max
  Peptide Sequence Number=SeqID_169997
atggcaagacacaaggtcacacgcacacacacacacacacactcacgcaggcacaagggggaggaggggcttggtcggtttgttggtgatttggaggggagggacgaatcaaagcgacaagggctgaatctcagtggatcgtggcagcaaggccactctgccacttacaataccccgtcgcgaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacg

SEQ ID NO: 78313 - DNA, 827 bp, Glycine max
  Peptide Sequence Number=SeqID_169998
aggactacacgtcctcgccttcagagggctacacgccctcgcctttagaggactacaggtcctcgcctttagaggactacgtgtcctcgccttcaaagggctacacgccctcgccttcaaggggatacacgtcctcgccttctgaggactacacgtcctcacctttagaggactacatgtcctccactttagagggctacacgccctcgcctttagaggtctacacaaggctacacgccctctcgttcagagggttacacggcctcaccttcaaaggactgcacgccctcgccttcaaagggctacacgccctcactttcaaagggttgcacgccctcgcctttagaggactacacgttttcaccttgagaggactacaagttctttccttcagagggctacacgccctcacctttagaggactacacatccttgccttcagatggctacacgcccttgccatcagaggactacacgtcctcaacttcagagggctgcaagcctcgccttcagaggactacacgtcctcaccttcagagggttaccacgcccttgccatcagaggacttcacgtcctcgccttcagagggctacacgccctcacgttcagaggactacacgtcctcgccttcagagggctacacgccctcgccatcagaggactacacgccctcgccttcataagactacacgtcctcacctttagaggactacacgtcttcgccttcagaggactacacaccctcgccttcagaggactacgtgtcctcgccttcaacgggctacgtgtcctcgccttcaacgggctacatgccctcgccttctga

SEQ ID NO: 78314 - DNA, 1641 bp, Glycine max
  Peptide Sequence Number=SeqID_169999
atggcttcctcaccaaaagaaacttccgctcctggttcacccgctgtaccatcatctccgcaccaggaacaaccagagttcaacatccaacccatacaaataattcctggtcaagcttcagtccctgagaaactggttcccagaagacaacagggagtgaagattgctgaaaaccctagctctgcaacaagttctagcgaagtagacacggagatggacaagaaaatccgcagtattgtgagtagcattctgaaagatgcttctgtgcctgatgctgagaaagatgttccaacatcttccaccccgaatgtttctgtgcctgatgttgagaaagatgttccaacatcttccgctccaaatgctgaagccgatcaagccgcagaggagacccctgcaccaagggcaccagaacctgctccaggtgacctcattgatctagaagaggtagcatctgatgaagaacccattgccaacaagttggcacctggcattgcagaaagactacaaagccgaaagggaaaaacccccattaagaggtatggacgaatcaagactatggcacagaagaagagcactccaatcactcctaccacatccagatggagcaaagttgcaatcccttccaagaagaggaaagaaatttcctcgtctgattctgatgatgatgtcgaaccagatgttcccgacatcaagaggaccaagacatcagggaagaaggtgcctggaaatgttcctgatgcaccattggacaacatctcattccactccattggcaatgctgaaaggtggaaattcgtgtatcaacgcagacttgccttggaaagagagctgggaagagctgccttggattgcaaggagatcatggacctcatcaaggctgctggactgctgaaaactgtcaccaagttgggagactgctatgagagtctagtcagggaattcattgtcaacattccctctgacataacaaaccgaaagaatggagtggtggatattactgtctctgagcatcaaattgccaaggaaatcactgccaaacaagtccagcattggccaaagaaagggaagctttctgcagggaagctaagtgtgaagtatgcaatcctgcataggattggcactgcaaactgggtacccaccaatcatacttccactgttgccacagaatcttttgctgtcaaattacccattgccttcccaactgtattgtgtggcattatgttgagtcaacatcccaatattttaaacaacattgactctgtgaagaagagagaatctgctctgtccctgcattacaaactgtttgaggggacacatgtcccagacattgtctcgacatcagggaaagctgctgcttcaggtgctgtgtccaacgatgctttgattgctgaactcaaggacacatgcaaggtgctggaagcaaccatcaaagccaccacagagaagaaaatggagctggaacgcctgatcaaaagactctcagacagtggcattgatgatggagaagcagctgaggaagaagaagaagcagctgaggaagaagaagaagcagctgaggaagaagaagaagcagctgaagaagaagaagatgcagcagaggataaagagtcagatgatgatgattctgatgccaccccatga

SEQ ID NO: 78315 - DNA, 527 bp, Glycine max
  Peptide Sequence Number=SeqID_170000
ggctgcacggcctcacctttagagaactgcaagttctcacttttagaggactgcacgccctcaccttcagaggaccacacgtcctcgccatcaaagggctgcacgctctcaccttcagaggactgcacgtcctcaccttcagaggaccgcatgtcctcacctttagaggacttcacgccctcaccttaagagggctgcacgccctcaccttcagagggctacacgccctcgcctttgtagggctacatgccctcaccttcaaaggactacatgtccttaccattggaggactgcacgccctcgcctttagaggactacacgtcctcgccatcagagggctgcatgccctcaccttcagaggactacacgtcctctcttttagagggctacacgccctcgcctttagaggactacatgtcctcagcttcagagggttgcacgccctcgcctttagagggctacgcgtcctcactttcagtgggctccatatccacgccttaagtttatttaaggtcctctgcccttaa

SEQ ID NO: 78316 - DNA, 345 bp, Glycine max
  Peptide Sequence Number=SeqID_170001
atgcaggattcccctcaaacactttttctggagactccagttgttctagagccaggggagactcttcctggttactccaggttctgcagactgagaccaggccctgaggagctagctgcccaactttgtatccctggtaggggattttttctgaatgctgagggcctgccatggaagctgctgaggaaagacctcactactctggcgcatacttggagcgttctgtcttatttcaaccttgcccctacatcacacacttctgatcaaaacttggacagggcaaggttggtatatggattagtgatgaagatgggcatgaatgttggagccctcatctctggatag

SEQ ID NO: 78317 - DNA, 1041 bp, Glycine max
  Peptide Sequence Number=SeqID_170002
atggcttcagccaccgcgtcgacctgcgcctgcgcccgttcggcagccctggactgggacgtgctgcgtcgcgcgtcgttggccgcagcgaggatcagacatcaagcgtggcgccggtggcatccgcgtgaaatcgagttcctgtgccaggcgctgcagctgatccgcggtggtcgcgaaccggcactgcgcgaacgccgcctgcgggcgctggacgcgctggtcgccgccgggcagatcgcccccgaagatggcagcgcgctgcgcgaggcctacctgtcctgcgccggctggaaaaccagcctcgcgctgctggacgagcagcccagcgtgctgccggctggtcgatgcgctggaccgcagcgcactgctggccgaacgcctggcggcgtatccgctgctgttggacgaactgctggacgtgcgcgtgtccgggccgatgcccgatgccgccggcatgctggccgagtgccagcaggtgctggcggtggaggatcccgaatctgcgctgcgctggctcaacgagacgcggctggcgctgagcttccgcatggcgatggccacgctggacgggcgccagggggcggtggacagcacccggcaactggccgagctggcgcaggcggtggtggtcaccgtgctggcaatggccgaggcggacatgcgcgccgcacacggagagattcccggtggccgcttcgcgatcatcggctacggcagcctgggtggcctggaactgggcttcggctccgatctggacctggtgttcctgcacgacaatccggccggcgtggacgccagcgacggcgcgcgtccgctggagccggggcgctggtatgcgcgcctggcgcagaaggtgatggcgctgctcggtgcggtcactgctgcgggccgcctgtacgacatcgacgtgcgcctgcgcccggacggtggcaagggttcgctggtgtcttcgttggccagctacaccgaataccagcgcgaacgcgcatggacctgggaacaccaggccttggtgcgcgcacgcggcgtggccggtga

SEQ ID NO: 78318 - DNA, 231 bp, Glycine max
  Peptide Sequence Number=SeqID_170003
atgcccttttgcgggcagagcgaaggcgaggctcacgggtgcgctttccaaaaggagggaaagatgcgcggagtcgccaccaacgtttatttgtgggaaaacgtcggaaaaaccgagggaaactggtcgacaaaagcgggggcttttgctcctacgtaccctcctttggagaggaaatcagacctacgtagttctttcttatgcgtgaatcaagtgattctttttacttga

SEQ ID NO: 78319 - DNA, 600 bp, Glycine max
  Peptide Sequence Number=SeqID_170004
caatctggagtcaatgagcaacctgaagcttatgctgcaaacatttataatagacctcctcaacaacaaaaccaacaacaacagaataattatgacctttcaagcaatagatacaatccaggttggaggaatcatccaaatctgagatggacaagtcctcaacaacaacaacagtctgtccctccttttcagaatgttgttggtccaagcaagccatatgttcctcctccaatacaacagcagcagtcacaacaaagacaacaagaaactgaggctcctcttcaaccttccttagaaagtgaggcaaatgaccatccagaatatgcaatttcagcaagagacaagagcctccattcagagtctagcaaacaaattcaagtgcctccaccagtggcagcacctacacctgaaaaagaggatgagatagtagaacaaaagagaaagcttcctaacaaaaattttcatgcaggtggaccttcttctagtgatttcgacttacagcagccttatatccctcttccattcccacctagagcaattccaaacaaaaagatggaagaagcggaaaaggagatcttggagaccttcagaaaagtatag

SEQ ID NO: 78320 - DNA, 315 bp, Glycine max
  Peptide Sequence Number=SeqID_170005
atggctcaagtccaggaaaacccagaatcaagagtcaagcaagtctcaagaatcaagatcaagattcaagattcaagaataatcaagatcaagattcaagattcaagaatccagattcaagattcaagtaaagaatcaagactcaagattcaagaatcaagagaagactcaatcaagataagtattaaaagagtttttcaaaaactattgaatatcacaattttgttcaaaagattttttcaaaagaaaaattttaccgaagagttttactctctagtactcaattgccagaaggcagcaatcgattaccagtag

SEQ ID NO: 78321 - DNA, 648 bp, Glycine max
  Peptide Sequence Number=SeqID_170006
atgtacttatctttatctattagaaaaagtaatgaaatttcaagtgttatgtttatcttctttacaaccctccctaagaatgacatctacagccgatcgcgaagcctgtccggcaatgtctcgcaaatgagcggcaagtacctttggtctaatgggtgcatgtacgagggtgaatggaagaaaggcaaagcgtgcggtggcaagggccggttctcattgccctccggcgtcacctacgagggtgagttcaccgtcgggagaatgcattgccacagcacctttattggcatcgacgatgacatgtctccaatagaaagcgcgtattgggcgagaaacgctatgccaacgctacaaaggagtccttgtggttcggttgatggggatgttaaggaatcgggtcatactgaaccaatggagctagctgccatttgtggaataataccaatgacagtggtgttgaaagacgacgcggaaatggtgaaagaattgaatgtagttaacatggctggagagggtgtacgtcactcttggaggcaatctaggcagcactttggttttataatatcttggaggggatcacgtggtgattatcttgggaggatacaggggggcatgggatacacgttactgtataattgtgaatggtaa

SEQ ID NO: 78322 - DNA, 320 bp, Glycine max
  Peptide Sequence Number=SeqID_170007
atgggttttttaactgtttgcggtttggtttgctcttccctcccctgcattctcgtgattgtgagggttcgcgctctttgtcaggttggtgctggtgagcatgttggtgctggagagcagagagatgctggtgagcagggggatgctgatgctggtgagcaaagagatggtggtgagcagagggatactgatgctgctggtgagcaaagagatggtagtgagcagagggatgttgatgctggtgagcagagagatgctggtggtgaagagagagatgttgctgatagtgaggaggaaaaggaagttgacagtgatgagtg

SEQ ID NO: 78323 - DNA, 426 bp, Glycine max
  Peptide Sequence Number=SeqID_170008
atgtatgtcggagtaaaaggtgtcacaacgatagtgtggaggcaaatttccccatttggggtagttttacaaactatttccccagatggggttgttttcgagtattttccaggagggggcagttttatacgtaaaatgcatggggcatgcagccaaaccgccagaaccactggcgagtttggtctccgtgaaggactcgccactgccagtggtgatatgcccatgcaaggtagaaatcgccattcgaagtggcgatatgcacatgcgcatagggaaccgccagtcaaactggcaagttccaatagactgagggtgcagggtgcaggcaaaatcgccactaccattggcggtttgcctttcactgggatcgccagcatggctggcgagttgcttgattttgaaatttttcaccctcttccattataa

SEQ ID NO: 78324 - DNA, 537 bp, Glycine max
  Peptide Sequence Number=SeqID_170009
atggaaagtcgcagaagaaccgggacacggcggcgtataccactacacccgaccacaacatttagtcaacagcgcaaggcatggcccaggctctccgcgttgtcaaacacctccgccatgtggtggatagcaattgttgctcccgtggctatcggcctggggtgcctaatgagtgagctaactcacattaattgcgttgcgctcactgcccgctttccagtcgggaaacctgtcgtgccaactgcattaatgaatctgccaacgcccggggagaggcggtttgcgtattgggcgctagcggagtgtatactggcttactatgttggcactgatgatggtgtcagtgaaatgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtga

SEQ ID NO: 78325 - DNA, 246 bp, Glycine max
  Peptide Sequence Number=SeqID_170010
gtagtgctacctctccactcgaaagtggctcgcacacacacgcaagtgagagctctcactggaaggaaaaataagaaaaatgtgattcacgcccacgcacgcactcttgagcaagaagggatcctaggattgtatatagggttgggacctagttgcatgaacttggtgccaactgcaggaatttctttcatgtgctatgaagcatgcaagaggatattggtagaggatgatgatgatgaggagtag

SEQ ID NO: 78326 - DNA, 1104 bp, Glycine max
  Peptide Sequence Number=SeqID_170011
atgggtttggttattcctgaagaagaactaagcttagatttgagaccctcttttgttccaaaaaccatcactgattttctctgccacctttccaccaccccaaatgcatccgtcaaggtgtccttgctcgatgactttgtccacagattgcaactcgaattggccaagatccaagcattcaaacgcgaacttcctctctgcatgttcctcttaaatgatgcaatttcagcgttgaaggtggaatcagaaaaatgcatggcttgcaagtctgagccagtgttggaggagttcattcctctgaagaaagagtgtgatcagagggaggaaagtgagaaggagaaggaatgcagggacaagaagagttggatgagttcttttcagctttggaacactgatgataaagctgatattaacaacaatgcatatgaatgtgacaaaaaacaaaactacggagttgaagacaagaataatagagaagaaagaaaatctgtggccaaggacttgttccaatatggtggaattagaaatggagagaaggggtttgttatgcctttttccacttaccctgcatcaaaggaagtaaaggaagattgtgttttcaatggactttctcttcagacacctggaactgcagtgaagaacacaagggagggatctggttgcagaaccagctcttgcagggtggtttcctcggctccttcaccgctgcgtcagccacaaagtggccggaaacaaaggcggtgctggtcgccggagttgcatagccggtttgttaaggctttagaggagcttggaggttctcaagcaactactccaaagcaaattagggaactcatgagggtagatggcctgaccaatgatgaagtaaagagtcatttacaaaaatatcgacttcatacacagcgagttccagttgctaaagctgcaaattctaatcgctctgccgtagctcttggaggcttgtggatgcacaatgaatccttaaagggtagaagttctggttctcctcaaggccctctccaattagctacacaatcgggggaagcgacatcccgaactgaaggtgacaacatgatagatgatgatgtaaaatcagacttataa

SEQ ID NO: 78327 - DNA, 1092 bp, Glycine max
  Peptide Sequence Number=SeqID_170012
atgacgtcaaattttgaaataaaaaaagttctttggaaaaccgtacttgaaatccctaattcaaagacagttttcaaaaacgtttttgaagctcaagtgtccaacgccgctgttgaaggtgatcactgccgccgtcgaaggtgtccagggcagccgttgaagcttccttccggagaagaaggttattggttacatatgggtgacgattctcgcaccattgagaacacgagggaacacgacgagaccgtttgcaagcccgacgatgatgaggaaccaggctataacgcttcaggttttgctgccgcctctacaccaggagaagcgaagcttggtgtcgtgtcgccattgatcgaaggcatgccgcttccggtgttggtagaggtgtctcactggctggcggtggatgaggcttatggggtcgtgggtctgaggctgatatttcagggcagagtgaggttgaaggctggggccatcaaaattgcgcactacggattctatgttaagcggacacctaagactggtggtgagcacctggcatttgaagatatgatctcttggatgcgagaaggtggccaggttgggatatttgatgccacaaacagtagcaaagaacgaagaaacatgctgatgaaattggttgaagaagatgcaagatgcaaggtactaggttcagtggaggatcgacttcacaagtgtttaacaaccaagcgcctcaatttgcaagcttttaaggctatagtatatatgttaacatttattaccattactagtcctgaaagagcaccgggggtacaacaacagcaagtgccccctctttctgtgaacacattaatcactccacaatgtgctggcaatgaccttgcagccctagctatatcttcatcttttagtatgcgggatagtgagaagaagttaaacaacaaaggatctaaaaaatccaggcctttgaaggtgcataagaagggacaagggaagaaggaagaagtgaaagtgggatcaaaatctcacacaaaaactgcttgcactgatatatcaaggaagagagttatctcttctctcaaggtcaaagggccacgtaaggaagagagttaa

SEQ ID NO: 78328 - DNA, 180 bp, Glycine max
  Peptide Sequence Number=SeqID_170013
atgggcaacgtagaaaatttcattttggcagcagagaaacatcacatccactggagaagtctagtcttgcagataaggatggctccatgtagagcttgtaggccttggatcttcttcatcaacggagtcttttgcttcttgaagatcaatgtcagcggaatggagaaggaggaaaggtga

SEQ ID NO: 78329 - DNA, 83 bp, Glycine max
  Peptide Sequence Number=SeqID_170014
atggctaggaaactccaagaagattgggccaaagatgtaggagaaggccctatagttctcatgagctttaatatagattttgg

SEQ ID NO: 78330 - DNA, 429 bp, Glycine max
  Peptide Sequence Number=SeqID_170015
atgcataaggcattgcggttaaatgctcctttgccctatcctcacttagttaccttgttccttcaacattttagcatccctcttgattctgaaccttatgttccaatcaagagatctttcttgattggttctgctgtggttgcctcctatggttaccgcaaagagcgtgatggctcttgggtaaaaaagggtgctcaaccaaatgatgatgaaggacacttaccgtttgaagaggactcttctctccttcagagtattttggacaggtttgatggacttcaaacctatgttggtgagaggtttgactccttgggacatcaagtggacacacgatttgaggagatgaactcaaggattgcaaaggttgaagaagatgtccccatcattcgcgactgttttgatttacctccaccgccaccattagtttag

SEQ ID NO: 78331 - DNA, 768 bp, Glycine max
  Peptide Sequence Number=SeqID_170016
atggaagacctttttaagaggtggaatgagcatcttgacaacacacgtttaagggtcagccaaccaccactgataaattgtgatttttgtggaggagagcattacaatgacaattgtcatctctactccatgaataattctgggtggggacgggagttaagtccttacaatcaatatgaagaagaaagaactcctagtcttgaaagtgtgtttgaagaattcatggcatatcatgctagctctaaagccaatcagaatttaatgcaaaatcaagaaattccttttggcaagagctactccatagaagattaccaagggggacccgagttacaaccctataatcaaatgaagcagaaagaggaaacaacagaatcaactcagcgagcatttgaaagtgcagaaattcaggttggaaagctggcagaagaagtgacccaatttgtggccagaagagaagaagattttgtagaggttgaagctcaagaggaaagccctgtaaaagctcatgattcaagagaaaaagaagaagagaaaggtgaggaaaaagcacaacaatgggaggagtactcaactgtagaaatcaacaagaaagaagaaaggcagggagaagatgagaaaaccttaagtgtcattccttccttgatcaccgacacctctcctacaatgagttggaatttacttccaaaatacatgaagttcatggaatttctagctaaaaggagaaactgcaaggaagatgtgttttatgtgaccttcatgccaccttga

SEQ ID NO: 78332 - DNA, 126 bp, Glycine max
  Peptide Sequence Number=SeqID_170017
atggaagaagaggttgctcttgaaagtgttggtttgaacaacaaacccgatgtcaatcttgatgtggagcagactcctacaagaaaaatatcaactaagagaacaacaaagagttggaaagtatga

SEQ ID NO: 78333 - DNA, 738 bp, Glycine max
  Peptide Sequence Number=SeqID_170018
atgtctcgcaaagaaaatctgatatctgagttacacaccagaaaaggaacatggaaaatagttgtgcgtatcactgatctttggcaagctcgaaagcaaaatagtaaacaaacaattgagatggtgttgatagaccaaacgggttcaaaaattggagctactctctggcaagaactcttcactgaattgagggacaagttacagtgtggttcttcgtatttgattcaaaacctgaggattgttgacaaccaatctgaatacagagtcagcccagctccatatttggtttatttcctaaaaactacatctgtcaaggaaatccaccgtccagaaattccttctaatatttatctcattactccttttagtgatataatctctggcctcgcaccacgccatactttagtggatattgttggtgtggttgctgatttcatcgatgttaagacagttaatccccctcacaggatgacagtaaggctcagggataacagtaactgcgacattctaataactgtttgggaggactatgctattcagctagatgatgctattgacaaaaaccttatgcttcaggaaccattggttgttatgttgaccctaggtaaaatcaaggatgctacaagtgtgtctggtgttgatggttctcagtcccaatctagccagagtaatgtggtggaaaaatttatgcagaatgctcaggtggtcagtataggtgaaatcaacaatctcagacag

SEQ ID NO: 78334 - DNA, 195 bp, Glycine max
  Peptide Sequence Number=SeqID_170019
atggaagttggagaaacaaagaaacaaagaaaacagaatatgaaggaagatgaatggagaggaacgaaaaaggaagatggagaaacaaagaaaacgaacatatacttggcaccctttgttgcacaatatgtgaagtcccgagacgtgccgaaaaatcaaaaggaagcagcttacgcgatccgtaaaattccgtaa

SEQ ID NO: 78335 - DNA, 93 bp, Glycine max
  Peptide Sequence Number=SeqID_170020
atggctatttgtttcgccctccgggatactacttgtttgtgtggatgtgaaatctactggcaagtgcaccgggtcgtcaagctcaagtactaa

SEQ ID NO: 78336 - DNA, 407 bp, Glycine max
  Peptide Sequence Number=SeqID_170021
tcaacaattactcatacagacctgtagatccaaatctgccaagttcatctcaaaggccaaaggatagttatcctactgataggataatactccagaatactgatgatggtcaaatccgaacagagatttatgttccaaaacccgagtttcaaaaagtggaagatttggttgatgatcattctgcattagaacaagactgggaagactataatgctcaattgatggaagaattgttacacaaaaagagatatccttatcaccacccagtgtacggaagtctcgccagatcaaaagatccatctacttacaaggataaagtgatcgccattggtttgcctgcatcccctggagctgcagtagggcaggttgtgttcactgctaatgatgctgaagaatggcatgcataa

SEQ ID NO: 78337 - DNA, 366 bp, Glycine max
  Peptide Sequence Number=SeqID_170022
atgttgagactccactgtttctggtcaatgcaacttatgatgcatggcagcctagaagccttagaagaatctgatgaaactagaatagaatctgatgaatctaaggaacaatttgaagaatctttgacagaagcagaaaaatcttattctgataaggaagaagaggtcatatacatggacatctcaaacattttgatggctcgctccacagaagaaccattctatgattctcctatagaagaaaaagaaccagtgatctcaaagggttcatcctccaagccgaatgcaggaccttggttcacccttgatgatactccaccaagaggatggaggaaaaaacttatttgtgatgggagcatggcttga

SEQ ID NO: 78338 - DNA, 258 bp, Glycine max
  Peptide Sequence Number=SeqID_170023
atggagatagctagatgcatgttgcatgagaaggagttacctaaaacatttggggcggaggcagctaacatggcagtttttctgcaaaattgtcttccaaccaaagtcttgaaggataaaactccatttgaggcctggaaatatgcaaaagaaattttgaagaagtttcaaatggaggaatggaaatctattagcacaccaatgaatcaaaaggagaagttcaacaaggaagatagtgctgataaaattgatgaatga

SEQ ID NO: 78339 - DNA, 240 bp, Glycine max
  Peptide Sequence Number=SeqID_170024
atgttggttcctaagttgtggttctttcttattggaggtttgaaaacaaaagcttcaatgaggtcctttaatggtgattttccaccatggagatgcagtggaagacaaaggagaagaggtgagaggaggcgtcatccactagggaataagccatggaagaaggagcttcaccaccaagatgagccttggataagaagcttggagaggatgcttcaatggaggaaaagaaagagggagtga

SEQ ID NO: 78340 - DNA, 604 bp, Glycine max
  Peptide Sequence Number=SeqID_170025
gttgtaccatctatgttgaggctcatgaaacaggccaatggtccttatagtcaacaaggacagtggaggtcacaccttggtaatcagttcaacaaagaccagggtggaccttcgaataggccaatccaacaagggcctaacatctttcagaggactactaagctggaagagactttgactcagtttatgcagttttgtggcaaatacagagaagaatcccaaggggaatgcaaagctatgatgacaagaagtaaaaggtttgtggagaatgaggaagagaatagtgttggactcaagaagaaagctgttgaagagaaaggtactgatggcaagaaaaatgatgaaagtgaaaaagctgtgaatgaagttgcggaagtaccatatcctgtggtaccttccaagaaggagaaggactgtcatttggcgagatttttagatattttcaggaaactggagataaccatacccttcggagaagctttacagcagatcactgtgattcaaaagatccttccacctaagcataaagaccctgagagtgtaactattccttgttcaattggagaagtcactgtgggaaaggctcttattgacttaggagcca

SEQ ID NO: 78341 - DNA, 300 bp, Glycine max
  Peptide Sequence Number=SeqID_170026
atggtggaaagggaaaaattcgatcatataaaggaaaggccaagggccattgaaggaggcagagactatccttttgccgacatggaagaattgtgcctagtgtcagatgtcgtcattcctccgaagttcaaggtgctggatttcgacaaatacaaagggactacttgccccaagaatcacctaaagatgttttcactgagctgtcctcctctggctgagcgcatgatccgttgggcgcataaaagaacctggaagaagatgacctgtacaggtgcgttgagcgagagtcaaactcgctaa

SEQ ID NO: 78342 - DNA, 336 bp, Glycine max
  Peptide Sequence Number=SeqID_170027
acttatcaaggtaatccttgtggcgtctacccagacttatcttccttcaccggaagtggcgtctacccagacttatcttccttcattggaagtggcgtctacccagacttatcttccttcaccggaagtggcgtctacccagacttatcttccttcattggaagtggcgtctaccctgacttatcttccttaaccggaagtggcgtcatccaaaccttcgtaacctgtatcaagcgatccaccccatatggttcacatcatctggtatcagagctttggctcttgatacaggttctatcctatcctatcctatcctattttatttattcttcgtaa

SEQ ID NO: 78343 - DNA, 339 bp, Glycine max
  Peptide Sequence Number=SeqID_170028
atggcggtttccaaactcagaaatgatgcaaaggtcagattagggtttctttctctaccgaaatcgcgagccaagttggaaggttctgcttcggttgaagggttcctctcggcgtggggtctcaacggagaacaacggcggtttgtggtggctactggtggttgctcaaaaagcacaagtgagcaattctctcgggaacagaaacctcgcgcaccctccaaatatcttctcaaagatcccaacggtctgatcgttgacaagtatcctttgaagctgaaaaccgaatttcgagaagatccaacgattaacaaaggctggacaacgtttttaccgagatag

SEQ ID NO: 78344 - DNA, 577 bp, Glycine max
  Peptide Sequence Number=SeqID_170029
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcaaagtgcatacatgccccagattcctgatattgccaattgtccagagtatctgctgccattgaaagagtgggaggatgtgtttcttgctgagttttctgcactgagaaggcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 78345 - DNA, 259 bp, Glycine max
  Peptide Sequence Number=SeqID_170030
atggattcgacactcggacttccgagtactttactacttgtgacaatttggtacacttgccaacgagttaacagtaagcacgcgccgctacaatccaacgtcgggcctggcatctactctaatacacctcatggagccatgacagtcgcacgtaagccccatgagcacgtatggtctcaactcgagcctcctcgccggatacctctagaagctccattaacaacaagactgcctcgtccacgcccagaggctcaaacct

SEQ ID NO: 78346 - DNA, 543 bp, Glycine max
  Peptide Sequence Number=SeqID_170031
atgaagattgagaaagtctttacttgttacaactacaatgaagagaaaaagatcaaattggcctcactagagtttaagggatatgctttagtgtggtggaaccaagtgaggagtgatgttgagaggatgagaagacctttgattaatacgtggctcaaattgaggagtcttaagaggccaccatggcaaggtttttgcatgcaattaaagaggaaacaaatatacaacaagtctccctattgctctttaacttggaaggataaggaaacattcaagaagaagggaggaacttcgttcaaatctcatgaaaaaggtgttgcccttggtaaaaataattctaaccctactctcacttcttcaaaaatgagttctattaaatgttttaagtgtttgggaaagggttatattgcctcccaatgtcttaacgaaaggactatggttgtgttgggtaatggggatatcactagtgcatcttcttctacctcttctagttcttctagtgagagtaaaagtgaatgtgatgtacaacccctggaaatgtga

SEQ ID NO: 78347 - DNA, 276 bp, Glycine max
  Peptide Sequence Number=SeqID_170032
atgacaccggttaacccgaaaggcaggaaacaggagagcgcacgagggagccgccagggggaaacgcctggtatctttatagtcctgtcgggtttcgccaccactgatttgagcgtcagatttcgtgatgctggtcaggggggcggagcctatggaaaaacggctttgccgcggccctctcacttccctgttaagtatcttcctggcatcttccaggaaatctccgccccgttcgtaagccatttccgctcgccgcagtcgaacgaccgagcgtag

SEQ ID NO: 78348 - DNA, 423 bp, Glycine max
  Peptide Sequence Number=SeqID_170033
atggcgcgtaaaaagaaagaagaggctcaacagacccgacagcagctgattgaggcggctatcggacagtttgcaacacgtggcgtagccaatacgacgctgacggatatcgcggatgccgccagggtgacgcgcgttttaatctctaccagcaggcgcccgccctcgtcgatagcattctggcgacactcccgatcgttcgcgtatcgcctcatgatgattacagctccgcgccagccaagctcggtcaaaaagttttgctgtgcttcggtttccaccccttccgccacgactttcaggttaagcgtttttgcgagggccacaatcgccgaaacaatggtggcatcctcgctctcaccgcttaactctttcacaaatgccctgtcgatcttgagttcgcaggccggcaagcgcttgagatag

SEQ ID NO: 78349 - DNA, 444 bp, Glycine max
  Peptide Sequence Number=SeqID_170034
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagcagttcgctccaagctggactgtatgcacgaaccccccgttcagtccgaccgctgcgcctttatccggtaactatcgtcttgagtccaacccggaaagacatgcaaaagcaccactggcagcagccactg

SEQ ID NO: 78350 - DNA, 525 bp, Glycine max
  Peptide Sequence Number=SeqID_170035
atgaagggaagaaggcataaatatgggtttaacaacaataaacgtgagaaggcagagaagatcatgggttctccacctgcctcccctcctcctcctccttctcctccttcacctcctcctcctccttcacctccttcacctcctcctcctcctccttcggatgcatcgacttcgccatctgccgtgaagcagacacgcaaagcctcacgtccactagacctcctggtgctgagagaccagtggtccatgttgatcctgctaccgggaaggctgacggcggaatttgatatcccagaggcttctgacagtaggacaaaaaggaagttacttcagaccgtgggggagagatggaggcagtttaaattagacctcacgaggaaatgggcccttgcagccgagcaggacggtgtcgaggacactgtctgtgagaaatacggcatcagcaaggaaaaatgggcccagttttgccagactcgcagagacccttcttgggaggatgtgcgcaagaaggcacaggccatctag

SEQ ID NO: 78351 - DNA, 263 bp, Glycine max
  Peptide Sequence Number=SeqID_170036
gtgctgtgaccaaagatactttgattgctgaactcaaggacacatgcaaggtgctggaagccaccatcaaagccaacacagagaagaagatggagctggaacggctgatcaaaaggctctcagaaagtggcattgatgatggagaagcagctgaagaagaagaagaagcagctgaggaagaagaagaagcagctgaggcagaggaagatgcagcagaggatacagattcagatgatgatgatgattctgaagccaccccatga

SEQ ID NO: 78352 - DNA, 345 bp, Glycine max
  misc_feature (4)..(4): n is a, c, g, or t
  Peptide Sequence Number=SeqID_170037
tggnctgttccaccttgggctgcaccgtggcaaccatgggccacgccaccatgtccgtacccaactacgccaaattggcaacatcagtccactcctcgccagcaaggaattcttggaccaaagcctccacaagctcatatggcagccacatcagcaaataatgctcaaccatcatatgcatcaaccgacattcaagctgcgatgcatactctttctatggctcctcctgatgatcagtggtacatggataccggggccacctctcacatgactgcaaatggagtgatatttggacgtcccctgtgctcagctcaggtggacatcgttattatgctttgttcctag

SEQ ID NO: 78353 - DNA, 555 bp, Glycine max
  Peptide Sequence Number=SeqID_170038
atgaccggaaggcttcttaccggttcattggcttttgagagccgcatccttcattatctcattgttcgcatcttgcttccaagatcttcaaaccttgcacaggtttctgaagaagatcttattgttatgtgggcttttcataaaggcctacaaattgattgggcacacttatttcgatatcgcatgcataagacattgcgattaaatgctccattgccatatccatacctagtcaccctcttccttcaacactttaacatccctcttgattctgaaccttgtgttccaatcaagagatcctttctaataggcgttgctgtcattgcatcctttgaaggacatttacatggtggagaagattcctctcttcttcaaaagattttggatgggttcgatagtcttcaaacctttgttggtgaaaggtttgatactttggagttacaagtagacatgcgtttcaatgagatggagtcaagaatcaccaaggtcgaagaagatgtttcttacattcgtacaagctttgatctaccaccaccaccgccaccatcatcttag

SEQ ID NO: 78354 - DNA, 264 bp, Glycine max
  Peptide Sequence Number=SeqID_170039
atgcagatgccgtatactaggtgtcctattcgtccacagttcaaaagatgtctttggaactgccttactaggaaccttattcaacaaatacatgacagctttcaaggtaaacatccacaaagatatgggcattgtttattgcgcacaaatggcatgtttttgaaggagtttagcaaatggacctgggtgttgcccaatttcatcgtatcttccataatactcacaacttctatcagacctgacaactttcacctctctgtctaa

SEQ ID NO: 78355 - DNA, 192 bp, Glycine max
  Peptide Sequence Number=SeqID_170040
atggaagtggaatggagatggaagagagagaggagatgccacttcaaggagaagatgagtctagaagaagctcaccaccataggaggccatggataagagcttcgaggaagaaagagatgaatgttatggttcagcccactaatccaagatcaattccaagattctccactaagtgtgcttacgtgtcatga

SEQ ID NO: 78356 - DNA, 66 bp, Glycine max
  Peptide Sequence Number=SeqID_170041
atgctaagttacagtgtctgcaaagttggcttagctgtcaaggagcccgctaagcctaaggcttag

SEQ ID NO: 78357 - DNA, 408 bp, Glycine max
  Peptide Sequence Number=SeqID_170042
atggcacctccagactctgttcctatagtagagcagtttactgatatggtagcctggtccgggacccaatcttctcttcataaggaagacgaaggtcccacagcccagatacctcagcatacggagaatgagtcatctgaggccactatcttagagccatttgatataggagaagaggcagaagagacacaggtgagacaggtagctactaccactcctgagcgatcccttgaggctactttagagccttctgcaccaggggtaaatctaccttcacctcagcctgcagcagaaccttccactcctcttctacaaatgccaaaggacctaactacaccagtgctagctgtggacacttctcctcccgctactccagtacttcagctgacagatgaggaggatggttag

SEQ ID NO: 78358 - DNA, 578 bp, Glycine max
  Peptide Sequence Number=SeqID_170043
ctgagggacaaactctgcccgcatactgcagatactacaggttgcctataaacttcagagagatagaggctgccttatgcatacctggccgagggttcatcttgaactctgagggccatcctgggaagattctcatgaaggatttgactacactagctcaggtgtggagtgtcctctcatactccaaattggcccccacatcacatacctctgatctgacagtggacagagctaggttgatctttggcctcgtctctcacttggatatgaacataggagcgctgatttctggcctgatgacctctatagcccagtcaaacacttctagacttgggttccctgctctgatcaccgcattatgctgggccaaaggggttgtctcttacagccttacctttgagcgcctaagcctggtcattaacttggcctacatcaagaagaactgttggaatcccgacgatctaacagtttctatccaaggggctaggagggtgagggcaaggccaactaagcttccttctacttctatagctcctactccagcatccactttagtagacccttttgtcccagcttag

SEQ ID NO: 78359 - DNA, 426 bp, Glycine max
  Peptide Sequence Number=SeqID_170044
atgaaggaattctatgaaaacctctatgaccccgaggacaaatcacctaagcaggtgagggtgagaggtcaactgattaagtttgatgaggatactctcaacacattcttaaagacccctattattgtggaacaggtggaaacactttgtgcatattctagatttgcactcttgaggcctgaccctcaggagttagctgctaagctctgtatcctaggtagaggattcgagcttaatgctgatggttatccgttgaagatattgaggaagaacatgaccacccaagctcagacatggagtgttctttccttctctaacctgattcctacctcccatacttctgatgtcaccctagacagagccaaactcatttatggcatcatcatgaagatggatatgaatttggggtacctcatctcccactag

SEQ ID NO: 78360 - DNA, 228 bp, Glycine max
  Peptide Sequence Number=SeqID_170045
atggcagaaatcaaccaaggtaagacgatgaccgctcacgactggtcgcatatcattttggctcttacttgcaggtacatagggacggatgcaagtggggctagggtcacgaccgaccgatcgttgccccttcccggcgctaaacaagctgagaacgtcgctgcaaggcagcccagtatcctttgtgttcgcagtttcttttactatttttttgttttaaataagtaa

SEQ ID NO: 78361 - DNA, 615 bp, Glycine max
  Peptide Sequence Number=SeqID_170046
atgcgtgatgacgcgggtcatgtcccttcccccatccttgaaggggagcctcctcgacagtcggacgaggttcacgaggatcgtagagagtatgcccaaggagacatcaatttctaccccctagtccccgtcgaggggccggcacccaacacactgcctcagcccaacctcatgggagaacctcgaaacctcccagcacagccaatattcttgtccacagaagggtcgtccccggcagcggaagaaaaaaggaaactcaatctcatatgtcataccctaatttcgtctggggaccattgtttgatggcatgcaaccttcacttgaccgcttcgaggaacttgacacccatcgttaaacaaaccgtgaagttccgcgacatgtcaggagtcgaaaggaaacattattacgcaatccgtaaaagtgtttttcgaagctggattgcttctggaggaagcaacccatctcgcctgggtgagctgggcggcaaccgcctccccctttttcttataaaaaggcaaaatggggctgttctaagggtccctgatctccctggctatgtatttcagctgttttgggtgaaaaaaattgtttccgtgaagaaaatcgaagccgag

SEQ ID NO: 78362 - DNA, 246 bp, Glycine max
  Peptide Sequence Number=SeqID_170047
atggattttgaagcattggaggtagtgagcaatgcttatgtcgagtctcccccaatgcaaccttgctcattcagtgcggccttgatggtagcttgtgtaatgttggggcatgggggggttgccctgacccacgatgaagtccctcaagagcaatcaaattgggtgcggccatgccctcctgagttcgagttgggaaactggcaaattatcgaacaacccgaaacttctgtggcaaacgtaatgtaa

SEQ ID NO: 78363 - DNA, 486 bp, Glycine max
  Peptide Sequence Number=SeqID_170048
gagctcaatgttgcttccaagaatctcatggatcccatacctgaagatattatggtaaatgtggtcgaaatggaaataaagacagtagggaatgtggatccaccttcaaaaccaccaaccgaattagatgaagaagcacaagaaaaggaacaagctacccgtgaaagtgaatcttctcctaacaagaccatgcatgaagagggttatgttaacatgcaagctcaatctaatccttcatccattcttcaaaaatgcactcctactcatgtcacttcaacaattcaatcaaacccaatggaaaaagaaccttcgagcattgctcataccaataacaaagcaacagttagagttcaagaggtcaccaaaaacccatttttgctcctcaaacttatttcgagtgattcgaccatctccaaaggatctgacaccagtgtgccaaagcctacctccaaccaaatctttgagcaagcaatcacatatttttga

SEQ ID NO: 78364 - DNA, 252 bp, Glycine max
  Peptide Sequence Number=SeqID_170049
atgtctgccatggtagaggggtggaagggggagctgacaaagctcagagagaaagttgtcatggcccggaagagcctcttttccaaaggcaaagaggggtcagaagaagaagaaagagtcgtggagaaggaggctcacaaggctatcatggctgttcagagagacagcactcatgaaaccatgtcagaggcaacagaggtttgtaatggaaatgatgtgttaagtgttaactattggaaatgtgcaaattaa

SEQ ID NO: 78365 - DNA, 495 bp, Glycine max
  Peptide Sequence Number=SeqID_170050
atgaagggaataaggcataaatatgggtttaacaacaataaatgtgagaaggcagagaagatcatgggttctccacctgcctcccctccttctcctcctcctccttcggacgcatcgacttcgccgtctgccgtgaatcggacacgcaaagcctcactggtgcatgttgatcctgctaccgggaaggctgacggtccccacaggaagaaactaagaacatatttggggattgtggcgcgtgataaggtggacgtcacctacgagaactggaaggaggcggaatttgatatcccagaggcttctgaaagtaggacgaaaaagaagttactacagaccgcgagggagagatggaggcagtttaaatctgacctcacgaggaaatgggcccttgtagccgatcaggacggtgtcaaggacactgtctgtgagaaatacggcttcagcaaggaaaagtgggcccggttttgccagactcatagagacccttcttgggag

SEQ ID NO: 78366 - DNA, 129 bp, Glycine max
  Peptide Sequence Number=SeqID_170051
atgtcttctcagattcaagttgttgtccttgcccttgttgtggtggagtttcatgttcttgtggttgtgaatgagcttttgtcccttactttgatggactttgagtatgacattgagagggagtgctaa

SEQ ID NO: 78367 - DNA, 294 bp, Glycine max
  Peptide Sequence Number=SeqID_170052
atggcgtaccagttgtctggattgaagagtggtggggagaacaagcttgtcgaaacaagggcgaggcattgtgtgagagtgattggggacttagaaaagaaggaaaagaagataacgacgtttcgagatttagggtttgctatcatagccctcgaacgcagcggcaacggaacaggcatagtgaagcttctctggcatgggggtgttggtgaagaaggaagcaaaaaggaaggtgcaggaagtaaaatccaagcaggagttgtgttaactcattgtaaggacagggagatttag

SEQ ID NO: 78368 - DNA, 192 bp, Glycine max
  Peptide Sequence Number=SeqID_170053
atgtcgcatactttcgcagttgccgccgtagccgtcgtcgccatcgccatccgttcgtcgtgtgcgaggtgcgtcggtgccgtgtcgctggtgcgtcatcctgctgctgtcgttgcactagaggctggagttctccgtcaccgtcatcaaacatgccgtcgttgcactgaagctttgctgtcgctggagtaa

SEQ ID NO: 78369 - DNA, 168 bp, Glycine max
  Peptide Sequence Number=SeqID_170054
atggtgccacccatgaacggcggagttgagacagagcactcaggtgaaaagggtttgcaaaagctcacaaaaatgagaaaagaagcaaaacactcgcgaacgacgacgatggtaacgaggagatggcggtcacaggtcacaaacgacggtcacaggtcttgcgggtga

SEQ ID NO: 78370 - DNA, 315 bp, Glycine max
  Peptide Sequence Number=SeqID_170055
atggataagagcttgaaggtaggagaatatgagtggagggagagggagagaagaggcacgaaattttgtacctcaaatgaggtatggttcagcccactaatcaaagatcaagtccaagattctccactaagtgtgcttaggtgtcataaggcatgctcatacttatcccatgggcccaaaatctatcataaggctcatgagaaccctagggccttctcttgcatcactggcccaatcttcttggagtcttctatccaatgcccttgtggggtaggattgcatcacttacccctgaccatgttacaagcccaataa

SEQ ID NO: 78371 - DNA, 114 bp, Glycine max
  Peptide Sequence Number=SeqID_170056
atggcagcggaatggagaaggaagaaagatgagtggagggagagggagagaaggggtatggttcagcccactaatccaagatcaagtccaagattctccactaagtgtgcttag

SEQ ID NO: 78372 - DNA, 396 bp, Glycine max
  Peptide Sequence Number=SeqID_170057
atggtgagtttagcctctcattatcatgagaggcttacaaatacaaaagggcttccaaggtggcttcttgcgctaagtgggcttcttgggttgagcggtcctgatgcgctaagcgaggaaaagagttttgttaccatagcaatcatactcaatgatgtaagctccattggagcttgtaggcctaggatcttcttcatcaatggattcctttgcttcttggaagatgaatggcagcggaatggagaaaggaagagagagatgagacgccacttcaaggagaagatgagtctagaagaagctcaccaccataggaggccatggataagagcttggaggaagaaggagatgaatgaggggagagggagagaagagcacgaaattttatgctctaaatga

SEQ ID NO: 78373 - DNA, 699 bp, Glycine max
  Peptide Sequence Number=SeqID_170058
atgtggatgagtcttcctatgtccattctgtttgtttcttgtctgtgcattcttttgaacaaggtggaattccattggaagaaaaatcaactgccactgaatgacgggcacctcacttattcacctccccctcccaaatggaagaagaagattaattctcctattgtggaggctgccttaaatgattttgttgatttgatattgaaggactttgtgataaatatgtggtatgcaaacattactccagatatggagtttcctgagctggtacatgacttaatcatgcatgctattgctgaagtgtcagcaagagttaaagagataaacctcgttgacttgctcacaagggacatagttgatctaataggtgatcacatagaccttttcagaagaaatcaagctgctataggtgttgatgttatgttaaccttatcttctgaggagagggatggaagattgaaattctgtctgttgaattctaaggagcttcatctagcactaatgtctccaaagagtgagtacaaggttcttcggcggctaatgagaggattattagctatgatatcaaagaatgagttcaagatgttcaagatagaatcaagaacacttcaagattcaagaggaaagttgaattcaagaatcaagaatcaagattcaagaatcaagaaaaggctattcaagaatcaagaaaaagcttaa

SEQ ID NO: 78374 - DNA, 159 bp, Glycine max
  Peptide Sequence Number=SeqID_170059
atgaaggatgcgatccatggtcacttctctacagctccagctccacttttctcacttctctcgctaagcttcgtggttcttctttctatttctgcattgttgccttcttcctctggtgccagaccaactctcctaggcgagctgtactcgcccaggtga

SEQ ID NO: 78375 - DNA, 1221 bp, Glycine max
  Peptide Sequence Number=SeqID_170060
atgccttggacaaatatatgtgttttgtacaggattctttggaggagcaggcatcacaggaacaccctggtcgtgtgcgtattgctagagccggtgtcaccatcaagcaatacttcggatcagctccacgaagctcccgcagttcctcctccatccctcccgaagaactcgagcagctcactcaacaaatcagggactagttggaggagtcgatcacagaaaaacacaaaggggagttgtgttgatccctcaccgaccgatccagagacgggtgactcagaaaaatgcgggttatacatcgaagaaaatccttcccgcctagttgcccttggaagagtttatgagagatccatagttgttcacaacatccctttgttgcatggccaggtgaaagttggtgttgaggtggttaaagatgcagaggctcccattcctatacccactgacgaggttcaactagtggggcaagcactgaacaccttccttgcttggctgacatgtctcatgaagcgtgtatcagaacatgcaactgtgtctccaacaaagcctccatattggtcggatcctgaagctgatgatcccttgtatctgatgacattgaccatcccacagcttttcttgaagcctctccaggttatgtgggatgctaccatgttcagggtgtttaattcagacttcccattgtacatcaagcacaaagatctcttcaaaattgcacacggtggtcaatgtctcagcatatttgttatacagttgtggattttgcatttgactgagacaagtatgcgagtggggaattttgatgtgtatggattcctcgagccacaatccattcagagatctaggcaatcacaatttgaatcagaaagttacatcaagagttggatgcagagttcaaaacgcgatgtctaccttggagcctacctaaatggcgggaactggcaaatggtcgccattctgcctaaggaaaaccttgttgtctggttttgttccttgcataacaggccagacaattaccttaagggagtaattaatagacaaaaaggaagcactgagtgcggctattatgtcatgcactggatgtccatgataatcttaggaactttcaagaataattgggaaacatattttaacgatgttagaccattggaagcagagagattgaaggtgcttcgcatccagtgggcacaattttatctcaaagttagaaatgaaagttag

SEQ ID NO: 78376 - DNA, 171 bp, Glycine max
  Peptide Sequence Number=SeqID_170061
atgaaaacaaaactcatacagaagagtcttaagcttgtaggcctaggatcttcttcatcaatggattcctttgctccttggaagatgaatggcagcggaatggagaaggaagagagagaggagacgccacttcaaggagaagatgagtctagaagaagctcaccaccatag

SEQ ID NO: 78377 - DNA, 375 bp, Glycine max
  Peptide Sequence Number=SeqID_170062
atggaatggttagttttaaggattgaagctcttcaaaatttgacagccatcactgcagctttgttgcttgttctagttcctcagggatacgtttccccaggccttgtggggctatctctctcttatacattcaccttgacaggaacccaaatattttttactcgatggtattgcaacttattaaactatattatctctgttgagagaatcaagcaattcattcagcttccaaaagagcctcctgtcattgtggaggacaaccggcctccatcttcatggccttccaaaggcaggattgaccttcaagccttagagccttggctaacaagccacagtttaaaatatgacatggccaagtacaatagttacacttga

SEQ ID NO: 78378 - DNA, 120 bp, Glycine max
  Peptide Sequence Number=SeqID_170063
atggcactgcctaagaaaattccagagaaccatgatgcttcgaatgatgcaagtagtgatgaagaaccaaaacaaggcaaagaagtcttcttccaaaccaaagagcaatattgccattaa

SEQ ID NO: 78379 - DNA, 2124 bp, Glycine max
  Peptide Sequence Number=SeqID_170064
atgaaaagagaaaaacatgcctcctatagtagtcataactcttgcaaaagcctaagggaagaacttcgtgactattacgaaggaaggcataggtcacatcttagacctcactcccatagaagagaaaaggaaagaaagcctcaagaggctaacattaaattctcatacttccatgggaaggacaatgtagaggctaacttagattgggaaataagggtagagcaacaacttaaaaagaagtctacttcaaaatcttatggctctcactcttatccaaagaaagaccaaggtcaaggcatcttaggggtgacaccttctaagcccaaagatgataaggggaagacaatagaaaagcaagaccataaggctagtatgcaagagaaaactagctctataaagtgctttaaatgtcttggaagaggacacattacttctcaatgccccaccacaaaaaccatgattatgaggggccaagacatttatagtagtcaagatgaggctactacttcaccttcctctagtgaaagtgaaaaagcaaaagaggaagaatctagtgaagaaatctacccccaagaagaaggacaaccattagtggttaaagagaagtgtaaggaggtacttgctagcattgccacacctcttgggcttgagtttatttctcaagtaaagaagttgttggatgagggtttggttcgcaagagcttaaatccttgtgctttgttggtgcccaaaataggtatcattaggtaccaagtccctaaaataggtggtatgatgaatgttttgagtggtgcaaccctcttttgtaaaatcacttgtacacctaacatcttcatgggaaggagcccagagtatgaagaacctcgggatttgaggtcaaatcctttccaaggtggagggaatgatgcaatcctatcccgcaagggcattgggaatcttcttaaggaagcttttcaaggaggtgagcttagttatgagagggcatcctctccaagcttcttatccaaggctcatcttggtggtgaagctccttcttccatggcttattccctagtggatggcgccacctcttacctcttctcctttgacttccgctgcatctccatgaatctccacaagcaagcttccatcagtattagggcagaccttctagcagacgagtgtgccgccatcacctaccatgacacggaggggggcgatgttggtggagggcagcgagaggaaatgggccaaccgagcttgcatgaaatcatgggcatgccggaaagggcgttaagactcaactgtggtgtgtcgggtagtgagaccaagggttcgtcgccatctgagggaggtggagagtctatggacaacgtggggttgtcgttggctaactcttcgggtgagaggcaccacacagggagtttggtcagaggtggggtaggctgggtggtctgtggtgggggtagaggtggtgtttgggacggaatgagtggaaaacgggtcgggggtaaggcccgaaatgaagcagctcaaaaggagtgggtgcgcgagcccgatggtacaattggccaggcgttcaaattcagagagcaccgtgtggatcatcgtagtacgacggggcaaactgagcttcgagagcttgaagcatcgttggccatgaagtcaagagactgttacggctcatccactgataccaacatagagtcgggccctccatatagaaggaagctacagtcaaacgctcgttgtcaggaatgcagtgatactcgaagaactggggtggcgaggattttggtgaagtgggaggggggattgttgactctgagtgaggcagagcacgacctcctcgagtctctctacggtagcctgcctggtattgtggtcaggcatgctgggagagacagggcaggaataacagaatgcaaaaagcaaaataacagaaatgctagagctgtcggcaagggccactacaatgcagtggagaactttagaagctgtggtggtgcacacatggcggtggtggctgttgcagaggaaccacccagaaagtcctcaaacttgtggtcgccggtgaatattaagaggttggtctatcatgtgccagtggtgaggctccacaccaagttgtgtgacggatgttag

SEQ ID NO: 78380 - DNA, 408 bp, Glycine max
  Peptide Sequence Number=SeqID_170065
atgggtgaagtagaggaggtgcaagagcagatggaggccgacatggaggccatgaaagagcaaatggccgtaatgatagaggccatgataagcatgaagaagataatggaagccaatgtggttgtagttgccgctaccagcgctgttgctaaggtgagcccgacgtccccatccggcatcaaccaaatgaatcatccaacctcagatatggtaggcaaagatttgggaagtaccggcggcccccatgatgtgcaaattcaaaacgagcacgccttcccgccatatggcttgcctctcaactatacgccacccaatgtggcgtacactcccaataagaatgtcaataactccactcctatacccattaggagccaacaaccccaaactgatcatgcacatgtctcttaa

SEQ ID NO: 78381 - DNA, 111 bp, Glycine max
  Peptide Sequence Number=SeqID_170066
atgagtcaggtggcaggcggagataccttatggtcatccagaccttttgtcaaccgaggcaaatgtgttcgacggtttttactctcgtcatccggagacattcaagcctga

SEQ ID NO: 78382 - DNA, 315 bp, Glycine max
  Peptide Sequence Number=SeqID_170067
atgggttgttccatcctccgtgccaagtccaaatccatacagccaagaacaatttctacggcttccttccagaccttaaaatttgtctcattcagcattgggatagaattcacttgggcaataacatttgcagcactgattcatcacaagatacctgtcgcaacgtgccctttagcgaggctcacgggtgcgctttccaaaggaggaaagatgcgcggagtcgccaccaacgtttatttgtgggaaacgtcggaaaaatcgaaggaaaccggtcaaaatgaaaattctaagttcgggagttgtatttacgcttga

SEQ ID NO: 78383 - DNA, 438 bp, Glycine max
  Peptide Sequence Number=SeqID_170068
atgactagagataggacatttcatagattagttaggcatagtgtgcatcttgattaccctaaacattttgtaccttttgagcatcctgagcattctgttattggtgagtctgagcattctgtggttggtaattttgaacattctaaaaatatggctcaacctccacctcgtgagaggactctaagggaaatggttgcacctgatttcacttatgaaagcttgtgcattcaataccccgatgaggatgtcccatatgttcttaaaattggactaatccacttgttgcccaagtttcatggtcttgcaggtgaagaccctcataaacatctgaaacaattccatattttctgctccaccatgaaacctccagatgtccaagaagatcacatctttctgaaggcctttcctcattctttagaaggagtggcaaaggactga

SEQ ID NO: 78384 - DNA, 282 bp, Glycine max
  Peptide Sequence Number=SeqID_170069
atggacaaacttcacaaaatcgacatgcgaggtcgaactgacacaaattgggcgaaaaaacatgcaaagtggataaggtattggcaacaacgtcaatcaatggttttacagggacaacctattatagggcatgcaaatcattctcaggaatacatgtcgtgccaagatgtacaagataataatccatcactgcatgacataccagatgaacgcccacgtcaaaatctaggacgtaacaagagatgccttccatgtggaacaggacaccattatggggattaa

SEQ ID NO: 78385 - DNA, 138 bp, Glycine max
  Peptide Sequence Number=SeqID_170070
atggcttccatgatggatgccatgctaggaatgagacaactaatggagaataacgcgaccaccgccgccgctgttagttcagctgccgaagcagacccaactctcccagctactgcgcaccaccctatcccaaacgtg

SEQ ID NO: 78386 - DNA, 696 bp, Glycine max
  Peptide Sequence Number=SeqID_170071
atggttcttgggacaagtcgtccctttatacttgtcgaagtccggcactttgaattttggggggataacaacatctggtaccaaacaaagattcgtcatgtccgtgaacagatagtcaccaaagccttcaacaaccctcaatctctcctcgaggagattgagtttccttctttcttcggtcgccgggggtggtccttctgtggacaagattattggttgtgctgtgaggttggaccgaggctaagtgttgggtgctggcccctcgacggggatcagggggtagaactcgacatccccttgggcatactcttgatgatcttcgtggacctcgtcgggctatcgaggaggctccccttcaaggatgggggaagagacatgacccgcatcatcttgcatgattggtggcgtgtaattagatggcaatccataagggtaagccgcccggttgtatcccaaatgggggttgttgttgtgccccagtgtgctccttcctcgtcctactgcgcatttgggggaggatggtgcgcggtagctaggagagttgggtctgcttcggcagccgaactaacagcggcagcggtagccacgtttttctccatgagttgcctcattcctaacatggcctccatcatggaagccatttgttctttcagagccgacatgtcggctttcatgtgttcctgtgtctcctcttga

SEQ ID NO: 78387 - DNA, 384 bp, Glycine max
  Peptide Sequence Number=SeqID_170072
atggataacattttaggaagacacatcttacctgagaggaaggtggaaatataccacactgagttggatgagtttaaggctgaattggagaggcgtaacttccataaatgccttaccaatttagttgacagcagaatagacttagctttggtgaaggagttttatgccaacctttatagctctgaagacccttcaccaaagcaagtcagggtcagaggccacttggtgaggattgatgcagacagcctcaacacattattggagacacatgtgatattagctgagggtgagactttaccagcatattccagatactgcaggttgcccatagatataaagagattgaggctgccttatgtataccaggccgagggtttattttga

SEQ ID NO: 78388 - DNA, 473 bp, Glycine max
  Peptide Sequence Number=SeqID_170073
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaaggcggtaatacggttatccacagaatcaggggataacgcaggaaagaacat

SEQ ID NO: 78389 - DNA, 381 bp, Glycine max
  Peptide Sequence Number=SeqID_170074
atgagtcatcattcatctagtgttactagagagggtactagtcataaggatcctctatctagaatcttagatgagttgagttcccttaagttatggaaagaaaaactagaaataaaagaaaaaggaaaagagagggtagaaataaatcaagataagagggaacaaataagggaagaagaaagaaggaaaatactaaaagagttaaggaaagaaaaacatgccacctatagtgaagaacttcgtgactattatgaaggaaggcataggtcacatcttagacctcacttccataggagagaaaaggaaagaaagcctcaagaggctaacattaacctcccatacttccataggaaggacaatgtagatgcttacttagattga

SEQ ID NO: 78390 - DNA, 225 bp, Glycine max
  Peptide Sequence Number=SeqID_170075
atggcgccaaagcatagaacatggataacccatgagcatgcaaatcatcgtgatacggcacaagccaggataaagaataaaggtatcaggcagcacaaagttaatgatcaggctcaaaatattgatttttcttcacctgagaaccaaaattatatgtcctcagctaatgagcccgcaattaatagagaaggatattctgatcttggtgatcagctcatgcagtag

SEQ ID NO: 78391 - DNA, 112 bp, Glycine max
  Peptide Sequence Number=SeqID_170076
ggaattggaaggaggattggtgccatcccttgaagaatttgagtccataagaaacaaaggggccaaccaccttaagagctattggactaagaagcactccaaaattgagtga

SEQ ID NO: 78392 - DNA, 399 bp, Glycine max
  Peptide Sequence Number=SeqID_170077
atgactttgctacttagcaacattttgcccatcgaccgcaatgccgatcttcccctgctaaagtatcggggtcgtgcccacaagacacccagtggacccgaagaagtccaacagggccctgggatctccagctttggttacgggcctctgtcagtcctacagggtgcctgttccccccaggaagggatcgcgcccgcaagacacccaatggaccctgagaagtccaacagggtcttggggtttccagctctgattacgggcctctgtcagttcgacggggtgcctgtcacccccagcaaggtcataaggccccctaccaaccaatctttcatcaagaagtactgcgcccccaggcaggcgcagggagaaacaccacggcagcctggggatggccggtag

SEQ ID NO: 78393 - DNA, 162 bp, Glycine max
  Peptide Sequence Number=SeqID_170078
atgtgcaaaatcagaatgctcagaatcaaaatgctcaaaattataatgctccaaatcaggatgttcaaaatcaccaataacagaatgcacagattcactagtaatggaatgctcaatgatcaaaaggatcaaagggttgtaagtcagatggattgcctctag

SEQ ID NO: 78394 - DNA, 397 bp, Glycine max
  Peptide Sequence Number=SeqID_170079
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgattcaagcttatcgataccgtcgacctcgagggggggcccg

SEQ ID NO: 78395 - DNA, 132 bp, Glycine max
  Peptide Sequence Number=SeqID_170080
atggatgctttgttagggtcattcaataatggaaattgttctgattctaaagtctttgatagtacagggctaagttgtcgtactatcacgagtaatcgagtccaacaagaggaatctgcggacgacgcttga

SEQ ID NO: 78396 - DNA, 198 bp, Glycine max
  Peptide Sequence Number=SeqID_170081
atgacaactcatccttcttccagattcttcctcgtgcttagccaaaggagtgttgcactcagcggatggctcgctaagccagaagattggcttagcgagcggatgaaaatcagcacttcacaaactttcctaattaacctgaaattgagaggaaatggtgtatgcacaaaagttattgattgcatgataaaagaatga

SEQ ID NO: 78397 - DNA, 354 bp, Glycine max
  Peptide Sequence Number=SeqID_170082
atgccctcatcttttagaggattgcacgtccttgccatcagagggctacacgccctcgcctttagaggactatgcgtcctcactttcaggaccagtagtttccctttaacggttcttgggccaccccctgatattggaggagggccaactgtgcgagcacaaccagagagggaggctatcacacagctactatgcataccggggcaagatttcacctgtgccgttgcaaagagacgaggatcgcacccacaagacacccagtggacccggaaaagtccaacagggccctggggtttccagctctggttacgggcctctattagtcctatagggtgcccgtacccccccggcaag

SEQ ID NO: 78398 - DNA, 192 bp, Glycine max
  Peptide Sequence Number=SeqID_170083
atgaatgtcgaagaacggttgaaaaccttcgtcaatttcgagagaataagaagtgccagaaggctaaacctgatgcaatcctactccgtaagggcattgggtagaaaactccaagtagattgggctagagatccaagggaaggccctagggttctcatgagccttagggtagatttcgagcctatgggctaa

SEQ ID NO: 78399 - DNA, 489 bp, Glycine max
  Peptide Sequence Number=SeqID_170084
atgctccaaccatatgagatcagcataggcttaaaggagcactcaaacccggtgacccccaaggcctacactccgaagagtccgtcagggcctctccctcctgattcagttattcctccgactgcttcgatagaattcccaaacgtcagagagacggagaagagattgaaacctccacttatactgtcttcatgcgattcctttttctccctccacttttaccaagacagctctgggtttctgcgggaaagaaaaaggctacaatgcgaagggtgtttctctcagttcagaaatgatatcaaaattcccaacggtgagaattctcagaattgtgttgcaaacatgatacgcaaatttcatgacgatccaacggtgaacgggttcaagatcgtcgtttttctgagactggtttggtgggctgcgggaaaaagaaagggttttgagaggagaaggggaaaaacgaaaatgaggccaaaaggaggcagctga

SEQ ID NO: 78400 - DNA, 497 bp, Glycine max
  Peptide Sequence Number=SeqID_170085
atgactagggacaatccaggtgatttaaaaccctttgatcctgaaatagatagaacctttcatagattagttaggcatagtgtgcatcctggtcattctgtgcattttgaacattctgagcattctgttgagggtgattctgaatattctaattttgaacattccactactaatttttatactgagaacatggatcaacctccacctcgtgagaggactctaagggagatggctgcacctgatttcacttatgaaagcttgtgcattcaatatcctgatgagggtgttccatatgttcttaagactgaactaatacatttgcagcctaagtttcatggtcttgcaggtgaagatcctcttaagcatcttaaggagttccatattgtttgttccaccatgaagccccctgatgtccaggaagatcatatctttctaaaggcttttcctcattctctggagggagtggcaaaagattggttatactaccttgctcccag

SEQ ID NO: 78401 - DNA, 63 bp, Glycine max
  Peptide Sequence Number=SeqID_170086
atggcgagggagaaggttcagattaagaagattgacaacgccactgcgaggcaggggttatga

SEQ ID NO: 78402 - DNA, 63 bp, Glycine max
  Peptide Sequence Number=SeqID_170087
atgaaggagaaaccaaagaagaaggttaagttcacagagatctttcttgcaatggcctttgat

SEQ ID NO: 78403 - DNA, 288 bp, Glycine max
  Peptide Sequence Number=SeqID_170088
atgcagccacgacattatggctcaaacttaaaccaacccaaaaaattctctgcaccatttgaccctgcaggatacaattattgggattacattgatgatgaggacatgaccaagagcaagggcaaggatccacttgaaggacttggaggacctatgacaagggctagagcaaggaaagccaaggaagctcttcaacaagtgctgtccatactatttgaatacaagcccaagtttcaaggagaaaagtccaaggttgtgagttgtatcatggcccaaatggaggactaa

SEQ ID NO: 78404 - DNA, 183 bp, Glycine max
  Peptide Sequence Number=SeqID_170089
atggcaatgaattgtcacactttgcaatcacaagcatgcgtgggttccattccagaacccaaactcaaaagcaaaattagccattccttgatccgcatgggctttattgggcttgtaacctggtcaggggctatgaaggtttggatgacgccacttccgatgaaggaagataagtcagggtag

SEQ ID NO: 78405 - DNA, 399 bp, Glycine max
  Peptide Sequence Number=SeqID_170090
atgccatttgatctgaaaattactaagactgaaaggaagaatagaaagaaaaagaaacaatcaaccactataacaccaaacttaacatctagtgaggaagtctaccctcatgaagaaggtgacctcctaatggttagacggctccttggagtttccaagttgaacctcactatcattccccacccaaaaccttataaacttcaatggctcaaagagcaagggaaaatgatagttaactgtcataccctaatttcgtccggggaccatccattgttgggatgcgaccctcgtttgaccacttcgaggtacttggcacccatcgttaggcaattcgtgaagttttgtgacatgccagaagtcaaaagaaagcattgtagcacaatccgtgaagttccgtga

SEQ ID NO: 78406 - DNA, 201 bp, Glycine max
  Peptide Sequence Number=SeqID_170091
atggcaattaggaagataatttacaatggcctgactaatgagattaccctcacccatcttggcactaaatttgtgttgcatcctcaaacaccttcacatgtagctaaggatcaaatacaaataaaactcaaatgggatgagagaaagaatagaaaaagaaaagaagaacaacctttaatgattaaggaggagtgtaaagag

SEQ ID NO: 78407 - DNA, 264 bp, Glycine max
  Peptide Sequence Number=SeqID_170092
atgtcagaattcacaagcaattctactcaaatttcagccagcccgcatcaattagactttgcaccttatgtttcagggtcatacaatgctcaatggaatgccctggaactcctccgtgataagcacatgttgcgttcgagtcatatcctcagaaaaatggaggttgaggaaccttggctggggttatggctaccattgaattatcaagtagatatgggagcaagctttttcgctggaaaattccctccatggttggtgttttag

SEQ ID NO: 78408 - DNA, 75 bp, Glycine max
  Peptide Sequence Number=SeqID_170093
atgtcttcaaaaggaattaatgaagcattgggcttgaatctagaattgggcttggacttgaagagggcagactaa

SEQ ID NO: 78409 - DNA, 198 bp, Glycine max
  Peptide Sequence Number=SeqID_170094
atgatgggaggaacgcctatgttccaatgtctgactccctatcatggtggaacagtcactttcacagggaatcaaaaaggaagaataatcggcatggtggatatggtgtatccttcaacaaggatgaatgtgtcatctagtgtgaggatgggtctcgcgtattttctgcaaagagaaaaggaaacctctacaagataa

SEQ ID NO: 78410 - DNA, 294 bp, Glycine max
  Peptide Sequence Number=SeqID_170095
aaagctcatatttatgcgtgtaaagctgatcttccagggcaaaaggaggaggaagcgagggcgcagtcagctgatggcaaagtgtttaagattgttccatggcaccatctggagcatagcaccagcaactccctgagcatacaggccttaagccatgacttgactggtttagatagttgttcatgtcattgcatgcaatgtttgctttcacccaaaggggtggctttcgctcccattgacaaggatgattccaacctacctctggatacagctcctattaagcatgtcacgcag

SEQ ID NO: 78411 - DNA, 351 bp, Glycine max
  Peptide Sequence Number=SeqID_170096
atggagaaaaatgaagaaacatcaatggaggagaatctttctatggaggctagatctttgagcttcaatggtgattttccaccatggagatgcagcggaaggcaaaggagaagaggagaggggaggcaccatccacatgggaataagccatggaagaaggagcttcaccaccaagaatgtgccttggataagaagcttgaagaggatgctttaatgaaggaaaagaaagagagaaggggggagcacgaaatggaaggaataaaagagggagagaagtggaactttgaagtgtctcataagactttcattcatcaaagttacaacaagtgttacacatgcttctatttatag

SEQ ID NO: 78412 - DNA, 266 bp, Glycine max
  Peptide Sequence Number=SeqID_170097
ggtacatcctttgtggtacaagtagagggtacatctactttggtttgactgagaacaagagagggtacatctcttgtggatcagttctagtggagggtacatccactaggaagttggaagttggaagttggaagttgggagtggaaattggaagttggaagttgaaaattgaaattggaagttggaagttggaagttgtaagtggaagttggaagttggaagttgaaattggaagtggaagttgcaagttggaattggaaatttaa

SEQ ID NO: 78413 - DNA, 1338 bp, Glycine max
  Peptide Sequence Number=SeqID_170098
acgccatctgcgacaagttccgccaggtggttggtagtcgcccgaatattgatacgcgtgaacccgctatccgcgtgcatgtgtatctcaccagcgatagctaccagctctatgtcgatacttcaggtcttccgctttatcagcgcggtaaccgtaaaaacagtattgaagcgcctttgcgtgaaaacctggcggcaggtattttaaaactcactggctggcaacccggtcaagccttgcttgaccccatgtgcggtagcgggacctttttgcttgaggccgtgatgatggcactgaatattgcgccaggcctgaaccgtaactttggttttgagaaactcaaaaactttgagtcagataccttccgtaaaattcgcaatgcggcagctaaagcggtcaaacctgtgactttccaaagcatctacggctcagatatggatttacgtgctgtacgtgtgaccaagcagaacctggagatggcaggttggctggaggccgtgcaactgactcactgggaattcacccaggtagtgccacccgccgagagtggcgtactggtggctaatccaccctatggtgtacgtatcggtgaagatgaaacgctggctgcgctctatccgcaaatggctgcgacacttaaacagaaattctctggctggaatacctacttcctgactaatgacttacgcctgcccaagctcatgcgcttgagccccagcaagaaaacgcctttgtacaatgggccgctggaatgccggctatttgaaatcaaaatggtggcagggagtaaccgccgcgaaaaggccgattctccggcagtggatgattttgtggaggagcgcgactgggcgcagtttcattcgccgaaaaatctcgccatggccatgattgtggaggcagcagaagtggtcgagcattttcaatggatgaccgaagccgatagccgccagctggatgatgccaccaaagagaaagtggggcaggaactggctgatacctttgtttacctgatgcggattgctgaagtctgtggcatagacttgattgcggcaacgaatgcaaaaattgagttgaatgcccaaaaatacccggcagataaatgcaaaggatggttgaccatggtggcgaatgtccattcaccagtgacggatttgctcaaacagcaacagatcgcttttcaagtgattgaaattccattaagcgaagataaaaaacctatccggcatttggaagagctgctttttgcgcagggactggatccgcaatctgtggtgcgcagcgtcgtgttcaaaggcgaaaacagtggattttgcttattggccgttgccggcggagggc

SEQ ID NO: 78414 - DNA, 285 bp, Glycine max
  Peptide Sequence Number=SeqID_170099
atggctgatgagcaccagcaaagggttacccttgaggattattcaagcagttcagtgccgcaattctttaccagcattgcacgtccggaagtgcaagctcacaacataaactaccctcattctttgattcatttaatacaggggaacttattccaaggattaccaaatgaggacccctatgcacatttggtgtgccagatgaagccattagactcagtctattttcattttccttggcaagagaagccaaaaggtggctccactcatttaagggtaacagtctga

SEQ ID NO: 78415 - DNA, 609 bp, Glycine max
  Peptide Sequence Number=SeqID_170100
atgactggaaggattcttttcggttcattggcttttgagagccgcatcattcattaccttattgttcgcatcttgcttccaagatcttcagaccttgcacaggtttctgaagaagatcttattgttatgtgggcttttcataaaggccgacaaattgattgggcacacttagtccgatatcgcatgcataaggcattgcgattaaatgcttcattgccatatccacatctagtcaccctcttccttcaacactttaacgtccctcttgattctgaaccttatgttccaatcaagagatcctttctaataggtgctgctgtcattgcatcctttggttataaaaaagagcatgatggctcttgggtgaaaaagggtgctcgacctgttgatgaagaaggacatggtggagaagattcctctcttcttcaaaagattttggataggttcgatggtcttcaaacctttgttggtgaaaggtttgatactttggagttacaagtggacatgcgatttaatgagatggagtcaagaatcaccaaggtcggagaagatgtttcttatatttgtacaagctttgatctaccaccactgctgccaccatcatcttag

SEQ ID NO: 78416 - DNA, 877 bp, Glycine max
  Peptide Sequence Number=SeqID_170101
atgggggatcctgtggtaatcgatgaggttttcattgtgccgggtttcccgccgctgcgccattgcgggcgggatgtgttatcttacgcgccggaaataccttcaagagagcccgtcacggtggaaaaaaagaaaaccttcccgcagcagaaaagcggcctgcatccgcgcaaccgtcatcgttcacgctatgacttcccggcgctgatcgccagctgcccggcgttggcgccgttcgtaaaaccgaacgcctggggcgatgtgtcggtggacttcgccgatccggcggcggtgaaaatgctcaaccgtgcgttgctgcagcacttttacggcatcgaacactgggatattccggcggactacctgtgcccgccgatccccggccgcgccgattatctgcaccacctggcggatctgctggcgaccagcaacggcggcgagatcccgcgcggcaagggcgtggcgatcctcgacgtcggcgtcggcgccaactgcatttacccgatcgtcggcctgcgcgaatacggctggcgtttcaccgggtctgaaatcgattcggtgtcgctcaacgcggccaaaatgatcgtcgagatgaacccgacgctgcgcaacagcgtgcgtctgcggttgcaaaaacagcctgagctgatttttagcggcatcatcggcgcggccgagaaatttgacgccaccctgtgcaacccgccgttccacgcgtccgagcaggaagcgcgcgccagcacccgccgcaagctgcataaattgggcaaaggggaagtggccgacaagccggtgcaaaacttcggcggcaagaacaacgaactgtggtgcgaaaggtggcgaagaagccttcgtgcgcaagatggtggaagagagc

SEQ ID NO: 78417 - DNA, 1203 bp, Glycine max
  Peptide Sequence Number=SeqID_170102
atggatgaacgactacgctgccgggcaatgcgcgggccggtgcctgagcctgcacgtcagccggcgcaacgtggatgcgctgcgcctgtatcggcgctgcggttttcaggtgcggcgagaagagcattacgctgcgttgggatggctgttcggtcaggccgactgggtgttgatggagagacgctgcggggaggcgacgtgcgcaaaataggactgtgcagcgtggtgctgttcctgctggcgttcggctgggtcattttcgtcaacgactttcgcttcgtcactgaaccggtcacggtgaccgccggcggcaaccggctgaccggcacgctggtgttgccgcagcatgcgccggtcaagcccggcgtcgtggtgttcgtacacggtgatgggccggctaacgccagccgcgacgaaggctattacggcatttgggaggcgatggcgcagcagggctacgcggttttatccttcgataagccgggcgttggcggctccggcggcaactggctgcatcagaccatggcggatcgcgcgcgggaaaccgccgatatcatcgactgggcccggcgggacgggcgcttcgatgcgcgctgcgtggggctgtggggcaccagccaggcggggtgggtgatgccggcggtggcgcgtttgcgccccgacatcgccttcacgctggcgctggcgccggcgatcaactggctgcggcaagggcgttataacacccgggcggcgatggcggcggcaggggatgatgaagcgctgatccaggcgcgcgaggcgcattggcgccacattcagacgctgctcgaacagccggacggctacgcgcagtaccgccgcgagtatggcgccgccgctgcattgagcgccgaccgctggcactttatccgcgctaacatggccagcgacgcgacggcggaattgcggcatttcaccacgccggtgcacctgatcctgggcgggcgcgacgtcaacgtggacgcggacgaaaccgagcgcgtgtatcggcaaacgatcccggcctcgctgctgacggtgacgcgcatcgacgaggccgatcatgtgatgatcaaaccgttgttcgcccgccatccgtggctgatcaacgtggttggcctgtttgcgccgcgctcggtgcaatacgacgcctaccgacaggacgtggcggcctttctggccgctcagccctgcgggcgctaa

SEQ ID NO: 78418 - DNA, 321 bp, Glycine max
  Peptide Sequence Number=SeqID_170103
atggttatgggggatcccatcagcagactctccttccctgaaaacaccgagactttttcaagtctcacaagttatccagaactacgtaggtctgagttcctcattggaggatacgtaggagcaagagcctcgcttttgtcgaccacaccgtcttttgttgccatgactcaagagctggtagcccgcggagacaccttacggttatccgcacctcgtcattcagtgaccccaagtgtccgatggcacgcagagaccaagtttggtcattctgcacccatgatacgcggagataccttacggttatctgcacccctttgctag

SEQ ID NO: 78419 - DNA, 153 bp, Glycine max
  Peptide Sequence Number=SeqID_170104
atggaggagatacatggagaagaagatgaagaacaaggaattaaagccttggatcttcttcatcaatggagtcctttgcttcttgaagatcaatggcagcgaaatgtagaaggaagaaagatgattggagacgccacttcaaggagaagatga

SEQ ID NO: 78420 - DNA, 174 bp, Glycine max
  Peptide Sequence Number=SeqID_170105
atggagaggtgcgcttcacgattccgaaaatggcttcctttcgcgatttggaatagaaatggtgtgcaaaggttgaagctttgttggagcttcaatggtgaggaagaagaaaggaatagcaacgtgagaaagagatcacaagaagagaaaaatctgacctttttgaaacgctaa

SEQ ID NO: 78421 - DNA, 315 bp, Glycine max
  Peptide Sequence Number=SeqID_170106
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggtttccatagctgaagaagccatgttgaagtgtttgggagaactttgtctcgtgaaaaactga

SEQ ID NO: 78422 - DNA, 435 bp, Glycine max
  Peptide Sequence Number=SeqID_170107
atggcttctccacctgcctcccctcctcctcctcttgctccttccgacgcaccggcttcgccatttgccgtgaagcggacacgcaaagcctcacgtctacgatcgttgtctactagaccacttggtgctgagagaccagtggtccatgttgatcctgctattgacaaggccgacggtccccacaggaagaaattaagaacatatttggggattgtggcgcatgataaggtggacgtcacctacgagaactggaaggaggtccctactgctcagaaggacctgatttgggaggatattcaggatgtgtgcaaaaaggcacaggccatccagaagcagaacactgtcccccacgttttgtctcgtgggggttatgactatttggagcagaagctcttggctgagaagacgaagaaaaagctggaggaagctgcataa

SEQ ID NO: 78423 - DNA, 183 bp, Glycine max
  Peptide Sequence Number=SeqID_170108
atgccaaaagatagggggacttgtcttgatttcagggattgtcatcatcaaaaagggggagattgtggacaaaggatcaagctgaatgttttgatgatgccaaagtttcacatgcgtctcaaagctttattcaagacaaagaaattaaagatattcaagatggatgatcaagacagtctctag

SEQ ID NO: 78424 - DNA, 387 bp, Glycine max
  Peptide Sequence Number=SeqID_170109
atgagtgatggattttgcggtactcatttacagatcatggttaataccagaggattaggtcgtgccttaggtcaggtcactctcagaggtgtgggcagaggagatcatgatgattccgatgatgctccacagcgtcgacgacctactgcatccgcacggaggcagcgagtcgctgtgactgcggatcacatcgatgagccagtcatcgctgacccagacgttcaggatgacccgatggaggcaccagctgctgtggaggacattcatgcggacgcaggcgcagaggcggctgaggatcagcctcagggattttcgggtggtccgagcgacccatctgtgctgacagcgtatgaggatcacgttgcttgcagcgtatggacgggagag

SEQ ID NO: 78425 - DNA, 297 bp, Glycine max
  Peptide Sequence Number=SeqID_170110
atgaagcaagccctattaaaatgtattcgtgtaggtccaagcccaatatggcataaccgtgtgtggaagttagttagaggagagacaataagactagtgttctgtcatatgggaggggtatggaattgtaagttctacgctgaatttggaaatagaactgggagctctgagagcctttctcaagcttgggggagcatttgctctcatttggtcaagcaagtgaagcctgacgttctcctaggattatcggctgttggaggattattctcaaaagaggtatctagactgatgctttaa

SEQ ID NO: 78426 - DNA, 295 bp, Glycine max
  Peptide Sequence Number=SeqID_170111
atggctccgaagaaactctccacgaagaggtctagaagagacgccgcagcagaagggtccagtgccgcccctgagtttgatagtcatcattttcggagcgccgagcaccagcagcgtttcgaggccatcagaggatggtcgttctgcagagaaaggcgtgtccagctcagggaggatgagtatacagactttcagaaggagatagctcgcagacaggagggagtgcgagacatgcgttcatgggtgaggggtcagtggattccctttgatgcagatgccctcagccagttcctgg

SEQ ID NO: 78427 - DNA, 399 bp, Glycine max
  Peptide Sequence Number=SeqID_170112
atgccgatctccccctgcggaaggatcgcacccacaaagacacctagtggacccggagaagtccaacagggccctggggtttccaactctgggatcgcacctgcaagacacccagcggacccgaagaagtccaatagggtcttggagttgccagctctgattacgggcctctatcagttctacggagtgcctgtcgcccccagcaagtcatcaggccccctactaatcgagtttcatcaagaagtactgcgtccccaggcaggcgcagggctaaacaccacagcagcctggggatggtcggcagcgggcaacagacgcaccgccatcacctctagagttcacctcagctcatccacaaaaaggttagagcgttgcttacgacccatggacgaccaatag

SEQ ID NO: 78428 - DNA, 387 bp, Glycine max
  Peptide Sequence Number=SeqID_170113
cttgtcactctctttttccgccattttcaaattccttttgattatgaaccttatgttccaatcaagcgatcttttttaattggtgctgctgtgattgcttcttttggttacctcaaagagcgtgatggctcttgggtcaaaaagagtgttccacctgctgatgatgaaggtcacataccagttgaagataattccactcttcttcaaaggcttatggacaagtttgatggacttcagacttttgttggtgacaagtttgatgccatggaattgcaagttgacatgcggttcgatgctatggaatcaaggaccactagggttgaagaagatgtctccttcatccgaacttgctttgatccaccaccaccgcctccttcatcttcttag

SEQ ID NO: 78429 - DNA, 369 bp, Glycine max
  Peptide Sequence Number=SeqID_170114
atgggtaaagaacactttcgacaagaaggtacgcccgtgcaaattcaacgagggagacctgtgatgcaatcctaccccacaagggcattggatagaaaactccaagtagattgggccagagatgcaagagaaggccctagggttcttatgagccttagggtagggtaccctagaaatataggatcaaaagatcaaagaacaactcaagtgaatcaaagaacatctcaagtgaatcaagaacaagtcaagagttcaagaatcaagaagaattcaagactcaagaagaaagcctacaatcaagaatcaagattcaagattcaagatctcaagaatcaagatcaagattcaagactcaagattcaagaataa

SEQ ID NO: 78430 - DNA, 1108 bp, Glycine max
  Peptide Sequence Number=SeqID_170115
ttcttaccgttttatactacttgcgcgatccggtgcacttgccgagttcgaacagaaagccacaacatcttggccccacaagccctatgagaccaccaggtttacatctgagggtgcctgggagcgatattctcaaaacattcactcccggaacatcctttcagagaggaatgttaacctctttgtgacagagtacgatgaatttagacgagagctaatcagaagaaactgccacaaggccttgacccagcacatggacgggcacattgatgtggccctggtcaaggagttctactcgaacctgtataaccctaaagacaaatcaccaaaacaggttcaagttaggaggaagctgattaagttcgatgcggcatcactgaatgcctttctggagacaccaccactcattcagccaggggagcagagcaccctggaagctcttgaggaaggatctgactacactagcccagacctggagtgtgttatcatactccaaccttgccccaacttctcatacggcgaggttagtctatgggctagttttgaagatggacatggatgtgggcttcctcatatcacaccagatttctcagatggcctagtccaactcctcgcggctcggcttcccagccctcatcaccgccttatgcatcgcccaaggagttatctcggattctctaactttcgagcacgggctcgaggatctgaaggcccatcttcgtctgctcctgctcttgcttctacttctgctcatgcctccagtgatccaactacctctacttctcatccaccatcatcagttccagcaccctctggcacctctgctcagagcttagacctcacagtgccgatgctgcagagcctccaccatggcttacgcctggtgatgcagagtatccacgatttggctcagcatcaacccatcatgagcatggaggagttcacaactcaggtggcctggccaggagtccaaccttctcctttgaggggaggtgaggcctctgcagcccaggagcctcattcacagccagaggtctctgaggaggaggagaatggcgctgctgatttggattatgtagctgatatgaccgcagcacagagcacctag

SEQ ID NO: 78431 - DNA, 1281 bp, Glycine max
  Peptide Sequence Number=SeqID_170116
catactccggacccggagagcggggccttttatgcccgtattcgtcatgagcgttatctcaaccagcagacgcggctgaatggggaaaccaactgcgcggcgctggctcccggccagcagctaaaagtgagcggcggcgaagaggtgacggacgtctggcgccagggggtggcgatcgctgcgattcactgccgcgcccgtcgcgaccgcagcttcgtcatgacgtttcaggcgattccctgcgtagagacttactgctttcgcccagcggtcatcagcaaacccagaatggccgggacgctgccggcgcgcgtcaccagcaccaaaatcaacgatctctatggccatatcgatcgcgacggacgttatcgggtgaacttattgttcgatcgcgatcgctggcagccgggggaggaaagcctgtgggtgcgccaggcgcgcccttacgccggtgaaacctttggcctgcatctgccgttgttagcgggcaccgaagtggcgatcgcttttgagcagggggatcccgataggccctatattgccggcgcgctgcacgactccacgcaccaggaccacgtgacgctctacaactacaagcgtaacgtgctgcgcacgccggcgaacaacaagattcgcctcgatgatacacggggtaaagagcacgttaaggtcagcaccgaatatggcggcaagagccagctcaacctcggccatctggtggatcatcagaacacgccgcgcggtgagggatttgagttacgcaccgatagctacggcgcgatccgcggcgggaagggaatatttattaccgccgatgaacagctgaaagcgatgggcgcgaccgtggaaatggatcccgcgagtcaattgctcggcagtgccgttgttcagctcaatgactggcaggagatagcccgcacccactacaacaccccgccggatgtcagcacgttaaagcagttcgtcggcaaagccgtcaacctggcgagccccgtcctgctgatgagcgcgccgaaaggcatcggcatccaaaaacgcaatctcgctgctgtcccaccgggaagggatgcgcatggtatcggtgaaaggaccgctggagatagagtcgcacggcgacacactggcgctcacttcactgaaggatattaccgttcagtcaacgcagggacatctgcagcttaccgccaaaaatggcatcaccctgggctgcggcggcggctacattcgcctgacgccgcagggagaaattcatcttcacagcccgagtctgctcagttttaa

SEQ ID NO: 78432 - DNA, 504 bp, Glycine max
  Peptide Sequence Number=SeqID_170117
atgtctaccagtttgtggtggggacatcacaaaatcgtctgcagaatccttggaagcagcatctttgtacgagcaggcagcaattatttccttgtttattgtgccatgcacaatgtcaacaactttaacataaaagagatgaagaggtgccctcttacgaacaaagaggataggcttacaggcataagtgtccctcacctgagaagtgcttcacaggcaaatgctcttccagtcattggagtcaatcttgtagaaagcataatactcctcctttgtgatctcctaaggctctgtcatccaaatggccttatccttctttttgtagttgtgaaaacaaagtcctctaaaggtttccccctcacgaaggatttttcctttcacagcaaactaatgttcaatttacgaatgaatgataaccaaccattagtacctgtccataattcacacgggattgctctttcccaaatctgcccgaacaacttgaatggaaatgttttgacataa

SEQ ID NO: 78433 - DNA, 189 bp, Glycine max
  Peptide Sequence Number=SeqID_170118
atgacggaggcaaccggaaacaatggaagggatgaactagctgtgacgtggaacaggagtcacacaaagcattgcaaactaaagcaaaaggaagggcacgacaatcgagtgaaaagcatgaggaagtatgctacggacaacaactgcaaaaagaaacaatactccaatacgagattaggttccacttaa

SEQ ID NO: 78434 - DNA, 1800 bp, Glycine max
  Peptide Sequence Number=SeqID_170119
atggaagttccttcggaagcgccgccgtctaccggcaccggtgaaaccataagcaaaaatgcgctgaagcgggaactcaagaacaaacagagagaagaagatcgcaagcgcaaggaggaggagaaggccaaaaaggcagctgaaaagcttgaaatgcagaaggataaggataacaaatctgcacctgctgatgaagatgatatggaccctactcaataccttgagaataggctaaagtatcttgcagttcaaaaggcagaagggaataacccttatcctcacaaattctccgtcactatgtctcttgatcaatacatcaaggaatatggaggtttaagcaacgggcagcacctcgaggatgtctctgtgtctttggctggcagaatcatgcacaaacgtacctctggttctaagcttgtcttctatgacctgcacggtggcggtttcaaggtccagcttatggccgacgcgagtaaatcggacttggatgaggctgaattttccaaattccattctaatgtgaagcgtggggacatagttggtatcactgggtttccaggcaaaagtaagaagggtgaacttagtattttccccaagacttttgtgttgctgtctcattgtttgcatatgatgccaaggcaaaagtctgctgctgctgctgataatgcaaatttgaagagaaatccatgggtaccaggaagtaccaggaatcctgaaacatatattttgaaagatcaggaaactaggtatcggttacgccatttggatttgatgcttaatccagaggttcgagaaatattcaagacccggtctaaaatcatttcttatattaggaggttccttgatgaccttgatttcttggaggttgaaacaccaatgatgaacatgattgctggtggagctgcagcccgtccatttgtaacacatcacaatgatcttaacatgaggttattcatgaggattgctccagaactttatcttaaggagttggttgttggtggactggatcgtgtttatgaaattggtaaacaatttaggaatgagggcatagatttgacccataatcctgagtttactacctgtgagttctatatggcttataaggactacaacgacttaatggatataacagagcaaatgttgagtggtatggttaaggaacttaccaaagggagctataaaatcaagtatcatgctgatgggattgacaaggaacctattgaaattgactttactcctccttttagaaggattgacatgattgatgaattagagaagatggcaggcctaagtattcccaaagacttgtcgagtgaggaagctaatcaatatttgaaggacgtgtgcttgaagtatgagatcaaatgtcctccccctgagacaactgctcgtttgttggataaacttgttggtcactttttggaagagacatgtgtaaatcctacattcataataaaccaccctgagatcatgagtcctttagcaaagtggcacagatcaaaacctggcctgactgaacgttttgaattgtttgttaataaacatgaactttgcaatgcatatactgaattgaatgaccctgtagtacaacgacaaagatttgcagaacaactcaaggatcgacaatcaggtgatgatgaagcaatggccttcgatgaaacattttgtacggctctggagtatggtttgccacctactggtggttggggtttgggtattgatcggttgaccatgttactgacagattcacagaatatcaaggaggttcttctcttccctgccatgaaacctcaagactga

SEQ ID NO: 78435 - DNA, 447 bp, Glycine max
  Peptide Sequence Number=SeqID_170120
atggcaaagatgtggacagatcctctatttattgggagagttataggagatgttcttgactctttcaccccaaccataaaaatgaccgtaacttacaagaagcaagtctacaatgggcacgagttcttcccttccacaattaccacaaggccgaaggttgagattggtggaggagatatgaggtcattctatacactgattatgactgacccggatgtccctggtcctagtgatccttacctgagagagcatttgcactggatggtgacagacattccaggcacaacaaatgcctcatttgggaatgtgttggtgagctatgagatgccaaagcctaacatagggatacacagcactcgcaaattctcagctgagaatgaccttggcctccctgtcgcttctgtctacttcaatgcacagagagaaactgctgcaagaagacgctag

SEQ ID NO: 78436 - DNA, 285 bp, Glycine max
  Peptide Sequence Number=SeqID_170121
atggattatcaaaatgaacaagaatgtggtgtgaatgaaccacatgttgattgttcggatgcttttaatacttctcaggctcgatcagttgctcataaaaatggatttgttgcagtcattatgaggaagaaagattttgttagaagagatactgagagtaggaaatgtgagtgtcccttcaagcttcgtgggaaaccagtcattggaggtaaaatgctcggtgcaccagcaattgtgctgggtgcacctagcaacaccctgaaaggagtgatgaagttggcttga

SEQ ID NO: 78437 - DNA, 237 bp, Glycine max
  Peptide Sequence Number=SeqID_170122
atgatatatgctaggcttgaggcgtcttccatggatggagcggtgggggagactaccatcttaaagagactcacacttgagggggagattgttggagtacaaagcatgttggcaacaatggctagacgagctagggtagccacggttaagctctacgggtcactattggatactcgtggattgaaaatggctttcactcgaagggtagactaccatgtggaagagactcacacttga

SEQ ID NO: 78438 - DNA, 207 bp, Glycine max
  Peptide Sequence Number=SeqID_170123
atgactgttcgattatgtgaccaacttatatggagaaaggtcgcaaacacaggcagggaaggaggagccatgactgattcgaaggtggttaaagctaaggattctgtcgatggtagtttagtggttggagggtgttgtcgatggtgctttggtagttggagaatgtcattgacgatgtgtagtggaagaatgcttagggtttcttaa

SEQ ID NO: 78439 - DNA, 547 bp, Glycine max
  Peptide Sequence Number=SeqID_170124
gggcattgcacaggccgaaaggcatcctcctataggcaaaagtgtcgaaggggcaggtgaatgtggtcttttcctgatcctcaagagcaatagtgatttgcatataaccagaaaaaccatcaaggaaacagtagtgagatttacctgccaggagttccagcatctggtcaatgaatggcaggggaaaatggtcctttttggtaacttggttcagcctcctatagtcgatgcaaactctaaaactgttctgcacccgagtaggaatcaactcctccttctcattttttatcacggtgaggccagttttcttcgggactacctagatgggactcaaccattggctgtcggagataagataaatgattccagcttgcaaaagcttggttacctccttcttcactacatcaagaatcaccaggttgagtcttctttggttcatcctatatcctttgatgcaatcctacccccaagggcattggatagaagactccaagaagattgggtcaaagatgcaagagaaggccctagggttctcatgagccttagg

SEQ ID NO: 78440 - DNA, 774 bp, Glycine max
  Peptide Sequence Number=SeqID_170125
atgtatgaatatcctaggagaacccgcgcattaacgcgtaggcattcctttcaaaattcgtatggatattcatgctttgttggaaaaagggaaatggctccgaagaaactctccacgaagaggtctagaagagacgccacaggagaagggtctagtaccgcccccgagtttgatagtcatcgtttccggagtgccgagcaccagcagcgcttcgaggctatcaaaggatggtcgttccacagggagaggcgtgtccatctcagggaggatgagtatgcggactttcaggaggagatagctcgcaggcgttggacaccgctggtgactcccatggccaagtttgaccctgagatagtccaagagttctatgctaatgcttggcccacggaggagggagtgcgagacatgcgttcatgggagaggggtcagtggattccctttgacgcagatgccctcagccaattcctgggtgacccgctagtttttgaggaaggccagcagtgtgagttcagccagaggaggaacagggttgacgggttcgatgaggaagccattgcccagctgttgtgcacaccggggcaggattttgcccgaaccgctgcagggaggcgggtgcagatcatgcgcaccatcatgaccactttgacccagacatggatgacactgctgctcagcaatttcttgcctagcgatcacaacttcgatctccctctgcctaagtgccagttggtgtatgccatactgacacggatgagcgcccacgtggcccagtga

SEQ ID NO: 78441 - DNA, 699 bp, Glycine max
  Peptide Sequence Number=SeqID_170126
atgacgaaagataactcaaagccttacactggggaaatgaggggcatcttgcatgagcctcaaagggcttcacgccttcaccttcagaggactacacctcctcgccatcagagggctacgcgccctcgccttcgtagggcaagcactccctcaccttccgaggactacatgtcctcaccttcagagggctacacgccctcgcctttcatagggctacacgccctcaccttccgaggactacatgtcctcaccttcagaaggctatacgccctcaccttcagaggactacacgtcctcgccttcagagggctacacgtccttgccttcagaggacaacatgtcctcgccatcagagggctacacgccctcaccttcagagggctacacgccatcgccttcgtagggctacacgccctcaccttccgaggactacatgtcctcaccttcagaaggctacacgcccttgccttcatagggctacatgccctcaccttccgaggactacatgtcctcaccttcagaggactacacatcctcgccattagagggctgcacgccctcacctttagagggctacacgccctcaccttcgtatggctacatgccctcaccttccgaggactacatgttctcaccttcagagggctacacgccctcgccttcgtagggttacacaccctcaccttaagaggactacac

SEQ ID NO: 78442 - DNA, 345 bp, Glycine max
  Peptide Sequence Number=SeqID_170127
atgtcctttggaagcagattgtgcactacctccagcagtgaggtaaagcttttgtcactccacccatacctagccttcacattaaccagacttaacaccatagacaacagggttaaggaattcttgcaccccgtatacaaaggcttctttgaatcactctgcaatccttcatacacagggggtgtgtgcttgctgaaaagactcttgtccaaggtcacgaatcatgtcctccaagcgatctcccatttctacatcaaatggttcagattgggacccactctgcatgtctgtcacttcaccatgccatatccacgtcgtgtaattcttcttaatcccatcacataa

SEQ ID NO: 78443 - DNA, 291 bp, Glycine max
  Peptide Sequence Number=SeqID_170128
atgaagcttgcttctacaacaccttctaagcccaaagatgataaggggaagacaatagaaaagcaagcacctaaggctagtatgcaagagaagactagctctataaagtactttaaatgtcttggaagaggacacattacttctcaataccccaccacgaaaaccatgattatgaggggccaagacatatatagtaaccaagatgaggctactacttcaccttcctctagtgaaagtgaagaagcaaaaggggaagaatctagtgaagaaatctacccccaagaagaatga

SEQ ID NO: 78444 - DNA, 465 bp, Glycine max
  Peptide Sequence Number=SeqID_170129
atggtggaccatatgtacgcctatagtggttgcgagacatataccaacacagatgtcagacgcaacactggacagatgccgctcatgcttatcttctgcatctttttgggttgcactctttttgctaataagagtgcaactcatgttcatgtcatacatttacaggccctgcgtgacctcactcttgctgggcgcttaatgatgccagtctcagcactaatcgatagcttgctgtgttggatatacgagcactttccgtcatttgcggagtgcaatgctgatctggactacgacgaggtgtcaccacgtgcgtgtcggtggattgtgacaaagaagactgtgaataaggtatctacaacgacgaacaggcaacacctggatcgtctgaggatcccagatgtctgctggatgccatatgcggagcaccgacctgtgcaggactttcatccgatttcgtgcttctaa

SEQ ID NO: 78445 - DNA, 289 bp, Glycine max
  Peptide Sequence Number=SeqID_170130
gggagatgtgttgggttacaagtgtgaggtgaagtcccacatcgggtctccttatgtggtggctcgtggtccacaggtgtacccctcgaatctccccaacaattggtatcagagccgatggttcaagttggtgaccggctcagacgagtatgcaagtaccgcagtggtggctcgtggtccacaggtatacccctcgaatctccccaacaattggtatcagagccgatggttcaagttggtgaccgactcagacgagtatgcaagtaccgcaggtggtcagaatggctag

SEQ ID NO: 78446 - DNA, 483 bp, Glycine max
  Peptide Sequence Number=SeqID_170131
atgaccatgattacgccaagctcgaaattaaccctcactaaagggaacaaaagctggatcatctttgtttctgaagcgaaagtggggtattggatatcatttaaggtatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 78447 - DNA, 602 bp, Glycine max
  Peptide Sequence Number=SeqID_170132
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaatggtggcgaaacccgacaggactataaagataccaggcgtttccccctggcggctccctcgtgcgctctcctgttcctgcctttcggtttaccggtgtcattccgctgttatggccgcgtttgtctcattccacgccctgacactcagttccgggtaggcagttcgctcccaagctggactgtatgcacgaaccccccgttcagtccgaccgctgcgccttatccggtaactatcgtcttgagtccaacccggaaagacatgcaaaagcaccactggcagcagccactg

SEQ ID NO: 78448 - DNA, 228 bp, Glycine max
  Peptide Sequence Number=SeqID_170133
atgatgcaatatgtgcaatttcagttgagcttagctcatcagtgggctaagcgtgcatccaccgctaagcgcagctttagcgcgcttagcgagaaagaagaatctggcaaggcattagcatcaaggccacacgctaagtgcgagatcagtgcactaagtgcagcaggtgtcttcagccaggctcaacgcacgactaacgctaagcccgaatccacttactcgcgctaa

SEQ ID NO: 78449 - DNA, 805 bp, Glycine max
  Peptide Sequence Number=SeqID_170134
atgtccaaatcttgtgaatttgggatgactggtcctctcgatgagtcaatctcttgttttctcataagggtggacccttggaggactgcacgtcctcaacttcaaaggattgcacgtcctcgccatcagaggactacacatcctcgccttcagaggactacacgttctcgccatcagagggctacacgccctcgccttcagaggactacacgtcctcaccttcagagggcttcacgtcctcgccttaagagggctgcacaccctcgccttcagaggactacacggctacacgccttcaccttcagaggactacacgtcctcgccttcagaggactcctgtcctcgccttcagaggaatacacgtcctcgccttcagaggactacacatcctcgccttcagaggactgcacgtcctcgcctccagaggactacctgtcctcgccttcagaggactccacatcctcaccttcagagggctacacgccctcaccttcagaggactatacgtccccaccttcagaggactacacgtcctcgccttgtagggctacacgccttcaccttcagaggactacacgtcctcgccttcaaaggactcctgtcctcgccttcagaggaatacacgtcctcgccttcagaggactacacgtcctcgccttcagaggactgcacgtcctcgcctctagaggactacctgtcctcgccttcagaggactccacatgctcaccttcagagggctacacgccctcaccttcagaggactacacatcctcaccgtcggggggctacacgccctcgccttta

SEQ ID NO: 78450 - DNA, 684 bp, Glycine max
  Peptide Sequence Number=SeqID_170135
atgggtgttaagcatctcaaagtgatcaaccaaggtccgcacgccaacaacaattgtccctggacgaaattagggtatgacacagatgacccagttcgtggatcggtgtacacatctacgaacccaatatttattgacgtcaatcgttctattacgtttacacaattcattcaaaaaattaacagccttctccctactcgagcaactgaaaaagttgctgtccctatttcatttcataagggtcagacacgttatatttcagcacaactacaagacaatgacgatctcagaggcgcgatggaaacaattctccataatccacaattgaattctaccgaattcaaagctgttagtgaccttattcctcaaccacaaccatcatcaccacaaccctcatgtccacaacaacaactaccgcctccacaacaattaccatataacaacatagacctcaataatccagtatcttcatacaacaaccttgaaacacaagacccctttgatatttatacttcatacacacaactattatctgaaaatccatcttcttttgatgcccaacaaacctcctttgaccaacaaaaccatccttcatatccctttacgccaccttcacaacaaccacaaatgcaaacatcaaatcaaaatgaacatcccatcgctaacgaagatcccattatatga

SEQ ID NO: 78451 - DNA, 189 bp, Glycine max
  Peptide Sequence Number=SeqID_170136
atgttagctatcatcaccaagtaccaagaagagcaaagtctagccacggcccacgagcatagggtggcggacgagtatgcccaagtgtacgtggaaaaggaggctagaggaagggaaaaacaccataacttaacatgccacaaggcatccctatctgatgcaatcctaccttgcaagggcattgggtag

SEQ ID NO: 78452 - DNA, 288 bp, Glycine max
  Peptide Sequence Number=SeqID_170137
atggcctctttagattctctgtctttcaaaagtattttcaggaacaggatattccaagatgatgatgaagaccaagtcaacttgtgtctcatgacaaaatctgatgagaataacaaagaagaatctgcaaggaagaagtggtacatttacagtggatgtttcaagcatatgacaggagatgtatccaaatttacaaccattttccccaagaaaagtggacatgttacatacggcgacaacaatattggtaaaatctcaaaagaggtaacatctaagccatctctatga

SEQ ID NO: 78453 - DNA, 888 bp, Glycine max
  Peptide Sequence Number=SeqID_170138
atggcggaggtctccatggaggccattgcctccctcgcccaatattatgaccagcctttgaggtgcttcacctttggggacttccaattaacacccgtggtggaagagtttgaagagatcttgggatgccctatgggaggaaggaaatcgaaagacgccataactaagtgcgccccaaggcatccctattgcaccagatgcaaatctaggacgatgggtgacctagaggaagtacaggaacagatgaaagccgacatgtcggctttgaaagaacaaatgggttccatgatggatgccatgctgggaatgaaacaacaaatggagagtaacgcggccaccgccgccgctattagttcggttgccgaggcatacccgactctcccgactgttgcacaccaccctattccaaacatggtgggacgagagagaagcacaccggggcatatcagcaacccccgtctgaggtacaaccgaggaacttacccctacgacttaccacctaattacacaccaccaaccatacttgacgacgcgggtcacgttcctcccctcatcctcgaaggggagcctcctcgacatcctgacgaggtccacgaggatcatcgagagcatactcaaggagacgtcgactcctactccccgtttcccaccgaggggccgacgcccaatgcactacctcaagccaacatcacgggggaacctcgaagccacccaacacagccaatgtttctgtccgtggaagggccacccccggcagtggaaggaaaggggaaactcgatctcatcgaagaaagattaagggctgttgaagggttcggaaattatccattcgcagacatgaccggcctatgcctggtgccggacgtcgtcatccttccgaagttcaag

SEQ ID NO: 78454 - DNA, 384 bp, Glycine max
  Peptide Sequence Number=SeqID_170139
atgagaaccacgcatggtcttccttgtgcatgtgagctatctaaatatgttgttggttgcatcccactagattcattccatatgttctggaggagactcagtttttcagaccaagggttatctgagcccgaagtgagcatcaaggaagagacggaaaccatatccaaaagatttgaagaacttaatgtttgtggtgcaccgaagaaaccgatgaacagaaacccaaggtcaacaaagcgtgatccatcttactgggagtatgtagatgcttttcattctgtgcaaaatagcaattcgtcagtgaggcgtagtgcatcatcttctgaccagcccaatccaagaaaggtcatgcctatgttggatcaatttcagccatttatgtag

SEQ ID NO: 78455 - DNA, 295 bp, Glycine max
  Peptide Sequence Number=SeqID_170140
gaaaacatcccttagcaccgccatacctcttgagcttgaggttattcctcaagtaaaggagttgttggatgagggtttggttcgtaagagcttaaatccttgtgctttgttggtgcccaaaataggtattatgaggcaccaaatccctatgataggtggaataatcaacatgaaaataaagaaaaaggtgttgaggaaagaatccctagagtttcaagaacctctggatttaaggtcaaatccttttcaagggggagggaatgatgcaatcttaccccccaaggacattggatag

SEQ ID NO: 78456 - DNA, 838 bp, Glycine max
  Peptide Sequence Number=SeqID_170141
gagctaaggaagctaaaaaggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcagttcatcatgccgtttgtgatggcttccatgtcggcagaatgcttaatgaattacaacagtactgcgatgagtggcaggcggggctggctgctgccagtggtgcttttgcatgtctttccgggttggactcaagacgatagttaccggataaggcgcagcgacaaacgcggccataacagcggaatgacaccggtaaaccgaaaggcaggaacaggagagcgcacgagggagccgccagggggaaacgcctg

SEQ ID NO: 78457 - DNA, 799 bp, Glycine max
  Peptide Sequence Number=SeqID_170142
atgaggggagcaccgacggaagaaagcctgtctcttttccttgtgggagattttggcgcgcaaagtttcaaggttatacaaagagtccataaggcgtggaaaagcccgttaaggaaagataaagaacttaggggcattcgtaatggcatcattggtggttatcatgaatggctgaaagttcatacacgaggtttagattggctcgccaagttaatgattgtcaacgaagagaacttcgaagctccggaagaggatgaagaagtccgagctctaaaagccgaactaggaaaaatgagacttgccaaagaaaagttcaagttggtcgctatagacgtccgaaaagagtgtgttgagttacgagaagaaaatgcagctaccgcaagagcccttgaacaagaaaccaagaggactcgcaaggaagagcatggccgagacaaattccgtggagctttgtggggcagcaacagtgagctcaagcttcgaagggaagagagagaccaatcacgagcacatagcatggtcttgaaaaaggagttagctgcttgctcaagcaagtaccaagaagaactaaatctagccacggcgtacgagcataaagtggcggacgagtatgcccaagtgtacgcggaaaaggaggctagaggaagggtgattgactcgttacatcaagaggcaacaatgtggatggaccgatttgctcttacgttgaacgggagtcaagaacttcccctaaccagggccaaagcaatggcggacacctactccgcccccgaggagatctacggacttctcaactatt

SEQ ID NO: 78458 - DNA, 948 bp, Glycine max
  misc_feature (740)..(740): n is a, c, g, or t
  Peptide Sequence Number=SeqID_170143
atgctggaaaccggcatccgcatcccgtcgatgtgcctctccggccaccggcgctttccgtttggcagccacgatccggcgctgcgacagcgcgccttcgacgtgatggaacaggccattcagctggcccaagacgtcggtatccgcaccatccaactggccggctacgacgtgtattacgaagagcaggacgaggggacgctggcgcgctttagcgaaggcatgcagtgggcggtagaccgtgccgccgccgcccaggtgatgctggcggtggaaattatggacaccgcctttatgaactcgatcggtaaatggaaagcctgggatgccctgctggcctcaccgtggttcacggtgtatccagacgttggcaacctcagcgcctggggcaatgacgtgccgcgtgaattggagttgggcatcgatcgcatcgccgccattcacctgaaggacacctacccggtcaccgccacttcgccggggcaattccgtgacgtgccgtttggcgaaggctgcgtcgacttcgtcgaggtgctggaggccaatctcgatctgccgcgccataagctggtgacctttacctggggcaacgtcagcgcggtggatcgcgaacgcggtctggtggtgatcaagccttccggcgttgaatacgagcatatgacggcggaggatatggtggtggtcgatctggccagcggccgcaccgtcgagggggcaaaaaaaccgtcgtcggacaccgncacccatctggcgctgtaccgcgaatttgccgatatcggcggcatcgtccacacccattcgcgccacgccaccatctgggcgcaagccgggctggacatccccgcctggggaaccacccacgctgactatttttatggcgctattccctgcacgcgcctgatgacccaggatgaaattgagcacgattacgaactggaaaccgggaag

SEQ ID NO: 78459 - DNA, 318 bp, Glycine max
  Peptide Sequence Number=SeqID_170144
atgtcaatttgcgccctccacggcaaacccgcccgctcccactatcgggtcgtcgagcgtttttatcgtgaagcggagggcgggatctcgctgccgctgacgcgggtgcagctcaccccagagactgggcgcacccaccagctgcgtattcacagccggcagttgggccaccctattttaggctgcgatctgtatggcgggcgtctgctgccgggtaccgaacagacgccgcggctgatgttgcacgccagcgaactggactttgtgcaccccatcagtggagagcggatcgccgctcgtcacgccgcgccgttctga

SEQ ID NO: 78460 - DNA, 978 bp, Glycine max
  Peptide Sequence Number=SeqID_170145
atgaatagagactttgcctttacgattaagagcagttctttcgatgaagattataacccttctgaaagtacgcgtatcaccaccaacttcgccaatttggccagaggggaaaaccgccgggagaacctgcgcaacacgctggtgatgattaacaatcgcttcaattcgttggcgcattgggataaccccaaggccgaccgctattcggttgagcttgaaatcatttcggttgagatgcgcgttgaagatcagggggccagcttcccggtgattgaaatcctgaaaaccaacatcattgataaaaaaacgcaaaagcgtcttgagggcatcgtcgggaataacttctcgtcttacgtgcgcgattacgactttagcgtcctgctgccggcgcacaataaaaacacggcggaattcaacattccggatgatttcggcgatttgcacggcaatatctttaagcacttcgtcaattcaaacgcataccatgagaatttcagcaaaccgccggtgatctgcctcagcgtgtccagcaaagacacctatcatcggacgggcaatcaacatccggtgttcggcgacgagtatcggcaagacggcgcttcgctgaccgaccggtattttaaaaaaatgggcctgcaggtgcgctatttcatgccgaaaaatagcgtcgcgcccttggcgttttatttccccggggatttgctgagcgattacaccgatctggagctgatcggcaccatcagcacgatggagaccttccaaaaaatctatcggcctgaaatttacaatgccaactcggcggcggggcaatgctatcagccaagcctgaataaccaggactattcattaaccaagattgtttacgatcgcgaagagcgtagccagttagcgattgagcaggggaaatttacggaagagcaatttatcaaaccctacaagcccattcttgagcaatggtctgctcactacgcgctttga

SEQ ID NO: 78461 - DNA, 345 bp, Glycine max
  Peptide Sequence Number=SeqID_170146
atggagtgcctagagggagtttgggagaccctcgaaggcaacacaaggtgccgatttcgaggcaccattcgattcacggctacttctttggtgcatctagatgaacctgcacggacgcttcagcgcacggtggagtggatactacccacgcctacaccatatcgtctactggagccagtccaagtgatcgaggtgacgtcatccgaggaagaccctgaggaggatcttgaggagctacctcttgagcctgctgtggatgctcttgactttctagagggtgatgaggatccacttcttgaggtggatccacttcagtgtttgggcaaagaattctcagacggatag

SEQ ID NO: 78462 - DNA, 770 bp, Glycine max
  Peptide Sequence Number=SeqID_170147
atgcaatctcagggacttgcactgcctcccgagcctctggttggtccctccggtcctcgagtaagcacaaaggggagttatgttgatccctcaggaaacgatcttgagacgggtgactcagataggtgcggcttgtacattgaagcagatcatgcccgcctggttgccctagggagagtttatgagggatccactgttgttcataacactcatttgttgcctagccaagtaaaggtgggtgtggaggagggtacagatgcagatgctccagttcctgtatccactgatgaggtttccttagtggggcaggcacttcacaccttccttgcttggccgacacatctggtcaagtctttatcacagcaggttacatgggatgccaccgtattcggggtctttaatctagatttcccgctctacataaagtacgaagatctctccgaaatcgcacacggtggtcaatgtcttagcatatcactgttacagttgtggattctgcatctcactgaaacaagtatgcgagcggggaattctgatatctatggattcctcgagccacagtccattcagaggtctgggcaatcgcagtttgagtctgaaagttacataaagacttggatgcagagctcaaaatgcgatgtctatcttggagcctacctaaatggcggacactggcagatggtggtcatcctgcccaaggaacacctagttgtctggttttgttcattgcataacaggccagacaactaccttaaggggattattaacag

SEQ ID NO: 78463 - DNA, 1167 bp, Glycine max
  Peptide Sequence Number=SeqID_170148
cttggcaagggaattttgaagcatgggtacaggatcctttacatgtaagacctatagctcatgcaatttgggatcctcattttggtcaaccggctgtagaagcttttactcgaggaggtgctctaggcccagttaatatagcctattctgggcatttagtccatgtcgctattccgggatccaggggggaatacgttcgatggaataatttattaagtatattgcctcaccccgaaggattaggtccatttttcacaggtcagtggaatctttatgctcaaaaccccgattccaatagtcatatatttggtacccctcaaggagcaggaactgctattctaacacttctcgggggatttcatccgcaaactcaaagtttatggctgaccgatattgcacaccatcatttagctattgcatttctttttctagttgctggccatatgtatagaaccaacttcgggattggtcacagtcttgctctagcctctttaggggttattacttccttggtagctcaacacatgtactctttacccgcttatgcatttatagcgcaagactttactactcaagctgcattatatactcatcatcaatatatagcgggcttcattatgacaggggcttttgctcatggagctatattttttattagagattataatccagaacagaatgaagataatgtcttagcaagaatgttagaccataaagaagctatcatatcccacttaagttgggctagcctctttctggggttccatactctgggactttatgtccataatgatgtcatgcttgcttttggtactccggaaacacaaatcttgattgaacctatatttgcccaatggatacaatctgctcatggtaaaacttcctatgggttcgatatacttttatcttcaacgaacagtccggcgttcaatgcaggacgaagcatatggttgcctggttggttaaacgctgttaatgagaatagtaattctctattcttaacaatagggcctggagacttcttggttcatcatgctattgctcttggtttacatacaactacattgatcttagtaaagggtgctttggatgcgcgtggttctaagttaatgccagataaaaaagattttggttatagttttccttgcgatggcccgggacgaggcg

SEQ ID NO: 78464 - DNA, 3063 bp, Glycine max
  Peptide Sequence Number=SeqID_170149
atgagttcgtttcgtaaacccttcgtggccattctctgggttgttctgtttctgggtctccatgaggcagcggaaccagagaagagcacatacattgtacacgtggcgaaatcggagatgccggagagcttcgagcaccacgcgctgtggtacgagtcgtcgctcaagaccgtgtctgactcggcggagattatgtacacctacgacaacgcgatccacggctacgcgacgaggctaaccgctgaggaagcgcgtttgctcgagacccaagcggggattctggctgtcctcccggagacgaggtacgagcttcacactacgaggacgcccatgttcctcggactcgacaagagcgccgacatgttccccgagtcgagttccgggagtgacgtcatcatcggagtcctcgacaccggcgtctggccggagagcaagagcttcgacgacacgggacttgggcctgttccgagcacctggaaaggcgcgtgcgagacgggaacgaatttcaccgcgtcgaattgtaacagaaagctgatcggagcgaggtttttctcgaagggtgttgaagccattcttggtcctattaatgaaaccgaggagtcgagatcagcgcgcgacgacgacggccacggcacccacacggccagcacagccgcggggtcggtggtatccgacgcgagcctcttcggctacgcgtccgggacagcacgtgggatggccacgcgcgctagagttgctgcatacaaggtgtgctggaagggaggatgcttcagctccgacattcttgccgctatcgagagggcaatattggacaacgtaaacgttctgtctctgtcgctcggtggtggcatgtcggattattacagagacagtgtcgctattggagctttttccgctatggagaatgggattttagtttcatgctccgctgggaacgcgggccccagtccctacagtctctccaatgtggctccatggataactaccgtgggcgctggtacactggatcgtgacttccccgcttacgttgcgctcgggaatggccttaacttctccggcgtttcgctctatcgcggtaacgctgtgccggattctcctctgccttttgtttatgcgggtaatgtgagtaacggcgctatgaatgggaacttgtgtatcacgggaacgttgtctcctgagaaagttgctgggaagattgttttgtgtgaccgtgggttaactgctagggttcagaaaggctccgtggtgaaatccgccggagcgttgggcatggtgctcagcaacaccgctgccaacggcgaggagctggtggcggatgctcatttgttacctgccaccgcggttgggcagaaagccggtgacgctattaagaagtatttgttttctgatgcgaaaccgacggtgaagattttgtttgaaggcacaaagttggggattcagccatctcctgtggtggcagcgtttagctctagaggacccaactcgatcaccccgcagatccttaagccagatcttatcgcgccaggtgtcaacatcctagccgggtggtccaaggcggtgggacccaccgggttacccgttgataacaggcgcgtggatttcaacatcatttctggcacgtccatgtcgtgccctcacgtgagcggcttagccgcgctgatcaagtcggctcaccctgattggagcccagccgcggtccgatcggctcttatgacaacggcttacacagtttacaaaaccggtgagaagctgcaagacagcgcaacgggaaagccctccacgccgttcgatcacggttccggacacgtggaccccgtcgctgccctcaatccaggactcgtctacgatctaacggtggatgattatttaggttttctctgcgcgttaaactactcagcttccgagatcaacacattggccaagagaaaattccagtgcgacgcgggcaagcagtacagtgtgaccgacctcaactacccttcgtttgcggtgttgtttgaatctgggggcgtggttaagcacacgcggactctcacgaacgtggggcccgcgggaacttacaaagcttcagtaacgtcagatatggcttccgtgaaaatctcggttgaaccgcaagtgctgagtttcaaggaaaatgaaaaaaaatcattcacggtcacattttcatcctcgggttcgccacagcaaagagtgaacgcttttggaagggtagaatggtccgatgggaagcacgtggttgacattgatgatagcggggacctcgtgcttgattggtgttggttctgtttgttccctgggagaaatgttgcaaaggggaaaaaatgtttggctcatgtgtttcttttcttcccggatgaggatcagaggactttgaaaaaatcttctagaaagaggaaaactctttcttccagcaatactgatgacaagaaagctaccaagaccaagagtgatgatagagtaaagtttccaccaagatcacccaaattccaacaaccattaaagtctacttcctctcaaccttcaaagtccaaagtttcaaagggattagatgattatgatgaagacatgcctaccaattcttcctttaaactgacctcttttgctaagaccaagcgaaaggattcagatatacacgtttcgacaacggatgcaagcaatgttgaagcgtcagaagatctagaagaacaagaggatgctcaaagccacggtgaatcctcccccatcgaaatcagtgtcactctcagagccaatgaagagggacttgggttcatagatcctgttgatgtttttgtttctattttagttgtcaaaaccaatgagcctctaattgatcaaactattgtcaaagaatctcccattgtggatgtaggaaatcctcaaggggaaacagatccattggatgttgatcccctttccttcatagacgtttggctggtgtttgatcaacctcttaaagactctctttctaatccagattacaagcctcaacttcagtatgtaagagctaaaggggccctctcaagaagtgcagacacctcgagtttgctcaaaaggagtctatga

SEQ ID NO: 78465 - DNA, 750 bp, Glycine max
  Peptide Sequence Number=SeqID_170150
ctttgtcacagcttagagggaaatgttggtgcactcacaaattttgaggtccttgatttcttacgagctaaaggagcttcaaaggatccaacaagagttattaccaaagtagcgcaatctgaatacaaggtttatgattatttggttaacactcctgcctctattcaaacaagagagagcatcaatgagttcttgacaagtgttaaacaatatgacctagcaaaagttgaggttctgaacatattaaacattgagccagttgctgattttgaactatacccagtgatatattaccaaacagtttttgacaagtccacttctaccctctttgtggcttctgatcaagctggtaaggtgcctctcttttggggaatcacaactgatggatacgtagcatttgctgatgatgtagatttgcttaaaggttcttgtgcatatcacaatcctcaacattttggcaactatttgttccaagtgatcccagattggatcatttcctccctccccttcaagatgatgataattcataatatgaggatttttacattgacgctgtctatgttttgtttcttttttgtcccccggaattcagttggaggattgagatgcaatgagaatccaaagaataagattactaaaatacctgttgaggaagaggaaatctggggtgcattcttcaaggtaatcttagagcttaagaagttagagttgaatatccattatgtaactaggattgccagttgcaactaa

SEQ ID NO: 78466 - DNA, 234 bp, Glycine max
  Peptide Sequence Number=SeqID_170151
atggttgtcgtaaaaacacctatttctagtagtgtaaatgatgaggacatgaccaagagcaagggcaaggatccacttgaaggacttggaggacctatgacaagggctagagcaaggaaagccaaggaagctcttcaacaagtgctgtccatactatttgaatacaagcccaagtttcaaggagaaaagtccaaggttgtgagttgtatcatggcccaaatggaggaggactaa

SEQ ID NO: 78467 - DNA, 267 bp, Glycine max
  Peptide Sequence Number=SeqID_170152
atgccgtcggaggcggcaaagaaggcgaggacatgggtgatgaagtggcgctcgccatcgctaagggtggcccagtggcagaggtcctgcgatagaataatcaaacaaggttgcattcaagattacttcaacaaacatttaaagcttaagcattgcttcaagattaatacaaggttgcttcaacaaacaagcattgcttcaagattaattcaagatcaaactttgtctcaaaacaaagtgttttcaagacatccaaggctctggtaa

SEQ ID NO: 78468 - DNA, 237 bp, Glycine max
  Peptide Sequence Number=SeqID_170153
atgaagcaagggtcagcaaacaaccaacaagtattgtttctctctaccatgaacttgtgcatggcttctttctgcatgcttgtgagagttggtgttttgggctcttttgggcaagagtggctatgcgcaaatggcttaacaaggctagtgatgattgcatcagctagtaacgagcctaattacaccgctgaccctgatgatgatagtgaggatgaccctgaacctaaatgtgactga

SEQ ID NO: 78469 - DNA, 224 bp, Glycine max
  Peptide Sequence Number=SeqID_170154
gggttcagagagttgagcgggttgagcctaagaacaggtgggagcagcgaatgaagaatgcgagctttcaaggagttgctttcagtgaagactctgtagcagaagtgaaggccatgctcgatgaacatgctgctgggtggggattgaagaaggaagatgaacacattgtgctcacttggaaaggacacaatgtggtcttcgcctctgcttggttacctgcttga

SEQ ID NO: 78470 - DNA, 903 bp, Glycine max
  Peptide Sequence Number=SeqID_170155
atggagggatgtagtgtaagagttgaagttgtgtgtgatgcgttgcatgaacatcaggttttattagggttcgatttggccgctcttgcctctgatctcgattttagaggcactagtgaagcagatgctcctaggaaaagacttgctaaaccactcatattttgtcaaactgagagtgactgtcctatggaaaatggctatgcccaacctgttgagggcatccatgttcttgttgatatgcaaaacacaatgggatgtgattgtttgggatacatcaagtattttgacgcttacttcaaaaatttcactggtggaggggaaacaattgaaaattatgtatgtttgcatgaaaaggaccatgaaatgctctggaaacatcaagactggagaactggcttagcagaagtccaaagatctagaagacttacaatttctttcatatgtaaagtggccaactatgagtacggatttttttggcattttaatcaagcaagtagggttcatacaaagaggagaaatcacttgcatcaaaagaagatgaatgacttagtttatgtgatgtacaacttgaagctaaaaagtggccaaataagaaaattggtgctcgaacttccatttgaagatatggaatctagtgatgagtggataacaggaaatggagatgatattttttatgaagacaatgtccaagttgagcaacctctaggtgaaagtggtagtggaaacaatattgacttgattggagaaagtttaagtgatacaactttggatgcatttgatattgacaatttggttttgaatgacaatgttgaagatcacttctcaaccaaggaagagcttgaagatgatggtggtgggggtgatattggagatgatttaattagaggattgataaacatttga

SEQ ID NO: 78471 - DNA, 900 bp, Glycine max
  Peptide Sequence Number=SeqID_170156
atggaggcaaagaacatgaaatcacaccctttgatagatgagttcattcccgctattgaaggagaagatggaatttgttatacccatccagagaagcttctaggagtaacaagagatgggttgagcaagcactttttccatggaccttcaaaagcttacacaactgggacaagaaagaggagaaagattcaaaacgaatgtgacttgcaaggtggagaaaccctgtggcacaagccagtgatggtgatgcaccaataccatttggggcagcacgaggaagagaaaggagaggtaatggtgtcaaagatattctaccagacacaaccaaggcagtgcaactggtcaaataaaagtgcaataactagtgaaggaagtggagaacctaacaacaatagtactggtagaagggacagtggaagtcgaagttgctcttctaaggaaattgttactcacagatatgagatgtctgttgttgttggtgtccctccaatgacaagtttcactactcatcatcctttggatattcaacaactaaaacttgatcactttagcttcatccctttcaagaaaacctttgatgagatcagcagtggcaacaacaacaacacccttgacaggtttaacaactccatcactagttttgatatgatgggaatgggatattttcctttccagcacctcaactatggaccaaacatgggactcactattactcccaacaacactccactttgcttcataccaagttccacttcttctcaaatgatgtcagagctgaatttcaccatgttccattctatgtttccaacacatgtaaaacccactgttagtcttcactctaacaacaacaacaacaataacaacccttcttcaatatcctctgatgatgttcaaaactag

SEQ ID NO: 78472 - DNA, 1443 bp, Glycine max
  Peptide Sequence Number=SeqID_170157
atgagacttttgtccacaaaagcaacgtgcaatagtcacggccaagattcttcatactttttaggatggcaggaatacgagaaaaacccttacgacaaggtccataaccccaaagggattatccaaatgggtctcgcagagaatcagctctcattcgacctcctagagtcatggctcgccaagaaccttgacgtggcagggttcaagcgtgacggcaaaaccatattcagagaactcgctctcttccaagactaccacggtctcccttcattcaaaaaggcattggtggatttcatggccgaaatcagaggaaacaaagtcactttcgaccccaaccacatcgttctcactgccggcgccacctccgcaaacgaaaccttaatgttctgtctcgctgaacaaggcgaagcattcctcctccccactccttattacccaggattcgacagagacctaaagtggagaaccggggttgagattgttccaatacaatgcaacagttccaatagcttccaaatcacggaggcagcattgcgacaagcgtacgaggatgcgaagaagcgcaacctaagagtgaagggcgttttggtcacgaacccgtcgaacccgttaggcaccacgatgtctcggagtgaactgaaccttctcgtcgacttcatcaaagagaaaaacgacatgcatttgataagcgacgagatttactccggcacagtttttagctccccgggcttcgttagcgtcatggaagttctcaaagaacgaaacgacgtcgtcactgacaacggagtctggaacagagttcacgtcgtctatagtctctcaaaagacttgggtttgccggggttccgcgtcggcgctatttactccgaaaacgacaccgtagttgccgcggcaacgaagatgtcgagctttggtcttgtctcttctcaaacgcagtaccttctctcagccatgctgggggacaagaagttcaccagaaactacatcgctgagaacaaaaagaggcttaaacgacagcagagaatgctcgtatcggggctattgaaaaccggtatttcatgccttgacagcaatgcggggttgttttgttgggtagacatgagacaacttttgcattcgaacacgttcaaggcggagatggagctgtggaagaagatagtgtaccaagttgggcttaacatttcgccaggctcctcgtgccattgcaccgagccggggtggttccgcgtgtgtttcgcgaacatgtccgaggagactctggccttagccatgaagcgcttgaagaacttcgtggcggctgagtctcagaggaatagttctagtggttgtagtgctggtgctctgttgaacaacaacaacggaagcttcaagagaaagtccctcactaagtgggtttttcggttatcgtctcgcgatcatcatcgtgaacaggaagaacggtag

SEQ ID NO: 78473 - DNA, 897 bp, Glycine max
  Peptide Sequence Number=SeqID_170158
atggagaagttaaacgtgagaaaagtaagatgccaaccaaaggtgattggaactgtagtaacagttgttggggccatgttgatgacattgtacaaagggcaagtaatcagtttcttcgggtctaagtacatgcatcacccaacaaactatgtacctaaaaacaacactgattcttgtgaaaaggattggttcaagggttctgttcttctcgtacttgccaccctttcatgggcttcttcatccttcaggcaagcagcgacattaaggaaataccctgctcagctctccctcacagcacttgtgtgtgccttaggtatcacctactatgttcaagggattgtcatgcagaaaaaagggcctgttttcgttactgctttcagccctttgatgatgattatcgtagccatcatgggtgccttcatccttgcaaaaaaaatatatcttggaggggtcattagagctattgccatagtaatgggacttcactctttcagtgggaatgcccaagagtggaaaatgcattggctcaattcgaagaaacttaccacatctaagaagaagggaggcttaggatttcatatgtccatggctttcaaccagcatcttttagccaagcaatggctcacaaaggccatcgtcttagctgcacttggacaagtatttactcggccaaaggtgttatggacgatgttggatcagcccacatggaaatatgctaaagatggtaggtacatggtgaagtctggctactacagagcaatggttggcctaacaaatgaagagaactccacaattaagaagaatctcaaagcaaaaatagaatcttttgacccaacttgccctttttgtggaaaggaagaggagatggtggaacatgagtttcttttccgtaaggag

SEQ ID NO: 78474 - DNA, 801 bp, Glycine max
  Peptide Sequence Number=SeqID_170159
atgatccttgatgcctcaactggtggcactatgatgtccaagagtccagaggaagctattataggccaacttcctcaacaatgtcaccaaggtggaccacagaaaacacatcaagctcaccaagttcaacaaattttgagatgtgatttctgtggtgataaccatcagaatggccactgttcaacacttggtgatggaaaacaagaagagaaggcccattatctgcaaaatcaagccagacctcaacaaaacttccaaggaagctaccaaggctatagaggtggctcaggttcaaatcaaccttatggtcggagaccacaaaattctagtcccactaacacttcttgcgcaggtccttctaacaactcttatggaggttcttcaagtaggggtccacaacaacatcaagctcaaccagatagaatgtcaaagatggaagatactttaacacagtttatgcaggtatccatctcaaaccagaagaacactaatgcttctattaaaaatctagaagtttgggttggagaactgacaaaacagttatctgaacatggaagtggatctttcttagcaaacacacaggataatgatgagaaaaagaataaagaaggagttgaaaaagaaaataagaaaaatgatgaagtggtgactagtggaaaagtggaagaaaaagtgattaccatttctttttttgaggcgttggagcagatgccaacatatgctaaattcatgaaggatttgcttacaaagaagaaaagaattatggatgatgaaatagtgaaccctcagccacaacaatga

SEQ ID NO: 78475 - DNA, 177 bp, Glycine max
  Peptide Sequence Number=SeqID_170160
atgtctattactgataggcagaaacatttatcaggctggaggggtaaacaagtgaatgtgcaacgggatgggttgaggttgagtatattttggattctatatccaaatgatgcaaagccccaagctgttcactcaacagaggcaatggagcctcataggggggcacatcaggtttga

SEQ ID NO: 78476 - DNA, 1266 bp, Glycine max
  Peptide Sequence Number=SeqID_170161
atgggtgttgtcatggaacatggagagtggaaagttcaacaccttcagttaataaatagtgagaagcgccgcctccacgctcccatcatcgaccgctcctacgacgggcctgctccctacgtcgttgtcgtgcagggccctcctcaggttgggaagtcactgttgataaagtctttggttaagcattacacgaagcataattttcccgatggaagcaaaggcgggtgcagtttgcagtttgtggaatgtccgaatgatatcaatggcatgatagatgccgcgaagtttgccgatctaacacttcttcttatcgatggaagttatggtttcgaaatggatgctatttttgagattttacttcacttgcaggaaacctttgagttccttaacatattgcaagttcatgggttgccgagggtcatgaatgacaaaatagaagctttggataaatatcagcctgggactggttctgatgaagatgaagatgcaccaaatagtactgctaagaatggagtccacttgcaagaacatattgattttcatgatggaagatggaggagaagagcaatatttggaaatgattgtgtagattcagaaggggatgaggatggtgctaccagtgatgatgatatagaatcttcagaagaagaggaggaagatggcaatgataatcatgacacaaatggtgtgagcttttttgtacgtgtggtggcaatggaagaagctgtgttggtgttggcttttgtgggcaagttgagaaggcaccttctgctgcttgttgtggcaatggtgcttgtgctattagtctcttcatttgcttcacctctcagcgatgaagaaaaacaagagtttctcttgcattcgtgcatgtgggtgtctgtgaggatcacgtttggttatgctggagggttaaaaatccaagatgggttgttatatggctggtacctatgcagactgtttcagcttaatgaattgttccttatggagtctcaaaaggctaggatttatcattactatgtacctgtctttctctggtgtgaacagcagattactgagcatcagtcgaagtttaaagatggagaagatatacctcctttagtggatgtctcttccaaagcaatcatcaatagagctgaattgagttataattataggacatccagtggctctgatatgacattgtcaagttctgatgacagagtacaagatgttgctgagttacttgacatgatggttgaggatattcctttttctggaatttgttag

SEQ ID NO: 78477 - DNA, 297 bp, Glycine max
  Peptide Sequence Number=SeqID_170162
atggagtctaatccgtggaacattgatagacgtctagtggtgttggcaaaaatgcaaaacaacagaaaccagaagaggtacaattgtctatgtgccccatttgggtccaaaaagattgcaaagattattcctaggtgggatgaagggggtgaggacaagtttgggaaagcgatgacaagtgggagttacatctatgtgtttaaaccattgaacaatgccctacctttaaaatcttcttcaagtatgagtggcttagtaaccttttctatgcgtgtgggagcctcacccaagttataa

SEQ ID NO: 78478 - DNA, 438 bp, Glycine max
  Peptide Sequence Number=SeqID_170163
atggctacggagttagggcaacaaacggtcgagggaggttgcagtcccagggatagtgttgttgattcttgtcaaaccataaggggcatgattatgcttgctttttgcttgttggctcaaaacattggtagcagtgacaaggagaagtcattcccccattttgatgacttagtattagtttatgggaaaaaaaagggcactaggatgcagatgctgaaaaatctgggtgatgcagttgaggaaatgaatgagtatgaaagctccaaagagtcaaagacaacatgggtgacctcattagctgcttcaggcatggaaaacaagagtaaggccttacagtatgtgcaggagaatccagatgaagtttgcccagctgggtggaagcctggggagaagtccatgaaaccagaccctaaacttagcaaagactactttgcaggg

SEQ ID NO: 78479 - DNA, 390 bp, Glycine max
  Peptide Sequence Number=SeqID_170164
atggttgcgaacaacaatgacactaacgccataattcaaggaaatcgaccacgtgagcaggaatccaccgtaaagggatacctgccatgggtgcctctgaaaaaaggagccaagcaaatgtgggtgcaacactacattggtatatttgattgccgaaaaaactccattgactcattcgcgatgcttatcatgaattttagagctcaaaacgcaacgagcagaccacatcatctgacagttgtggcattcgccaacattaggaaagaaaaagaagaatcgcttcacgatttcatggagaggttctcatcagtctcgattcgtattcggaacttgaacctagaagtcacgctcacttcaatgattatggcactgaaatctggtcccatctga

SEQ ID NO: 78480 - DNA, 354 bp, Glycine max
  Peptide Sequence Number=SeqID_170165
atgatgccgaaatatttaaagctcttaaaagacctcataactaagaagaagagtttgaaagactatggcgtagtgactcttgaaagggattgcaatgccatcttggagaatccaaataagctagaggaatgcattttacaagtggatgatgaggagatcacatttgatgtgcgtgaagctatgaagcaccccaagggtaaaagagtttgcttcaaggtggatataacagatgaagtaatagaagaacaaactccacaaatcataataccaacaccattagagcttgctttaaccaacatcatggaagatctcacactagagtataatgaagagctagggggatgcatccattaa

SEQ ID NO: 78481 - DNA, 168 bp, Glycine max
  Peptide Sequence Number=SeqID_170166
atggtttgccgacaagataagagcaaggaatatgctaactgcgaatcaagcatagtcatgaaggacgcaagaataatcataggtcaacctgaacttttcacatttgcattaccttcatcggaatcagaatcaggattatacgatattaaagatgcttatgccgtttga

SEQ ID NO: 78482 - DNA, 212 bp, Glycine max
  Peptide Sequence Number=SeqID_170167
tgacggaagcgcagcccaatttgcgacaaacacgaactcatgcagaaggagaaacacgcccagggagtaccctttccaggactctttcctttcctacttttcttcgacctgtgaaagtgagcaaattcatggaagcacaggagactttgacacaaggagaaagaagaagaacgatagggttcaagcgcaaggagaaagaagaagaacgatag

SEQ ID NO: 78483 - DNA, 207 bp, Glycine max
  Peptide Sequence Number=SeqID_170168
atgacaaggtctagagtcaagcttctacaagaagagatgaccaagaggatcaaggatggactactcattaaaggaaaggaaggagaaaatcacaaggagttgaattggagtagaagttcaagaatggtggttcttgaatttgcatctggaacgatccgaaccaagcgtccatggcttggattgcatctcgtggtagttagagcttga

SEQ ID NO: 78484 - DNA, 639 bp, Glycine max
  Peptide Sequence Number=SeqID_170169
atggcattatcaggcttttgggataaacggcggaaagaggatagggaagtcaaggaagcatccatgtctcccttgacttcaaccactgaactcccaacaccacattcgcacccgaaatggggagaacatataagtcaacgtgaaaattgtgagcctgaatggaaggctcaattgggtcacgagctgcagttgaatgaagttatgagtgctcccgccatctacaaggagcactacgttgttgctggcaatagtggcgatgaaacgaaggtccaaactggttataagaggggagtcaggtatgggtatggtgtcacggtcttcagcgagaaggaggaatacccgagaggcacactggtgtcctcgatggtatttctcatcacagttgaagcaaagacctcgttcccggcgaaaggcaatctcgtccgagagggtgagggaaaagaaggtgggcaaggagaacggagaggtggggcagagaaaaaaggggcagagggtggtcgcggacggctggacaaccctaacagagcaaccagaggaggaagagctctagagagcaccagaaaagccacaattgctaacggagaacgattgagggactacgtcgaggtaagggatgagttattcacgcttgaggattag

SEQ ID NO: 78485 - DNA, 234 bp, Glycine max
  Peptide Sequence Number=SeqID_170170
atgtggtatcatttttcagtgaaaaacctcgtcgggcgcctaggagtacatgataggacatgcctcacaatgggcttacaagagcactcaaaccggatgacccccaaggcatacactccgaagagtccgtcagggcctctccctcctgattcagtgcgcctcaagtggttaactcgtcgggttcccacagtggatctcatcacaactcatcgcgcattaactcgtcgcccttaa

SEQ ID NO: 78486 - DNA, 540 bp, Glycine max
  Peptide Sequence Number=SeqID_170171
atggtagaaataccagtgatggttgcggtagcaataacaatagtagtggtagtgaaggtggcattggtggtagtggtaaaggtggcattggtggtgatgacgatcaacgacattggtggtattagtggtggtggtggtagcaatgtcggtggcgatggtgggatggtggtggcgatgacaataatagtgatggaggtggtattgttgttgttgatggtggtggtgatagtgatgctaacaatggtggtagcaatgttgatggtgatgatggttgtggcaccaagtggtagcaatgtggtgattgtggttgtggttgcgataactttggcggtggttgtggtggcgacggtggtggtagcaatgcctgtgatgatgatgatgttggtggcgatgatggtaatcatggtggtggcaaccagttgtgacggtgacaatgatagtgatagtgacaataacggaggtgatattggtattggcaatggtgatcgtggtggtggtagtagcgatggtagcagcaaaaagtgtcattgtcaaatttga

SEQ ID NO: 78487 - DNA, 402 bp, Glycine max
  Peptide Sequence Number=SeqID_170172
atggttcaaccagttatcattgttcaaccaagacaagatgaaattcaaaatccattttggaatgatgttttccattataacaatatcaattggagtcatcccgatgaggaggacatttgcggtttggagaggccatctacttttaatgttgggcaaaaattatatgttggtatggattttgatagtaaagatgctttaaaaaatgcactcaaacaatatgttatgaaggtgcatcaatgttttaaagttcctgaaaccaaatcgcacaaatatatcgtttgttgcccaaataaaagcgcaaagtgtccatgcccattttatatgagggcaattttatctaaaaaaaccgattcattggaaagtgacacaatggcgctggactacacacatgtccgactatga

SEQ ID NO: 78488 - DNA, 1033 bp, Glycine max
  Peptide Sequence Number=SeqID_170173
ggtacatctacttgggttgttgactgagaacaagagagggtacatctcttgtggatcagttctagtggagggtacatccactaggttgttcaaagagaacaagggagggtacatcccttgcggatctttgcttgtaaaggaattttacaaggttgaaaagaaatctcaaggaccgcaggtcgcttggggattggatgtagccacaggtactgattccgccattgggaaaagcgattaccaactaaaatattccgttgctccactggcgggatacaaataccatccatccatgccatccattcagccagtggcctatgcagcatgcatccagatactgattccaccattgggagaagcaattaccaaccaaaagattctagttgctggcattgtgggcctggagtttttgctcattgatacctccagtaggataggcgtgttccatagagcagagggagcagggattcagcgcagtgtagtaagggttcatgcatgctgcatgctttgtagtttttgtagggtttcagcatgcatccaggtactgattccgccattgggtaaagggattaccaaccaaaagatttcggatgctggcactggcgggatacacatgccatccatcccagccatccatctagccaatgaaccatgcaacatgcatccaggttgcactgattccgcgtgggcctggtttgtgctcattgataccgccagtaggacaaacgtgttccagaaggcagagggagcatggattcagcgcagtgtagcaggggttcctgcatgctgcatgctttgtagtttttttagggtttcagatacacatgccatccatccagccaatgacccatgcagtatgcatctaggtactgattccgccattgggaaaagtgattaccaaccaaaagattctgctgctggtactggcgggatacacatgtcatccatccatgccatccatccagccaatgacccatgcagcatgcatccaggttgcactgattccgccagtgagcctggtgtttttgctcattga

SEQ ID NO: 78489 - DNA, 1347 bp, Glycine max
  Peptide Sequence Number=SeqID_170174
atgacgttagggggtggtgttctgccattggtattggcggaatatacatccactgattccgccattgggaaaaacgattaccaaccaaaagattctggctgctggcactggcgggatacacatgccatccatctagccaatgacccatgcagcatgcatccaggtttcaagtatagggttagggttgcagaacatacatgcactgattccgccattggaaaaagtgattaccaaccaaaagattctgctgctggcactggcgggatacacatgccatccatccagtcaatgatccatgcaacatgcatccaggttgcactgattccgccagtgggcctgacgtttttgctcattgataccgccagtaggacaggcgtgttccagagggcagagggagtagggattcagcgcagtgtagcagggagggttagggttgcagaacatacatgcactgattccgccattggaaaaagtgattaccaaccaaaagattctgctgtaggcattggcgggatacacatgtcatccatccagccattgacccatgcaacatgcatccaggttgcattgattccgccagtgggcctgacatttttgctcattgataccgccagtaggacaggcgtgttccagaggcaagagggagcaaggattcagcgtcgtgtagcaggggttcatgcatgctgcatgctttgtaatctctgtagggtttcaggtactgattccgccattgggaaaagcgattaccaaccaaatgattttgctgctggcactggcgggatacacatgccatccatccagccaatgactcatgcagcatccatccaggttgcactgattccgccagtgggcctgacatttttgctcattcataccgccagtgggacaagcgtgttccagagggcagagggagcagggattcagcgcaaacatacatgcactaattccgtcattggaaaaagtgattaccaaccaaaagattcttctgttggcactggcgggatacacatgcgatccatccagccaattagccatgcagcatgcacccaggtactgattccgccattgggaaaagctatcaccaacctaaagattccggctggtggcactggcgggatacacatgccatccatccaaccaatgacccatgtagcatgcatccaggtactgattccgccattgggaaaagtgattaccaacctaaagattctactgctggcactagcgggatacacatgccatccatccagccaaggagccatgcagcatgcatccaggtatagggttagggttgcagaacatccatgcattgattccgccattggaaaaagtgattaccaaccataa

SEQ ID NO: 78490 - DNA, 153 bp, Glycine max
  Peptide Sequence Number=SeqID_170175
atgatttacttaagttgtccacttatgttagatcatcgaatgagtatgcttaagttgtggctaaaggcccaagtggagaaggacgaaggcccaagtggagaaggacaaagcccccgagtggagaaggatgaaggcccaagtggagaaggatga

SEQ ID NO: 78491 - DNA, 276 bp, Glycine max
  Peptide Sequence Number=SeqID_170176
atgatgacgtgtatcaaaacaaattcgtttcattttctgcaagagttggaaagcgaggtagggttggatggcgtggataggtcagaggagatgaaggagaaaaggagggacttagcattgaagaacttgcggcaggcgaggaggggaaggagaagggagctgagggatgatgacacgtgggtttggagccaccagaagaaggagaagagagttatggggtcggagttgagaggcttgcatgagaggatggagaggatgagagagagagtgaggtga

SEQ ID NO: 78492 - DNA, 606 bp, Glycine max
  Peptide Sequence Number=SeqID_170177
atgaggaagaatgtggtggtggcggtgagcacaactcttgcggtggtagtagtaggagcattgatcagaaggtggaagcagtggaaagagcaacagttgaggaaaacaaaccaaattattcgaaaattcgctagtgaatgcgccaccccagtaacaaagctttggcaggttgctgatgatttggtctcaagcatgaaaatctctcttgtgtcttcccatgaaaccaccactctcaacatggtcatttccaacgttacatcactcccacttggagatgaggaaggatttttttatggggttaatttgcaaggaaagcatttgttgatgttgtgtgcacggctaggaggaaagaataagcctatctctgcgttacaaagagaagagatttccatccctgatgctgtgttggctggtgcttctgaggaaataattgattacgtagctacagagatagctaagtttgtttcatcccatcctgagattgacgatggtgcaccagcgaaaaagaagaaattgggcttcaccctatcatatccagtggatgaaattttgcctttcgcggccacaacatttcaacggaaaagcgcaaacaatccagttgagtag

SEQ ID NO: 78493 - DNA, 130 bp, Glycine max
  Peptide Sequence Number=SeqID_170178
gctacagactcaagtggagaaggacaaagcccccaagtggagaaggatgaaggcccaagtggagaaagatgaaggcccagaggcagagacactatcaaaactattaattgttgctgaagacccagattaa

SEQ ID NO: 78494 - DNA, 255 bp, Glycine max
  Peptide Sequence Number=SeqID_170179
atgtaccctctcttgttctcagtcacaacaatccaagtagatgtaccctctacttgtaccacaaaggatgtaccctccaatgtcttaagacaaagttctcagatgggaagaatcaaaagaattctcagactgtgtctttttgaattctttgacaagggagaagggagacacaaaagaattcaggcggttagtccttcgttcttttggaaaagggagaagagagacacaaaaagaattcagacggttagtccttag

SEQ ID NO: 78495 - DNA, 282 bp, Glycine max
  Peptide Sequence Number=SeqID_170180
atgaaggtgcattgcacagaccaaacgacatcacgcagaactcatagtggccatggtgcgtgcgaaatgccattttacagatatcttcaggcttcatcaagatttggtggtacccttgtagaaggtcaagctttgaaaaccaacaggctccctctaattcatcgagtaactcatcaatggatatcgatagggtcaaacattgatgggttcagagttgggtatcaagtgtatggcgggattggtggtgtgggatggtgggagggtcattggtgtgtggaatag

SEQ ID NO: 78496 - DNA, 141 bp, Glycine max
  Peptide Sequence Number=SeqID_170181
atgtttgaagaaattaatatgaatggagacaatgaaaaggaacctagtgtttgctaccttgatgacgttttgcatcgggctcgctctgttgtgtatgatactgattttgtggtggtgataatgaggtcagacacatactga

SEQ ID NO: 78497 - DNA, 681 bp, Glycine max
  Peptide Sequence Number=SeqID_170182
atgtcgtggaacttcacggattgtgctacaatgccttcttttgacttccggcacgtcacggaacaccacgaattgcctaacgatgggtgccaagtacctcgaagtggacaaagggtaattggagagccagctgcctctgggttagtccttgatgaatcttggctttggcatcttgactttgagacttctacaaagttagtccccctattaggaaatgaggacatgataaggccgcaactaaggactgaggctacaaatgttgcaaagattgtaactactttcttaaaaagtggtgtggttccaagtcagattggtgtgataacaccttatgaggggcaaaaaacttatattgtgaactatatgtcaagaaatggtgtttccaggcaacaactttacaaggagattgagctactacatgagttttattcttttccggttgctagtgttgattcctttataggaagggagaaatactacatcattttgtcttgtgttagaagtaatgtacatcagggcaaaacaattggtgttaatgtagaagatgatgattcatacatggacacctatgttagtcctttgaccgctcaaatcactcgtaacgttgtcggagaagaagaagctgacgacgttcattctaatcgaaatgatcatgatgaaggagaattgattaacatcgtctaa

SEQ ID NO: 78498 - DNA, 618 bp, Glycine max
  Peptide Sequence Number=SeqID_170183
atgactttgaaacaagaaatcaaagacggttctctactgggcatttccccttccgcattgaagaagaaaaatcttgtctctttatttgttcaacatcaatggcttcctcatgtcgcggctatttcaaggcccaaatgtgcttcttcaagattctccacaagattcttcgtggctattccccaccctcaaaccaacaacagtgaagggtttctagagaagagtgttgaagtttcggagaaactcgacaacaacaacaacattagcaatcacgaggaaccaagcgttgttgtaccggttcggagactcagttgtggaactgtggaaatgtgccactcgttcgtagagaccgtcgtcaaccacaatgaagtgagttgtggaaggttcgtgccgagggcaatgctcatggatctagagccaaggaccatggatagcgtggatatgagtgaaacaaggaatgagctacaagaaactataagagtcactaaagatgccaagaatgatgcagctgcaggagaggcaactccttgtgctattcatttagctgattttgtgaacactcctttatatgtggttcatgtaatgagcattgatgtaatggaagaaattgcaaaggcctag

SEQ ID NO: 78499 - DNA, 681 bp, Glycine max
  Peptide Sequence Number=SeqID_170184
atggcttcttgtaagagaaaagcactagcttcagtgtcccaggctaggtatgatagatcaagatttttatcccaaaatgtctgggactgttacgcgaacaatgtccttggctggaaggtccttccggaaaggaatgtgaagctgtacattacaaaatttgatgaattcaagagagaaattgagaggaggaattggcataaggagctcactaacttctttgaagggagcattgacatggcattagtgaaggaattctatgccaacctttatgaccttgaagataaatcaccaaagcaggtgaaggtgcgagggcacctaattaaatttgatgatgacgccctcaacacctttttgaagacaccagtggccatcgaggaaggggaaagcttgccctcttactccaggttctatattactttggatagggctaagttaatctacgggcatgtaattcagatgaatatgaacttgggatccctcatctcagctccccctacatcatctccttctacctctcctctccctccaccaccaatagctccagttcttctaggtccctccgctcagagctcaaagctcagagccttccttgtctatgctgcagagcctgcatcaggaccagctcttgatcatgcagagtttgtaggatgttgtccaacaacggccagttatgagcgttga

SEQ ID NO: 78500 - DNA, 159 bp, Glycine max
  Peptide Sequence Number=SeqID_170185
atgacgacgacagtgacaacaataaaggatgatggcgatgaagacaacctcaatgacggtggagttctttttgggggtttagggaagcacgaaaaggagaacttaatacaccagaaccgtaagaggaaacttaggtgtacaaccacaatagtagattaa

SEQ ID NO: 78501 - DNA, 723 bp, Glycine max
  Peptide Sequence Number=SeqID_170186
atggagagacgccatgaggaagggttgagaaagctaaaggctgaccacgaccagttagaggctcgcaacactgcagacgacctaagtccctcctacaagcactatccagcaaaatggactgaccgtcgacatgctttcatcgaccatattatggaggcagacatacccttgtgttggaagccactcaacctcgagcaatacggtgggacaaccggaacaacattgacctggtacggtggacttccacccaagtccttagacagcttcgaccccttcgtcaaacaattcagtgcacaatacgccactagaaggtgtcacttcatgacctcgactgccttggctagtctgcgacaagcagacgacgagtccctcaaaaagttcatggacagatttgggagcatgaccatccaaatccaaaatctcaatctcgagaagcgcgacaaacacgaagcaaacaccaaggccgacttgcaaaagtcgaacaagaggcacaagtcagacaagcgtcagcctctctccaaagggcctaggtacgagcgttacacacctctaacgaccaatcgtaccataattcacgaggaagcattcaacctagagggaccattgtttggtggcatgcaacgttcgcttaaccgtctcaaggcggtgccttctggtggaagcaaccctgctcgcttaggcgagctgggcggcaaccacctccctattttctcctataaatag

SEQ ID NO: 78502 - DNA, 429 bp, Glycine max
  Peptide Sequence Number=SeqID_170187
atggagaagtccaacagggccctggggtttccggctctaatcacgggcctctgccagtcctacagagttcctgtcacccctagcaaggacgcgggcacaccgtcaccaccttggcaggccgttgggtcactgggcgtggagcggtatctacagcatttggttcgccaacaggcggccaaccaccgtggacaggtgcagatacatgagtgtctctaccggttcagcctcagtcagcaggggcagggttccgtcccttttgtatgccttaccccagagcagtttggggctgaggtcacatggcctggagactggcccgatgcccaggcaggggaggagcctgcagaatctcccggtgaggcggatgaatcccgtatggatgaggatatgactgacctgctcaatttcttgggagggagcgaagccacatga

SEQ ID NO: 78503 - DNA, 246 bp, Glycine max
  Peptide Sequence Number=SeqID_170188
atgagggttcactgttatcaagcaagtcggagacctagcatgaccacagattcacctccactccttatgttcccatggacccggtccccagtggagtcaccaactgtcgcaacctacccttcggtgggagggcaacgcggggctcacgggtgcgtcttccaagggaggaaggcgcgcggagtcaccaccaacgtttattcgaggaaaatgtcagaaaaacaggaacgtgtggtctacgaactttaa

SEQ ID NO: 78504 - DNA, 234 bp, Glycine max
  Peptide Sequence Number=SeqID_170189
atgggaactgaagtaggtgcatctgaggctgatatcatggctcgagatcaacctaggagggaagccaagaagtggttacattcatttaaaggaaatagcttgaagacttgggatgaagtagttgagaatttgttgaagaaatatttcctcgagtctaagacagcagaaggaaaagtagccatctcttcatttcaccagttttcggatgagtctttaagcgaagcacttgattga

SEQ ID NO: 78505 - DNA, 1242 bp, Glycine max
  Peptide Sequence Number=SeqID_170190
atgactgaagacatttttgtcttcgaaatgtgtgtggattaccgtatagggcgtctccgcatgctatcgaacttaatcgtctctgatgataaaagggatttcgatagtcttcggataggaagggtgtgggcgaccatatgttgtctccacgcgtcatcggacttgtcgtctctggatgacgaaggtgcggataactatgaggtatctccacatgctatcggaccctcgagtcacgatagcagaattgagacttttttgcggtctcggccggaagacgttgacatctccgggaagggtgcagatgaccacattggtctctgcgtgtcaatgaggtcgcttgcctctgaattgagactttttcgcggtctcgactggaagacgctgacatctccgggaagggtgcaaatgaccatattggtctctgcgtgtcaacaggctcgcttgcctttggttaacaaaggtgcagatagccacaaggtgtgtccgtgtgctaccgaacccttgggtcacgatagcagaattgagactttttcacggtctcagccgaaagacgctgacatctccgggaagggtgcggataaccatgaggtatctccacatggtatcagaccctcgagtcacgatagcagaattgagactttttcgcggtctcggccggaagacgttgacatcttcgggaaaggtgcggataaccaagaggtatctccacatgctatcggaccctcgagtcacgatagcagaattgagacttttttgcggtctcggctgggagacgctgacatctccgggaatggtgcagatgaccacattggtctctgcgtgtcaacgagctcgcttgcctctggttgtcaaaaggtgaggataaccataaggtgtgttcgcatgtcacctgattctcacagaactgtgtgtgtacggataaccgttggttatatcctcctgccacctaactcatgggtcaggatcaacagatgttgtgtttgtacggataaccacttggggtatttccgcctgccacctgacgcatggtcaggattaacagatgttgtctttgtatggataaccactcgggtatctctgcctgccaccgaacttcatgggtcgggattaatagatgttgtctttgtatggataaccactcgggtatctctgcctgcccccggacttcatgggtcgggattaacagatgtctttgtacggataatcactcggggtatctccgcctgccacctgacttctcgg

SEQ ID NO: 78506 - DNA, 207 bp, Glycine max
  Peptide Sequence Number=SeqID_170191
atggagttcatggtccctacacctattgttgatgttccaccagtagcaaggtataagctaaacataagaagacccaaacaaaagaacatttcagacacttcaacagtagacgcacctgttgtggatggcccaccaacagcacccttacttttcatgccaacaccaaggttcactagaaggaaggctgctaataaagatctagtataa

SEQ ID NO: 78507 - DNA, 723 bp, Glycine max
  Peptide Sequence Number=SeqID_170192
atggaaagcctgttaaagtctatcaaagttaacttcagaaacctttactacagaggacaggagaaaaaggaaagatgtggtctccatgattatatccagcagcgaccaaggacattactcattgctgccaacattacgataaactttttcaactttttaaaacgtgttacacgaaaaagatcaagaaatggggtaggaattattgtggacaaggagtggaagaaggatgtcgtggatgtaagaagagtaggaaatcgtatcatagccttaaaattggtagtgggacaggacacctttaatgttattagtgggtatgcacctcaggttgggttagcagaacactttaaggtaaaattttgggaggatctagaaggggtacttcaggatataccccaaggagagaaagttttcctaggaggggatctcaatggacatgtaggtagcgtggctagaggttttgagggggtgcatgggggttttggcctaggggagatgaatggggagggtaaatccatcttggagttttcggaggctttggatctttctatagccaatacatggtttaagaaaagagaggaacatcttatcacttacaaaagtggagggacatgttctcagatagatttcttccttatcaggaagtctgataggaagtattgcttgaactgtaaagttatcccgggagagagcttgactacccaacatagagttttggttatggat

SEQ ID NO: 78508 - DNA, 303 bp, Glycine max
  Peptide Sequence Number=SeqID_170193
atgaaaaatattcccaacaacatggggggcgaagtgtatttctgggaaatgagaatgattcgaattgctaacagcagaaagagtgagaaattgcggtggaatttgaggagaaacaacaaatcgaagaagattgtgagccttgataactggctcgatttgctgatgccacagcaaaaaattctcatcatcgagcttttcagagatttgatgagaaaattgaacagcagtggtggccatagtcaccctcacccactgtcactagctaaggatagtcaaatgctggcaatcatcgacaatgactga

SEQ ID NO: 78509 - DNA, 2004 bp, Glycine max
  Peptide Sequence Number=SeqID_170194
atggatgaggcaatcttcttgtgttggtcatggtttaggaatctggaaaaaggggagggaagcatacataggacctgggtagcctatagcttaacaattagcagaaagacaacaaaggatacgaagaagattctaatagcagacaaacaaacactaaaccttgaggcacggggcaactctacacgctgccacctcaattggaggaacaaggacaacattacatcatactacttcactcactttcccgacgaagctaacgaagagttgctatggaaatatttcaaaaaatggggtgatgtgcgagaagtctacattgtcaaaaggcgcaacagggaaggtagaagatacggtttcgtgcggtttaagggagtctcggatgcaaaaggtctggaggtgaagttggacaatatcttcatcaacgattataaactatttgtcaacttacctaggttcacgaggacagcatggactgaagagttgcagcaaaagactattgtcgggaggaaccccttcaaggtaccctgtaaaccttgcgaagtaaccactggaccttttcggagatcatacgcggaagtgacgaccaagggggaacttccaggcgataggacgagaggtgaggtcttaacaccaactatatcgatcaccccaaatgaaggtaggggatattggtgcaatgaagcttgggttgggaagttaaagaaggttatggcggtggagaccttagaggatcgaatagcatgggacttagggtacaatattcgtaccatatttctcggtgatgacatgattctcctcactgggttgtcggacgaaaaagctcaactcatcattcaaatggagatggaaagcggaaactcccttttttactcgttggagaagtggaggccggggtgtaggcctaataactgggttgtttggcttcaagtgtggggatttccgatagaggtgtgggaagtggatcacctcaagaaagctgtttccactatcagcgacgtcatcgaactagacgatgacatagaggaccgttgcagactggaccgggctcggttgttggtgaggacacctctcccgccgtcaataaggagagatgtcatcgttcgagtgggcgagattgaatatcgggtgtggatcgtggaggagataggggtagatggcgggtcgaaccagaaaggaagctcaacgtccgatgtttggtcggaggagataacgtcggacgacggaggagacgtcggcgacgtcgacgacaacagcgacactaatttttccttctcgccggaattgtccaacaacaaaccgagatcccccaatatccaacggtcagaaggaggtactaatgggtgctaccgtgaaaccagaccactgggcaaaacccaatctgacgaaatccacagggacaagtcaaaggatatcgaggagggtacacagggtcttgatatggcaaagtttgacctaggagaaagcaaggcagaaacgaaaaaagtaaaagctttcattaaagaggctgcctgttataagactcaagctgctgctcgaaagcagagtagtcaacaagaaggaaataatttgaatggtggagataaagttccttttgatcagccttataatggggaagccgagggagacacaaggcgcgtagaaccccattcagatctgcatcctgtgcagcctcaagaagatgttgggccaagccacaacatgggcccactatggaaaaataaggggtgtaataaggaagaactctttcctgtagcccaatcctctaaagagaccccagataaatattccaaagtctatgttagacaaagacaccttcaatataaagcccgacttcttcaacctgtggaagatcaatctcaactacaagaaggagataatgacatggctgccatgattgataaccgggacaaggcccaaaaccagggtcattttggagcagaaaggaggttaaaaaaaagtaaaattgaatgtaacacagaggtgttggaagaggctcaacaactatga

SEQ ID NO: 78510 - DNA, 1050 bp, Glycine max
  Peptide Sequence Number=SeqID_170195
atgtttgacagagtcaaagatgaaatttcgtgggacgaaggagtagatatttcgccgaagtacctaggggacgatatggtattgctactcagtctcactgatgccagagctgaacagatgggcaaggaagaaaccatgaatggatcatccctgttccactcgctggagaagtggaactcgaggatgcgaattggctataggttgatctgggtacaatgcttgggtatcctgctactagcttgggacatggtgcaaattcagaagatcgtggcagcgattggggaaatggtggaggtggatgacgatgttgaagaagctcagaggttggacagggcacggcggaagagaatgggaccggcaccggaaaatgcaattgtcgatttaggagtgtctttgggtcatcagaggaaatcgattccgaggagaggcaacatactaatgcccaacagtcaaaatgaacaggatagaccacagggtaaaaacccatgtctatggacacattgtccaactcagaataggtgcagaacagaaggcatgggagaaaaagagacaaaacataggaccccaagaagaggaagcaaaatgactaaagtggaagaaggtaagaggaaagtcaacatggaagggagggtgcagtgttttcatgaaagtggaaatgatgattttgaagtgggccagaagttgtcaggaaaacaaaatttaaatgaaaaagggtcaagtgacacacaggaggctgatgggaagttcaggacattattggggtggtgcaagaagcaattggacctgggcaacgtcaataaaaaggggctaactaaagacacaaaatcatctacacaaaataatggtcatcaacaacacagtgatgaccctgggaaagatgaaagcctgtcactagaaataagagacaatggacaaaaggaggtgaatacttgggtggacccgaacctggtgcaaaatgaaatagaggtagtaacaccagccaataacagtgatatcaatgtccagctggaagaggcaacatcctactggactatggcaaaagatctgggg

SEQ ID NO: 78511 - DNA, 264 bp, Glycine max
  Peptide Sequence Number=SeqID_170196
atgggagctcatgagaaagcttgtttttgggttcttagattgatgagaatcatgaaactggccaaatacaggctaaaggcccaagtggagaaggaagaaggcctaagtggagaaggacaaagcccccgagtggagaaggatgaaggcccaagtaatccttgtggcgtctacccagacttatcttccttcactggaagtggcgtcatccaaaacctccgtagcctgtatcaaacgatccgctcctactcaggttcacatcattaa

SEQ ID NO: 78512 - DNA, 329 bp, Glycine max
  Peptide Sequence Number=SeqID_170197
atgactaggggcaatccaggcaatttacaactctttgatcctgaaatagatataacctttcatagattagttaggcatagtgtgcatcctgatcattttgtgcattttgagcattctgagtattttgttgctagtgatcctgaatattctgattttgagcattccactgctaatttttatactgagaacatgactcaacctccacctcgtgagaggactcttagggagatggttgcacctgatttcacttatgaaagcttgtgcattcaatatcctgatgagggtgttccatatgttctcaagactggactaatacatttgctgcccaa

SEQ ID NO: 78513 - DNA, 669 bp, Glycine max
  Peptide Sequence Number=SeqID_170198
atgaaggtggcaaaggaaatcaattgtgatggttgtggtagtgacagtggcagcagcaatgagagttgcaatggtggtggctttggcggcaattgcatcagaaacagtggaggttggactagtggtggtgatgttcctgctaagcaatttaaagggattttgagtgtattaggcatagctgaagatattaaaaacataacaatgagtcatttgttgccatgtatgagaactgttagatactttaagggccctgaacttctagttgatttacaagactatgactactcattagacatgtggagtcttggctgcatgtttgctggaatgatatttcgcaaggaacctttcttttatggtcacgacaaccatgaccagcttgtcaaaatagctaaggtgcttgggactgatgaactgaacgcatatctgaataagtatcatctggagcttgatcctcaacttgatgcactggttgggaggcacagtcgcaagccttggtctaaatttatcaatgcagataatcaacatcttgtgtctcctgaggcaattgattttcttgataaactccttcgatacgatcaccaggacaggttaacagcaagagaagcaatggcacatccatatttctctcaagtaagggcagctgaaagtagcagaatgaggacacagtaa

SEQ ID NO: 78514 - DNA, 675 bp, Glycine max
  Peptide Sequence Number=SeqID_170199
atgaaagccaaaacggtgaaaggaaattggagcttgaggacgaacaagctcagcttcccttacgtcttcctcgtctgcatcttcttcttcctcgctggattcttcggtttcactctcttctctcactctcaggtctttcttctaagttttaattacttcgctgtttcagattttcttgttttttgttttttgctggaaaatattgatataatatcgatcgctgagaattcgcagggcgatggagatggcttgaggccgaggcagaggctgcttgaaccggggaacgaggcggagtacaatttgatgcctgttagagatcttggcgatgattccattacatcgattccttttcaggttttgagctggagacctcgagcactatattttcctaattttgcaactgcagaacaatgtgaaaacattattgatgtggcaaaggatggcctcaaaccatcaaccttggcgttacgccagggagaaacagaggagaataccaagggaattagaacaagctctggcgtgtttgttagtgcttctgaggataaaacagggactttagctgtcattgaggagaaaattgctagagcaacaatgattcccagaagtcatggagaggtaacatccctattgagcagaaaaggcattttggaaggtcttatcaatctgatttactga

SEQ ID NO: 78515 - DNA, 807 bp, Glycine max
  Peptide Sequence Number=SeqID_170200
atggcagcattgcctccaatttgtgtggttggaagtgtagcctggttcgtggtggtgccactgatttgtttccatgttgttgagtggcaccaacccgatagagttttacgacaatttggattgcaacaacctattcccgggtgtctttcgcaaccacagaatctccatggcataacgctcaaaggcaaacaagacgaaaattggttccacctgttagccccgatcatcagtcaatggaacaatcgagctgagtttagggtcgacgtttatcctcgacaggagggcctactgggttttaactcggactacatggtgtggtataggcgtaaaacaaagatttttgtcgacccaaataattcaaacacaactacattgggtgaagttgtggagactttacagtatatggtgtcaccacaagggaggaacacatggacagttgatgatctcgtgccttacgtggaaaagttagtgattatatccgaagagcaagagagaatcattgagctagtgttacatggtccagcatcagagcgtgaattcccaacacaagagtttcacattcttcagtcaagtgttgaaactcggggcataggcagaggaagggagtctgttgaagcggaacaatattcccaacaaataatggagcgtggtcatggaatttttctgctgaggctgagcaagcagaagcggggagacaacgcggcagaagaaatcctaatcgtcaagcgcgaagatgggatcgaccatgtggcacatcctcacgacatcatggacaccataatgactgattttgatgtctctgtgtaa

SEQ ID NO: 78516 - DNA, 522 bp, Glycine max
  Peptide Sequence Number=SeqID_170201
atggttattgaggccaccgttggtactaagcaaagaacctacaaaacaaaaagaaaagcaaaatgcagaaaaagcaaacaacgacagaaactctcaaactcaaacacccaggggaatagagcccaccaaactcctccctcaagtccagcagcacaaagaataaatatggacaagcgccttgcctttgtgtctacatggcgctggaggcgcaagcagcaatggcgcgttgaggaaggcgctagtcaaactggcgtgttggccctagggtgcagcagagcagggacgcgcagagtgctgtgctgcagcaatgcagcaggaagcgccattggaggttgcacgttgcagttgcaggggggaggcgccatcatgaggagcgatttgctcctttatatgcagttctcgtccactgcattgctactcactctcctcagccttcgactttcatcttggttatccagaaagcttgcttccttgcttcctttgcttctttcgtttctgctgcttgtaacttcttggttataa

SEQ ID NO: 78517 - DNA, 285 bp, Glycine max
  Peptide Sequence Number=SeqID_170202
atggaatgccctaaagatgttgagaagtataacaacatgattaattctcaacgagtttatgtctttttggctggcctggattcacatttggatgcaattcatagtcgtatccttgctaccactccccttccaaatgttcaaccagtttatgcaactgtttatgtcgaggcaaaccgccaagaggctatgcttgatagtgagtctactatggggactgcctttgctgttaagaagtattctaagaaaggaatccacaattgtacccacttgcatggggatactcat

SEQ ID NO: 78518 - DNA, 408 bp, Glycine max
  Peptide Sequence Number=SeqID_170203
atgcaattcaaggaattaattgaatatactcaacaagcatttaaaagtctagaaattcaagtagaggttgaagctcatgaggaaagcctagtagaagagcgtgattcaagagaaaaagataaagaaaaaagtgaggagaaagcacaacaatgggagaagtgctcacaagtagaaattcaacaagaaagtattctccaagtcaatactcctccccatcaattgattgtcaaggaagaaaggcatggagaacatgagaaagccttaagtgtcattctttccttgatcactagcacttctcttgcaatgatatggatggtgtttccggaatacatgagtttcatggagtctctagctaagaagcaaaaatgcaaggaagatgtgttttatgtgaccttcatgccaccttga

SEQ ID NO: 78519 - DNA, 195 bp, Glycine max
  Peptide Sequence Number=SeqID_170204
atggctctaaactattcaggaccaaatgctacatgtatgcatgcatctggagctccatcctctgtatgtgagctgagatggactctagaggtggtggctgatgtggaggcggtggtggtgcttatgtggccggctgctgctactggtcttgccccaactgttgtgcctgccttggcatgcaatatttctcaatga

SEQ ID NO: 78520 - DNA, 390 bp, Glycine max
  Peptide Sequence Number=SeqID_170205
atggagaaattggagaaggtgcgcaacacaattcaccctgtcacaaggattgaggtggcaacgttcgcagcgaacatgcggaatgtggaggaatcatgcggtgcatttgtgacggatgtctacaggccctcgacgacgaacttggcaaacttggaaggtgagaagagggagaaggagaggagggagatgaggaaccaaacccaacccaccgtgccttttgtgaggatggagattaggatggagatagacaaacccaccccgacctgtcctgctgccatccgtatctgggtttcaagaatggttacaaatgctggcattcataagccagtttccaataatcaaaactgggtctcacaagagccatctaacctaaagatcagtaatggctga

SEQ ID NO: 78521 - DNA, 363 bp, Glycine max
  Peptide Sequence Number=SeqID_170206
atggctacaccacctagctctcctcctcctcctcctccttctggtgcagcatcgcattcaccgtctaccttgaagcggacaagaaaggccacacgcctaagatcattagcgactagaccagttggggcagagagacccttggtccatgtggatcctattaccgggaaagtgggcagtccccacagaaagaagtttagaacatatttggggatcgtcgcttgtgataaggtggatgtgacatacgagaattggaagcaaccgacaaagatagtgtcgacgacactgtatgcgaaaagtatgacattagcaaggagaagtggacccaattttgtcagacctgcagagaccattcgtgggaggtaa

SEQ ID NO: 78522 - DNA, 237 bp, Glycine max
  Peptide Sequence Number=SeqID_170207
atgtctcattttcaagggtttttcaaaggaagtgtgaaaacatccaataacgggttctactacgtgcggtggtccgacggcaagcagtggcggctcgtggcggtcaccggtggttgtgggtggaggaggatgaggtttagggtttggggaaaaagaagaaggatcccgcttagcgagctcgtctcgctaagtgaaatttcacttttggcactaagcgagacacttcacgctaagtga

SEQ ID NO: 78523 - DNA, 633 bp, Glycine max
  Peptide Sequence Number=SeqID_170208
atgacccgcactaagaaaactggccaaatgacatctgaggcaacaaaggattttgctaacaagattgcctcacagggtttctttgtcgcccatagacgtcagggtgtgctgactgctgccattaggcaaccaaaacaccctggtggtgtgcgtgctactggagttgatgtcacgatcaaacaatactttggatcggctccaaggacctcccacatgtcttcgtccatggttcctgaagacttggaaaacttaatgcaaaaaatcagggaccaactggaggagtcgatcactgaaaaagtgactcgacaactaatgttgtccttcaaccagatgcaatcccagtttcaatcgtatatgcaatcacagggactcgcactgtctcttgagcctgaggggtcgacaaccgttcacaacatcctttttcacaatgatcaagtcaaggttggtgttgaggaagttagagatgcagatgctcccattcctacacccattcaagagggagttgtgggactgataaaacttgcagataggccaaatcatgatgtcgatgatcccctatatctgatgacattaaccatcccacagctttttctaaagtcgttgcaggttatgcgggatgctaccgtgtttggg

SEQ ID NO: 78524 - DNA, 414 bp, Glycine max
  Peptide Sequence Number=SeqID_170209
atgattggaagataccacaacaccttcgctgggggcccatctttgaattttcgtcactaccacactcgtcatcatccttcactttgtatcgtgatccctaaacctagggcatttgtgcatttcttcaaactcatgtctgtacagtatgcaatcattaggaggcatatgcttgctaaaaagactcttgtccaaaatcatgaatcatatcctctaagcgatctcccatttctacatcaaacggttcagattgggacctgtcacaacctaccctttggcgggaggccgacgcaaggctcacgggtgcgtcttccaaggaaggtccttaccgccacaatgtttgatatcaaagaggatgatatctctaggaacctttgcaagctagatgctaccaccttgggaattatcactaaatag

SEQ ID NO: 78525 - DNA, 585 bp, Glycine max
  Peptide Sequence Number=SeqID_170210
atgggtgacatagaagaggtgcaagaacaaatgaaggccgatatgaaggccttgaaggaacaaatgacctccatgattgaggccatgttaagcatgaagcgaatgatagaaagcaacacgaccacaacagccatcactagtgccgctgctgaggtagacccgacccatccctccgccataaaccaagcaaaccaacccatcccggacgtgttaggtcaaggaagagaggtgttgggcagcaccggcggtccacacggtcagcaaccccagcctatagggggagcccgtgaagaacctcgggagcatgctcaaggggggccgcctccagcagtggaagggaaagagaaacttgatctcatcgaggagagattaagggatgttgaagggtttggtgattacccttccactgacatggcagaattgtgtttggtacttgatgctgtcattcccccaaaattcaagggacgagaaattgttaatgcatttcttctaagaaagtttggcctaagcggcggtcatctagtataccaatttggtggcttctcgtatctgcacatggaaggacttgattactgccttcattag

SEQ ID NO: 78526 - DNA, 513 bp, Glycine max
  Peptide Sequence Number=SeqID_170211
atgccgctggagaaggttccaatgcggccccacaggtggacatggagtttgatgggcacaggttctgaagtgaagaacaccagcgatgatttgaggccattaaaggttggtcgttcctcaaggagagaggaggaagttagagacaaacgctcctgggtgagaggccagtggatccccttcgatgaggatgtcattaatcagtttctggggcatccattggtcttggaggagggccaacgctgtgtagggtcaggtgtcgtagcagccagaggaggaccagcagcagccagctgcagatgcaccgtcgctacccctataggagacaccatccctgggagtcaggaccccagtcctttcccttggcctacccccgagcagttcggggccacagttgcctggcctggagatgaggccgattttgagacacgggcaagacccgtaggggcccttggggacgacgaaggagctcaggaggatgacaatatggccgacgtgttggatttcttcacttga

SEQ ID NO: 78527 - DNA, 1197 bp, Glycine max
  Peptide Sequence Number=SeqID_170212
atgaccaccgcgaaggcgccgcggccgccgtgccgctccggagtcttccgcaatatcgtatgcggaccgtcgccggcggcggagacgctagggtttcccaggctccgcggaatcagcgtcgccggattgcaccgcagtcacagaaacctcgtcctccgtgcgagatcgaagccgattaaggtgaaggagaacgcaaccgtaagcgcttctctgatcgatgactggttcaagccaattacggcgaaggaggattctgatgctggtgcgttttctggttctgcgatcttcgttttcagttcgctatcaagatctggaattaatgtcttttttttttcttttgaaatgcgaatatttaagactcgttgttatagttggtcacgcgcaaacaaattcaacgatataattattatgggaaaagacggcgaaaaaaacgaacatattcttgttgagtggctcttgatagctgataaaggtgacttttctggtaaaaatctctcccagatgtcaaatgttgcgaactcgacaaatattatgtggcatgactgtccaattcagaaacaagatagacagcagctgcttcagcaaaaaggctgtgttatatggctaactggcctcagtggttcagatcagctacccagtcagaatgaattttctttgcttattatctatgctgcattgcctttaagtctaatacaaggaaaaagcactattgcatgtgctttgagtcgaagcttgcactccaaaggaaaactgtcttacatccttgatggtgacaatattcggcatggtctaaaccaagatcttagtttcagagcagaagatcgttctgaaaacattagaaggattggtgaggtggctaaactctttgcagatgctggtgttatttgcatcactagtttaatatcaccataccaaaaggatagagatgcatgcagagcactaatgccaaaaggagattttattgaggttttcatagatgttccactacatgtgtgtgaagctagggacccaaagggactctacaagcttgctcgagctggaaagatcaaaggtttcactggtatagatgatccatatgaaccaccgagtagttgtgagatagtattacaacagaaaggaagtaactgtaagtctcccagtgatatggctgaagaagtgatatcctacttagaggagaatggatacctacgggcttga

SEQ ID NO: 78528 - DNA, 1095 bp, Glycine max
  Peptide Sequence Number=SeqID_170213
atgccagaaggagaacccaccaatggttactgcagcagcagcagcggcgaagaagacggtgacgccgcttggagagcagccatcgattccattgctcaaaccaccacctatgtctcttccaccaccaaacacactcaccctaatcatgatgatgatgatgattacgatggccacaaacccaaaacacgacaacttaagcactaccaactcaaggcacaaaaccttctgaatgaaatattggaaaattcaatagagatagtgagaaaacctgtccctgtcgtggatgaggatcccgagagcaatgaatgcggcattcgcttgtttaaacatgctcagccaggaatagtgtttgatcacatttggggtagttttgttggcttttactttgctatggtaagttggcttttatgtggtagtgttgttggtggcagtaggtcactagtcaccattgttcttgacttgaacatgaaaaatttgagaacttctctgaaatatgaaaaaagctgcattgtggtaaaagcagcttctggtgctgatgaacctcaaccaccaaggaaacggcctagaatacttcctggaggggatattgatgagaaatcaaagaagcagtttagaaagcagattagatctgttgctgttaatggtatagaaataatagctgcagcaaacgatgcatacaagaagtcattagctagactagaagctaaagatgcagcagcaaaagctaaagccaagagagaagatgaaagagttgaaaatttgaaaaagattaggggagaaaagtggctaccttccatggcccaggagatgcaggataaggacgagctttcgaccatgatcgtgggcatcatctctctccattggtctggcacttgcaattccctttccaatgacatccactctcgcatctgctggtcaagtctctcaatacttgccatcgatgatacccacgtttgtgctatcgaggtggggtttgagtattttgggttagcacgaggagttgtgcctggttgtgcgattaaagggtcgaatggttcggttgtgtgttgggctaacaatgggcaattctcgatggcaccttgtatttcaaaatga

SEQ ID NO: 78529 - DNA, 189 bp, Glycine max
  Peptide Sequence Number=SeqID_170214
atgggtacttacttggattgtagagaagttacaagcaagacggagacaaagaagcagagaacacgaaagcatagtgcagatgaatgccaaatgattgcaagtgcaactgtctcgcttagcgagaccccttcagccaatgggtgggggttggcgcacttagcgcaaggtgctacttgctcagctcataag

SEQ ID NO: 78530 - DNA, 342 bp, Glycine max
  Peptide Sequence Number=SeqID_170215
atggactcagaaatctaccctgaggctcatgagaaccgtaaggccttcttcagcagctctagcccaatcctcttagagcctcttgctcatggctctagtgactggtcctttcctagggaggattgcatcagttcatggcccaggtggcctgcccaggagtccagccttctcctatcaggagagcaaatatggcagcagcgcagagcacctgggacccttggcccactccagcataggacacacctctgccagcccaggatgctccttcctcacctcaagacgaccctacaccgacacaggagggctgaagacatgattcatttacattttctgctattttga

SEQ ID NO: 78531 - DNA, 165 bp, Glycine max
  Peptide Sequence Number=SeqID_170216
atggaggttgaggaaccttggctagggttatggctaccattgaattatcaagtagatatgggagcaaggtggtgtttggcaacgaatatgcggcaggcagactttgaggctgatttagggatgacctttgtggatgattgggtggtgggtaatgagaagggctaa

SEQ ID NO: 78532 - DNA, 465 bp, Glycine max
  Peptide Sequence Number=SeqID_170217
atgaccggaaggctttttgtcggatcattggctcttgaaagccgcatccttcactatcttattgtgcgcattttacttccaagatcttcaaaccttgcacaatttaacatccctcttgattctgaaccttatgttccaatcaagagatccttcttgatcggtgctgctgtgattgcatcttttggttactgcaaagagcgtgatggctcttgggtaaaaaagggtgctcaaccccatgatgatgaaggacacttaccaataagagaggattcctctctccttcaaagtattttggacaggtttgatggtcttcaaacctatgttggtgaaaggtttgatgctttggaacaacaagtggacatgcgattcgacgagatggactcaaggatcaccaaggttgaaggagatgtcacttacatctgcacatgctttgatctaccaccaccactaccaccatcatcttag

SEQ ID NO: 78533 - DNA, 1032 bp, Glycine max
  Peptide Sequence Number=SeqID_170218
atggcctctaggaagaggaaatctaccgcctccagaccccaggagccctatgaaaccactagattcatatctgagggcgcctgggagagatatgcacagaacgttcactcccggaacatccttctggagaggaaccctgacggtcacattgatgtggccctggtcaagaaattctatgctaatctttacgatccagaggacaagtccctgcgacaagtcagagtctggggcaagcttataaagtttgatgctgagaccctcaacaccttcctggagaccccaatggtcttggagcctagggagcactacaccctttactccagattctatcattcacatccaggtcccaaggagatggcttctagactttgcattccaggggtgaggttagtctacgggctggtcatgaagatggatatggacttgggctcgctcatttcaggccagatatcacagatggcccagtccaactcctctcggctcggctttcctacacttattacaaccttgtgcgtagccagaggagtagtatccgactcccttaccttcgagtccctgagccctgccattaatttggcatacatcaggaagaattgctggaacctggatgatcccacgatcacctttccggggacccacaaagctagggctcggggaccatcaaacgcttccacttcagctccctcttcttctgctcctctagcaccagctgcagctcccactcctgccactcaacctccaccatggcttatgcttggtgatgcagagtatacacgacctggctcaggattggccgattatgaacatggaggatttcatggcctaggtgccctggccaggagtccagccttcaccttttggggggggggggtgacgcccgaggccactccagagactacccctgctgccacaccacttgtggaggttacagaggatgaggatggcactgcaaacacagattatgcagctgacatggtagcggcgcagagcacttgggatccctggcccactacagcacaggagacaccttag

SEQ ID NO: 78534 - DNA, 432 bp, Glycine max
  Peptide Sequence Number=SeqID_170219
atggggttgtgggaatcttttctcaattggcttcgcagcctctttttcaagcaggaaatggaattatctctgattggacttcagaatgctgggaagacttcacttgtaaatgttattgctactggcgggtatagcgaggacatgattcctacagtgggattcaatatgaggaagttagagcagtttgtacagcgagaaaatccagataaccttagcatatcaaagagtgaactacatgatttgttgagtaagccatcattgagtggtattccattgctggtattggggaacaagattgacaaacctggggttctgtctaaagaagctttgaccgaccaaattgacatatatctggaagttgctggaggcatctgcatggctaacttggttgcagattactttattcctgcccttttctcatttgcttcttaa

SEQ ID NO: 78535 - DNA, 372 bp, Glycine max
  Peptide Sequence Number=SeqID_170220
atgggaaagagaggagttaactctgatcaagaaactatccttcattgtcttagagattgtcgttttactcactctatatggatgaagcttggttgcaatgatcttggcttcttctcaacaaacatctcttgtgattggattaagtatgccttggctgctcctgaagttaactcccctcttttcctggctggtctatgggaagtagtttggcatcgtgatcatgaggagggagccattcttaatgttgacggtagttgtctgaccaactcgggaaaaggagacttctctccggtgtactttgatttccttggaagagcagagaaacaagatttcactcccttaactattctttctgcctctctacatttgtga

SEQ ID NO: 78536 - DNA, 300 bp, Glycine max
  Peptide Sequence Number=SeqID_170221
atggaaactgagatacttttctttaatgttctaaagttaccacaaaggtcatcacctccaacaattgtggttcaagagtcaactatagttcaagatcaagttaatgaaccaatcttagagctaattcaacaacctatgaaccaagtgcatgagccttctagaaaatctactcaagtgcaccgtgtacctgatagactaaacttgatggtcctagataacacatcaaatgaggtttatcacgatgatgatgatccaagaaactatgaagaggctatgcaaagcttgaattgtaagaaatga

SEQ ID NO: 78537 - DNA, 276 bp, Glycine max
  Peptide Sequence Number=SeqID_170222
atgtttcatgttgcaaattctgttacgtcatatgggcataatgtaccttatcatgagtcggaactgccaagaaatataagcaatttacatgacgatgaagatgatgatgatgattatcttgcgtctaactcatacgttgaagagtctttcgatgaaggtgatagtgttgatgaaatatctgatacagacgatgaagtcaccgacatcgttgaaccagtttcaattgttcacccaactgaagggttaagggtttatcgtgaagggtttaaggcttaa

SEQ ID NO: 78538 - DNA, 210 bp, Glycine max
  Peptide Sequence Number=SeqID_170223
atgcaagtcccaagcaaatcgctagtcaaactggcgagttcgtggcaggagaggcacagcctacatgcaggctacatgtgcaggctacgtgctgcagcagggcacaggcttggcgcagagggaagaactcgtcattggtgtagacgagatgcagctttggatcagggaagaactcgtcattttgactggcgagttgaggtgaagttttga

SEQ ID NO: 78539 - DNA, 156 bp, Glycine max
  Peptide Sequence Number=SeqID_170224
atggcgagtttgctgagcatctcccacgtggcaaggaaaacgccagtggtgatggcaatttcgtaccacctgcaagtcgccaactcttctggcgagtctgggctcagggttgttccagctttttcagatgaaagagaaggcacgtttttcaggtag

SEQ ID NO: 78540 - DNA, 585 bp, Glycine max
  Peptide Sequence Number=SeqID_170225
atggctgcaagtgacatagcaattttgagagataaagcccatattccaacaaaaaagaagcctgctagagctttcatcacaagatgcattgctgtcacaaaacaagctgctatccaagcaactggaagcattgaccgaaacattaagttgcaggttgcgtcatatgtggtggagcacatgagtccggctgctgtattccccaagaagaaacaccacatgaagtcaactacatggggaaccagccaagacacaatttcaatgcagatggattctctggattccagcatggccaacagtataatcaacaacagggacaatggagaaatcaccctagaaatccttgcaacaaagaccagggtggaccatccacaaggccgcaacaacaagggcctagtctctatgatcggacaacgaagctggaagagactctggctcaatttatgcagggtcaaagcgcttagcgcaagcaacagaggcttagcgcgtgaagacatggcgcttagcgcaagggttgcgtttagcgcaagggttgcgcttagcgcaagggttgcgcttagcggatggacaactaaaaaaaatttctaa

SEQ ID NO: 78541 - DNA, 1215 bp, Glycine max
  Peptide Sequence Number=SeqID_170226
atggcttttgaagagctcgttggaatccttaaattccatgagcaaaagcttgctcaagataaaagaacaaagaaaaggaaatcattagccattaaggttcaaagactaaaatgcaactctgcatccaaagagtattcgttcaaagcctttgtcgcgaatgatgctttcgaagaagaatccgatgatgacgactttgatgatgagctaagtctgatcaggtttaatggatcattcaaaagatccttccacaagaaagagaaaagtctaatcatctgctatgagtgtaagaaactaacgcttcaagacctggatgattcctcatctgacgaagacaataaggaagaagccaacctatgtctgatggttgatgtgcccaccagtaaggtagaaccaacattggatatgagttcggaaaatgaggactctcaacttgaggacactgtcaactctgatggtgaagagcatgacgatctcaagaaagctcatcaaattcacatagttgattttgtcctggaaaccaacttgcctggtagtgtacaagatgcctctgtttgtgatgtagtcaaagtactgatggacaaaaaggaagaaagggtcaaatccttaaccatagctcttgaagatacagaagaaggacgtaaggaaatgcttgaacaaaaactcttacttcaaaaagaatgcacccttgctaatgatgaacttgataagattaaaaggaaaaactcaaatctttggacgaaatgtcttgaaggaacaacatttgagattgtaaaactctatgaggaaatagaaaccttgagagataaactaggcaagtttattggtggtcatgaagctcttaacaaaattattaaggtgcaaagaaaccccaaagacaaatttggccatggtttcaaaggcaaaaagatcatacatggaaagaaacaccaagcttggtacctagatagtggctgcttacaacacatgacaggcaaaaagtctatgttccaatctgtaagccctatgtctggtggggtggccacttttgaagggaatcggaaagaaatgagaatagaaaatatcatcaagtttgcttctgcgtccaatcaagatgagcttgcatctaacacatcagtggacgatcaacctaaagaagccagagaactaactagatgcttgctaagaaaacattatccagagtctcatatcattggtgatcctatggataaagtctag

SEQ ID NO: 78542 - DNA, 126 bp, Glycine max
  Peptide Sequence Number=SeqID_170227
atggttgagaaaagaggaagaaagggtggtgttcaaagagttcatttgttggatggcactattagtggagttctgttgttagaactgttcaagagagatgggatgggaacaatggtggctaggtag

SEQ ID NO: 78543 - DNA, 465 bp, Glycine max
  Peptide Sequence Number=SeqID_170228
atgcttaaatactggatattgatgagttttgttttccacagcacctatgaagttgcgacagcctgtgccttggctgtacgagctgacaagcttatatgcattacagatggtccaatactggatgaaagtggacaccttattcgtttcttgactcttcaagaggcagacatgttaattcgtaagcggcttgagcaaagtgaaacaactgctaactatgtgaaagctgttgctgaagaaagtttcaaatctcttaaaaattttaatggggcagtccattcttcacagaatggaaaaccattttcagaatgtcataattcaacctttcataatggtgttggttttgacaatgggaatggcctatctgaggagcagggttttgctattggaggtcaagagtcactatgtcgaacaaatggttacctgtcagaactggctgctgcagcctttgtttgtagagtgagttga

SEQ ID NO: 78544 - DNA, 321 bp, Glycine max
  Peptide Sequence Number=SeqID_170229
atggtgttccgcagcttcaccaacaccctcgaatcttatgaggccgaattgcgcactgacatcggaaaaggattcgaggtcgacaagatcctcgacctaatcttctccctctacgtccccaagttccacgctgattgcctccttgcgctcctcggtttcttcaagcactacctctcttcctcctccgacgcgccgcttgcctccacgctctctaagttggagacttctcttctacgcttctacgtcattcacgtcgtccagtgcaaccgcaacgacaatgttgtcaacttcttcacgctatacggtgtcgaattactatag

SEQ ID NO: 78545 - DNA, 261 bp, Glycine max
  Peptide Sequence Number=SeqID_170230
atgagcaaccacaatcatcaacaacagccttcaactgctgctcctgccccacaagagtctccaacaaaggacaaggaccttgacactcgatcggcatgcccgccgccaggcggtgcagcacagttcgttcaaccccctcttactcccactgaagaaatcggttgtcttgaaaaatggtatgccattctttttttattaacccgaagtgtctcaataaatttgaagaacagatcttctaaaataaaacggtgcagtatttaa

SEQ ID NO: 78546 - DNA, 432 bp, Glycine max
  Peptide Sequence Number=SeqID_170231
atggccctcatatttgcaaaaaacatggccattctaacagccttgaataacaccgtctcaaaggtcatacgtgaactagttaagattcttgtggacaaagtggctcttgacgacacactcctctctctcgatgatgtgttagagcaacaaggatttgatagtggcaaaaaaggcgacgacgatgttgtcctcacatgcatcaacaaggctaactccaaactcttatcgcaccagaagatctttaaggtcgacaaccacatcggtgttgccatcgttggcctcaccatcgcgaccgtgtcctctcttgctacatgcgatccgagtctccacattgaacatgatgtcgtcgtcctcttacaggtcttgtcgggttcgagtttgaagaaggaaaggggatcctaccactattatggaatgactatttcagaatag

SEQ ID NO: 78547 - DNA, 732 bp, Glycine max
  Peptide Sequence Number=SeqID_170232
atggctgaatcatcaaaaaagcgaaagggctcatccacttcctccggcgctgctgcccatcgacaccacagaccatctgaagctcccacagcaccacttcccccttccttatcatctccacgatcatctattctattttcttcagatgatgaatgtctacgtcaaggtgcaccttttgaggacaccattgttgatgactggaagttcaactattctagtcatgatgctcgccatatggtctgtaatgaccaggctgatatgaccggtagattgttggctggatcattaacctttgattgtcgcatcatgcactatatcatagttagaattttgcttccccgttcatctaatctggctcaagcctctgaggagaacttgattttgatgagggctttccttaccggtcgtcagatcgactgggctcacttggttaggtaccgaatgcataaggcattacgggccaatgcacctcttccgtatcctcaattgtggctgaagaaggacgcgcaacctccgcaagacgagcatactccctctcctcctcctcaacgagatgattcctcaacccttatgaatgaagttctttcggaattacggggcctccgcacctatgttggcgaacgctttgattccttggatggtcgctttgaaggaatggatacccacatcacccagcttgaagaggatgtgagttatcttcgtcggtgcttcgaccttccaccaccttcctag

SEQ ID NO: 78548 - DNA, 549 bp, Glycine max
  Peptide Sequence Number=SeqID_170233
atggaagacaacttgaaccccatggactttgggaatccccagaatgagagcagtttattctgggatgtggtttttcgtacctcgatccataaccatatgcacaacatacctaaagtcacccacattgatatggaaaagctgaactttgtgaactacgtaaaaggcccgcatgtagaggcaaatcgagtctgcaccattttgtgtgcagttgaagaccgagggaaggatttgttgaacaagaagatgcttgaaaatgataaagctcgacttactgttgaggtggaaaaattgaggaagcaaatggtggatgctgaggagaatcgggaaaagctaaccaccttagaggtgcaattgacctcgacaaaaaatgaggtggacaaggtaaagttcgacttgactatggtggacaccaaattggctcaacaaattgttgaaggttttaaggatgcaatagtacaagtgaagattgttgtcgaggacgtggatttcgatgtggtcgacccctccaaagaggttgtaaattatgaaattgtggaggttgtcgaatga

SEQ ID NO: 78549 - DNA, 1119 bp, Glycine max
  Peptide Sequence Number=SeqID_170234
atgaggaataacttagaaatttttttcagtcatccactcgctcagcgtgccctatgcgctaagcgaatcatccttcatacactgagtgagtcatcactcgcgctaagctcgtcaacccctacccattggctgaaaggggagctcgagcggaggcagtggcataaagccttgaccaggcagcctgatggtcacatagatgtggccctggtcaaggagttttatgcaaacctttatgatcctgaagataagtccccgaggcaagtcagagtgtggggcaagttgattaagtttggtggggactcgctgaacacattcttggagaccctggtgggagtgtcctggaagctcctgaggaaggatttgaccactctagctcagacctggagcgtcttgtcctactctaaccttgcccctacctctcacacgttcgatcttaatgtggatagggcgaggttgatctctcaaatagcccagtccaacttctctcgacttggttttcctgcactcatcactgccttgtgcatagccagaggagtagtaccaaactccctcaccttcaagtccctgagccctgccattaatttggcgtacatcaggaagaactgctggaacccggatgatcccatgatcacttttttggggacttgcaaagctagggctcaaggaccatcagacgcttcagctccttcttcttcgactcctcctgctccagctccaccagcaccaccaactcccattcctacacctctagtaccctccgacacctccgctcagagctcagacaccatggtgccgatgctaaagagccttcaccatggcttatgcctgccttctcctttggggggaggtgaggctcctacagcccaagagccgaacccagagccggaggcgacgcccgaggccacactggaggaaactccagagattacccctgctgccacaccatctgaggcacctgaggagagagacggtgctgcagacacagattatgttgtagacatggcagcaacgcagagctcctgggatccctggcccactccagcactagatacatctttgctagctcaggatgcgccttccatacctcaggatgatcccacacaagtgaaggatgattga

SEQ ID NO: 78550 - DNA, 237 bp, Glycine max
  Peptide Sequence Number=SeqID_170235
atgactattgtgacttgttacgtgatggtgggtaatgaattatggtgtcacaaaaaggacttggttggcaaggtagagggcattgcggcagagaaggatgagcttgccaaggtggtggcggacctccaggatgtgaagaacgatgttatgcatgatgaggaagatattgccactgaagaggaagctactgaggagaaggatggcgaggaggagcaagatgttagggctagtgtttag

SEQ ID NO: 78551 - DNA, 1287 bp, Glycine max
  Peptide Sequence Number=SeqID_170236
atggcaaagttcagttccagaaaaaaatcctccatttgggtccccaacggttgcatcttcttcctcggaggagcactcacaaccctccttctcctctggggtctatcctccttcataatccccatcccaaactctgacccagaactcaaccctgtctccacaaaactcagttccctccaattccccacaaacaccgactcaccagaaacaactttttacgacgaccccgaaacgagttacaccatggacaagcccatgcacaactgggacgagaagagaaaacagtggcttttgcatcatccttcattcaccgtcacgacacatgatagcaagatcctcgtcgtgacggggtcgcagccgaagcgctgccacaaccccatcggcgatcaccttctattaaggttcttcaagaacaaggttgactactgccgcctccacaactacgacataatttacaataacgccctattgcaccccaaaatgggatcatactgggccaagtacccggtgatccgagccgccatggtggctcacccggaggccgagtgggtctggtgggtcgactcggacgcggtcttcaccgacatggagttcactctccctctcaaccgctacaaggaccacaacctcgttgtccacggttgggaaaatctcgtacgtgaaaaccgtagctggacggggcttaacgccggcgttttcctcatgagaaactgtcagtggtcgttggattttatggacgtgtgggccagcatgggcccaatgtccccggagtatgaaaaatggggggaaaccttaaaatccacgttcaaggacaaggttcttccggactcggacgatcagacggcgctggcatatctgatcgcggttgagaacaaatgggcggacaagatctttctggagagtgagtactatttccaaggctactggttggagatttcgaagacttactataacgttagcgagaggtacgatgaggtggagagaaaggttaaaggattgaggaggaggcacgcggagaaagtgagtgaaagttatggtttgatgagggaggagtatttgaacgatgtgggagagtggaagaggcctttcatcacgcatttcactgggtgccaaccctgcaatggacaccataaccctgcgtatgatgctatggattgctggaacagcatggagagggctcttaacttcgctgataatcaggtgttgcgcgtctatggttacatgcgtaaggatctcttgaataaggccatttcacctataccttttgattatcccaatgttgtgtag

SEQ ID NO: 78552 - DNA, 270 bp, Glycine max
  Peptide Sequence Number=SeqID_170237
atgaccaaatcccaaagactcgttgttcttaaatgggttaaagaactaaagttaccaaatggctacgcctccaatttaggtcgtgcgtggatcttaacaagggaaaaattcatggaagaaaagtcatgttttcatccaacgattgcttcctgtggaagcaatgtcttccaaggttattttgatgatgccaaagaatcaagagttaagcaaattccaaagattcaagaatcaagttctcaagaatcaagattcaagaatcaagtttcatga

SEQ ID NO: 78553 - DNA, 567 bp, Glycine max
  Peptide Sequence Number=SeqID_170238
atggctgaatgggcagagggtgcaggacttaattgtcgattgctgcaatcacaacttcattctggtatcagaagcagagaaaagcttattcaagcaaatttgcgcatggtagtccatgttgccaaaagttatcaggggcgtggtctcagccttcaggacttactacaagagggaagtatgggtcttatgaagagtgttgaaaaattcaatcccctagccggtagtcgatttggtaattatgcattctggtggataaggcaagcaataaggaaggcagagaaggtatttatcctattgggcaaggtaatagaggctaagaaattgtacattcaggaaggaaaccttcacccaactaaagaagaattagcaagaagggtaggagttactgtagaaaagattgacaaattactattttctgcaagaattccaatttcaatgcagcaaactgtgtgggctgaccaaaatacaactttccagcggcttcaaatggaacaagacgcaacggacacgagatggtggttgtcagagacgatggtctttgtcggagaagatgctctgtgtagctag

SEQ ID NO: 78554 - DNA, 444 bp, Glycine max
  Peptide Sequence Number=SeqID_170239
atgatttcaccagagattcatctaataggggaaagttctaatgatgatccctctcaccattacagtggcttcaacactgccagtgatcatgtttccagctctcccgctgataacactgcccctattgatggcatggctcctcctaacactggtgtcgttgcccctattggtggcactgctactgctgaaggaggactccgctctaactccaacgtgtgtgagaatcctggggaggatgaggtcgagtctcctttgcctaatcctcctcctatgcaagtcatagtgccttgtccttttattcctcccccacctcctccactcagaaaacctagtaaggccaagaaggtgtttcctcttgttgtccttctaggttacacctgggttcatagggagatttcaaaggcaacttcttttgagcgtgccctggagtcgagtcgaagctga

SEQ ID NO: 78555 - DNA, 348 bp, Glycine max
  Peptide Sequence Number=SeqID_170240
atgaagactcaattgaagagtatgaagatcaaagttgagaaaacaaaaacacttaagaaagatcttgctaatagtaaggagtttgtagccaagttgcaaacagatttcgataaacatgttgcttcattatctgctaagtctaaagagaataatactctgaatatcctggttgttgctttggacaaatctgtggcagatgttaaagccaaatttgctgacttttcttcacaatttgctgctgagcaaacaaagagcaaaactgctgaggaagagaagaaaattgctaaagacaaattgacatctgccaatgaagaggttgccaacttaaagaagattgttgcaagatag

SEQ ID NO: 78556 - DNA, 390 bp, Glycine max
  Peptide Sequence Number=SeqID_170241
atgtcttaccctactcaggcgaaagtgaagcagtacgtagataggtcagggcttaagagtttgtttgatgtgtggtacatgtccatgaataaaggcataatcaatgcctttatcaagagatggcataacacaacctacaccaggatagaaatcaaagcaatactattttttcaagaagagcgcgacgcatgtacacatctacaacttgtagtacctcaacgatctagatcgcaaccacaagtgtttgagcatctgccaaccattccttgtagtgataaggttttggattatgatcgtaagaagcaacttgaaactaggtggttattgttgaggggtaacaataaggttgttaggaccaaacaatttgttggatcggttgtaaatgattga

SEQ ID NO: 78557 - DNA, 129 bp, Glycine max
  Peptide Sequence Number=SeqID_170242
atgggtttggggttgctggcggcgtgtggtgatgcatgtgcgggtgttaagggtgggtggcgatgtttgagtggtggtggtcaggggatttatgctcatgagattaaggatagcaatgaacacttgtag

SEQ ID NO: 78558 - DNA, 285 bp, Glycine max
  Peptide Sequence Number=SeqID_170243
atggagccgaaacatatggggagaatcgagaatcaaaatttccagagggtacatacattgccaacgtgccacgtgacagttgttgtgaacgtggcagccttgtgtaaagatgtggtcgataatctgttacgtgataatgtcgcgccgcgctctttcactttggttctttgcacccagtcagtgactcagccacacaccacaaacacagatggccacattctatttgggattggagatcgcaaccgcaatcctagaaaacgtaatggttgcatagatctcgactag

SEQ ID NO: 78559 - DNA, 618 bp, Glycine max
  Peptide Sequence Number=SeqID_170244
atgtctttaaagattaaatccttttgtttgaagacacaaaaactgaacagtaaggacatcattggatcaggtggttatggtgtggtttatgaactaaaactagatgactccacgaccttggcaataaaaagactaaatcgcagaactgcagagagagataaaggttttgagagagagttggaagcaatggcaaacataaagcaccacaacattgtgacacttcatggatattacactgcaccacactacaatcttctcatatatgagctaatgcatgtcaatagcacgccttggttgagcagaacagtcctagaccgctatgggattcaaatagcagccattgtggcttttcaaaagctatattggcactaccatgatataaccttcaaaattccatttttgcttcaaccaagagttgtttctttgttggttttgctgctcaaaggaattttgctgaggtttaacttcaaaaaagtggtggtttttgacaactctactggcaggtggcaaaaactgaaggtcatctttttgaaagcactttgcttaggtatggcttcgaaacacatcttgaaagagctcaaggatttgcagaaggatcctcctacatcatggagatga

SEQ ID NO: 78560 - DNA, 141 bp, Glycine max
  Peptide Sequence Number=SeqID_170245
atgaaaggagcggtggctcgaccgaaacatcgagggcgatacaggcgaggtggcgaagagctagatagcgaggacgaggcagcaacaactagggttgtcaataagggccgaccccgcccgcttttggcctgccataaatag

SEQ ID NO: 78561 - DNA, 234 bp, Glycine max
  Peptide Sequence Number=SeqID_170246
ggttcctctcggtgtggggtttcaacggtgaactatggcggcttgcagcggccactggtggctgtgggttgtgtggaagaagcttgggacattggaaatggttttagggaagaggaagagaaaggaaagggcaattttaccgagatagctcttggcagcttccttgagaagctttctcgtgaggcttcctcaagaagctttctcgtgaggcttcctcgagaagctttctcgtga

SEQ ID NO: 78562 - DNA, 636 bp, Glycine max
  Peptide Sequence Number=SeqID_170247
atgtctaatcacaagagtactaagtcagccattaagaacctggaaatccaaggagtgtttgtggaggatgagagtaggagtaatgaaggagagttaggagctgagaaagaaaaagagaaagagggagaacagacaggagagagaaaaataaatgaggttgatgaagtacaaaatgagaaaaacaataaaaagagagaaagtgagggggataagagaaaaaagagtgaggagaaaaagactaagagtgagctgactcatcttctccttgaagtggcgtctcttctctctctctctcccttctccattctactatcattcatcttccaagaagcaaaggaatccattgatgaagaagatcctaggcctacaagctccattggagcttacatcactggatctttgagcttcaatgcagttcttcaatgctgggctcagcccaccatgaaggctaagtgcgagcatcacactaagcgtagcttcagcgcacttagcgcgatagagaatttggcagatcactcatttcaaggtcgtgcactaagcgctcaacacatgagggtgctaagccctaacccactaactcacgctaagcgcgagggtggtgctaagcgcagtgtcgcgattttagagcctatttaa

SEQ ID NO: 78563 - DNA, 163 bp, Glycine max
  Peptide Sequence Number=SeqID_170248
gttcgatggactccaaacttatgttggtgaaaggtttgatgctttggaacaacaagtggacacgcgattcaacgagatggactcaaggatcacaaaggttgaagaagatgtcaccttcattcgcacatgctttgatctaccaccaccaccaccatcgtcttag

SEQ ID NO: 78564 - DNA, 387 bp, Glycine max
  Peptide Sequence Number=SeqID_170249
gaacatgagatggaactccaacgactaaatcaaaatgaagaaaccaacaataggaaacgaagcatagcactaaaagccttctcatcaatgcaagaagaaaatgaagatgaagaatcagaagatgaagaagacttctcactctttgtgaagaagtttcacaaatttgtcaaaaatagaagaatcgagaggcgtcaaaatttcaaccatggaaaaagatcccatgaaggctctccaactcttagatgctacaagtgcaaccaacttggtcacatcaaagcaaatttcccctcaaatgagcaatggcctgagaagaataataagaaaagccatgaagaaagaaggaccaagaaggcttacatctcttgggataacaatgattcatcctaa

SEQ ID NO: 78565 - DNA, 227 bp, Glycine max
  Peptide Sequence Number=SeqID_170250
atggccccgaggaaacttgcctcaaagagatctaggaaggataaagcgactgaagggaccagttccgctcccgaatatgacagccaccgctttaggagcgctgaacaccagcagcgcttccaggccatcaagggatggtcatttctccgggagcgacgcgtccagctcacgcacgatgagtataccgatttcaaggaggagacagttcgccggcgtgggcatcactg

SEQ ID NO: 78566 - DNA, 228 bp, Glycine max
  Peptide Sequence Number=SeqID_170251
atgggtgttaagcatctcaaagtgatcaaccaatgtccgcagactgacaaaaattgtccctggacaaaattagggtatgacagggagcacgaaattgaaggagtaaaagagggagagaagttgaactttgagttgtgtctcacaagactctcattcatcaaagttgtcacaagtgttacacatgcttctgtttatagcctcagcagtttccttgagaaactctcttga

SEQ ID NO: 78567 - DNA, 372 bp, Glycine max
  Peptide Sequence Number=SeqID_170252
atgaaatggaggattgggggaactttctccaccgaatccttgagaaggatttttaggattccgcttcgattaaagtgttcctcttggtgggggggttcaacagcacacatcggcggctcgcggtggccaccggtggtcgtgggtggtggaggagagcatacaacactcgcccaggcgagtgaggctcgcctgggcgagctgatccacagctcaaattttctgcttcggacaaaacttcatatctcacgctccataggttatactacaaatcccaacggtcaaactgtgaatacttgtcttaggaacctccagaaaaaaacttacgatgatccaacggttaacgaatacaggatgccaatttcaatgagatag

SEQ ID NO: 78568 - DNA, 644 bp, Glycine max
  Peptide Sequence Number=SeqID_170253
ttcgaatagctgcacgtcttccatggtggcattgccgaatgaaactaccagaaaatgcacaacaactgccacttgcagacatggacaaatcaagtgaacaagcagcagggattgagcctcagagtagaagaagaagaagcaactcagcgtgggaagaagaagaagaagcaaccagcagcttcgtaaaccctaatttttttggggaagaagaagcaaccttgcatgttagtccggaagaacaacttcttctggaacacgttccggaagacgtccttccaaaacttcttctgaaagttcttctggaagtccaccttctttttccggaagttatttcggaaggacgtcttccagaacgtgttccggaagaaggcttactttgcacctatgcagtacttggggctctgtggctctacaataacaattcatcactggggtgggggaaactgaagccacaactgaaggagcatgaagaagcattgaaggagttcattgccaagggaaagatgatcggaacaactaatagtccaaaagggaaggctgagagtgataaggagaattttgatgaggaagctcagaagctgtggttgaggatgaagaatgagctcaaaactgaacttatggagaatggttttgatgttgaataa

SEQ ID NO: 78569 - DNA, 453 bp, Glycine max
  Peptide Sequence Number=SeqID_170254
atgtccaaggctcacactttagtccctatgctgcaaagcttatttcgaggacaatttattatcatgcacagcctgcaagagttggctcataacaggctaatcataattatggatcattttcttgagcaagtagcctggcctaaagctcaacttccattggtaagacccaacgaggttgctctgcctaagcccacacctgtgcaggttgatccagagccagctaacccacaatctccagtggtgaatccattgtcttctcctgagcgtgaagtagttcccccatctccacctctgattatcatcttcgatgcatcattagatgaagtggctgcccctcctgattcaccagcaggagaaacaactgaccttcctacttccctagttggaggaatttccgatctttctgatttgtcatctggagaagctgttgctctcactgattccccagtttag

SEQ ID NO: 78570 - DNA, 372 bp, Glycine max
  Peptide Sequence Number=SeqID_170255
atgaccaacaaggagaggccaccatcaacgaacaaactctttgatgtctgccaacagtcgagggagtcattgaaagagtttcttatgagattcaacaaagtgacttatcatattggagctaaagagttaatggctaggaaaagggaactggagaaaaaagagtatggtttgaaaccctatcggagacatttcttaaagcctcaaggaatttggataaagggaatggttggccaattctcaagaagatatgatgatgagagacataggagagaggaggaagtctatggggcactgactgttctgagacagcagattttgaaggaggtatatagcataaacctgataacatacactacatcgactgatcgatag

SEQ ID NO: 78571 - DNA, 981 bp, Glycine max
  Peptide Sequence Number=SeqID_170256
atggaagacgcacctgtgcgcctcgcctcgctcacccacaaaaggaccacacctttccggttttttcgacgttttcctcaaataaacattggtggtgactccacacattttcctttcttggaagacgcatccgtgagccccgtgtcgccctcccgccgaagggtaggttgcaacaaccattcaccgaagcaagccagagtgaaaggccacctggtgaggattgatgcagatagtctcaatgagtttcttgagacgcctgtagttctagaggagggggagactttacccacttactctagattctgcaggttaccatctgatcctcatgagattgaggttgcactatgcatacctggcaagggctttacgttgaacgctgagggccatccagggaagattttccggaaggatttgatcactctggcccaggtttggaatgttatctcttactccaacctggctcccacatcacatacctcagatctcactgtggatagagctcgacttgggttcccagcattgatcacttccctatgccgagccagaggggttgtgtttgacagcctcaccttcaagcgtctgagcccgaccattaacttggcctacattaggaagaactgttggaatgtagatgatctgacagttgctttcagaggggctaggagggtaggggcgaggccaactgatgttccttctacttctgctacaccagcactagcaccagctcccccatctacatctaatcaaggctctcagcgtgtagagtccatgctccagagtatattccaggcacaggtagaggatgcatcctttgaggccaccctcctagagccatttacttttcatgatgaggcaggcgagttacaggtgagacaggaagttattgctactcttgagaagtcaccattggtcacatcagatccacccacaccagtgtggacctatcctcacctcagcatgcagcagacccctccactctga

SEQ ID NO: 78572 - DNA, 681 bp, Glycine max
  Peptide Sequence Number=SeqID_170257
atggctactctaatgagtactacttgttatctggataaagatgaaaccggtcagtcaatagacttaaagaaatatagaggccaacgccgccacgacacatctggtgacccaccagcaccaaatcctccttcgttttcttctccaaggtcattgactctattttcttctgatgaccaacgtcaaaggtactattcccaattctctaatcgtgtcattctcgatcctaagtatttagatgtagaattctttgatggggaaacctttgatttgattcctatcaagtccaccaatcttgctcaggcctctaaggaggatttaattttgctatggggtcttcaaatcgatctccaaattgactgggcccatcttgttaggtaccaaatgcataaggcattatgggccaatgcacctcttccatatactcatcttgtcactttatttcttcagcatttcaatgttcctttagaggatgacccttttgttaatgttaaaagatcattttctattggtgcttgtgctactacctccttcggatactggaaggatatggatggccaatggctatgggatctttgggctttcatcggtgatcacttcgatgcaatggactcacatatcacatgtcttgaagacgatatgagcttcattcgatgttgctttgatcctcctacggattcttag

SEQ ID NO: 78573 - DNA, 474 bp, Glycine max
  Peptide Sequence Number=SeqID_170258
acccacaagacacccagtggacccggaaaagtccaacagggccctggggtttccagctctggttacgggcctctatcagtcctacagggtgcccgtacctctccggcaaggtcacgtcatcatagggatcgtgcccgcaagacacctagtggacccgaagaaggccaacagagtcttggagttgccagctctaaatacgggtctctgtcagttcaagggagtgtctgttgcccccagcaaggtcatcaggccccctaccaatcgagctttcatcaagaagtattgcgcccccaggcagatgcagggcgaaacaccacaacagcattgggatggccggtagcgggcaatagacgcaccgccgccacctctagagttcacctctgctcatccacaaaaaggtttgagtattgcctacaccacatggccgaccagcaggctaccaagtccaaagccaaagataagcaaaagtgctag

SEQ ID NO: 78574 - DNA, 846 bp, Glycine max
  Peptide Sequence Number=SeqID_170259
atggaagccacacttgttgatggcaatggaatggagacacgacatatcattgtgactaccattgggggtaaatggttttatattagacgtctcgggttttatattgccaccaagaacatctcggaagctctacgcgatgaggggatactccacggggctgttgtcgtggatcgggttggggatcgaggcctcctactcaatgcctacattagagacctgcgattgaggctttggtgtctaggtggagtcgaagcgctttccaagttcccctcaatgaagccctccctcgcgacatcaccctctaagggcgggaacgagtacctgcttcagatgggaatggcttctgggcaccgcaccttccatatgggttccatgagtgcacctctctattgctcttcattctggttgcagtcgccgatgccgtttcagagcgagttcaacgagtttctcaaggccaccgacactaaggtcgccatcgaagaggaggctctgaaatcaatgatggcatcgctagaagaagaaatggaagaaggagaagaagccaaatcgtcaccgattccaccggtgcaaaagaaagcacaaccgaagaagaaagcggttactagtgatgacgtggagatagtggaggtgcgaaagcttgtggagaagagaaacattccaaatattttgaatctcgaggatggtgagtttctgaaagagtctgggtgtttccttcttggtaggaagattaaggttgcagtttcaacgactagaagagtgaatagcctgggcatgcaatacttctcgatgaaagctctattaataggaggctggatgagcttggtgggggtgaccgacactccatag

SEQ ID NO: 78575 - DNA, 189 bp, Glycine max
  Peptide Sequence Number=SeqID_170260
atggtggctcgtggtggccatcagtggtcgtgggtggtggagaagaagatctcgcttagcaagctcatctcgctaagcgggagtccacttttcatgcttagcatgacaattctcgctaagcatgaaaattctcgctcagcgcaattccctctcgggttggaattgtgcttagcgcgcttatcacgctaa

SEQ ID NO: 78576 - DNA, 282 bp, Glycine max
  Peptide Sequence Number=SeqID_170261
atgccccttcgggagaaggctttacaacagatgccattctactccaagtttttaaaggatatgttaacaaggaaacacaacaatgcttttcaagattattttgatgatgccaaagactcaagtcaagaatcaagagtcaagcaagtttcaagaatcaaagagtcattcaatcaaagcaagtttcaagaatcaaagcgtcgttcaatcgaagcaagtttcaagaatcaagattcaagaaaagaatcaagagaagactcaagatatgcaagaaccattaagtga

SEQ ID NO: 78577 - DNA, 258 bp, Glycine max
  Peptide Sequence Number=SeqID_170262
atgcctcaccaaaagaggaaaactctatatgaggcttcaccgtcgttgttgttttggctcaaaatttgttctataattggtgtctattttataccaatcttagttatgaaatttcaattgagaattagtgtgaaaacaagtgccaaaaatagagggaattggaaaggaggattggtgtcacgccttgaagaatttgagtcaagaagtaaggggccaaccaccttaagagctattggactaatatgcactccaaattga

SEQ ID NO: 78578 - DNA, 682 bp, Glycine max
  Peptide Sequence Number=SeqID_170263
tgccggaaggtcaaggaagttggtgacctgatgacaggggagccgacgaccgaagccccggtgaacggcggccgtaactataacggtcctaaggtagcgaaattccttgtcggactcggtgaaatagacatgtctgtgaagatgcggactacctgcacctggacagaaagaccctatgaagcttcactgtttcctgggattggctttgggcttttcctgcgcagcttaggtggagggcaaagaaggcctccttctgggggggccagagccatcagcctcccaaaaggtaacggaggcgtgcaaaggtttcctcgggccagacggagattggccctcgagtgcaaaggcagaagggagcttgactgcaagacccacccgtcgagcagggacgaaactcacatcgacgggaaggtttggcacctcgatgtcggctcttcgccacctggggctgtagtatgttccaagggttgggctgttcgcccattaaagcggtacgtgagctgggttcagaacgtcgtgagacagttcggtccatatccggaccgggaaggacgcacctctggtgtgccagttatcgtgcccacggtaaacgctggagcctccggtagcacagccgagacagcgatgggttctctgccccagcggggatggagcgaaagaagttttgagaattcaagagaag

SEQ ID NO: 78579 - DNA, 837 bp, Glycine max
  Peptide Sequence Number=SeqID_170264
atggtgggttacacaccttcaagttttccggatttggtcttcgccggtgaaaggatcaaagtgggtctaaaaagaggcaaatctgataagcctgctttcatcaatgcaaaaactagggcaaacgaagaggatgagaatgagggagaaacccttgctatgactgtcattcctacacggtcaaatttctcatcagcccaacaatgtcattactcaaccaataacagactacacgtcctcgcctttagaggactgcatgtccttgccttcagagggctacaagtcctcgccttcagagggctacaagtcctcgccatcagagggatacacaccctcgcaaacagagctgcacgtccttaccttcagagaactgcacatcctcgccttcagagggctgcacgccctcgccttcagaggacaacatgtcctcgccttcagaggcctacacgacagcacgtcctcactttcagaggagtgcacatcctcgccttcagaggactgcatgtcctcgcctttagagggcttcaggtcctcgccttcagaggactgcaagtcctccccttcagagggctacacgccctcgccttcagaggactacacgtcctcgccttcagagcattacacgtcctcgccttcagaggactggacatcctcgcctttagagggctacacatcctcgcctttagaggactccacgtcctcaccttcagaggactccacgtcctcgccatcagaggattgaacgtcctcaccttcagagggctacacgccctcgtcttcagaggactacacgttctcccctttagagggctacacatcctcgccttcagaggactacac

SEQ ID NO: 78580 - DNA, 381 bp, Glycine max
  Peptide Sequence Number=SeqID_170265
atgtcacgaaaccttacggattatgcaatcgtcccctctttggcttctggaatgttacggaactttacggattgcgtattaacacttcctttcaactcccgacatgtcgcggaacttcacggattgcctaatgaggggtgtcaagtacctcgaagtggtcaagtgaaggtcgcatcccaccaaacagatggtccccggacgaaattagggtatgacaacactgatgtggcaggacctcaaagaacaccatcactacaagccccctacactccaaagcaaaatggggttagtgaaatgagaaacagatcggtgatagagatggctagatgcatgttgcatgagaaggagttgcctaaacattttggcagagcaactacatag

SEQ ID NO: 78581 - DNA, 168 bp, Glycine max
  Peptide Sequence Number=SeqID_170266
atgactaaagcacgtcaaaagggggtacggaaagaaaatgagggaggagcttgccacccagctcgcccaagcgagctaggttgcttcctccagaaggcggtgccttctggggaacttcctggaaggcccaagtgggcctggttgctatttgcaccccctgtttactaa

SEQ ID NO: 78582 - DNA, 174 bp, Glycine max
  Peptide Sequence Number=SeqID_170267
atggctggtacattcttccttttgaaaaagcaaaatagtttagagattatgagcgccaatctgctggcttatcgagcgtccactaagcgcaacactcatgggctaagcgcgaggaagactttagaagaagatgagctatataggttcggtaagcgcaccacttcatctcactaa

SEQ ID NO: 78583 - DNA, 255 bp, Glycine max
  Peptide Sequence Number=SeqID_170268
atgactccattgatgaagacgatccaaggcctacaagctccacatggagctacatcattttgttttgaccttttctggaggagcacacatagagtttacatcaggtggtattgtcgcaacctacccttcgacaggagggcgacgcgaggctcactggtgcgtcttccaagaaaggaaaatgcgtggagtcgccaccaacgtttattcgaggaaaacgtcggaaaaaccggaaagggtgtggtctacgaactttaa

SEQ ID NO: 78584 - DNA, 291 bp, Glycine max
  Peptide Sequence Number=SeqID_170269
atgttggataaacagggagttgtgggaccagcaaaaccttcagataggccggatcatgaggtcgatgatctcctatatctgatgacattgactatcccacagctttttctgaagccattgcatatgactgagacaagtatgcgagcggggaatgccaatgtgtatggattcctcgagccacagtccatccagagatatgggcaatcacaatttgaatcagaaagttacatgaagaactggatgcagaattcaaaatgggatgtgtacttaggagcctacctgaatgggtaa

SEQ ID NO: 78585 - DNA, 212 bp, Glycine max
  Peptide Sequence Number=SeqID_170270
atgacagatccattgggtctacaccaagtgaagcatctcccaacagacctaacctcctcaacttccatgtcagctaatctagattcctccctgtacataaagcacgaagacctctccgaaatcgcacacggtgggcatctcactgaaaacatgtatgcgagcgggggaattctggatatctatggattcctcgagcctcagtccattcagag

SEQ ID NO: 78586 - DNA, 291 bp, Glycine max
  Peptide Sequence Number=SeqID_170271
atgaggaaaattgtttccatggaaaaaatccaggccgaggcgcttccaagacgtttccgtgagcgatttcgtgaggattcttcatcgttcttcattgttcttcgttcgttcttcatcgttcttccatcgtcaacaatttccttgaatgaattgactaataaccaaagtgaaactaaggctaaaatcaactcacaaatgaagctttgtccacaaaaatcacttaaaaaccattttaaggtccaacgccttaaatggtcctctttgcttttattggttaacatggacttttga

SEQ ID NO: 78587 - DNA, 231 bp, Glycine max
  Peptide Sequence Number=SeqID_170272
atggcagcggaatggagaaggaagagagagaggagacgccacttcaaggagaagatgagtctagaagaagctcaccaccataggaggccatggataagagcttggaggaagaaggagatgaatgaagggagagggggagaagagcacgaaattttgtgctctaaaagagctctgaaatctgaacccactaatccaagatcaattccaagattcttcactaagtgtgcttag

SEQ ID NO: 78588 - DNA, 366 bp, Glycine max
  Peptide Sequence Number=SeqID_170273
atggctgttgtaattcatttttgggcactgatcgtgatggcagcacagttgatccatgatcgcgtcgtgatggagtgcctagagggtgtttgggagaccctcgaaggcaatgagaggtgccgattccgtggcacagttcgactcactgctacttcgctagtgtcatcctctgaagaggatcttgaagaggacccagaggatttatctcctgaacctgctatggatgcccctgacttaccagagaatgatgaggacccgctccctgatgttgattctccaaaggatattatgccagcatctgaggcagactctatagaggagagtggccctggagggacaacgactagtgacgactcttcatcatag

SEQ ID NO: 78589 - DNA, 854 bp, Glycine max
  Peptide Sequence Number=SeqID_170274
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatgcaacacaggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 78590 - DNA, 492 bp, Glycine max
  Peptide Sequence Number=SeqID_170275
atgaccatgattacgccaagctcgaaattaaccctcactaaagggaacaaaagctgcattgatagactctgtatttcccagatacatcgtatcgtcctcctcatcatcgagttcagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 78591 - DNA, 213 bp, Glycine max
  Peptide Sequence Number=SeqID_170276
atgaagatctcatcgctcgtcaaagatgcgaggaagacagtgtctggtgatcttgcagctcattgtggcaccatcattgtttgccctctagatcctcaacctcaaaaagggatgcatcaaggaaaccttaatttgggaaaatgtctccaaatccaactccaacgtccaagcattgaatccttgttagaagacatacatgttcaacaactttga

SEQ ID NO: 78592 - DNA, 183 bp, Glycine max
  Peptide Sequence Number=SeqID_170277
atgaccataaggtatctccgcgtgccacctgactcgctgtcctggatggaaaaaggtgcagaagatgatgttagtctcttcgcgtcaacggagcgtttgcccttggttgacgaaaggacgacaaaaggtgcagaagacgatgttattctcttcgcgtcaacgggctcctttgcccttggttga

SEQ ID NO: 78593 - DNA, 288 bp, Glycine max
  Peptide Sequence Number=SeqID_170278
atggttaaagcacgtcaaaagagggggaaaagagggaggtggttgccgcccagctcgcccaggcgagctgggttgcttccaccagaaggcaccgccttctgttggaacaccctggaaggcctaaaatgttgcggaactttacggattgcgcgacaatgctccctttcgactttcggcatgtcgcgaaacttcacggattacctaacaatgggtgttaagtacctcaaagcggtcaggcaaaggttgcaggccatcaaacaatggtccccggacgaaattagagtatga

SEQ ID NO: 78594 - DNA, 1029 bp, Glycine max
  Peptide Sequence Number=SeqID_170279
atgggtcacaatcaaaagggaaagtgggcccttcttgctctactcaaatggggacatctctctctctccctcacgttgccattttcttctccctcatcctccattgaagctccaaacaaagctccaacctttggccatcatttccgctccaaatcgcgaaaggagggcattttcggggtcgtgaagtgcgtggctacgagtgggacttcgaaaactcagcttgtgctgtttgaatgttgttttgcttggatgttgtggaagcttgggaggattgatggggacccggtgttgagagaaacgaggatatgggctacgtgggagtacgtgagctcaaatggaggtgggcaacaggggatggagaccttggggacgtcaggtggggtgctattgcccgaaaccaagcttgaccaatcccgacccaacccgggcatagtcgggaactgggagatggtggaagcctctggtaatcgattaccagcctgtgtaatcgattacacagaggaatgggtcactggttgtgtaatcgattaccagagatggaaagccttaaaataccccttttacttgcatgtagtggttatgagacaaatgatcgtgatggcggcgcagctaatccgtgaacgagtagagatggagtgcctagagggagcttgggagacccttgaaggcaacacgaggtgccgatttcggggcaccattcgattcatgactacttctttggtgcatccagatgaacctgcacggacgcttcagcgcacggtggagtggatactacccacgcctacaccatatcgtctagtggagccagtccaagtgatcgaggtgatgtcatccgaggaagaccccaaggaggatctggaggagctacctcctgagcctgctgtggatgcccttgactttctagagggtgatgaggatccacttcttgaggtggattctcccgaggaagtcatgtcggcatctgaggtagactctacggaggatagtggcccgagggagatggcgatcagcggaggctcttcatcctag

SEQ ID NO: 78595 - DNA, 600 bp, Glycine max
  Peptide Sequence Number=SeqID_170280
atggatgcaacttcttggttacgtcatcacattcaagatcatgaatatgttgtttacatcttagaacactcaactggaattgcaaagcaaactgttggtacacccagcacaacatgcgcaactccaattttgccctttcataaaattgatacggattgtcaatccattatggttagaaccagaggtttgagtcgggctttaggcagggttataggtagagccccagggagagaagtaaattgtggttcaaatgaaactccccagcggcaaaggcccacagcatctgcacgtaggcaacgggaagttgcccctgttactgaggatgaatgtcctgagttgaagttatcctcccatggaaggaagaggttgcataagaaaactagcaatttccatcttcttgtaggagaggtgactatcaccctcggtgatgtggcatctttacttcatctgcccatcacaagcgccttccatagcttcgaggctcttcatgttgacgaagcggtgttgttgttagttgaattacttgaggtgattccagatgaagcaagagctgagatagtacaatgtcatagggcatatgttcaactatcatggctatga

SEQ ID NO: 78596 - DNA, 599 bp, Glycine max
  Peptide Sequence Number=SeqID_170281
atggcatctaagaaaagaaaggctccttctacaccttcccaagttagatatgattggtctaggaaactactaccagagagaaatgtagtagtatattacaccgagtttgatgagttcaagaaggaactcgagagaagacactgggatgaggagttgactgattttgctgacggcagcatagatgttgccattgtgaaggaattttacgcgaacctctatgacctcgaggataaatcacctaagcaggtgagggtgaggggtcatttggtgaaatttgatgaagatactctaaatacctttctgaagaccccagtgattctggaagagggggagaatctctgtgcttattctagatttgcactcctgaggcctgatcctcaggagttagttgctaagctttgtatcccagggaggggattcgagctaaacactgatggtcagcccttgaagatattaaggaagaacatgaccactttagctcagacatggagtgttatttccttctctaacttgattcctacctcccacacatctgatgtcacattagacagagacaagttaatctatggcatcattatgaagatggatatgactgtggg

SEQ ID NO: 78597 - DNA, 300 bp, Glycine max
  Peptide Sequence Number=SeqID_170282
atggctactccacctgtctcgtctcctcctccttctcctcctcctcctcctcctccttcagacgcatcagcatctccgtctaccatgaagcggacacgcaaagcgacacggctacgatcattggccactagaccacctggtgtagagagactagtggtcaacgtttatcctgctatcggcaaggccgacggtccccaaaagaagaaattaagaacatatttggggattgtcgcgcgtgataaggcgcaaattgaaatccctgaagcttctgacaataggacaaagaagaaaattctttag

SEQ ID NO: 78598 - DNA, 1029 bp, Glycine max
  Peptide Sequence Number=SeqID_170283
atggcgaagcagcaaacacacaaaatcaatgcaagcactaacaataacattagcacaactaacactgtcaccgccaaggtgaaacgaacaaggagaagcgtccctagagattccccacctcaacgcagctcaatatacagaggagtcactaggcaccgatggactggccgatacgaagctcatttgtgggacaagaattgctggaatgagtcacagaacaagaaaggacgacaaggtgcttatgacgatgaagaggcggcagcacatgcttacgatctagcagcattgaaatactggggtcaagataccattcttaattttccgaatgaactgaaagaaatggagggtcaatctagggaagagtatattggatcactaaggaggaaaagcagcggtttttctcgtggagtttctaaatacagaggtgttgcaagacaccatcataacggaagatgggaggctcggattggcagggttttcggcaacaaatatctttacctcggaacttacgcaacccaagaagaagctgccacagcatatgacatggcagctattgaatatcgaggagtcaacgctgtgaccaatttcgacctcagccgctatatcaagtggcttaagcccaataataacaacaccacagtcaactctaatcttattgactctaaccctaattgtgagacgaactttacctcaaactctaatcaacaacaaggattcaattttttcaacagacaagagtcattcaataatgaagaagcggcaatgactcagcctcggccagctgttgccacgtcagccctaggacttttgcttcagtcatccaagtttaaggaaatgatggagatgacttctgctacagatttgtcaacaccgccgtcggagtctgagttgccgtcatgcacatttcccgatgacattcaaacatattttgagtgtgaagattcccatagatatggagaaggggatgatattatgttcagcgtgctcaacggctttgtgccccctatgttccattgtgatgacttttga

SEQ ID NO: 78599 - DNA, 186 bp, Glycine max
  Peptide Sequence Number=SeqID_170284
atggttgatgcagaatatgctacacaaactcttatggttgaggcagaagatgatctagcaaaggcttcccaagttattatagtggttagtggggttttatttctagaggaatttaatgtgatccaccccgtttccatgatcatatcattttctctccctcttcaaaaagattcgtcctcaaattga

SEQ ID NO: 78600 - DNA, 546 bp, Glycine max
  Peptide Sequence Number=SeqID_170285
atgggtgccaagcacctcacaaggaccaaagaaaggtcgcatgtcatcaagcaaaggtccccagacgaaattaggtgtgttcttttttattcctatatccgaggtaaatttcctacagataaatcgctatttgatccagaaattaccaaaactgaaaggaagatcaagaagaaaaagaaacaagcaaccactaaaccaccgactgaatcttcttctactaattctccttcaactaaaaagccacttctgattgataacatgactaatcgaagaggagaaggaaatagaccaccaaggaggactcttggtgactatgcttatcaacaaggaccaaagcattacaacaacatagtcattcctcctttcagtaataaggttgtggagttgaagccaacactgcttagtcttattggttcatatccttttgttggaatggatcatgaagatccatacacacatttgtctaccttcatggaactatgcagtaccatgggagcttctgacgaaaatgctaaagctctcttagagctttcccattctccttaa

SEQ ID NO: 78601 - DNA, 201 bp, Glycine max
  Peptide Sequence Number=SeqID_170286
atgttaatctgcagtcgtttgaaaatgtctaagaagtggtgtctcctctcaactcttcttcaccattccgctgccattaaaattcaaaaagaaaaggactccattgataaagaagatccaaggcctacaagctccacatggagctacatcatccagctccatcatggtgactctgatattcactggcttccatggagttaa

SEQ ID NO: 78602 - DNA, 847 bp, Glycine max
  Peptide Sequence Number=SeqID_170287
atggaagaaggattctccaccaacaaactacccatgttcaaaagtgtaaaatatgactactggatagaatgtatgatagctcattttgaatccattctcattgacctatgggatgtggccttggatcttcttcatcaatggagtcctttgtttcttaaagatcaatggaagtggaatggagaaggaggaaaggtaggggaagatgagtggagggagagagagaaagggggagcaagaaatttatgcttcaaatgtcttgggagaggtcacattgcctctcaatcatccacaaagaaaaccatgattatgaggggtcaagacatttatagtagtcaagaggagactacttctttcccttcctctagtggaagtgaagatgaaggggtcaagagtctagtgaggaaatctacccccatgaagaagttgaacctcactatcaatgagcaaggggaaataatagttaaccaacaagtgaaggtacctttctccattggaacatttaaggatgaaattaattgtgatatagttctcatggaggaggagtgtaaggaggtaagtgtctcctccaagaggacacttgttagcactgacatacctcttgagcttgaggttattcctcaagtagagttgctggatgagggtttagttcgtaagagcttaaatccttgtgctttgtcggtgcccaaaatagcacaactcattgagttggcgagtagccatgttccttcattggaagatgcccatgaaatgggtgttgaggaaagaagcccagagtttcaagaacctctggatttaaggtcaaatccttttcaagggggaggggatgatgcaatcctaccccccaagg

SEQ ID NO: 78603 - DNA, 285 bp, Glycine max
  Peptide Sequence Number=SeqID_170288
atggaggaaaagttgagagctctattctctactgaatccttgaggtggattctgaagattccatttcgattaaagcattcctctctgtatggtggtcggacggcaagcaacgactgctcatggcggccaccggtggtcgtggatggtggaagagaagggttgaggatttggagtgatgcaatcctccctaggaagggaccagtcactagaaccatgagcaagaggctccaagaagattgggctagagctgctgaagaaggccctagggttttcatgaacctcagg

SEQ ID NO: 78604 - DNA, 426 bp, Glycine max
  Peptide Sequence Number=SeqID_170289
atgaggtgtgagttttcaagatttcaaggatcgaccaaccccaatccatggagtgactctcaagaatacatgatctccaacctcgaattccaggtctttcctcctcttgtcttgataactcttctgccttctttcagaagtcctcatcctctcttggatcaacttgaccttcttagtagtttttgtaccacttcaggtcctaaggtgaggataaagaagaaaaggtgtaaaaagttgatgatgaactcgcttagcaaggcagattggctaagcgagcctcatccgcttaggaaggcagtcagctcgcttagcgaatgcaaaatcctagaagaggataagtcagagattggcacacttagcacgcagcaagcccgtccaataaggatgttgtctcttcatgtgcttagcgcacccaagctcgcttag

SEQ ID NO: 78605 - DNA, 282 bp, Glycine max
  Peptide Sequence Number=SeqID_170290
atggaagaggagcatgcacgacaagtgacactagaggactactctagtacaactaccccgcaattcttcactagtattgcaaggccagaggttcaagcggccaacatctcttatccccactctctcatacagatgatacaaggaaacctcttccacggtctaccgaatgaggatccttacactcatctcgtcacctacatagaaatttgtaacacgggaaagcaaaaaggtggctacactcctttaaaggcaatagcttgcagacctgggcggaagttgtag

SEQ ID NO: 78606 - DNA, 537 bp, Glycine max
  Peptide Sequence Number=SeqID_170291
atgtttcagaaattagtgttcatgaagccaaggttcgatggttcatccaacgaagcaccttccttcaataaggagttgaagagaagcttcacaagtgagagaaccacaccagtgggaaagaaaagtcatgaagaaaataaatccaagcaaggcacattgtttagaaataacaagttcatggggcatgcaagcgtgcctcttgtgtcacagccagctgagaaagaaagccttcttgtggaatctaacgatgatgacgacgacaatgacacagaaaccgaggaccaagacgttgaaggaggaagaaccgttgctcagaacaatgacaggggaaagggcccacctgttattggtggagaaagttcaaaaatagatggtcatgaaggaccagatgtggataagaaggctgatgagttcattgctaagagaattgagtcaatcaagaggagtagaaggagtgcaagaaactcttcaagcacaacctgcatttcaaagatacctttaggggaggactattcacagatactcattagatgttag

SEQ ID NO: 78607 - DNA, 165 bp, Glycine max
  Peptide Sequence Number=SeqID_170292
atgttagtgaaaaacctcgttgggtgcccaagagtacatgacaagacagaccacattgggagaccagtcagggtcacattgttttgcgagaatgctccaaccatgtggaatcaacacaaacttaaagaagcactcaaatcgggtgtatttacctccaagacctag

SEQ ID NO: 78608 - DNA, 658 bp, Glycine max
  Peptide Sequence Number=SeqID_170293
atgtgagaagagcagtacgaggattgtctactgtactcccgctctttatgtatggttggtttcacacctttttcgccaagaggtaaggcatgcttgcctgctagaaggtcaccactcatgcacagagaaaggaggggcaaattgggaccaactcttagcaaacaaagaaggagcgtttgtcaactggttccctcgatggaaggaaggaagagtcggagttcttatttcatgcggaggatttccaaatgttcccttgatggggacgaggggttgcatcagctacaatctcgttcttgctataagacaacttggctaccctatgagaggggcgccactagaggatgagctcgcgcctgtcatttcacgaggcttcaataagaccaacgtggagacacttcagaaggtccgcaaggcatgggaggtgttgcaaaagaaggacaaagaactcaggggcagtaacaatgggtccatcgatggctaccgtaagtggttgaaagcccacgtgcaaggtttggattggctcccgagtctgagaaccgctaagagggaggaagatgaggcactggaggaagacgaagaagtgcaggcccttaggacaaaacgcaagcaagctcaaacggtcaaagaaaggttcaaatcagcaactcttaaaatctga

SEQ ID NO: 78609 - DNA, 132 bp, Glycine max
  Peptide Sequence Number=SeqID_170294
atgcagagttcaaaacgcgatgtctaccttggagcctacctgaatagtgctttgaaaggacttgatgatactccacaacctaaatccaaggttgctgctaggtggattgttgttaagttaacgtttaattaa

SEQ ID NO: 78610 - DNA, 375 bp, Glycine max
  Peptide Sequence Number=SeqID_170295
atgggcgaggaaaattcccagcaccaccaccagcagcaatcagcagccccatcagcgctcaggcggccgccgccggggatggtccacgccagcccggaagagtgtcatacagcggatgcacgtagtcagcaatcccatacccgaaggcgcagcccatggccagtaccaccggaaggcggcagcagcggcgagatcccccaaaagccgatcgcttgcaagaaacacgccggtgaagcacagaagacaacgagccgtgaccggatcacgatcaccggcgatgcccaaggaacagcaggttatcgccgctcccaggatattgcaacacgccaggcgtcgagcgagttaaacccggacaatctgcccggcaggcagtag

SEQ ID NO: 78611 - DNA, 255 bp, Glycine max
  Peptide Sequence Number=SeqID_170296
atgcctagcctaccgaagagggagctagagatatgtgctcctgaacgccctcagtcaattcttgggccacccgctgatcttggaagagggccagcagtgcaaattcagccaaaggaagagtcagctattatgcatactggagcaagatttcgcccggaccacttcagggagacgggtgcggatcatgcgcaccagcatgaccacctttacccagatatggatgatgttgctgctcagcaacatcctacccagtga

SEQ ID NO: 78612 - DNA, 231 bp, Glycine max
  Peptide Sequence Number=SeqID_170297
atggggatgagggattgcattaattacaatcccgccctcgccataagacaacttggctaccctatgagaggggcaccattagaggaaggcctcacaccttttattgcacaaggtttcaatagcaccaacacgggggtgcttcagaaagtccgcaaggcatgggaaagggtgcaaaagaaagacgaggaacttcggggaagtagcaacgggcccatcagcggttactcgtag

SEQ ID NO: 78613 - DNA, 237 bp, Glycine max
  Peptide Sequence Number=SeqID_170298
atgtggttgttccaaaatgtttcatgccaagtgtcgcaacctacccttcggcgggagggcgacgcggggctcacgagtgtgtcttccaagaaaggaaaacgggcggagtcgccaccaacgtttattcgaggaaaatgtcaaaaaaaccagaaaagacgtggtctacgagctttaagtgtgaaaggttcgagagttgtatttacgcacggggaagttttaaacgtggttacggcgtga

SEQ ID NO: 78614 - DNA, 249 bp, Glycine max
  Peptide Sequence Number=SeqID_170299
atgttgcgacaagtgcagatccatgagtgtctctaccagctcagcctcagtcagcagagccagggtttcgctccttttgcgtgccctactccagatcaattcagggttgaggttgcatggcccggagattggcctgaggcccaggcaggggaggcacctgcagaggctcccggcgatctagaggacgcccgcatggatgaggagatgacaaatttactcggctttttgggaggaagcagagccacgtga

SEQ ID NO: 78615 - DNA, 833 bp, Glycine max
  Peptide Sequence Number=SeqID_170300
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtataagacgcggtgaggatttagaagttccaccaaacccaagtactattctcggtgaagatgataaattatatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 78616 - DNA, 231 bp, Glycine max
  Peptide Sequence Number=SeqID_170301
atgggggtgcaagtagcaactaggcccacttgggccttccagaaaattcctccagaaggcggttgcttctggaggaagcaacctagctcgcctaggcgagctggggggagaagtgaagagaaaaaaggttcaaccctcctggttattcgagatcacttgaaattagtgaaaaaaatcatttccgtgaagaaaatccaagccgaggcgcttccggaacgtttccgtgggtga

SEQ ID NO: 78617 - DNA, 124 bp, Glycine max
  Peptide Sequence Number=SeqID_170302
ggagggatttatgtcaccacaaacagagactaaagcaagtgttgggttcaaagctggtgttaaagattataaattgacttattatactcctgaccttgttgtttcgagaattcttaattcatga

SEQ ID NO: 78618 - DNA, 468 bp, Glycine max
  Peptide Sequence Number=SeqID_170303
atggagaggagtatgattgatgctgccagtgatggagctcttggtgatatgactcttgctgaggctaggaatttgattgagaagatggcttccaactcccaactattcagtgcaagaaatgatgctattgtccttagaggagtccatgaggtggccaaaaattcatcttcatctattgaaaataaaaggcttgagggaaaacttgatgccttggtcaacctagtaactcagcttgccatgaataagaaatctacacctgttgcaagagtctgtgcaatctggaatgagcaacctgaagcttatcctgcaaacatttataatagaccccctcagcagcaaaaccaacaacagcagaataattgtcacctttcaagcaacagatacaatccaggttggaggaatcatccaaatctgagatgggcaagtcctccacaacaacaacaacaacaacatgtccctcatttctag

SEQ ID NO: 78619 - DNA, 848 bp, Glycine max
  Peptide Sequence Number=SeqID_170304
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgattttcttcctagtctcgatggtctttacattttggcatgatgttgcagcggctggtatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 78620 - DNA, 253 bp, Glycine max
  Peptide Sequence Number=SeqID_170305
atgggagggttggggattagagatcttccaagtcttaacaaggctctgttgttcaaatggaagtggctgatgttccaccaaccagaccagctttggaccagaattctgatctctatgtacaatggctggaggggattggagtatggtcctcgaaagcagtatttctctacttggtgggctgatttaagggccctctttcaacagcaaaatgtggtcagtgctgataatcaaatcaggtggaagctggggagag

SEQ ID NO: 78621 - DNA, 890 bp, Glycine max
  Peptide Sequence Number=SeqID_170306
atgaacgatggaacggactatcgcgcgatcctcgcgtctgatacccctttaatcgacgttcgcgcgccgagcgaatttgcccagggcgcgatgcctgccgcccttaacctgccattgatgaacgacgacgaacgcgccgccgtgggcacctgctataaacgccaggggcccgaggccgcgctggcgcttggccatagcctggtgcgtggcgacacgcgtgaggcccgtatcaacgtctggcgcgacgccagccttgcccatcctgatggctttctctgctgtgcgcgcggcggccagcgctcacatatctcgcaggcctggctgaaagaggcgggtatcgactacccgctgatccgcggtggctataaggccctgcgccagacggcaattcaggtgaccattgagcagtcgcaaaagccgatggtgcttattggcggctgtaccgggaacggtaaaaccctgctggtgaagcagcatgcacagggtatcgatctggaaggactcgcgcaccatcgtggctcgtcatttggccgcacgctgacgccgcagctttcccaggccagctttgaaaatcaccttgcggttgagctattgaaaaaagacgccgcgcgctgggtactggaagatgaaggtcggatgattggctctaaccacctgccagcctgcctgcgcgaccgcatggttgaagcccctatcgtggtggtagaggatccgtttgagctccgtcttgaacgcctgcgcgaagagtatttcgaccatatgtgggcggatttttctgccgcctacggcgaggaagcaggctggaaagaatacagccagtacctgcatcacggcctgttcgccattcgtcgccgcctggggctgcagcgctttgcggaatttaccgcgct

SEQ ID NO: 78622 - DNA, 384 bp, Glycine max
  Peptide Sequence Number=SeqID_170307
atggagttcttggagcttaagcagggaaacatgattgtggctgaatatgcagccaagtttgaggagctggtgaggtactttccctattatcaagggagagatgacatagagggaatattcaaaaaagattgtccatatcccaagaaggagcataatggtgggggcctgaatgaccaaactggacatccgaaggccataggaagagtctttacctttaacgatgccgaagcttcgaaatcaaaagatctaatccaaggtatggactggttatcttccaaccatgtcttgttaaactattttgataaaactgtggtgtttgatggttctgaagtgagtaaggatatggtgtttatctctgccaaaccagttatgagacatctttaa

SEQ ID NO: 78623 - DNA, 153 bp, Glycine max
  Peptide Sequence Number=SeqID_170308
atggcgttaagcgcgccttcaagagaacaaatgatgcaatcctaccccgcaagggcattggatagaagactccaagtagattgggccagagatccaagggaaggccctagggttctcatgagccttagggtagatttcgagcccatgggctaa

SEQ ID NO: 78624 - DNA, 198 bp, Glycine max
  Peptide Sequence Number=SeqID_170309
atgaagcacttcactgacaccctcatcagtgccaacataggaacaaaagctggtaccgggccccccctcgaggtcgacggtatcgataagcttgatatatcgggaatccccggatctacgcttattttcaactccccgaagcatttcgtcgcttactacgcccttcctcgtctctgggtgcctaggtatccaccataa

SEQ ID NO: 78625 - DNA, 186 bp, Glycine max
  Peptide Sequence Number=SeqID_170310
atggtgctaagcgcgccttcgagagaagacatccccactgctttgaaatctgagcaaggaagcaaagatgatgacaaaggtgatgacaaaaagctcaaagatcaatcaaaggacaactcaagtgaatcaaagatcaatcaaagaaaaactcaagtgaatcaagaacaattcaagagttcaagataa

SEQ ID NO: 78626 - DNA, 422 bp, Glycine max
  Peptide Sequence Number=SeqID_170311
gatcaacatggaccactggtctctcagcaccaggtggtctagtagacaacgatcatagatgtgaggctttgcatgtccgcttcacggcagacggcgaagccgatgcgtccgaaggagtaggaggaggaggaggaggggagacaggcaattatcaacatcaagagttctttatagaaatcattgagaacaatacttcaaactctcggggaaggaatgacataaagaccttgaatgatgaaggaatgtgtcgcaacctaccctttggcgggcgggcgagcgaggcgaggctcacgggtgcatcttccatgggaggaaaatgcacggagtcgccaccaacgtttattgaaaggaaaacgttagaaaaaccaaaggaaactggtcataaagaatattccagattcgggagttatgtttatgcttga

SEQ ID NO: 78627 - DNA, 141 bp, Glycine max
  Peptide Sequence Number=SeqID_170312
atggtgaaagttggaacctcttacgtgccgatcaggacgtctgtttcgccaaaagttggcctcagcttcccgctgttccctcctgttcagctactgatggtgcgtaacggcacaaagcaccagccggacatcaaagtgtag

SEQ ID NO: 78628 - DNA, 581 bp, Glycine max
  Peptide Sequence Number=SeqID_170313
gaaacgatcttgagacggatgactcagacaggtacgacttgtatatcaaagcaaatcctgcctgcctggttgccctaagaagagtttataagggatccactgttgttcataacacttctttgttgcctagccaagtaaaggtgggtgtggaggaggttaaagatccagatgctcccattcctgtacccactaatgaggttacatgggatgccaccgtgttcggggtctttaatccagacttcccgctctacataaagcacgaagacctctccgaaattgcacacggtggtcaatgtctcagcatacagcatctgactgaaacaagtatgcgagcggggaattctgatctgtatggattcctcgagccacaatccattcagaggctagacaactaccttaaggggataattaacaatgctttaaaaggtcttgatgatgctccacagtctaaatcaaaggctcctgctaggtggattgtcgtcaagtattttaacgatcctagaccattagagccagagagattaaaggtgcttcggatccagtgggcacagtattatctccgagttagggctcagagctag

SEQ ID NO: 78629 - DNA, 477 bp, Glycine max
  Peptide Sequence Number=SeqID_170314
atgaagcacttcactgacaccctcatcagtgccaacatatcccagctactcaggaggctgaggcaggagaatggcttgaacctgggaggcggagcttgcagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 78630 - DNA, 243 bp, Glycine max
  Peptide Sequence Number=SeqID_170315
atggatccaatggatagtgaatgtttatcggttgtgtcatatgacgtggttccttgcatagataggtcagaatacttggctttggaaagaagaggaggcaaggcatttcttcctccccaagttgttgaggatatcctagaggaacagatggtgtggcattctacccatagtgatagttacatggtaaatagtgattacaaaaacattgatggtgtatgtttattagacaatgtcaaagtctaa

SEQ ID NO: 78631 - DNA, 348 bp, Glycine max
  Peptide Sequence Number=SeqID_170316
atgcgtaacgaattgattaaagaacttggcaaatggttgcaagactacataaagatctttggtggcatggagagatatgaacagctgaggttgtccctacacgtggatgggttatccaaggttagtatggacaaatggatggatataacggatatggaatatgtaattgcgtcaagatataatgtttatttgaaagatcgttgtcccttacctcctatggcgttgttgtggtcaagcaattcgtatctggagggaaaacagtggccaactgcatatgtaggtagaatgcagcactacttaagcctaatgacaattaatacaacgcacgtagacctaagcagacactga

SEQ ID NO: 78632 - DNA, 81 bp, Glycine max
  Peptide Sequence Number=SeqID_170317
atgtcacactgtacaaaatcacctgctgtgagatacttgccggtgccagctttggtgacagctcaagttgacactttgtag

SEQ ID NO: 78633 - DNA, 1473 bp, Glycine max
  Peptide Sequence Number=SeqID_170318
atggccatctcaaacaataatcatcatgctctagtccttgtttcaccaggaatgggtcacataatccctgccctagaacttgccaagcgtttagtcactcacaaaatcatttccaaactcaccttcttttatggttcaatcaaaacctctactccatcaaaagctgagacacaaattctccaatcagccataaaggaaaaccttttcgatctaattcaactcccccctattgatctcaccatccatgttagtcctcatgacaccttagaaaccaaactagcaattataatgcatgaaatcccactactttttatgtccacaatatccaccatgaacctcaacccaaccatgatcatcactgacttcttcttcagccaagttatacctctagccaaaaacctaaacctacccatatttgcttttgcaccaaccaattcatggctcgtcgcacttggtcttcacacccccactttggataaagaaatagaaggagaatatagcaatgaaagcaaacccatcccaatcccaggttgcaaatccgttcacccccttgatttgattcctatgatgcatgacaggacacaaaggatctaccatgaatttgttggcgcgtgtgaaggggcagcacttgctgatgggatctttgttaacacgtttcatgagttggagccaaagacacttgaagcacttggtagtggacacatcattgccaaggtgcccgtgtacccggttgggcctatagtaagggatcaaagaggccctaatggtagcaatgagggaaaaataagtgatgtttttgagtggctggacaaacaagaagaagagtctgttgtgtatgtgtcacttgggagtggatacacaatgtcatttgtggaaatgaaagagatggctttggggttggagctgagtggaaataaatttgtttggtctgtgcgtccacctgtcaccaaagctggcaccggcaactatctcacagcaggtgcacctcttggagaaaccggaactacccttgggtctaataatcaaccatcaaattcttttcctgatgagttctaccgcatacaaaccaatggaattgtgatcacagattgggcaccacaattggatattttgaagcacccatctattggtggttttgtgtctcattgtgggtggaactcattaatagagagtgtttcatgtggggtgccaataattggattgcctctttttgcagagcaaatgatgaatgctacgatgctaatggaggaagttggcaatgcaattcgagtagaggtgtcaccatctaccaatatggttggaagggaggagttatcaaaagcaataaggaagataatggataaggatgacaaagaagggtgtgtaatgagggaaagggctaaagagcttaagcacttagcagaaagagcttggtctcatgatggtccttcttatttagcactttcaaaaatcactcactcaaatgggatgtga

SEQ ID NO: 78634 - DNA, 165 bp, Glycine max
  Peptide Sequence Number=SeqID_170319
atgctggaattaaggcagcccaaagatgccacaactaaggcattttcagaagcttactctgttcttgaaaatgaactcaaattcctaaatagtgatggtgagtcatgttcaaggccacctgacagactgcttccaaaaatcattccaagtcttgatatatcataa

SEQ ID NO: 78635 - DNA, 1167 bp, Glycine max
  Peptide Sequence Number=SeqID_170320
atggagaagcacaagtgcaagctttgcttgcggagtttcgcgaatggaagagcgttgggaggtcacatgcggtctcacatgatgaacctacctgttcctccgaaacagagcgagttggtgccgattcaactcagcttcgaggccgagtcatctccttcgcagtcttcatcttctttctacggtctcagagagaatcccaagaaaaactttcgcttcgcagatcctgaattctcgttcgcagcagcggaaacttcctccgtgatcctgcaggacagggagagcgagaccgagtcgtcgaggaatccgactcggagacgatccaagagagcgtggcaacaactcggcggcgacagcggcggtggcggtgtttccgatgaatcagaaaaaaagatgatgaaagtttttgacgccgtaaacaagaacaacaacgaatccgcaagttcggtttcggacaccacgacggaggaagccgtggcattctgtctcatgatgttgtctcgcgacaaatggaaggaaaacaacaagttattatatgataacaaggttgagatagcagaatataacgatgattatgatgacgaggaagacgaagacgaagaagaagaggaagatgaagaaatttacgaatccgaagaggaacttaaatctgttaaaaagagtaacaaagtgcgaggaagatacaaatgcgagacgtgtgaaaaggtgtttcgatcttatcaagctcttggaggccatcgtgctagtcacaagaagatcaagctcaacaactgcgaaaacaagaacaagaacaacaacaacaacaacgacgatgaagctgaacaactcgaagttcagcacgttgttgtggtggagaagaaaattcacgaatgtcctgtttgttttagagtatttgcttctggtcaggctctgggaggacacaagagaacacatgtgattggttcttcgactgctgctgcaacaacaactgcgacagcaatcacaaccgtttctgttagaaactctgttgcaactgtttcggttagaacaacttctactgctagagttgttggagatagtttgatagatctcaatctccctgctccaatggatgatgatgaagaggaggaggggaatgttagccaattcgaagactcagctgtttcggatgcagagtttgttaaactgtga

SEQ ID NO: 78636 - DNA, 150 bp, Glycine max
  Peptide Sequence Number=SeqID_170321
atgatggtggtggtgatagaagtggtggtggtggttgatgatggtgatggtgatgacaacaatcatgataatgacgactataatggtggtcatggtgtaaactcaatagactctcaagtttaccatcgagtcaacgagttagcaagttaa

SEQ ID NO: 78637 - DNA, 264 bp, Glycine max
  Peptide Sequence Number=SeqID_170322
atgtttccggaacagctccttccggaacttctggaagaacccctaacgggtcttccggaagcctccgccatgagccccctttccccatttttttcggcgttccactactacaacaatgatgtatcatacaagcaaaggggagttagggagactaacctcgttcgcggagaagaagaagacgagcttcgcggagaagaagcagttcgcagagagggagaaaaagcagttcgcggagagggagaagaagcttcacggaaggaatag

SEQ ID NO: 78638 - DNA, 99 bp, Glycine max
  Peptide Sequence Number=SeqID_170323
atggtgatgcatacattaggggctggtttgctgctgcacgagctcgtaagcagcaattgtcttctgttacttctagtgttaatggtgattagtgattaa

SEQ ID NO: 78639 - DNA, 237 bp, Glycine max
  Peptide Sequence Number=SeqID_170324
atggtatcgctaagcttgatcgtgattgtgctgtgcggtatttggagttttgagagagtttggggtgtggtgaagttagagatctctgctgtgaagtgttatttatcgaccaagaatgttcttccgtgcaatctcccggaagaagttcattcccagaaattcatggaagaaccttcttccgtaattgaaatttttaactgtggaagaagtttcttctgtgaatttcatgcgaaataa

SEQ ID NO: 78640 - DNA, 465 bp, Glycine max
  Peptide Sequence Number=SeqID_170325
atgcccgtccccccagcaaggtcatgccatcgtgacatagggatcacacccacaagacacccagtggacccggaggagtccgacatggccctagggatgcccgtccccccatcaagggatagcgcccgcaagacacccagtggacccggagaagtccaacagggtcttagggtttctagctctgattatgagcctctgtcagttctacagagtgctcgtcgccccaacaaggtcatcaggcccctattagcagggctttcatcgagaagtactgcgccctcaggtaggcgcagggcaaggcatcacagcagcgggcaacagactcaccgccaccacctctggagttcacctcagctcatccacaaaaaggcgaccaagtccaaagccaaaggtaagctaagtactaggtccgtgaccgacaagtcatcatgcgtccaactcaagacgttaaagaagcgctactag

SEQ ID NO: 78641 - DNA, 243 bp, Glycine max
  Peptide Sequence Number=SeqID_170326
atgcctgaatatcctcccatatcaaatccttctgagcagcagggacttccttccaggtctcccttgccaatcgtaggatcgacgtggaccactggtctctttgccccaggtggtctagtgaccaaggatcgtagccgtgtggctttgcgtgttcacttcaacgtagacgaagacgctgatggtactacaggaggaggaggaggaggaggaggcgaggcaggtggagtagccatggtcctataa

SEQ ID NO: 78642 - DNA, 166 bp, Glycine max
  Peptide Sequence Number=SeqID_170327
tgctttgaaaggacttgatgatactcaacaaagtaaatccaaacctactgctaggtggattgttgttaaatatttcactgatgctagaccattggaaccaaagagattgaaggcgctttgcatccagtggtcaaagtactatttgaaagttaaaaatgaatactga

SEQ ID NO: 78643 - DNA, 222 bp, Glycine max
  Peptide Sequence Number=SeqID_170328
atggctaccgcaccaaaagaaatttccgctcctggttcacccgctgtaccatcatctccgcaccaggaacaaccaaaattcaacatccaacccatacaaataattcctggtcaagcttctgtccctgagaaactggtccccagaagacaacagggagtgaagattgcggaaaaccctagccttgcaacaggttctagggaagtagacagtgggatcctctag

SEQ ID NO: 78644 - DNA, 228 bp, Glycine max
  Peptide Sequence Number=SeqID_170329
atgaaacgacttccggaagaacagatcttccggaaaactctcggaacacctcttccggaatgtttccggaagatgtacttgttccggaaacattccggaagagggttcttccggaagtcgtttcaatggttccggaagcactttccggaagagccttcttccggaattgttccggaagaagtacttcttccggaattgttccggaagaagtacttcttccggaagtag

SEQ ID NO: 78645 - DNA, 466 bp, Glycine max
  Peptide Sequence Number=SeqID_170330
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaatggtggcgaaacccgacaggactataaagataccaggcgtttccccctggcggctccctcgtgcgctctcctgttcctgcctttcggtttacggggtcattccgctgttatggccgcgtttgtctcattccacgccctgacactcagttccgg

SEQ ID NO: 78646 - DNA, 134 bp, Glycine max
  Peptide Sequence Number=SeqID_170331
aggtagctgttttgttcggtgttgcagtaaaaatttactatgaaggttgcctagtgatgagaatcatgaaactggccaaatacaggctaaaggcccaagtggagaagggcaaaggcccaagtggagaaggataa

SEQ ID NO: 78647 - DNA, 642 bp, Glycine max
  Peptide Sequence Number=SeqID_170332
atgcgcgaagcactcatcgtctggggcggctggagcggccacgagccgcaggaatgcgccaccatcgtcaaggacattctggaggaggacggtttcaaggtctatgtcgagcacagcaccgaggctttcgccgatccgtcggtgcatgatctcagcctcgttgtgcctattgtcaccatgtcaaagatcgagaaggaagaaatcaagaacctgacggcggctgttgaaaacggcgtcggcatcgccggctttcatggtggcgcgggcgacagttttcgcgaatgcgtggaataccagttcatgatcggcgggcaatgggtcgcccatcccggaaatatcattgactacacggtcaacatcacccgccctgacgatccgctgatggaggggatttccgattttccctatacgtcagagcaatattacatgcatgtcgacccctccaacgaggttctggcgacaaagacgttcaccggtgatcacgcttggtggatcgacggcgtggtgatgccggtggtgtggaaacgcaaatacggcaagggccgcgttttttattcggcgctcggacatcaggccaaggaattttccgtgccgcagatgaagaccatgtttcgccgcggcgccacatgggcggcgcgttga

SEQ ID NO: 78648 - DNA, 321 bp, Glycine max
  Peptide Sequence Number=SeqID_170333
atgtgggctttccttactggtcgtcagatcgactgggctcacttagttcggtaccgtatgcttaaggcattacgggccaatgcaccacttccatatcctcagttggtcaccctctttctccgtcattttcaaattcctcttgatgatgaaccttttgttcaagtcaagcgttcctttgctataggtgctggtgcagtcacttcatttggttaccgtaaggatcgtaatggtcaatggctgaagaaagatgcacttcctccacaagatgagcgtactccttctcctcctcctcagaatggatatccgtctcacacagcttga

SEQ ID NO: 78649 - DNA, 165 bp, Glycine max
  Peptide Sequence Number=SeqID_170334
atggataagagcttgaaggtaggagaagatgagtggagggagaaggagagaaggagcatgaaattttgtgtctcaaaagagctatggttcagcccactaatccaagatcaagtccaagattctccactaagtgtgcttaggtgtcatgaggcatataaagcatga

SEQ ID NO: 78650 - DNA, 139 bp, Glycine max
  Peptide Sequence Number=SeqID_170335
atggggctccgaaaaaggggagaatggaggatttccttgagggtccgcactcaggcaatcatgaaacacagctccaaactcgaaagtggaggacacatgaacaatgctaggcaaaacatacatggagctccgaaaaagg

SEQ ID NO: 78651 - DNA, 396 bp, Glycine max
  Peptide Sequence Number=SeqID_170336
atggcctcatcatcggtcaaatgcagcacaggcgtgcctgctagtgatccttgcgaggtgctcaactctagcactggtgtagatactggtgatgcctatggactgacctccacaatcactggatctgcctctggatcagttttgggtacaaatgactctaggggaggaccggaagtagcaggaactggtgctgaaggaataggagctggtgcactagatgtctggggagcagtagaagatggaccctcagatcctctagccctggccttacgggtccctggaaagctgaccatggggtcgatggactcaaaagtcaaggaatctgaggtgactcctcgggccaagcataaggcagtgatgagggctggaaatccgagcctcgaggagttggattga

SEQ ID NO: 78652 - DNA, 393 bp, Glycine max
  Peptide Sequence Number=SeqID_170337
atggacatcgaagaagatgctgatatcccattaatcttgggatgtccattcatgctggccgcaagctgtgtggtggatatgggaagaagaaagttggaaatgggcatcgaagatcaaaagatcagtttcgatctatttgatgaagaaaaacaacttttggaccaaaatgtctgcttgcaagtgaagaagtttgaggaaaaggttctgaaggggttgaacagcttctttgaagcagcggacgaaaaaattttcagcagtccacttgctacgcgcacatcttgccctaagcggattttccttcctgcgctaagcgagctcttgcttgtgctaagcgtgttctttgcactaagcccaaaaacttctctgaattttaattctttcgaattgggctaa

SEQ ID NO: 78653 - DNA, 106 bp, Glycine max
  Peptide Sequence Number=SeqID_170338
aaaaaaagtctctgtcgtctctctcgtccttcgtcgttcgcgttgatctcagattcagtcttcgccatggcggagggtgcttcttacggattgcgtcgtccattag

SEQ ID NO: 78654 - DNA, 489 bp, Glycine max
  Peptide Sequence Number=SeqID_170339
atgggtgaatcagaggcgttgcttatgaggttcccgctacaatttgaacttgatgctggtgtttttagtcaagctttggtagcaccatatcctaggctatatctcaactcctgccagcagaaccacagaattgcggatatgggagtgcagaaggatatgggctgggaatggaatttaaaatggaggaggcatttgtttgacagccagctcaacatggctgctagattcctatgtgacgtggaaggctgtcatatacaaagtgttgcaacatgcccttttgcgggtgagcgaaggcgaggctcacgggtgcgctttccaaaagaggaaagatgcgcggagtcgccaccaacatttatttgtggaaaacgtcggaaaaatcgaaggaaactagtcaaaatgaaaattctaagttcgggagttgtatttacgcttgaggaaggtattagcacctctcacgtttgtctcaaaggacaacagcctactttttag

SEQ ID NO: 78655 - DNA, 591 bp, Glycine max
  Peptide Sequence Number=SeqID_170340
atgaagggaagaaggcataaatatgggtttaacaacaataaacgtgagaaggcggagaagatcataggttctccacctgcctcccttcctccctcagacgcatcggcttcgccgtctaccgtgaagtggacacgcaaagcctcacgtctacgatcgttgtccactagaccacctggtgctgagagaccagtggtgcatgttgatcctgctaccgggaaggccgacgatccccacaggaagaaattaagaacatatttggggattgtggcacgtgataaggtggacgtcacctacgagaactggaaggaggtccctactgctcagaaggacttgatttgggaggatattcaggcggaatttgatatcctagaggcttctgacagtaggacgaaaaggaagttactacagaccgtgggggagagatggaggcagtttaaatcagacctcacgaggaaatgggcccttgcggccgatcaggacggtgtcgaggacactgtctgtgagaaatacggcatcaacaaggaaaagtgggccaagttttgccagactcgcagagacccttctcgggaggatgtgcgcaagaaggcatag

SEQ ID NO: 78656 - DNA, 192 bp, Glycine max
  Peptide Sequence Number=SeqID_170341
ttctacggagttcctgtcacccccggcaaggtcattaggtcccctactaatcaagctttcatcaagaagtactgcgcccccaggcaggcgcagggtgaaacaccacaacagcctggggatggctggcagcgggcaacaaacacaccgccaccacctctagagttcatctcagctcatccacaaaatggttag

SEQ ID NO: 78657 - DNA, 141 bp, Glycine max
  Peptide Sequence Number=SeqID_170342
atggagggtcagatctctattgctattagcttggatccaaaggacgatttggttattggtggttatcctagtcacatggttcaagatgaagaaaaatgtacatcttattcagagtggattaagaatacaggagtgagataa

SEQ ID NO: 78658 - DNA, 897 bp, Glycine max
  Peptide Sequence Number=SeqID_170343
atggctgcacaggggaagaaagaaggtgaagcccccgtgttgtggttcgaaacctctgactctgtctgttgccaacaccagtttgaacccgatggtcgactctccgtagtgattgttgatgattccaggcccctataccaaaggatggctggatctttcatgaataaatttttcccctcaggatatccgtacagtgtgaatgaaggctatcttagatacacgcagtttcgagctttgcaacatgttaccagtgcagcactatcggtgctatcaactcagtccttgctattcgctgcagggttgcggcccactcctgcgcaagcaactgctgttagttggattttaaaggatggaatgcaacatgtagggaagctaatatgtagcaattggggtgctagaatggattctgaacctaaacgttggagactactaggttgggctgctgatgtgctctatgatataggcattggcttggaagtgctttctccattatgcccgcatctttttcttgaaatggcaggcttaggaaattttgcaaaggggatggctgttgttgcagcaagagcaacaaggttgcctatatattcttcatttgctaaagaaggaaatctcagcgacctatttgctaaaggagaggctttttcaactctctttaatgttgttggaattggagtaggaattcaattagcatctaccatttgtgcatcaatacagggaaagttggtttccatgttacatgccatttcacttcccccagaaaagaaagtatgtttattcagtagaatgggtaagaacaggggagaaaatgcacttttaggagagatcttccatgattggactgttgatgacctttcaaaagatctcaatctgtgcttcatgattatattttcagcttga

SEQ ID NO: 78659 - DNA, 243 bp, Glycine max
  Peptide Sequence Number=SeqID_170344
atggcaggtctcatcagtgacaatggcaaaatcaaactgctgcagttcaggctagggtgcagaggaccagagactagggcgcaggcacagttctttgaaagttgggtgtcatttaaaggaatttttcaagatcaaactcgtcaatcccaactgcgtgaccaacatgctgtcccaccagtgaaagtggcgagagccactgtgcctaactgtgccctacaccctgccctagcctggcacgtctga

SEQ ID NO: 78660 - DNA, 801 bp, Glycine max
  Peptide Sequence Number=SeqID_170345
atgtccaacaacaacaaggtgaagggcctccttaaaggcctaagattcatctctcagatattcgatactgatgaaaaagactcggaaattcagattagcaatcccacagatgtaaagcatgtggcgcatttaggttctggttcctctgaaaatgatcccagctggatgaacgagtttgaatctgtcccatggaattcatctgcaccccaaaatcttaatggagacattcatagcaaaagatccgataattcagtccaaaggacctctcacgattcaatggaaagaggttcaaggtcagggcatagtcaaagtgaagagaaggactcacgtgagtttccgaaatcatccaagcggcaaacgaaatcaatgggaaacataagagagtctcatgcaaaggaaaagtcagaccggccaaggccacctaaaaagtcatccaaacctaattcacacccaaatgatccatgcaatggggacacagattcactcgaacaacaacaacaagggagtgatttgtcacctaaaaaatctcgccccaagatgtcaaaagatggttccaatgttggtagtggctcatccaaatccagatcaaaaccccatcatcatcatcatcatcatcattctaaggactcaaactccaatattaaagaagtccatgctagacacagttctaagtccaggaccaaacacgggtcctttgaagaagatgcacaaactaggaacaaacacgggtcctttgaagaggaagaaggacaatttcaaagacgttctactgaaaatatactgaaaagttacccaaattag

SEQ ID NO: 78661 - DNA, 711 bp, Glycine max
  Peptide Sequence Number=SeqID_170346
atgccaatattcgagggagaagatccgatgggctggttaacgaagatagaaaggtattttcggttgcaagctgtaagagaagaggataagcttgaagtagtgatggttgccatggacggagaagctctagggtggttgcaatggtgggaatcttggaacctaaaccattcttgggaagggttcaagatcgcgatctcccaaaggtttcaagcgtctaacctagggaatccttttcaggcattgctggccctagaacaggaagaaacaatgcaagaattcataggccaattcgagaagcacgtcggaatggcgaaggggttggaggaactgtttctggtggagttcagattgatgattatggaagaagaggaggaaggagaccctattgacaaccagcaaataaagaggaggaaggagacccttgctgatgaaaggcaggctgtttttcctcaacttgaccttgaggacaagctgttacgcctgggagtgaacttgaagaattttccttcttcagcagtacctgctgcatatgccatcttattccagcttggcattgccactgttctattgctttatgtacttttctggttgaagctggacttgttcactacactcaaaactgtaggatttttgggagcttttctgttgtttgtgggacacagaattctttcccatctcgcgtcaacatcatccaagttgaagtctgcataa

SEQ ID NO: 78662 - DNA, 2739 bp, Glycine max
  Peptide Sequence Number=SeqID_170347
atggaagcagattatggaaaggattgcaccaaatctgagaatagagaaaatctttcagttccccctggttttacgtccctgacatctttcattttgaaaagggatggaaatgttaagaaaagtgataaatctacagcctttcaaattgcatccgaacaagagccaatattcatggagactattcctgagatgaatgacattagtgcttatagacaggttcttatgcatcggccgtggataatcgcagaccagagcaatcaccacaaacttgaggaatctcacataaagcatcttcctatggttaagttgggaatcttgcattttttttggtgtgaattaggcaatatctcgctactgacattggtagaatacacacacccaaacacatatatgtgtgatccccctttaaatgatggtcgtccaaaagggatcatacatggatgtccaaactgcagtaattgtgtgaaggtaacagcaaggtggcatcctgaggatgctataagagaagttttggaagaagctcctactttccacccaacagaagaggaattcaaagacacacttaaatatattgcaagcatacgttccagagcagaaccttatggaatgtgccgtattgtccctcctacttgctggaaaccaccatgctctcttgagaaaaagaacatatgggaaaagtctgaatttgttgctcagattcagcgaattgatggacaccaacttcagcatgcacaagaaattatggctagtgctagtggaaatacaaaaaccaagagaaaaagagatgtaaaagtagctttagactctcagcttggtaatagaaacaccagcactccaaataaccagaatgttcaaaaatgtgactgtgagtctgaacctggtcctaaattcagtctcaaaacattaaagaaatatgcagacatatttaagagtcagtactttgattacaaggataagaagaagattataggttccaatataaaattagctatacatcagcagtgggaaccatctgtggagaatattgaaggtgaatatggacggattgttcaaaatccaactgaagaaatcaaggtgctttgtgttaacactttggaggccggagtttttagcagtggatttccgacagtttctgatcctgtggaggcatacacttaccctgaatatttgaaatctggatggaacttgaataatatactttcactctcaggatcccttctttgttttgaaagctctgaagcttcacgtaattttgcccccaagattcacatgggaatgtgcttctctccactcaactggaaagttgaagagcaccacttatactcattatattacgtgcatttgggtgaaccaaaagtgtggtatggcatcccaggaaaatttgctattaactttgaaacaatttggaagaagtatctccctgatttgcaagcaggacagcctgatatgcatgataatatggtgatgcagctatcatgctccatattgaaggcagagggcattcctgtatatcgttgtattcagtatcctcgtgagtttgttcttgtctttcccgggtcatatcattcaggatttgattgtggcttcaactgttctgaagcagtaagttttgctcctcttgagtggctgcttcagggacagaatgttgtagagctatactgtgaacagaggagaaagacattactttcatatgataagcttttgctaggagcagcaagggaagctgtgagggtccaatgggaaactaatctgtgcaggaagagcacatcagatagcttaacatataaagatgcctataaaaaaaatgggttcttaataaaagctttgaactctcgcatccagagtgaaagtttgaagagaaaatttctttgcacttctttggtatcacaaagaatggatgaaaattttgatgccacttgtaaaagggaatgtagtatttgcctccgtgatttacacttgtctgctgtaggttgttcatgttcagataactttgcatgtcttgatcatgcaaaacagctttgttcttgcacttggagcaacaaaactctcttctaccgttatgaaatcaataatttgaatgttctttgtcaagctttggatgggaaattaagtgcagtctttaaatgggctaaagaggatctcggattaactctgaactctgttgcctccaagagatcaaaacaaagctcaaaaaacataattggttcaacccacccttcgcaagatttgcagatgaatgaacctgtatcgcagacagcatcagatgaatcctcaaaagggaaacaacgtcaattgctagatatattgaattcatcaaaaacaaaagaaaatgaagtggttccgaattcatcaaagaaaaaaaatgaggtggttccgaattcatcaaagaaacaaaatgcagtcgtttcccaagttgtgcggacttttggtggcactcacagtagttcttatgacattcgttcaaaaatgaagacaactgtacttcagtcaacctttgcagatgataagaaaggaatcaattctgttggtgccaaaattgatacgaagacacttgggcataagtttacaatttcaaaggaagtaggagatccaaaagtatctaaagttccttcagttacaaacgcacgttacttgccttttctacaagacaatgtgttagctgatgtttcatctgatagttcgagcacatctatgtcgtcagattctgaagatgaagatgtgcaagtagctaatggctaa

SEQ ID NO: 78663 - DNA, 486 bp, Glycine max
  Peptide Sequence Number=SeqID_170348
atggctcttaaccgaacaatggattcaagtttggtgggggaagaggaagaggtggatttgagagggtctgacggtcatgtttctgaggtcttcgtcaatggtgacggagatgagggaatcaaggtcttcgttgaggagctgggacttatcatgggggcaggggacgatgtgcccattgtagctacacatgagccggagcttggtggacatcaacgtgaagggctcgtcctaggaatcggtgttgtgagagtgcgacaagggttccacaaagtcggggaagctaaggtgcggcggtggagcagtcgagggggttggaacccaaacttttcgcctccaaagcgagctcgttatggtcgcatgccatcgtggggtgtgattacctcgacttctttagcgagccccaaaacgatcatcgagacgacacattcgtcatctttgcctgcggcttcttctccaaacttgtcacgcaccataactacaacctaa

SEQ ID NO: 78664 - DNA, 243 bp, Glycine max
  Peptide Sequence Number=SeqID_170349
atgtcgggccggatccaaaggcagagaccaatcaaggtaaatggtaatgcggccacagtttgtcgcgcaatgtcgtttcctgctttcagattttcgcccccaggccaccatttttgcgcttttgcttccattcttagtgtttttggtcactccatacaacttgtagaggttagaataagtgccaaaattaaggacttagacctaggaatccaagcctttggttttgggtgcaagaaaacatga

SEQ ID NO: 78665 - DNA, 527 bp, Glycine max
  Peptide Sequence Number=SeqID_170350
cggtggccttctagcgggactcaagcatgttcttacctctggtagaaaggtgcgaaacaaacccatacgtagagggccggagtacagcaaacgactccttgcactgttctttatcatgggtggaatggatgaatgcatgaagaaatgcgacacggaccctccatcagttcgtgacaaagtgatgggatcaagacgcaactcgtgcatgatgcagatgcaaaaaagggcacaacacggggatgtacatagtatcatccccttcgacaaacatattacgacagtagggactactagcaacaatatgttatcaaagagaaaaactctagatgagggttcactgttatcaagcaagtcggagacccagcatgaccatagattcacctccactccttatgttcccatggacccagggctcacgggtgcgccttccatgggaggaaaatgcatggagtcgccaccaacgtttattcgaggaaaaccatcagaaaaaccggacatgtgtggtctacgaactttaagtgtgaaag

SEQ ID NO: 78666 - DNA, 226 bp, Glycine max
  Peptide Sequence Number=SeqID_170351
ggatcgcgcccgcaagacacccagtggacccgaagaagtccaacagggtcttagagttgctaactctgattacgggcctctgccccctactaatcaagctttcatcaagaggtactgcgcccccaggcaggctcagggcgaaacaccacagcagcctggggatggccggcaacgggcaacagacgcactgccaccacctctagagttcacctcagctcatccataa

SEQ ID NO: 78667 - DNA, 216 bp, Glycine max
  Peptide Sequence Number=SeqID_170352
atgaagaaccttgaggtccaggtgggacaactagccaagcagataactgacaagtcatccaacagttttgtggcaattacagaacaaaatcccaaggaggaatgcaaagctgtgatgacaaggagtaaaagatttgttgaggctgaggatgaggatagtgttgtgcataagaagaaaactgctgacaagaagggtactgatgataagaaaaatgag

SEQ ID NO: 78668 - DNA, 237 bp, Glycine max
  Peptide Sequence Number=SeqID_170353
atgggcgtcgtcaagtacatgaccatagatgaattaaagcgcctaagcatcccctctgaaatgcttaaattctttaaccactctagtttcccacacaagggacatccgacaaggaaaatcagcatgcaacagggacatgcatatattctcgtagctaggttccctgaccctaactatggtgtcaaaacgggtttttcaaaggaagcgcaaaaacatacaatggtggttctaaagtaa

SEQ ID NO: 78669 - DNA, 327 bp, Glycine max
  Peptide Sequence Number=SeqID_170354
atgcagtatctaggaagtgatcctaggtcgtctcccaacaagcaatggttacaaggatttatccctaatcagttcaaccactttgtcgcaacctaccctttggcgggagggcgacgcgagactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcacggggaagggtgtttccctttgctcctacgtattcctcaatttgggatgagaaaatcagacctacgtag

SEQ ID NO: 78670 - DNA, 403 bp, Glycine max
  Peptide Sequence Number=SeqID_170355
ttacaacaacccaagtagatgcacctctacttgtatcacaaaggatgtaccctccaatgtgttcagacaaagaattcttaagcgggaagaatcaaaagaattctcagaccgagtccttttgaattctcttgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcagagaaaaaggctgcaccg

SEQ ID NO: 78671 - DNA, 69 bp, Glycine max
  Peptide Sequence Number=SeqID_170356
atgaagaagatccaaggcctacaagctccacatggagctacatcatatgagatgatgtttgtgtttgcg

SEQ ID NO: 78672 - DNA, 180 bp, Glycine max
  Peptide Sequence Number=SeqID_170357
atgactctaagacaacatggattaagcccttggatcatcttcatcaatgaagtcctttgcttcttaaagatcaatggcagcggaatggagaagaagaaatatgattggagatgccacttcaaggagaagatgagtcaagaacaagctcaccaccataagaagccatggataagagtttga

SEQ ID NO: 78673 - DNA, 618 bp, Glycine max
  Peptide Sequence Number=SeqID_170358
atgacgtacgaagatcttctaccatccctcatcgccaatcattttggccgtggtaactcccggaaagggtcctcgaacccccttttcccgaagtgggatcggcccaatgtgagaaccaacccgctcgccaatcatggagggggagcagttaatgcagttgaatccgataggccgcacaggtctaaacctttaagggatgtggcaacccctaggaggtttatctttgaggccctacaaaagggaggtgtgattccccatagtgggtgtaaggaggattcctgtctgctacattccggcgagatgcatgacatggagacgtgtttggaagtagaggaattgttacagcggatgatagatcaaggtcgactggaagtcaacattgaaggaaaagaagagcagcatatatgcatgcaatctacggaggggagcggtgatgcgaagcccaaacccttggtgatatacttcactaaaagcgcagcttcgcaaaagcccggacaccccttaatggccaaacctgttcctttcccgtaccaaaatagtcacgcggtcccatggagatatacacctccggggaagaaggaagaagaagtcactgacgtcagctcgttgtcagctaaa

SEQ ID NO: 78674 - DNA, 297 bp, Glycine max
  Peptide Sequence Number=SeqID_170359
atggcttctagaaagagaaggatcattggtataaggcccacatctcagtatgacacaaggagattctcttcattagatgcttggaccagatacacagacaatgttctggggagaaacattttacctgagaggaaggtagagctctatcacactgagctagatgactttaaggctgaattggaaaggtgtaatttctataaacaccttaccaatttagccgatgggagcatagacctggatttggtgaaagagttctatgcaaacttatacagttctgaggaccgtccaccaaagtag

SEQ ID NO: 78675 - DNA, 372 bp, Glycine max
  Peptide Sequence Number=SeqID_170360
atggtgaaagttggaacctcttacgtgccgatcaacgtctcattttcgccaaaagttggcccagggcttcccggttcaacagtctggtgcaccaggatttatttacgacttccgatcaagcttatcgcaataccctgttcctcctgttcagctactgatgtgttatccgtcaattcggcacacaagcataccagccggacatcaaagtgtaaagccggggtgcacgctgacgctaaccaccacattaatgctgccgctacactgccgctttccattcggaaaccatgtcggtgcgcaactgttgacggaagggcgatcgaggcgggcctttgctattacgggcgaaagggcggatgtgtgcatacggcttaa

SEQ ID NO: 78676 - DNA, 364 bp, Glycine max
  Peptide Sequence Number=SeqID_170361
atggcattgtatcccaaaggagaaccatctcctaaacctctcttgacctacagcagacgtagcactacaaatgaaaatcaacagacagaacctcaagggccccctcgagataattccttagctgctgatccagtagaagaaccagaaccagctcatccaagacgcagctcacgcattattaagcccccagacaggtatatccattccatgacagccttattatcctctattcccataccttcctcttatagccaggccatgaagaatgcttgttggcagaaagctattgaaattgaacttctagcattggaagaaaatcaaacatgggatatagtcccgtgtcctacatctgttaagcctttaa

SEQ ID NO: 78677 - DNA, 1897 bp, Glycine max
  Peptide Sequence Number=SeqID_170362
gactacgagccgcaggacagcatcggcacgccgaacccggctgtaccgctacggcaccggcttccagtcaccgcgctatgcgcagttgaccgtgacatgggcctactgaagcccgcacggcaggctcgaaactgcgtctgcgcggcggcgctggcggtgttcccggttgcggtggcacagaccaccgcgaccgcctccctcgatgccgacgtcgccaccgtggtccagcacgagcacctgcccgggctggccatggcggtggtcgacaacgggcaggtggtctatcgccacgccgaggggacgcgcggcgacggcggccgcatcgaccaggacacgctgttcaagatcgcctccaacagcaaggcgatgaccgccgcgctgctggcgcggctggtgcagcaggggatgctgcgttgggaggatccggtgcagcaacatctgccgggcttccgcatgcacgatgcgtgggtgggcgagcagatgcaggtgcgcgacctgctgatccacaacagcggccttggcctgggcgcgggtgacctgatgctgtggccggagccgaacgcgttcacccgtgccgacatcatcgcggggctggcgcacctgaaaccggtcagcagtttccgcagccgctacgcctacgacaacctgatgtacgtggtggccggcgaagtggcggcggcagccggtggcaagccgtatgaccagctgatgcgcgagcagcgcgtgggcaacgtggcgcagccgcatgcccggcgcggtgatcgcaataataaagtggtgaacgccgatggagcgatcagcccggaccaaccctcgatggcggctgggggcatccgctgttcgttgcgcgacatgacgcgctggatgcaggtgctgctggatcctgcgctggtgccggaatggctgggcgctgagcagcgccgcacgctgtggaccctgcacatgcccatgccgctgggcgagcgccagcggcgctgggacaacgcgcatttctacggttatgggtatggctggcgcgtgtcggacatggacgggcagtggaagggtgggcgtggtgatgctgatcaacggcgaaggcgaggatgcgcgcaccgcgctgatgcaggccacgctgaagcgcttcaccgcacccgacgatgcacgcccggcgatggaatacctggccgaactgaaggcggaccaggccgctcgtgcggcaaccgggcatcagcgacctgtgacttcatctgcgcagcgactcgcggcttccgatctgcagcgctggcagggccgctacgccgatccctggctgggcccggcctcgctgtgcccgggcaaggacggcctgcgcttcagcgtcgacaagtcgccagcgctgcaggcggccgtgctgaagttgcaggggcgctggctgctgcgctgggatacgcttggcgacgaagcgcaggcgtggttgcagccaggcgagggcccgcgaccgccagcgccgctgagccaccgcgtgtttcaccggccaccgacgcggccagcgctggtttggtggagatccgcgcgttgtcgccaggcatcgacatggacatccgctacgccggcgccaacaacttcaccggcgcgcgcgtgcccggctacgaggcgtcgtcctgctacctgctggcgccggtggcgaaggcgctggccgaggtggaacaggacctgcgcgccgatggcttcggcctgcgcctctacgactgctaccggccggtgcgttcggtgcaggccttcatggcctgggtgaacgatccgcgcgagctctcgcgcaaggcacagcagtatccggacctggacaagtcgcgcctgctggccgatgggtacatcgccgaacgctccggccacagccgcggcgccacggtcgatctgggcctgctggattgccgcagcg

SEQ ID NO: 78678 - DNA, 1028 bp, Glycine max
  Peptide Sequence Number=SeqID_170363
atggaagagaaaggcccctgcctcaggatctcaggccgatttgaccgatcaagattcacatctcaggaggcctatgatcgctattctgatattgtgattggcaggaagattcttcatgagagaaatgtcatgatatatcacacagaatttgatgagttcaaggctgagctcaagaaaaggattttgcacaaggagctgaccaatttcatggatgggagcatcgatgttgtcattgttaaggagttctatgcgaatttgtatgatcctaaggataaatcacccaagcaggtgagggtgaaaggccacttaattaagtttgatgaagacgccctcaacaccttcttgaagacgattgtgatcattgaggagagggacagcctacctgcctactccagattctgtcgtctgaggccaaatccacaggaactagcagcccgattatccatccctgggaggggatttgagctaaatgaagatgggctgctcttgaagatcctgaggaagaatctgaccaccctcactcagacatggagcattctttcattctccaacctggcgcctacttctcacacttctgacataacactggacagggccaggttgctccacggcattatccagaagatggacatgaacttgaggtatattatctcaagtcagatttctatgattgcacaacatgactcctcgaggctgggtttccctgccctcatcactactttatgcaaagcctggggactcacttctgattcattatcttttgagagtctcagtccaaccattaatttggcttacatgaagaaaaactgctggaacctcgatgacccctcagtcactttcagagggcctcgcaaggccaaggggaagaggtcagagactctcccatcttctgacattcccccatcagcagctccttccactacagttctaacttcttctaccgcatctgcatctgcacccttaccagctcttattgcagctccttctacaggaccatcttcctttacttcaaagacattatatgctat

SEQ ID NO: 78679 - DNA, 480 bp, Glycine max
  Peptide Sequence Number=SeqID_170364
atgaccatgattacgccaagctcgaaattaaccctcactaaagggaacaaaagctggtaccgggccccccctcgaggtcgacgaattaaacaaaaaagtaaaggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 78680 - DNA, 1363 bp, Glycine max
  Peptide Sequence Number=SeqID_170365
atggtcaccaccgagtttgtgccgatcggcgtgaagaccaacatcgccccttcgctcggcgtcagcaccggcaccgccgggctgatggtcaccacgccgggcatagtggcggccgtggccgcaccagggttgagcctggcttccggccggctggacagacgcctgccctgctgggactgccgtcaacttcccgatgatgctgctgggccgcgtgctgctgggcgtctgcgtcggcggcttctggtcgttcgccgccaactacggccgccatctggtgccggaagccagccagggccgcgccaccgcgctgatcctcagcggcatatcggtcggcgcggtgtgcggcgtgccggcgggggcgctgatcggcgatctgttcggttggcgcgccgccttcttcggcggtgcggcgctggcggtcggcgtactgttggcgcagctgcgtttactcacgtcggtaccgccttcccggccggttacgccgcgcgatctggtgctgccgctgcgcctgccgatggcgcgcatcggcctgatcgccatcgtgctgctgttcatcggccacttcgccgcctatacctatctgcgccctctgctgcaacaggtgttcgtgctcagcccatcggcgatctcgctgcagctgctggcctatggcgccatcggcctgctgggcaccttcctcggcgagcgcctggcggaacacagcctgcgcgccacctttatcctgatcgccgccatgctggcgggtattctgatcgtttcgccgctgctcagcggcctcgccggcgccacgctgatggtgttggtctgggggttggcgttcggcgccgtgccggtatgcgccaccaactggatgttcgccgcggtgccgcaggcgccggaagccggccaggcgctgctggtgtgcgtcatccagatcgcactggcctccggcgcactgctgggcggcgaggtggtggactggcagggcgtcagcagcgccatgctgttcggcggcgcgctgatcctctccgccacgctgaaacatgccccggccactgccggggcatgacgttgggaacctatggaccatcatttgctcgctatccggaatctggaggatcacctgcagaccaagctgttccagcgcaccacccgcagcgtgtcggtcacccgcgaaggcgaatgctattaccagaatacggtgaaatggctggcggatttggagcagatggagggctgtctgaccgagtcacagaattctccgcagggcgtgctgcgcatcgataccggcagcggcaccgcccgccagctgctgttgccggcactgccaggctttttggaacgctacccgcaaatccagatcgatctcagcatcggcgatcgc

SEQ ID NO: 78681 - DNA, 703 bp, Glycine max
  Peptide Sequence Number=SeqID_170366
gtcgactctagaggatccccagctgcgtagcactccagcagaaaaaggggcgcggcctggggagtccactgacaagaatccagctaaaaagggtggcaagcccttgtttgtctctgttgagcaggtcaagccgggcaccatccatgtctatcaccaggcactgggcaatgtgacttcatttgccaccgtggccgtcaaaagtcgcgtcaacggtcaactcacggccatccattttcgtgaagggcagttagtcaaagcaggtgacctgctcgccaggattgatgccaaacctttcgaggcgcaattggcacagattcaagggcagcaactcaaggataaagcgctgttgtcaaatgcgttggcggacttggacagataccagacgctgttgaaacaggattcgattgcaggtcagcaggtggatgcgcaggtttcactggtgcagcaatataagggtgccgtgctgtctgatactggcgcggtagaaaatgcgcagttacaggtggcatataccagaattgtggcacctatcagtggccgtatcggtctcaggcagattgatggcggcaacaatatcaccactgccgatacgttggccgtgatcaaccagatttcaccgattgctgtgacctttaccttgccagaaaatatggcgcaggaagtcagccgcttgctcgatcagcgcacgcatagcggattaccg

SEQ ID NO: 78682 - DNA, 207 bp, Glycine max
  Peptide Sequence Number=SeqID_170367
atggtgctggtagcggctattaaagctgcattgacctccattatctcctttatgctcatcatggcctccatcactgtggacatttgctctttcaaggccttcgtgttggccttcacctactcttgcacctcctctacttcacccattactctagcacgggttcgaaatgggtttatgatcccaatatggttagctcatggtacctaa

SEQ ID NO: 78683 - DNA, 345 bp, Glycine max
  Peptide Sequence Number=SeqID_170368
atggaacattttcttgagcaagcagcctggcctgaagctcaacttccattggtgagacccaacgaggctgctctgcctgagcccacacctgtgcaggtcaatttagaaccatctaacccacaatctccagtggtgaatccaccttcttcgcctgagcttgaagcagttcccccatctcctcccctgattgtcatttctgacgcatcatcagatgaagtagctgcccctcctgattcaccagctacagaaacagctgacccccctgtttccccaattggaggaattgttgatctttttgattcgtcatctagagaagttgttgctctcactgattccccaatttaa

SEQ ID NO: 78684 - DNA, 588 bp, Glycine max
  Peptide Sequence Number=SeqID_170369
atggatgagccatccgcacttagcagaaaatctgagaaggctttcgacagccaacgtaaaactttgttgaatctctatgacatggatcaattacgtaataatgtgaatgctaggtcgttgcccggaagcaacgtgctgtatggctcgagtacagtgtcaaaagagcaagggccgctgcatcaccgcccgaatgtagtgaaaagtaagcaagggttcccacattttcgtgaacgggtgtgggtaaagaagctagttcatgacaggaggattcactttggtacatggaatataggcacacttactggaaaatctatggaaatagtggatgttatggtgaggaggaagatcaattttatgtgcctacaagaaactaagtggacaggtgaaaaagcgaaagaattagacaactcgggatttaagttgtggtatacgggaaaaatcagatcaagaaatggggtagggattattgtggacaaggagtggaagaaggatgtcgtagatgtaagaagagtaggagatcgtatcatagccttaaaattggtagtgggacaggacacctttaatgttattagtgggtacgcacctcag

SEQ ID NO: 78685 - DNA, 570 bp, Glycine max
  Peptide Sequence Number=SeqID_170370
atggataaccattcatggtgttatccagcttgtgttcaatgtcataggaaaactgacatccaaacaggaccattcacatgcggatgtggcaaggataatgatcagcctgttctgaggtatagagttgaagtcatggttacccaaaacaatgagagtagcaagtttttgctttgggaccgtgaatgtgttgaattgattggtgaaacagctgatgatgtgaatagggtcaagattaaactggtggatttgtcctgtttctggcaggatggtgatcttgatttgaatgcttcccctcaagcactttacaaattgttgggtcatgtgcttgcttttaaggcatgttccaaaatagatccttccaatgttgattgcaataatactacgcatgctgaatgtcaatctttgtctgtcacagctgaccatgatccggttgtcggattccctttaacgaccaaaaagcggatgtcatctgatgaagttgatgatgagttaaggagctcacaaatttccccagcccaactatcgtctaacaaattaacaagacattctcataagagccaatttagctga

SEQ ID NO: 78686 - DNA, 426 bp, Glycine max
  Peptide Sequence Number=SeqID_170371
atgaaggacaagtatattgttcaaagcttgttaaagaacttagaaaaaatcaagaacaagcttgttcgcacatcgttcgcgtgtatgatatccactccacaagcttgtggttatgtgagcatgaactactaccaatatatagatgttttttacacaaatgagcacatcttaaaagcttactccgcacaatggtggcctcttgggaatgaagcaactattcctccttctgatgacgcatggacacttatccctgacccaactacaattcgtgcgaaaggccgtgcaaaatcaacaaggataaggaacgagatggagtggctcgaaccatctgagcaccgacaaaattgtagtagatgtggagcagaagggcacaataggcgtcgatgtccaatgcaatctgaccgtgggagtaattcatttaattga

SEQ ID NO: 78687 - DNA, 507 bp, Glycine max
  Peptide Sequence Number=SeqID_170372
atgtatgaataccttgaagaggaaagagtccctgatcttgagagtattttggcagacttcatgacataccaagccagctctaaagggtcctgttatggaatgcaacaacagggaactcaatttcaaaggaaccagtctcctgtaggctatcactgggagtcatgttggcaaccagattatgataataaagtagaaggagttattaatctggatgacctgctaatgcaatttaaagacacaatagagtcaatgcaacaggcttttagaagaactgcaactcagattagtaagttggttgatgacatggctaacactgcggccagacaagaggaagagcgtgtagagattgaaacgtatcaagaaagcatttttcaagtgacctccatgcatcatcagatgccactgcagaggaaattgtctgaagtctccagtactccagaatactcttgctcggccgctgctggctatgttagaggaacagagaaaggagattggaactcactgtag

SEQ ID NO: 78688 - DNA, 270 bp, Glycine max
  Peptide Sequence Number=SeqID_170373
atggtcgtcattctacgtaaggaaaaccttattgtctggttttgttccttgcataacagaccagccaactacattaagggaataattaacagtgctttgaaaggacttgatgatactccacaacctaactccaaggctggtgctaggtggattgttgttaagtattttaacgatgttagaccattggaagcaaagagattaaaggcgcttcgcatccagtgggcacaattttatctcaaagttaggatgttaggaaacttaggatgttag

SEQ ID NO: 78689 - DNA, 3093 bp, Glycine max
  Peptide Sequence Number=SeqID_170374
atgctcaactcaaggataagaagaccattatgtccaaggttcttggaaaagaggtggtgttatccatggagtccattacataagtcacagggtgcatcagggaaggaagcacataccaagaagattgagagaaaacataagagccacattccaaaagctctcatcggaaagaacctcaaggaggcagatgggaagaagaattggatgacatctactatgccaccctcatcagcaaactcctctgggaacaccaagtattccatgtctttgaaagattggacgaggactccaagcagtccatcatcagtaaaagaactttcgttgccagacagtaacactttagtcaacaagtttgttgactggaagcaacaccagagaggaacaaaattaccatcacgattgcccaaattggcgacgtttgattctctgaaattgtttccacggctgaaatttgctgctacatgctggtttccatggccaactcgtgatcgaagtggtgcccccttttccaaaaccctaggagagagaaacttcgcgctgaaacggcctcttggggctctcaggttgtgccctggcttccaattacgctacccttttgtggattcaggtgcttttcttgcatcaattgttgtggttttggcattttcgtatgttcccgtggaaaccctaggatcatgcaaattgggggaattcatggaaatgggtgctgctccaagtattgtggttgtgggtggtagtaggtgtacttgtaaagatactgcagcactcaagttagtatgtgttctaggaggcttgtgtattacattagatccattaccagagggcttagtccccattatagtggcaagaatgagatgcttggttaacaaggtggagtggagaggcatggagtggaaagggaagttgggaatgaatggatataaatcaggatctgctctccttgtaaatgctgaagttgattctatgggtggagttgttgacggcggagttggcataggtttgaagatctctccgtgcagagcagcaattgagaaggctcaagcagagctcagagaggagtatgatgttcgtgaagaaagaagaagagagcttgaatttcttgaaaaaggtgggaatcctctggactttaagtccgggaatgctgcttcagttagtgttcagtctacttcactcactgatcagcctcatgagcagtttgtgtccagtgaagcaaaaggtagttttgcattgactccctcccctcatggtgactctgttgacagtagtgctagacctggggctcctttggctagtgaacctaatactgctgataatctcctactttttgatggtgagaatgagttgcctgaaactgaaaggaggtgcctgcattcaaacagaaggaataatattgctctgtcagaacagtcttcccaaattgatggaaatcttaatgctaaggaaactgaagattctgccattttccggccatatgctcgaaggaacagatctagatcaggtcacggtcctcggggggcttcaagggaagtgaaggggttaatgtctgaaacgaatagccaaaagaaccttaatttgacaactttgtctaagccaaagctttccagtttgaatggtgatgttggtaccaaaaatttgattactaataatactctgaataatgaattggttgggatccgagatcatcaatccactagtggcaatgctagtgttcccgaagacaaattggatattacggtgaatagaagcttaaaagaaaatcatggaactctgccttctgaagataatactgttcaaaaccctgttctcatggcttttggagaagttaacatagttgaattaagggatccagtagctgttgtcaatcatgaacctccacctcatgtacctactacaaaacctgaaaatggaccttattgtcagccaaatgggtttggcaatgtagaagtagacaggaaaagtgcactaaatgaaggccaaaatagcaatgctacattaggcaagaataatttcgatttagagtcctcgtgcacacagactagtttagttagagatgtaaataatgatagtgatatgtgtaccaatacaaagaacgttgatgctaatggaaataccatggaacaaacatttgcattaaagaataaactgaactctgctgattgtgaagttgtgaaaggtaggcataagacaaaaaatgtaaatggtgctactgttagcaatgtgaatgatgctggttatcaaaaccattctggttgtggtaatatcaccaaagctgaggaagatgtccatattaacagttcttgcatgtcaaatatcaaaggagtacatcataatgacagtaacatttcaaaaactgataaagatactgtttatgtggatcagtccaattctgtcaaggaaaccagctgtgaaagacatgaggttcctgtggatgtgtcactttcagaacctcctcagactgctccagctgaaaaggttacaagcgctgccactgatgatcaaccatgtcctacacacaatatgaagttagcagacaaggctcgtgaagattcaattttggaagaggctaaaattatagaggccaagcggaagagaattgcagaattatctcttcgctccttatccacacagaactgcagaaagtcacaatggggttttcttctagaggaaatggcatggctggcaaatgattttgctcagatagctgctgctgcacaattgggtcatcaaacagcttttacttgtcagtcaagatttgaaaaactaaacaaacaactagggacaaaaattttgtctcacagaatagcgaaggctgtcatgcagttttggcattcggctgagcttcttctagacaatgatcttggtattaactgcattgttggttgtgttgaatctgggaaagttgatgcaaatgaagctttgagggatcaaagaagaaatagcaatatgatttttatgggactaggcttgctcatgggacttataattaggggtggaaatgagctgagcagcttgtcgagggccttcaactcggcctatgtaaggctcggttcggcttggcttgtttactataaaggtcaagctcaagctttttaa

SEQ ID NO: 78690 - DNA, 3750 bp, Glycine max
  Peptide Sequence Number=SeqID_170375
atggctgccagtcttttactcactaattggttagatgcatcagaggagacaagcaaatttttggagggacaaaatcctgcaaaacatgctgcacttaaagtgcatgcatatgctttgaggtttttagatgctaatagatctcagggaatttcctctcaagcagaagcaccaacaacacctgaaaagatatttgactcaagcactgtagatatgtcatgggatgagcatcttaatgaagaaaatcttttctatgaagttcctcctactgcaatggaaacatatagaaaagctatcgaatctcatttcctacagttcgagaaaactgggagtagcattcatgaggaaattgaaatgtctgtgtatgatactgcagcagagtttgggtctcaagagaatgcatatgatgaggaagaaggagaaaccgacacttattacatgcccagtgtctatgagggcaacaaatcatcaaaatctgcgcagaagaaacataaaaatttgaaggcttacactcctaggtgtggtgatgctggtgctgatttgccttatgtacactatgcaactggaaatcaaccatccatgctgtttggaaaaagacctgctagtgtaaatgttgggtcaataccaacaaagcgcatgcgtactgctactaggcatagagttagccttcctctttcagctgtggcggatactagagtttggcagcagaaggatcagtccaagaagagagtggatagtcatcactttgaatctaatggaagtttgtgtgggcaacctaatgctaagaagccaaagataataaggcagtcacttgataatcctttcgacaacattgttcctatgactaattctattccttcccctgctgcgtcacaaatgagtaacatgtcaaatcctaataaatttattaagatcattagtgggcgagaccgggcccggaaaactaaagctctgaagatttctgctgcacagcctatttctggaagtccttggtccctttttgaagatcaggctcttgtggtgctggtgcatgatatgggtccaaactgggagctcgtaagtgatgctatcaatagtgctctccaaatcaagatttttgccgataatgacattttacaacatttccagtgcgtctttcggaaaccaaaagaatgcaaggagcgtcataagactttaatggatagaactaccggggatggtgcagatagtgctgaagattcagggtcttcacagtcttatccttctacattacctggaattcctaaggcattatatttggatgcattgggtagtgccaggcaattgtttcaacgtttgcaggggccaatggaggaggatacactgaagtctcattttgagaaaattataaagattgggcagaagcagcattaccctaagaatcaggttgataacctggattcaaaacaattagcacctgtccataattcacacgcgattgctctttccctaaccagccccaacaacctgaatggaagtattttgacgccacttgatctctgtgaagcggaagaaataaacccagatgtcccagcccttgggtatcaaagttctcatcctggtggtatgacattaccaaatcaaggttttgtaccatcaatgcttcctacatccggggtgaattcttcactaccagggtcttcttctggtatggttcttggccataacttgtcatcatcacctggtccagttgctgcatctgtcaggggtggtagatatgggattcccagaaattcaccttcatcagtggatgagcaacagagaatacaatacaatcaaatgctatctggaagaaacattcagcagagtatgccagttacagggactctttctggaagtgatcatggtgttcgcatgcttcctggtggaaatggtatgggcttaatgggtggaattaataaaaacatggcaatgaggcctgggtttcaaggaatggcatcaccatcaatgcgtaattctggaagtatgctttcctctagtatggttggtatgtcaagccctgtaaatatgcactctggagttggtactgtacaaggcaactcaatgttaagacctcatgagaatctacatatgatgaggcctggccataacccagaacatcagagacaaatgatggttccagaacttcagatgcaggtcacccaagggaacagtcaaggtattcctgctctgtgtgggccgagttctgcctttagcaatcagacaacaccacctgttcagccttacccaggacatgcccaacagccacaccaactcccccagcagcagtcccatctcagcagtcctcatcttcaaggtcctagtcatgccactaattcacagcaacaagcctatgctgttcggttggcaaaggaaagacaactgcagcaacgatatctgcagcaccagcagcagcttgctgcatcaaatgcattaatgccacatgtccaggctaagtctcaacttcccatctcatcatcaccactgcagaacagttctcaggttcaaccacaaaattctcctcagcaagtgcctctttcacctataacgccatcatcccctttaactccattgtcatcccagctccaacagcagaaacttcaccatgcacaacctgggttcagcaggaattccactgccagtgggttgactaatcaagcagcaaagcaacacccacgccatccgccacagcggccgcagcagcagtatcaacagcccggtaggcaacatcctaatcaacggcataatgtacagtctcaacagcaggcaaaacttctgaagggaatggcaagaggaaatatgatggtccatcagaacctctctgtggatacttctcatctaagtggactctctctgcctgcgggaagccaaactggtgaaaaaggggaccaaatcttgcacatgatgcaaggtcaaaatttatatcctggatctggtttaaatccaaatcaaccatcaaagcctttgggtcatgctttttcttcaaaccattcacagttgcaacagaagttacattctgggtcaccaaccacttcatcaaagcaacttcatattccttctgatactagtactcaaggacaggtttcaccagtttcatcgggtcagttgttgtcacctccgcagccagctgttattgcttctaaccaccatcagcttcagccacaggttcaatctaagaaaattaatcaaactcaaacaaatgttaagagaatgttgcctcaaaaccattacgagcattctatgtcatctagcaagtctctgtctgatcaaagtcaatctgatcaactgcctgcaaacagtgcttcgcaggttagtgcaatgacagagggttgtatggattctgctagtgtggtaccaggtgttactactgctgtatcttctcagtggaaagcatcagaaccaccatttgattccgctatgaacaatcaaactcaagagagctccttggggagtgcacctgttgaaaattccacgggaaatgagcaaccaacaattagtcaagggttggggccaaggtcagttagcttgatttctcaggcacataattctgatacacagtcacaatctctccaacagtcatcacaacccatcctatctcagcagccgtatccagctgagcagcagcagcaacaggagcaagaacaacattctcctaaagatcttgctttacaacatcaacctcagcaacatatgcaacatctacaatcagggcagagcagtttgtttatccagtcacctaattctattgtggaatga

SEQ ID NO: 78691 - DNA, 864 bp, Glycine max
  Peptide Sequence Number=SeqID_170376
atggcgacccccccaaacgacgccgcatcgacgaagaagccacaacccatcccttggacccaccaggagaccgtgcacctcatccgcgcctaccaggagaagtggtacgccctcaagcggggcccactgcgccacaaccagtgggaggaggtcgccgtcgtcgtcgccgcacgctgcggctacgaccttgcccaccccgccaagtccgcccttcagtgccgccacaagatggagaagctccgccagcgccatcgcgccgagaagaaacaacaacactccgccgccgacgcgctccgccccggcgcgtggcagtacaacgccctcatggatgaccttgagcgcggccccctccccatctccgcccttgctcctctatacagcgacgaagaagaagacgaagacgacgacgacgccatcgacgatcaatacgacaatgatggcgacgagggtttcattaacatcaagtcgaagagtattaactgtatcctcagcgagagacctgtgagaatgagaagcaacgacagagggtttttgagagagcacgttgttgttgttgaagaagaagaagaagaagaagaggaggaggaggtggaggaggaggaggagaatgagaatgaagacgacgatgttttggggttgtcgatggagatgagggttttcgcggagaggtttattgggatggagagtttgaagatggagatgatgaaggagacggagcggtgtaggttggagatggagaagaagcggatccagatgattctggaatcacaaaggaggatcgttgattccattggcatggttctaaattgtggttgtgattgtggtttcatcgcgatccttgacattgtgggaaaatgcggctga

SEQ ID NO: 78692 - DNA, 993 bp, Glycine max
  Peptide Sequence Number=SeqID_170377
atggcgacgtcgctctctattttttcatctatctctcaacactctcttcattgccaaagcgcttccattatctcgccctcctttttccctctcttcctctcctcaaatccctactttctctcaccacgcgccaccacaccttcaccgtccgcgccgaatcacaaaatggcgtcaaccccgttcccacccactacgacttcaacctcttcaccatcggtgcaggcagcgacagggtctgagccactcacttggccaccaactatggcgcttctgtcgccatctgcgagtttcctttctccactatctcctccgaaaccatcggaggttcgagttgccgatccaacttttttaggttacttcattgataaaggtgttgctactactgcaaaagttgtcctcaaggcacatccacaagaaaaggttggtgtgtttgtaagacgaggtaaaggtggttctcttaacgtagtggaatacagtgagttggagcagtcactagcttctgcagtcaatcaagaatttgagcatgcaaaaatccgaggagccaaaatctatgcagaggtccgtggctatgggatgtcaggtgatgcatatcatattactcaacctcctagtgatgggaaaggagccattttggccatgactcgtgctttaagacagggtgctattggtcatctcctaggcgctgctggagctgttgaagcaatttttgtagttttggcaatacggcatggtattgctccattaactcctaatttaactaaaccaaatcctgtgttcggtgatggtttcatgccattgtctgctttagaagaaatgccaattagagttgctatgtcacaaagtgtgcttaatattttcaggaagaatgatagatctcatccagcacaagatgttgcagcccagataagcacactgctatataaccatggaggctgcacgagttctgtaccaagtccgagattgaagagttattttgtgagttttgggacttga

SEQ ID NO: 78693 - DNA, 345 bp, Glycine max
  Peptide Sequence Number=SeqID_170378
atgagggttcacggttatcaagcaagtcgaagacccgacatgaccacagattcacctccacccggtatgttcccacggacccagtctccagtggagtcgccaactgtcgcaacctacccttcggtgggagggcgacgcggggctcacatgtgcgtcttccaagaaaggaaaatgtgtggagtcgccaccaacgtttatttgaggaaaacgctagaaaaaccagaaaaggaggtgagtttagttatcaaaatggtgttagtagttaaagtgttagcttctcaaagaagcctcttgagaaagcttctcaaagaagccatgaggaagcttctcgaggaagcctcttaa

SEQ ID NO: 78694 - DNA, 267 bp, Glycine max
  Peptide Sequence Number=SeqID_170379
atgacgatgacacggtctatgaaaagtacaatatcaacaaagagaagtggaaccaactttgtcaaatccgtagagacctttcatggaaggtgttcgaacccgacaagtgcaccgaattgcgcaagtagtataaaacgcctaatcccgatcaagcatcgtcctcagattcctcttgttggactaaactcgaccagaaccacattaagacaaacatataaacaactaggttaccgtaccccgatccttcgtgataatacgataaactaa

SEQ ID NO: 78695 - DNA, 183 bp, Glycine max
  Peptide Sequence Number=SeqID_170380
atagtggaagcaaaagaacatcacctagatgaagatactctgataccacatgaagtagctccattggagcttatcatggcagtggaatggagaaggaagaaagatgattggagacgccacttcaaggagaagatgagtcaagaagaagttcaccaccataagaagccatggataagagcttga

SEQ ID NO: 78696 - DNA, 696 bp, Glycine max
  Peptide Sequence Number=SeqID_170381
ggacttgcactgcctcctgaacctaaggttggtcctttagctgctcgtgtcagcacaaaggagagttatgttgatccctcagggaatgatccagacacgggtgactctgacaaatgcaagttgtacatcaatgaatatcctccccgcttggttgccctaggaagagtttatgagggatccacaattgttcacaacattcctttgttgcatgatcaagtcaaggttggtgttgaggaggttagtgatgcagatgctcctattcttgtacccactaaagaggttaaggtcatagggcagacacttaacaccttcctttcttggccgacacatcttgtcaagcgtttatcagaacaaggggctgtgggacccacgaaacctgcaaataggtcgaatcatgaagtcgatggtcccctctatcttttgacattgaccatcccacagctttttctgaagccattgcaggttatgtgggatgctaccttgtttggcatgtttaatgaagacttccccttgtacataaagcatgaagatccgtctgaaatagcacatggtggtcaatgtctcaacatctctgttatacagttgtggattatgccagacaactacctcaaaggcataattaacagtgctttgaaaggacttgatgatactcaacaaagtaaatctaagcctgctgctaggtggattgttgttaaa

SEQ ID NO: 78697 - DNA, 309 bp, Glycine max
  Peptide Sequence Number=SeqID_170382
atggctgatttagagatttgtaaacagatttatactcctcaacaataccataaagaaattaggagaaaaagaccccagtacagacctcccaacaaacaaccctctaagaaaaagaatccaactagtaggtattcaattagagcctttaattctagaaaacctactcttaacaaagaaagacatgttggaaaacttagagataacaaacatatacaaagaaacaagaatgttatgcttgccatcaaccaggacattactccagagattgtccaaacaaaaccaatctatttacaagaaaagcagaattga

SEQ ID NO: 78698 - DNA, 54 bp, Glycine max
  Peptide Sequence Number=SeqID_170383
atggattggagactgaccctgatcttggccagtagtgctgctgaaagaagatga

SEQ ID NO: 78699 - DNA, 210 bp, Glycine max
  Peptide Sequence Number=SeqID_170384
atgggagctggccatgcccgaagtcgttaccttaaccgcaaggagggggatgccgaaggcagggctagtgactggagtgaagtcgaaagagagggatggggttctcttgcttttggcatagcgggccccggcgggaggcccgcacgacgggctattagctcagtggtagagcgcgcccctgataattgcgtcgttgtgcctggactgtga

SEQ ID NO: 78700 - DNA, 475 bp, Glycine max
  Peptide Sequence Number=SeqID_170385
taccctcacctttggaggactatacgtcccccccttcagagggctgcacgcccttaccttcatagggctacacgccctcacctttagcggactagacttcctcgcctttagaggactacaagttctcgccttcagaaggtcatgtaccttcaccttcagaggactacacatccttgccatcagaagactccacgtccttgcctttcgaggactgcacgtcctcaccttcagaggactgcatgtcctcaccttcagagggctgcacgccctcaccttcagagggctacaccccctcatcttcagaggattacacgtcctcaccttcagaggactacacgttctctgcccagcgaccgtaatgccgatctccccctgcggaagtatcagttggtctgtgtcgtcccgacatgatagcacgcaaagactagcgtcatcttctgcaccctttgtcaatcacggccaacgagcccgttga

SEQ ID NO: 78701 - DNA, 537 bp, Glycine max
  Peptide Sequence Number=SeqID_170386
atggcgaggacgtgtagtcctctgaaggcgagggcgtgtagccctctaaagatgaggacgtgcagtcctctgaaggtgacgacgttcagtcctctaaaggtggggacgtgtagtcctcagaaggcgaggacatgtagtcctctgatggcgaggacgtgtagtcctctgaaggcgagggcgtgtagccttctaaagatgaggacgtgcagtcctctgaaggtgaggacatgcagtcctctgaaggaggggacgtgtagtcctctaaaggcaaggacgtgtagtcttctgaaggcgaggacgtgtagtcctctgaaggtgagggcatgtagccctctgatggcgaggacgtgtagtcctctggtgaggccctttgaaggtgagggtgtgcagctctctgatggcgaggaagtgtattcctctgaaggtgagggcatacccttgatggtgaggacgtgtagccctctaaaggcgaggacgtctagtcctctgatggcgaggatgtgtagtcctctgaaggaagggcatgcagccctctga

SEQ ID NO: 78702 - DNA, 441 bp, Glycine max
  Peptide Sequence Number=SeqID_170387
atggccaagttcgacccagacatagtcctcgagttttatgccaatgcttggcctacagaggagggcgtgcgagatatgcgatcctgggtgaggggtcagtggatcccgttcgatgcggatgctctcagtcagttcctgggataccctttagtgctggaggagggccaggaatgcgagtatggccagaggaggaaccggtccgatgggtttgatgaggaggccatcgcccagttgctatgtataccggggcaggattttgcccggactgctgctggaagacgggtgcggatcatgcgcaccaatatgaccaccccaccttttgttaccatgatccgagagtccgggggcatgcggagccacatgaccgtgggatccccaaattcgcatgttccatcatttatcatttgtatgttatcctatttctatgacttgagggactaa

SEQ ID NO: 78703 - DNA, 486 bp, Glycine max
  Peptide Sequence Number=SeqID_170388
atggacatcaggatgttctcattgctgcaattggacgtccagagtaccctggacgtgttcgtgctgctggagccggtgtcaccatcaagggaccagctagaggagtccatcacagaaaaagtgactcggcagctcatggcatcgtttagccagatgcagtcccagtttcagtcccaaatgcaatctcatggaattgcactgccttcggagcctccgcttggtccctcaggtcctcgagtaagcacaaaggagagttgtgttgatcccttaggaaacgatcctgagacgggtgactcagataggtgcagcttgtacatcgaagcaaatcctgcccgcctggttgccctggggagagtttatgagggatccactgttgttcataatacccttttgttgcctagccaagtaaaggtgggtgtggaggaggttaaagatctagatgctccagttcctgtacccaccgatgaggtttccttagtagggtag

SEQ ID NO: 78704 - DNA, 612 bp, Glycine max
  Peptide Sequence Number=SeqID_170389
atgaccggtcctctcaatgagtcaatctcttgctttctaaaaagggtggacccttgggtactagtaccctcaccttcccaggactacacgtcctcaccttcagagggctgcacgccctcaccttcagaaggctacacgccctcgccttcagaggactacacgtcctcgccttcagaggactacacgtcctcgccatcagaggacaacacgtcctcgccttcagaggactacacgtcctcgccatcagagaactacacgtcctcgccatcagagggctgcatgccatcgccttcagagggctacgcgtcctcaccttcagagggctacatgcatgccctcaaaggactacgtgtcctcaccttcagagggctacatgccctcacctttagagggctacacgccctcaccatcagaggaatacacgtcctcgccatcagaggactacacgtcctcgccttcagagggctacacgccctcaccttcagaggactacatgtcctcacctttagagggttgcacgtccttgcgttcagagggccgcacaccctctcctttagtgggctgcacgccttcgcttttagagggctagacgccctcaccttcaaagggtga

SEQ ID NO: 78705 - DNA, 147 bp, Glycine max
  Peptide Sequence Number=SeqID_170390
atgcctccccccccccccccccacttatgggatactgggctgccttgcagcgacgttctccgctggcccagcgccgggaagggacgacgattggtcggtcgtgaccctatcctccatttgcatccgtgcctaagtacctgcaagtag

SEQ ID NO: 78706 - DNA, 240 bp, Glycine max
  Peptide Sequence Number=SeqID_170391
atggtgaactatggcagtgccaaagtgtcgcaaaatgcccttttgcaggcgagcgagacgaggctcacgggtgcgctttccaaaggaggaaagatgcgcggagtcgccaccaacgaaggtattagcacctctcacgccgacaaaagcaggactcttgctcctacgtaccctcccttgaagaggaaatcagacctacgtagttcttttttaagggtgaatcaagcgattctttttacttga

SEQ ID NO: 78707 - DNA, 387 bp, Glycine max
  Peptide Sequence Number=SeqID_170392
atggcgtccgtattgaaaggagtggatgaccgtgttggaacaactacgagcacgccttgtgcgccaggggccgtcgctgctgcgcatcccgctgaaattcacgccgttcgccctgcagcgtcagctgctgcaacaggtgctgagctggcagttccgccaggcgttggcggatggcgatctggaatttctcgaatcgcgctggctgaagatcgaagttcgcgatctggcgctacactggtttatgacggtagaaaacgacaaactggtggtcagccagcacgccgaagcggacgtcagcttcagcggcgacgccaacgatctgatcctgatcgcggcgcgcaagcaagatccggatacgctgttctttcagcgtcggctgcagattga

SEQ ID NO: 78708 - DNA, 1008 bp, Glycine max
  Peptide Sequence Number=SeqID_170393
atgaggggcactgtgcataagcctcgagcgaacctaggggaagatcaaaagtcctcaccttcagaagggctacacgccctcgccttcagagggctacacacccttaactttcgatggctgcacgccttcgccttcaaaggacaacacgtcctaaccttcagaggactacacgtcttcgccttcagagggctacacgccctcgcctttagaggactacacgtcctcgccattggagggctgcatgccctcaccttcagagtactacatatcctcgctttcagaggactacacatccccgccttcagaggactacacgtcctccccttcagaggactattcgtccgcacctttagaggactacacgtcctcgcgtttagagggctacagtacctcgcctttagagggctacacgccgtcgccttcagagggctacacgtcctcaccttcagatggctgcacgccctcgctttcagaggactacatgtcctcagcttcagaggactacatgtcctcgcgtttactaggttacatgtccatgcctttagagggctacacgccctcactttcagaggactacacgtcctcaccttgagagggctacacgctctcgtattcagagggctacacgccgtcaccttcagagtgctgcacgccgtcaccttcagaggactacacgtcttcgccttcagaggcctgcacgtcctcgccttcaaagggctgcacgccctgcccatcagagggctgcatgccctcaccttccgagaattacacgtcctcgccttcagaggactacacctcctcgcctttagaggactgcacattcttaccttcagaggacctcacgtcctcactatcagaggattgcatgtcctcgcctttagaggactgcacgttcttgccttcagaggacttcacgtcctcactatcagaggattgcatgtcctcgcctttagagggctacacgtcctcaccttcagagggttgcacgccctcgccttcagaaggtag

SEQ ID NO: 78709 - DNA, 321 bp, Glycine max
  Peptide Sequence Number=SeqID_170394
atggacgtgtggggtgctaataccttccccatcgcgtcttttccggtttttcgacgttttcctcaaataaccgttggtggcgactccgcgtgtattcctttcgtggaacacgcatcccgcgagtcacgcgtcgccctcccgccaaagggtaggttgcgacatgaggaatttttcgggcttggaggacgagacccagaatcggtcctctcagcattcaactggaatgtgttgcaacctatgctccaagtatatagagttggcttcaaagactcaatctcatgcttacctttaccaacatcacccaggtccttgctggtgtaa

SEQ ID NO: 78710 - DNA, 303 bp, Glycine max
  Peptide Sequence Number=SeqID_170395
atggaggccatgaaagagaaaatggccacaatgatggaggccaatataagcatgaaggagataatggaggcaaagatttgggaagtagggatggcccccatgatgtgcaaattcaaaacaagcatgccttcccgccatatggcctgcctcccaactgtacaccacccaatgtggcgtacactcccagtgagaatgtcaataactccactcctatacccattgagagccaacaaccccaaattgatcatgcacatgtctcttaaaccgtgggggagacacatgaaatgccccaccacaatctag

SEQ ID NO: 78711 - DNA, 222 bp, Glycine max
  Peptide Sequence Number=SeqID_170396
atggttcgacttggtgaccggctcagacaagtaagatggcggctatggatcttagccttggggatcccttgtatcgaaagtcttcctagcagtgagtccaggcagcgtgtcccgcagatggagcgatggtgcaagtaccgcaacgttttgaattatacaataaccctactggtgtttatcttgagaaaagtgtttatgagtagtgttaaagggaagatgtag

SEQ ID NO: 78712 - DNA, 148 bp, Glycine max
  Peptide Sequence Number=SeqID_170397
atgataacaaaagatgatgacaaaggtgatgacaaaaagctcaaagaatcaagaatcaagtttcaagaatcaagattcaagagatcaagattcaagactcaagattcaagaatcaagagaaggcttaatcaagataagtatgaaaaag

SEQ ID NO: 78713 - DNA, 588 bp, Glycine max
  Peptide Sequence Number=SeqID_170398
gatgcacatgctaaagttgaatatgtgaaaaaattgcataagcaagtgaaggctcaaattgcaaagaagactgaaagctatgacaagcaagccaaaaagagcaagaagaaagtggtacttgaaccgggagacagacctttccaagtactagagaggatcaacgacaatgcttacaagattgatattccagaaggagggaatgatgagaatcccaaagctgcccaaatacagggacctatgaccaagggtaggatcaaacagttagaggataccatccaacaaatggtagcagctatacttgacaagtgttcgaccaaaatacttgtttactccctcttccaaattggtattacttgtttttatatgggagtggtcttaccggaaagcgcatcgggtcgccaagaagctccttttacactaaagaagaggaatcaagagaaattgcttgcttacaaaggagtggggatgtctcctccacctctaggattctcacaatctctaaaaaactcactaatctccctaaaagatgaaaacttggccccttgctctgctatatgctctctgaaattcacactcttcaggctctga

SEQ ID NO: 78714 - DNA, 567 bp, Glycine max
  Peptide Sequence Number=SeqID_170399
atggcgaggggaccatcaaaggcgtccacaacaaccccatcttttgcttcttctccagcaccagttcctcttacttctcttccaccgccatcagttccagcacctgtcggcacctccactcagagctcagatcttatggtgtcgatgctgcagagcctccaccatggcttatgcctggtgatgcagagtattcacgacttggctcagcatcggcccattattagcatggaggatttcatggaacaggtggcatggccaggagtccagccttctcctttggggagaggtgaggcttctgcaacccaggagcctcagccgcaacatcagccagacatcgcacatgaagccatgccagagatgactccacgaacctcaccagtcatcgcaccagttatggaggtctctgaggatgaaaaaggcatcgaggacacagattatgcagcagatttagaggtggcgcaaagtacctgggatccctggcctacagctgcacaggagatacttcagccagcccaggatactccttattcacctcagggcgagcaaacaccagcccgggatgattga

SEQ ID NO: 78715 - DNA, 801 bp, Glycine max
  Peptide Sequence Number=SeqID_170400
atgatgaatacaatagagtatcgagttgattgtcagctgagcataaggtttcccattggcttagaagaacagataaagaagtgggatgctgataaaataaggaagtttcatgagcgttggtatttccctgcaaatgctaccttgtacattgtgggggatattgataacatatcaaagactgtttaccatattgaaaatcttatacttgtcacacatgcaatttttggacaaactggtgcagacaataagaaaggttctatagccactccatgtgcatttggtgaaatggctagttttctcactcctaagctttctgttggtttgggtggaaattctattgaaagatcagccaatgcaacggatcaatcaaaagtattcaataaggaaaggcaagttgttcgtcctcctgtgaagcataattggtcacttcctgggagcggtgttgatttgaagccaccacaaatatttcaacatgagttacttcaaaaaatttcaattaatatgttctgcaagagttcaaatccaccgttcacttcagttgaattggatcacaatgactctggaagggaaggatgcactgtgaccattcttaccataactacagaaccaaagaattggcaaaatgcaattagagttgttgttcaagagatgcggataaagattctactaaatacgatgacggtcatacgcaacaaccgatgtagaattcgaccattatgggcagcattttacatcggtcaatcaactatcgttgtagggtggtgggttttcaacgattctgactttaacaacaggtcataa

SEQ ID NO: 78716 - DNA, 1755 bp, Glycine max
  Peptide Sequence Number=SeqID_170401
atgaggttccagcagtgcagcctccaagacttggtgagtgtcactgctgaagagagaaccacgcagaactggtacatttcactcaacttgaaagtgaaagtgatgcttcaagtttcagttcctaacgcaatgggaagcacaagtttgcttcatctattacttggtgttgttttggctctgctgagtgtgtctcttgtggaaggagaagatgcatacaaatactacacgtggactgtgacatatggcattctttctccactaggtagtcctcagcaggtggttcttatcgatggtcagtttcctgggcctcaactagacttggtaactaatgaaaatgttgttctcaaccttgtaaacaagttagatgagccatttcttcttacttggaatggcatcaaacaaaggaaaaactcatggcaagatggggtattgggaaccaattgccccattcctccaaactcaaattacacatacaagtttcaggtcaaggatcagattggaacctacacatactttccatcgacttcactgcataaagcagctggagggtttggaggactcaatgtctaccatagatctgtcatcccagttccttatccgtaccctgatggagatttcactttactcattggtgattggtacaagactaaccacaaggtattaagagaatctttggattctggaaaatctcttgcctttcctgatggtctccttatcaatggccaagctcatacaaccataaatggggaccagggaaagacctatatgttcagaatctcaaatgtgggcatgtcaacatcaattaacttcagaatccagggtcatcctctgaagctagttgagattgaaggatcacacattgtccagaacacgtacgacacgcttgatgtgcatgttgggcaatcagctgctgtgttggtaaccttaaatcagcctccaaaggactactacattgttgcctcaacaagattttcaagaaaagttctcacagcaactgcagtgttacattattcaaactctaactctcctgcttctggacccttgcctagtcccccaatttaccaatatcattggtctgtgaagcaagctagaacctacagatggaatctgacagcaaatgctgctaggcctaatccacaagggtcataccattatggaaaaataactcctacaaagacaattgtgttgtccaattcagcacctttgattaatggaaaacttcgttatgctgtcaacaaggtttcttatgttaactctgatacaccgctcaagcttgctgattacttcaacattcctggaatctacagtgttgactcaatccaaacccttccttctgaaagtactcctgcatccatagccacctccgtagtgccaacttctctccatgatttcattgaggttgtttttcagaacaacgaaaatgccatgcaatcttggcatcttgacggttatgacttttgggtcgtgggttatggttttggtcagtggacaccagccaaaagaagaacctataatctagttgatgctctgaccaggcacactacacaggtatacccaaatgcttggactacaatattggtgtccttggacaatcaaggtatgtggaatctgaggtctgcaatatgggaaaggcagtatcttgggcaacaattatatctcagggtttggacttctgagcgcagccttgctaatgaatatgatattcccaacaatgcattgctttgtggcaaagctgttggacataacaacccctag

SEQ ID NO: 78717 - DNA, 546 bp, Glycine max
  Peptide Sequence Number=SeqID_170402
atggctttaccctcacttggtatttatcaaactttactacttctatggttaagtctgcatccaccgaattctcaccgacgctggaatggaagcattcgcaaagaactagaagggattgaagaaggtctcctgcagatcgtgcacgttcgggtcaagcctagtggtactgttcctccacggcttcccggagatttgcgggccatcacccctgacctctgtggctacggcgacactgccgccctacctgacgctttcttgtactctgccttccacatcattgtcgacctcgtcgggcaaagatctatgttaacactacattttactggtttacagctatattttatctataccttcttcagaatgattcaagagcttatcaaagagcttagtactccaacaccagccatgtactctactgtgatgttccttggaaccaaggacactttgggagtgcaaccagttgttgacatagaaagaactgtattgtatcatgaaaaagcaataggtatgtattcaacattgccctatgcactcgatcaagaataa

SEQ ID NO: 78718 - DNA, 324 bp, Glycine max
  Peptide Sequence Number=SeqID_170403
atggatgagtactttagggtatcaaattgtaaaagtgcaaaagatatgtgggataccctacaagtaacacatgaaggaaaaatctttccaaatgaagatcttataaataaagttttgagatgcttaagcagggaatggcaacccaacgaacatgaaatggaattaatgagattgaatcaacatggagaaaatgataagaaaaagaaaggaatcgctcttaaagcttcgtcttcaatccaagaagagagtgataaggaggactcagttgaaattgacgaagatgatgatcttagtctatttgtaaaagattcaacaaattcttga

SEQ ID NO: 78719 - DNA, 864 bp, Glycine max
  Peptide Sequence Number=SeqID_170404
atgagtgaaataaaggaggtgcaagagcagatgaaggccgacatggattccatgaaagagcaaatgaccacaatgatagaagccatgatgagtatgagaaaaatggtggaggtcaacacggctacagtcgttgccgcaagtactgccactgagatggacccgactcatccatttggcatcaatcaagaaagtcgtccagtcccggatatgagcaagcatcccttcccaccatatggcttatgtcccaactatatgccacccaatgttgtacatatgcccgatgagaacatcgaccattttgctcccataccccttgagagccaacaaccccaatttgggcatgcacatgtctctcaacccatgggagagacacctaaagcatttggtggcatacccctaccaaatactttgggggtacctcagtattgcccacaaccacaacccttgcattttacggtgggaagagtccctcctgtcatggtggaaagggagaaatttgatcatatggaggaaaggctaagggtcattgaaggaggcggaaattatgcctttgttgacatggcagagttgtgcctagtacccaacgtggtcatttatccgaagttcaaggtgccgaaaaagttgaagaacacttcaagattcaagaggaaagttgaattcaagaatcaagattcaaggatcaagcttcaagaatcaagatcaagattcaagattcaagaatcaagagaagacttaatcaagataagtatgaaaagaatttttcaaaaactgagtagcacatggatttttctcaaaacatgtttaccaaagagcttttactctctggtaatcgattaccagattgctgtaatcaattaccagtag

SEQ ID NO: 78720 - DNA, 315 bp, Glycine max
  Peptide Sequence Number=SeqID_170405
atggatgaagaagggctaaagtttgaagagaaacttgtgaaggttgacactaatccttttcaagttcataccaactatgcaaaaccaattcaaattttgatggtgggggcttttattgatgaggcgaaatctttggatgactttgaaaagaaaggagaaaatgcaacatatttgcccagttctagagttcctacaaacaaatggattcaacaaggtattctaggaacaagatctaaatggcaagcttttgaggtgaataataaagtacctcaaaaggaagcaacttctgaaggttcaaaaaaaggatactactag

SEQ ID NO: 78721 - DNA, 438 bp, Glycine max
  Peptide Sequence Number=SeqID_170406
atggctcacaaggagaaagccttggaacatctcaaggtaacaaaaaccaagatagttgtagttggccaaaaaatggacttggtgttttatacattgcaacttggtttctttgacatggattttgatctcatttccaaaagcattgacaaagccaaaaattggttttctaactgttcacatcatggtggcagcttgtatgaagaaggtgttttgaccatcattatatcattggatagagtttccctaaagcaaaaggtagtagattctccaaagatcttgacaatgattggcaaaatcccatatctttcagagtttttgaactccttatatgattgtcaatacaagtctttttttctcagcatttgcacgagtgcatcaagagatgaagaatcacgatacaagaaggagtgctatggtgagaaaaaatatgttttctaa

SEQ ID NO: 78722 - DNA, 279 bp, Glycine max
  Peptide Sequence Number=SeqID_170407
atgaagtacaggatcactcagtgctttgatcaagaatacaaaaggataccaaggaagggggcaaaagggttagcatctggctcacctgggccatggaattacctcctggctaagcaactagctcgcttggggattgaatgtgatctatgtacccttatgatgcaatcctaccccgcaagggcattggatagaagaccccaagtagaatgggccaaagatgcaagagaaggtcctagggttcttatgagccttagggtagatttcgggcccatgggctaa

SEQ ID NO: 78723 - DNA, 336 bp, Glycine max
  Peptide Sequence Number=SeqID_170408
atgggggagacacatgaagcacctcgagaccacagtttagccgacttcgagcctcacctcagatatgtcactgaggggcaggcattttgcagcgtacccctgccaaacactttggggggccctcagtatcgcccacaaccacaacccttgcattttgcagtgggaagagtccctcctatcatggtggaaagggagaaatttgatcatatggaggaaaggctaagggtcattgaaggaggcgaaaattatgcctttgttgatatggcagagttgtgcctattgcttgacatggtcattcctccgaagttcaaggtgtcgaatttcgataagtactag

SEQ ID NO: 78724 - DNA, 312 bp, Glycine max
  Peptide Sequence Number=SeqID_170409
atgggggcatatgcgaaagatggaaagttattgttgcatttcttccagaagagtgttgctagggcagctattacttggtatactaacttggaaccttcccaggtccattctaggaaggacctaatgatggtaggttacatgccttcaagttttgcagatttagtgtttgctggcaaaaggattgaagtgggtctgagaagagggaaatttgattatgcttctactgtgagttctagtaatagaagaccagggatgagtggagggaataataatgaggaagaaacccatgttgtgactatcgttcctacatga

SEQ ID NO: 78725 - DNA, 222 bp, Glycine max
  Peptide Sequence Number=SeqID_170410
atggctaaggaaatgatctatggtcacaattttgaagcgccttggctttacttttcttcttctccttttccttcagcgtttttcctctgttctcttcagttccagcccttaaacccttccccttacatagctatttatagaaacgccatttggtgcaaggaaagctcgcgcaagcgagctgcttgcttaggcttgaagtcatcagctcgcccaagcgagtag

SEQ ID NO: 78726 - DNA, 686 bp, Glycine max
  Peptide Sequence Number=SeqID_170411
atggtgaatcaagattcattcaaagatgttttgatgataacaatgatgataacaaaagatgatgacaaagatagaatcaagaagaattcaaaactcaagaggaaagttaagagtcaagaatcaagattcaaggttcaagatctcaagaatcaagatcaagattcaagactcaagattcaagaatcaagagaagggtgcggtgaaggtgaaggtatcggtgttgagcattgcggtggtcgttggcggcatacgaggtacgcagaaggtggtgcatcaatcagggacggtacatcctttgtggtacaagtagagggtacatctacttgggttgtaatactgagaacaagagagggtacatctcttgtggatcagttcaagtggaggatggaaaaagatgagtggatgtatgaaagtataatgtttgaagaagtggatatgaattatcaaaatgaagaagcatgtggtgcgaatgatccacatgttgattgttccgatgcgttcaatacttctcaggtgtttgatagccgagaggatgttttgcggtgggctcgatccgttgctcatgaaaaaggacttgtggcggtgattataagaaagaatttatcagaagagacactaggactaggaaatgtgggtgtcccttcaagcttcgttgcaagccagtgtttggaggataaggctggatg

SEQ ID NO: 78727 - DNA, 201 bp, Glycine max
  Peptide Sequence Number=SeqID_170412
atgagggggtttggtactttggcagctcgcccagggaaaactgccaggaagctaggtggttcatctacaaggccacaacagcagatgccaagtctctatgaccgaaccacaaagctggaagagactctagctcaattcatgcaagtgtcaatgtcaaaccaaaagagcacggagtctacaattaagaatctggaagttcag

SEQ ID NO: 78728 - DNA, 2430 bp, Glycine max
  Peptide Sequence Number=SeqID_170413
atggctatgattatggatgctgttcttggaaaactgcttgatgagctgctgaaagaagttgtgaatgtgaaagacagggctgtgaagttcagagccaccctgataaccttagagtcaaccctaaataaagtaggaaggttggctaaacagattgatggtcttaacaatcaattgaacaaaccagccgaggaaatgaaagagctgaaagataagttggcgaaagggaagaaactcgttatggagtgctccgaaatccagtggtggaattgctgctataaggccaactaccaagaggaactcgaggcgttgtacgagtcgatccgtttgtacttcaatctggatatgcaaggtctgatactaactaatgagttacaaaaccaggtgattctgaccgagattcatgcaacagttatggaaagtggtccgagaaggaccgaattgaaaggcgtgtgttcgcctccggcccctccggctttcacggttggcttggatgttcatttgagggagatgaaggtcaagttgctgaataaccaccaccatgctggatctgtgctcacggtcaccggaacaccaggctcagggaagtcaacgttggttaaaaagttttgttgtgatgaggaagtcaaaggtatattcaaggaaaacatattcttcatcacctttgcgcaaaagcccaagttaaataccatagtgcagagactgtttcaacacaatgcttgccaggtgccagagtttcaaagtgacgatgatgcagtttatcaattggaaaatttgctgaaacagattgggaaaaacccaatactgttggtcctggatgatgttccgtccgaatcagtgtctcttgttgacaaatttgtgttccagatcccaaagtacaagattctagtgacctcaagaatcacaattagaggatttgaccagccatacgtgttgaaatcactcaacgaagtcgatgctataaatttatttcgccactctgcatccctgaatcagagtagctctgacattcctgagaatattgtcaaaaagattgcgagagggtgcagtggttctcccttggcacttatagtgactggcaaatcactaagtcgtgaaccaccgtgggcttggaacaacagggctaagaaactgtccaagggtcaaccaattcttgcttttagtgcagatgtgcttacttgtctccaaaaaagcttcgatgacttggatcctaaggtggctgagtgttttagggacctaagcttattccccgaagcccagaggatacctgctgctgcccttgttgatatatgggcagaactgcgtgatgaagatgatgacagcgcaatggagaatatctatgaactcgtcaaaaggaacatggctgatattgttgtcacaaggtatggcaaatgcttcttgaaagatgacacgaatatttcaagtggcacgattgactataattaccactatgttacacaacatggtcttcttcgggacctagctatccttcaaacgaacaaggaactaatgaagaagaggaatagactgattattgacgtaagtggtaacaatcttcccgattggtggactacacagaatgagtatcacattgcagcccactcactatccatatcaactgatgacacattcacttcagaatggtgcaacttgcaggcatctgaggttgaggttctagtgctgaaccttcgagaaaagaagcggtcgctaccaatgttcatggagaaaatgaataaactaaaagtcctgatagtaacgaattatgagttctatcgcgctgacttggaaaattttgagctgcttgataatctgtctagtctcaaaagaatcagattagagaaggtttcaattcccttcttgagcaacactggagtgcaactgaagaatctacacaagttctcctttttcatgtgcaatgtgaatgaagcattcaaaaatagcaccattcaagtttcaaaagtgttcccaaatttggaggagatgaacattgactactgtgatatggtggaattgccaattgggctctctgatattgtttccctaaagaagctaagtatcacaaactgtcacaaactttctgcacttcctgaaggaattgggaagttggtcaatctggaatcactaaggcttacttcatgtactaaattagaagagttaccagaatcaatcacaagtcttagtaaactgaacttccttgacatctctgactgcgtaagccttagtaagttaccagagaacatgggagagttgcgtagtttagaaaatctcaattgcagaggttgcacaagattgactgatttgccatactcaatcacggagcttgagagcttaagcgctgtggtgtgtgatgaagagactgctgcattatgggaacctttcaaaaccatgcttagagatctaaagcttaaggatgaaaacagggaaggcaagtaa

SEQ ID NO: 78729 - DNA, 90 bp, Glycine max
  Peptide Sequence Number=SeqID_170414
atggcaacatacaggtggcaaaaacatacgcttgatgaatcacccttacttgctttgctgactacaaggctaaaatctgcccgtatctaa

SEQ ID NO: 78730 - DNA, 697 bp, Glycine max
  Peptide Sequence Number=SeqID_170415
atggctactatcatttgttggaggatatcctctgactgtttggtcctacccctggtcataggtccctgtatttgggcaactttgggattctcatcaacctctgtcgaggaatccccctactgtggcacatatcacctcatgctctcgcaagtgggagtttggtcttctcttaggagaattcggcttatatttcaactaagatccatcatgatcatcctcttctttgatactggtcaagtcttcttgatctttcttgttgctcattacaaggtggtcattcatatcaagaattcctccaaggtaccaggtggtgttttcgtgatggatacgaagaaaggagacccttccttcctaccgtccttaactagcatcagcacgactcctggctgcaaattctccacagctcttacttcgttattgaatcgtgagatgcatgctctgggcaattcctcgggtccttggtaccgccaacagcttctgcgggataggggtaccgccattgggtgttgcgggatagggggagataggagagagagagggtgtcccgcccttggagctggcgggataggagagagagagggtgaaggtagtcccgcccttggagctggcgggatagggggagagaggagagagggatgggatgccgcaactggctgttgcgggacaggcttgatgagacagcacgaagctttgcatg

SEQ ID NO: 78731 - DNA, 421 bp, Glycine max
  Peptide Sequence Number=SeqID_170416
ggcaccattgttgatgactggaagtttgattattctagtcatgatgcttggtgtatggtctgcaatgaccagatgcataaggcattacgggccaatgcacctctcccctatcctcacctcgtcaccctttttcttcatcatttcaaaattcctttggaagatgaaccatttgttcaagtaaaaaggtcttttgttattggtgctggtgcggttatcttgtttggttaccataaggatgatgatggtcaggttgattcctcttcacttctgaatgatgttccctctgaactccatagtcttcgagcttttgtgggtgaccgatttgatgctatggatactcccctggatgccatggatgctcacttcgatgggatggatacgaggattactcgacttgaggacgatatgagcttcattaggc

SEQ ID NO: 78732 - DNA, 315 bp, Glycine max
  Peptide Sequence Number=SeqID_170417
atggatgggcaatggttgaagaaggatgcgcacctccacaagacgaacgtactccctctcctccgcctcaacgagatgactcctcagccctcatgcatgaagttttttcggagttacgaggcctccacacctattttgttgaatgctttgattccttggatgatcgtatcgatgccattgatgctcgctttgaaggaatggatacccgcatcactcagcttgaggaggatggggagagaaacagggattaggagtggagctaagaaatcaagagatcataaactccaaaacatagggggagtatgggataagtga

SEQ ID NO: 78733 - DNA, 293 bp, Glycine max
  Peptide Sequence Number=SeqID_170418
ggtacatctcttgtggaccagttctagtggagggtacatccactaggtggttcaaagagaacaagggagggcacatcccttgtggatctttgcctgtaaaaggatttttacaaggtggagctgatattgaggaggagaaaccgacatatttgaggtcaaatcctcttcaagggggaggggatgatgcaatcctccctagaaagggaccagttaccagagccatgagcaagaggctccatgaggattgggctagagcggttgaagaaggcctgagggttctcatgaacctcagg

SEQ ID NO: 78734 - DNA, 551 bp, Glycine max
  Peptide Sequence Number=SeqID_170419
atgcagtcccagttgcaatcacagatccattcacagggacttgcactgccactggagcctgagggatcgacaacggttcacaacatccctttgttgcatggccaagtgaaggttggtgttgaggaggttaaagatgtagaggctcttgttcctgtacccactactgaggttattttagtggtgcaggcacttaacaccttccttgcttggctgacacatctcgtgaagcgtttatcagaacagcctctgcaagttatgtgggatgctaccgtgtttgggatgtttaatgaacacttctcattgtacataaagcacgaagatccatctgaaattgcacgcagcggtcaatgtctcagcatatctgttataaagttgtggattttgcacctaactgagacaagtatgcgagcacggaattccgatgtgtatggattcctcaagccacagtccattcagagatctgggcaatcgcaatttgaatcagaaagttacatgaagagttggatgcagagttcacaacgagatgtctaccttggagcctacctaaatag

SEQ ID NO: 78735 - DNA, 243 bp, Glycine max
  Peptide Sequence Number=SeqID_170420
gaaaataaaaggctacaatgcgaagggttttcctctcagctcagacataatatcgaaattcccaacggtgagaatgctcataattgggttgcgaacgtggtgttcaaatttcacaatgatccaacggtgaatgagcccgagatcgttgtttttctaagacaggtttggtgggctacaggaaaaagaaagggttttgagaggagaataggaaaaacgaaaatgaggccaaaaagaggcatctga

SEQ ID NO: 78736 - DNA, 309 bp, Glycine max
  Peptide Sequence Number=SeqID_170421
atgggggaggagcttgccacccagctcgcccaggcgagcaaggttgcttcctccagaagcaacagccttctggaggaagaatctggaaggcccaactttcgaagaagttacgaaaactcacggattgcgaaaaacacctcctttcgatttccgtcacattacggaattttcacggatcgcgtaagcctgcttccttttgattttcggcacgtctcaggacttcacatattgtgcaacaaagggtgccaagtatctcaaagcggtcaatcaaaggttgtatatcaaataataatccctggacgaaattag

SEQ ID NO: 78737 - DNA, 384 bp, Glycine max
  Peptide Sequence Number=SeqID_170422
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcatttccacgcctgacactcagttcccgggtaggcagttcgctccaagctggactgtatgcacgaaccccccgttcagtccgaccgctgcgcctttatccgggaaactatcgtcttga

SEQ ID NO: 78738 - DNA, 132 bp, Glycine max
  Peptide Sequence Number=SeqID_170423
atgtggaaattcttcatcgttcttcgtcgttcttcaccgttcttcatccgttcttcgttcgttcttcgttcttcaacgggtgaaactaaggctaaaatcaactcgcctagtcaagctcgtccacaaaaatag

SEQ ID NO: 78739 - DNA, 126 bp, Glycine max
  Peptide Sequence Number=SeqID_170424
atggctaacacaatgatgaagattaacaaaaaagcagaggaaatattcaacattgtttatgttattgatcagtcttatggtgaagtcagtaggtcatttgctataagatggaagaatgaagaatga

SEQ ID NO: 78740 - DNA, 541 bp, Glycine max
  Peptide Sequence Number=SeqID_170425
tgaaggaatctacccccaaggagaaggacaacctttaatggttaaggaggagtgtcaggagacacttgtttgcattgccacacctcttaggcttgaggttattcctcgagtaaaggagttattggatgagggtttagttcgtaagagattaaatccttgtgctttgttggtgcccaagataggggttcccatggaccctaagagaataaaggtcattcctgattggcccactccaccaagtgtcgaggtaaagagcctagagtataaagaacctttccaaagaggaggggatgatgcaatcctacccccaagggtattggatagaagactccaagaggattgggatggagctacaaaagaaggccctaaggttctcatgaatctacaggtagatttttttgagcccatgggccaaggttgtgatgccatccaaccccgcaaggttttggatagaagactccaagtagattgggccagagatccaagggaaggaccaagggttctcatgaaccttagggtagatttcgagcccatgggcgaa

SEQ ID NO: 78741 - DNA, 438 bp, Glycine max
  Peptide Sequence Number=SeqID_170426
atgtctcagcatatcagtgttacagttgtggattctagttcacaacgcgatgtgtatcttggagcctacctaaatgggttccactgcagcggacattggcagatgatggtcatcctgcccaaggaacacttagttgtctggttttgttcattgcataacaggccagacaactaccttaaggggattattaatagtgctatcaagggtcttgatgatgctccacagcctaaatcaaaggctcctgctaggtcgattgtcatcaagtgtaatagacaaaaaggaactactgagtgtggctactatgtcatgcactggatgtccaccatcattttaggaacttttagaaataattgggaagcgtattttaacgaccctagaccattggagcctgagagattaaaagcattgcggatccagtgggcaaagttttatctctga

SEQ ID NO: 78742 - DNA, 126 bp, Glycine max
  Peptide Sequence Number=SeqID_170427
cgagcattcgctaagcgcaacactcatgggctaagagcgaggaagactctaaaagaagatgagctatacaggttcactaagcgcaccgcttcagttaatccgctaagcgagaaaggcatgcgctaa

SEQ ID NO: 78743 - DNA, 624 bp, Glycine max
  Peptide Sequence Number=SeqID_170428
atggatatcattccagacaagtatcccctaagcatgccgaatatcaaatttggatctaaattgtatgtcaacgctgatattacagagatacacgaatttcgtcaaagcttgtgtgtgccattttattctggtgggatgatcaatgataaagatggttctcagtcccaatctagccagagtaatatggtggaaaaatttctacagaatgctcaagtggtcagtataggtgaaatcaacaatctcagacaggattgttactgcttaactgttggaacaattgacgaaatcattattgatgctccatggagttatgacagttgtcctaactgtacaacgacatttgatccatcaaaaggtggctcagcttgccgttcttgccataccagtgtggtcgatacaattccacggatggagcataatagggacaaaggaaacttccttctctgggatgcaacatgtatcaagctgtttggtaaaactgctggagaatgtcgagatgagttgatagcggctagggatgatattaaggtatttccaacgcgtgttgatgaaatccagttgaaaacttgggcttccagatttaagttccgttcacaatgcgccaatcatctgtgctggatgtga

SEQ ID NO: 78744 - DNA, 201 bp, Glycine max
  Peptide Sequence Number=SeqID_170429
atgtacatggtgaacgacattttcacactatctaggcacaaggaaaacatggtgcagcccaaaccaagtgctggccttaaggggaaacctcaccaacatgctctcactcatcatgccttcttgtatttcaacgaacaaaagcttgggccccctaggcctaagtcatgttttggcatttatcctaattgtgggatcctctag

SEQ ID NO: 78745 - DNA, 390 bp, Glycine max
  Peptide Sequence Number=SeqID_170430
atggctactccactcatatctcctcctcctcctactggtgtagcattacactcgtcgtctaccttgaagcggacaagaaaagccacacggctaagatcattgtcgactaaaccagctggggcagagagaccgctggtccatgtcgatcctacgaccgcgaaggccaacggtccccacaaaaagaagttaagaacatatttggggatcgttgctcgtgataaggctgaatttgatatccctgaagcatctgatccaataaggacagtgtcgatgacacagtatgcgaaaagtatagcattagcaaggagatatgggcccaattttgtcagagccgcagagacccttcgtgggagatatctaatttttgatttttattgttttcaactttaa

SEQ ID NO: 78746 - DNA, 564 bp, Glycine max
  Peptide Sequence Number=SeqID_170431
atgagtatgacatcctccactgcctcaagcagaatgaaatacccgatcataaggccaccctcaatcatgcaattcaaagcagcttttcacaatgaccagacaccaaattacccagaatccgtccagttaagatataatggagcaacctaccaaatacaactccaacaacaccgaggcagattttttttggcagatggactcacagacttcagagcagatttaaagatctatgagtccatcatcatcaacttctttgtctgcgatgatatctccatctttgatgtacacttcactcctccactcgatcaacagacatgtgccaaaccactacttcattcccgtcaacacatctcaacagaagaaataactcaatgtatcctgggtgctcctcatccactggaaatctcattccatgcagcaaaacatctgaatgaatgtggtaatcacatgacaattttaagaaagcatggacctcctctacaatggaaggtggttaccctcgatgtcagcattaaagataaaagcattgtccgaccatggtataagttcctcaagggaaaatga

SEQ ID NO: 78747 - DNA, 135 bp, Glycine max
  Peptide Sequence Number=SeqID_170432
atggctggtgatgcaatcctccctaggaagggaccagtcactagagtcatgagcaagaggctccaagaggattgggctagagctgttgaagaaggccctagggttctcatgaacctcaagggctccataatgtag

SEQ ID NO: 78748 - DNA, 486 bp, Glycine max
  Peptide Sequence Number=SeqID_170433
atgacggatgactcacttagcgagcgacaacgcgctgagcgcgtgcttgccccaaatttgggggagtcacatctcaaagcaagtttgccccaaatttgggggagctactgggtaaaaaggaatggaatggaagctaaatgtaaaaggggggcatgtaatagggttgggaataaaaagaaaaaggttgatctatggataaatgctctcctagaatctaagcttttgcatcctataaaaaccatgaattatttgcagcccagcctcattacaagcctaagagcagagaagcacacacagtcaaatgaagctgaatgtaaaaagagggcaagtaatagggttgggaataaaaagaaaaaagttgatttatggatgaatgctctcctagaatctaagcttttgcatcctagaaaaaccatgaattatttgcagccctgcctcattacaagcctaagaaaagtccttctgattcaatttgtgtgtttataa

SEQ ID NO: 78749 - DNA, 345 bp, Glycine max
  Peptide Sequence Number=SeqID_170434
atgctcatcagggaagttatccctaacaggaagggaatttgcaggtccctcaatcctgctcaaatgctcaaccaccatgttttctgcaccactcttgtctatgatcttaatatcaaactcttgaagaagaagcatccacctgatcaatctaggtttagcatcagacttcttcaacaagcagtggggatgaaaagatatgtgtggactatgaacagccaaatcctgatcaagcatcatcctcagatccctcttgttggactaaactcgaccagaactacattaagacaaacatacaaaaaactaggttaccgtacctcgatccttcgtgataatacgataaactag

SEQ ID NO: 78750 - DNA, 225 bp, Glycine max
  Peptide Sequence Number=SeqID_170435
atggaggaaagcataggtcacatcctagacctcactcccataggagaaaaaaaggaaagaaaggatcaagaggctaacattaacctctcatacttccatgggaaggacaatgtagaggcttgtttagattgggaaatgaaggttgatcaactctttgcttgccatcatacaacttctaagggtatgccctctattggtggacttcccttgttagggaaagaatga

SEQ ID NO: 78751 - DNA, 975 bp, Glycine max
  Peptide Sequence Number=SeqID_170436
atggctagggggagatatgaagcgaggatgttagctctcaagttggacaagaccttcattgggaaccaaaagctcatgctaggtaatgaggttcgtcctaatctttcatatgcaaatgtgacacaaagttattttaggggtaacacgaggcaaaagaggaatggtagtagagtctttgatgttcaatcttttcatatgtcatacaaggctaatctaagcactgaatccaaactaggaagagcatatgtgagtagagtagtaagggtaggggattcgtatattactaaaaaaaagcttcaccttgaaggaatttttgggatcggagttacccttataggttcatctttagtgttgttggaaactgaagatctagaagaagtgggtgaatatatcaatgttggggctgattgggtgacagagtggttcgaggagattatgtcatggaaattgacgatcattgataatgaacgcttggatgagagcattgatggatctataaggacgacaaagaggcgggtccgaaggaggaagatagaagtgacaggatggatgctttttgtggtaggaggggaccaagcccatcggaaagaaaaaataggccccaataatggattcttggaaaaccaacctaggtccaactcatatactaaggaggggagtggcacaagtagggtaggagtagcagttgggccaaaaaaagaggctcagactattgactttcaggcccaaggaatgtttgagggtagccctagaaagatgagtttcaagaatagtggaagggttgttctatcatcgttagaagtggagaaaggggaaggcagaaggcttagcattggggcaccagagaaaggtggtattaacgtagtagggtcaaatgcagatggaagtgaaccaatggaaatatatgtggagcaaatcaggtctatggaggagagggatatcatagataaagctaataaggggaagcaaatgtga

SEQ ID NO: 78752 - DNA, 945 bp, Glycine max
  Peptide Sequence Number=SeqID_170437
atgaatgtttcagctgtggattgtgaggttatagtcatgtttcagttcccaccgcttgatgcaaagaacaatggaggttacattaaaggtagtattgaaagtatgcgggaaaagtccaatcctctttacttcaaacagttggatgtgatttcagctgcattttacacagcagaagcatcacaaatcttgaagaaaatagatatggaggtcatagtgattctggtttgcaccacactagcatgtgtttttatggccctttttgcaaagaatcatgacaagaaaagcattttgcttggaaatgaatggcttgaagtgaatgaaattgctgtaaggataattgtaatggcggctttcttgttgcaactccatctcctgcagctaacatggtcaacaagaaaggctgatacaaaacagaaggacctttggattgctgagaagaaggttttgcatgtgatttttactctatatgcagtagggatcttgattgcgttgcttgtgcaccaaaacaacaccttgcatggtgatgtggtttattcatctagcctttcacaacaacactcattttgggagcacttgaaatcttgttcaggtttggtattagatgactttctcttgcctcaaattctgcttaacatattcatgaattccaaagggaatgctctttcttgttcattttactttggaactagtttggtcagactaattccccatgcatatgatctctttgaggctcttgcttatgttgatggttcatgcttatatgcggatgagattgcagactattactccactgcttgggatataatcattcctttggtaagcctgatgtttgcctcaattatccatttccaacaacggtttggtggttgcagcattctttcttggagaatcaagaccaagggtgtagaagaatatgaaaaagtgcctatggtgactgaagcatag

SEQ ID NO: 78753 - DNA, 1233 bp, Glycine max
  Peptide Sequence Number=SeqID_170438
atggagtttactgataaggaagaagtggtgattgaggagaaggtagaaagatgggaggaagaagacacagagggtatgccttatggtcaatggctaaaggccttgccatcacgtccaaatgtagtggtcgaggtcaaacaacaagtcatctatgggaaggtcaagcatactagtctgtttgatgataaggagaaggagaaggagaagccaatgtcaaatcataagaaggataagaaggaaattgtggaggttatgggggagaaaagtgagatgcagggtgtagatgtactggaagatgctaggaaagctggaggtattattctaatgcagagcgaaggaattgaggtggagttgcagtcttggagattgagccagattttgaatccgagagaaaatagtggaggtaatgttgttgaccttgatctcatatcacaattccaagaggtgttgatggacatagaaatagaaggctatgagtttacttggacaaataagagaaagggtgcagatttgattgaggaaaagctgaacaaggcctttgtgaacaatatgcaaagagatcaatatccaattattcttaatatgttggtttctcaacaacaaaggggtgtgaggataaggagacataggcaaggggatcgtattggcaacttcacaaacaatatccgtaggctacaaaagaggttgggagaagtgcaaaagatgacccaaaatgatgttgtgatggagatggaggcaaatatagagagagatatggatgagtgtttgaaaatggacgaagtcaacaagtacactcgttctagtgcaccaacactttcatcctcactcctcattttcgagcgaggatttgcagaagttgcagctgatatcggccgttcgggcacggtgacgactccggtaatgccgccgccaccaaaagagaatgcaaggacgaccttctctggaccaaagctagatcaagtccggcgacttcgacacctcgtcgacgtgtacgacggccaggggatggtggaccctaagcagatcgatgttgtgtattccgcgttggactccttgggctacaggaagttgctggttcacatctcaggaaccggttggccttccaagggggatctggacgaagctggtgcaaacctcaagaatgccaagaactataatgggaatcttattaagatggctatgagctactctgtcctatgttttttgtgcgattgccgccaaatccacctctag

SEQ ID NO: 78754 - DNA, 414 bp, Glycine max
  Peptide Sequence Number=SeqID_170439
atggcgaggttccattggtggaacctattgaaaatattacttcatcagttccaccacctcatcctcatccacacaacactccgctccgtttctctcttcactcctctttccccacacacaacacactcagatctctcaactcagatctctcaactcagatctctctctgcttccattaatttcacaatggtcactctcttcgactccctcgccgtcgtgcgtctccccaccgccgccttctccccggctgccaccagccggacctccgttttgctcccgcactgcgccggcctcaggctcagacccgccgccgccacgcgcttagttgcgtcccccgctcgcagaatcgcttcacgcgccgcgcgcgtcgtatgtgaggctcaggataccgccgtcgaagacaccgaaagatga

SEQ ID NO: 78755 - DNA, 210 bp, Glycine max
  Peptide Sequence Number=SeqID_170440
atgtattattcgacaaagaacatagtgcatgatgcgacactcaaagaaaatagagttaatgacctaggagatgaaaaagaaggaggaattagtgttggtgggtcaccggatgttccatggcggcagtggcctgcagcggtggtggtgaaggagggtcctttttgtttcttcgaggattctaccattggagcttgtttcagcaaattctga

SEQ ID NO: 78756 - DNA, 336 bp, Glycine max
  Peptide Sequence Number=SeqID_170441
atggtggagatgtgtcggttcccggtgaggttctacgttaggattatggatatcgatgctgttcttcttatagtggttgttaatccttgtaggatggcaccagaggatgtggtcgaggcaatggctacagtaatggcacaacaagaagacacaatggctcaacaataccaagctaatatggcacaacaaggcgtagctccaacccttatacatcctaaattccaacgatttgttgagttcaagaagaatgaccctccacagtttaaagacacgactgatctctggattcgagagttggagaagatctttcgagctatggatttccctgacgactga

SEQ ID NO: 78757 - DNA, 447 bp, Glycine max
  Peptide Sequence Number=SeqID_170442
atggggggtgcaatgaccatgatggatattgatgaggacatgaccaagagcaagggcaaggatccacttgaaggacttggaggacctatgacaagggctagagcaaggaaagccaaggaagctcttcaacaagtgctgtccatactatttgaatacaagcccaagtttcaaggagaaaagtccaagggcccaattggcaacctaggcatcagccttttgggagaccaaatggtggctgacttgttggctgttggggtgattcaagaacaccctggctgtatcaaaggactttcacaacctttgtgtgttgccctcgccggaaagagtgattctttccttcctttcatcttcaaccttgttctttcaaaccacaattccagaaaatccacttctgcccagaattatctcgtggccataactcccattttacgcactcaaattaagtga

SEQ ID NO: 78758 - DNA, 150 bp, Glycine max
  Peptide Sequence Number=SeqID_170443
atggataagagcttgaaggaggagatgatgaggggaaggagaaggagagaaggagcacgaaattttgtgcctcaaatgaggtgccctaaaatacaagggctgaaaaatcctacatttctagggtaccctacctacattatgaagccctaa

SEQ ID NO: 78759 - DNA, 225 bp, Glycine max
  Peptide Sequence Number=SeqID_170444
atgtgtggaagcaatgccttcgaggttattttgatgatgccaaagaatcaagagttaagcaaaatttcaagcaaagattcaagaatcaagtttcaagactcaagaatcaagtttcaagactcaagaatcaagtttcaagaatcaagattcaagaataatcaagatcaagattcaagactcaagattcaacaatcaagaagaagactcagtcaagataagtattaa

SEQ ID NO: 78760 - DNA, 825 bp, Glycine max
  Peptide Sequence Number=SeqID_170445
gctaagctcaagagaaggaattggcacaaggagctgaccaatttcatggaccgaagcactgatgttgcaatcattaaggagttctatgctaacctctatgatccaaaggataactcacctaagcaggtgagggtcagaggtcacttgatcaaatttgatgcagatgctttgaatacttttctgaagacccctatgatcatagaggagggggaagagctatcttcatactcaagattttgtcatctaaggccagatccatcggaactgccagcccaattatgcatccctgggaggggatttgagctaaatgcagatgggctgcccttgaagatcttgaggaagaatctgaccactcttgctcagacatggagcattctttcattctccaacttggcccttacttctcacacttctaacatcacactggatagggccaggttgatctacggcatcatccagaagatggacatgaacttggggtatattatctcaagtcagatttctatgattgcacagcatgattcctcgagtctagccattaatttggcttatgtgaagaaaaactgctggaacctcgatgacccctcagtctctttcagagggcctcacaaggccagggggaagaggtcagagactctcccatcttttgagattcccccattagcagctccctccactacagttccaacttcttctgccccatctgcatctgcacccttaccagctcctattatagctccttctataggatcatcttcctttactttagagattttatttgctatgttgcagagcttgcacagaggccatattattatcatgtag

SEQ ID NO: 78761 - DNA, 221 bp, Glycine max
  Peptide Sequence Number=SeqID_170446
gtggccttgtcggtgcttgcacgcttagcgcaactctggctcgcttaacgtgcattagtgaatttcgacttagcgcacgtcttctcgctcagcggatggactcaagcggtgcgcttagcgggataatcccttgctcagcgaacatgcacaactcattcttcttccagattcttcctcgcgctcagcgaaaggagttgtgtgctcatcggatggctcgctaa

SEQ ID NO: 78762 - DNA, 576 bp, Glycine max
  Peptide Sequence Number=SeqID_170447
atggctaaggttgacccagaaatagtcctagagttttacgataatgcttggcccacggaggggggcatacgggacatgcgttcatgggtaatgggtcagtggactccttttgatccagacgccctggcccagttcgtaggtgacctgctacagttagaggagggtatgccacctaccaggcaccctctagacccagataagtctaacagggccctgggtaaggtgattcgaccgccgatcacccgggccttcattgagaagtattgcacgcctagacaggtgcggggtgatgcaccgcaggccacagacgcaccgccaccacctcatcaggctgatccagctgggtcatttggcatggagcggtatttacagcacttggttcgccagcaggcagccaaccacaaggggcaggtgcagatccatgagagtctctaccagctcagcctcagtcagcagagccagggtttcgctccttttgcgtgccctacttcagatcagtccagggctgaggttgcatggcccagagattggcctaaggcccaggcagggaaggcgcccgcatggatgaggagatga

SEQ ID NO: 78763 - DNA, 795 bp, Glycine max
  Peptide Sequence Number=SeqID_170448
atgataatgcaaacatcaaaaccagcgctcgagcttctcaccagcgacgccatctatcgcgaaaacccgacggcgttattccatcaattatgcggcgcgcgcccggcaaccttgctgctggaatcggccgacatcgatagtaaagacgatttaaaaagcctgctactggtcgatagcgccctgcgcattaccgctcttggcaataccgtcactgttcaggcgctgtcagcgaacggcgccgcgctgcttgaactgctggataacgcattgccgtccggcattgagaatctgcgccagccgaacagccgggtactcaccttcccaccggttagcgccctgttggatgaagacgctcgcctgatttggtcagctcccgcaggccgagcgcgaagcgatgttcttggcggcctgttcgcttacgacccgggtagccgctacgtagcggatttgaccaaagtcgatcgctactcttttgtgatgcatctggtttcccgcgtggtcggcgaactgcgccgcgaccttgatgtcctgcacgcctaccgcgcctgcatgaatatgggcacccttagcggcgcgccgaaagttcgcgccatgcagctaatcgccgccgcggaagcaagcgtcgcggtagctacggcggcgcggtcggctactttaccgcccatggcgacctcgatacctgcatcgtggatgccgcaaaatcagcgccacttcgcagcgggcgaaattttccaggtccgtgccgtcgcgccgtatcgtgctcacttccctgccgtcgccgctccgaggctgtga

SEQ ID NO: 78764 - DNA, 202 bp, Glycine max
  Peptide Sequence Number=SeqID_170449
atggcctctggtaatcgattaccaagggtgacgtcatctgaggaagacccagaggagctacctcctgagcctgctgtggatgctcttgactttctagagggcgacgaggacccactccttgaggtggattctcccgaggacgtcatgtcggcatctgaggcagactctacggaggatagtggccctagagagatggcgatca

SEQ ID NO: 78765 - DNA, 827 bp, Glycine max
  Peptide Sequence Number=SeqID_170450
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggttgctgatatctactacaatgtctctagtcattttgggtgtaagcaactcatccgatcatcttggtatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 78766 - DNA, 354 bp, Glycine max
  Peptide Sequence Number=SeqID_170451
atgcatgctcccccaggtcgtgagcgaagagtgctgtcgttttctgacacgacccatagcctcagggtgctctgcggcgcgtatcggtcccagatacgtctcctccacgatgccctggcgattaacgtcacaatgaatggagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 78767 - DNA, 393 bp, Glycine max
  Peptide Sequence Number=SeqID_170452
atgaaacatagctccaaactcgaaggtggaggacacatgaacagcgctaggcaaaccaattcatggggttccgaaaaaggtgtgagaatggaggattgccttgagggtccacacttaaggcaatcactgaaacatagctccaaactcgaaggtggaggacacatgaacagcgtaggcaataacgattcatggggctccgaaaaagggggagaatggaggatttccttgagggtggaggacgacatgaacgaaacgctaggcaatacattcatggggctccgaaaaagggtcgagaatggaggaattgccttgaagggtccaatcactacggcaatcatgaaacatagctccaaactcgaaggtggaggacacatgaacagcgctaggcaataa

SEQ ID NO: 78768 - DNA, 2886 bp, Glycine max
  Peptide Sequence Number=SeqID_170453
atgaagatcaaattcggcgctgaaacgtattcggcttcctctcatccgtcatcatttcctgcgagctggctcacaagccagagcacccgcgaaacgggcaagccgcaccccgagaccccggaagcattgcgcttgatagtgggcggcagcgcccgccgtgtctgcttatcacagaaggaaaccatcagtatgagtacacaacagaagcggcttgatgtgatttgtattggacgcatcgccgtcgatctttacggccagcaaattggctcgcgcctggaagatatgaccagctttaacaaatacctcggcggctcttccggcaacgtagcctatggcaccgcgatccaggggctgaagtcggcgatgctggcgcgcgtcggtgacgaacacaatggccgcttcctgcgtgaagagctgcagcgcgtgggctgcaatactgacgggctgattaccgataagcagcgcctgaccgggctggtgattctcggcatcaaagacgaagagacctttccgctgattttctatcgcgacaactgtgcggatatggggctggttcccgaggacattcgcgaagagttcattacctcgtcccgcgccgtggcgataaccggcacccacctgtcgcatccggacacgcgggcggcggtgctgaaagcgctggatatcgcccggcgcaacggtctgcgcaccgcgctggatatcgattatcgcccggtgctatggggtctgacctcactgggtgacggtgaaacgcgtttcattgagtccggccaggtgacgcagcagctgcaggaagtggtgcactatttcgatctgatcgtcggaacggaagaagagttccatatcgccggtggcagtaccgatacgctgaccgcgctgaaaaatgtgcgtaaggccagcagcgccacgttggtctgcaaacgcgggccgctgggttgtgtggtgtttgagggcgaaattcctgacagctgggaacagacgcgcctgcacagcggcgtgcgcgttgaggtgctcaacgtgctgggcgccggcgatgcgtttatgtcgggcctgctgcgcggctggctcaacgatgagagctgggagcaggcgtgccgctacgccaacgcctgtggcgcgctggtggtatcccgtcacggctgtgcgccggcgatgccaaccaaagaggaactggacgatttcctcagccgcgataacgcggtgaaacgcccggatctggacgcgcgcctcaatcatctgcatcgcgttaccacgcgtaagcagcagtggccggagctgaatgtgttcgcctttgaccaccgtaaacagctggccgatatggcgcgcgaagcgggcgtcagcgaggagcgcattccgcaactgaaactgctgctgctgcaggcggcacaggaggcggctaacgaagccggtctcaatgagaagagtggcatcctggcggataccacatacggccagaaagcgctcaacgccatcaccggcaagcactggtggattgggcggcccattgagctgccgagctcacgaccactgcgtcttgagcacggcaatattggctctcagctggtggactggccggccgaacacgtcgtcaagtgcctggtgttttatcatccccatgacagtgctgaactgcgtaaagagcaggacgagctggttcttgacgtgtggcgcagctgtaacaaaagcgggcacgagctgctgctggaagtgattctgccggagagcaacccggaccgtaacgagtcctactattacgacatgctgagccacttctatagcctgggcgtgcagccggactggtggaagctaccaccgctgacggcggagagctggcaggcgatcggcgagctgattgagcagcaggatccgcactgtcgcggcattctgttactcggccttgatgcgccggaagagaagctgaaagccggcttcgccgccgccgcgcaggcgacgtgggtgaaaggttttgccgtgggtcgcaccatttttggccagccgtcacgccagtggctgaacggtgagctggatgataaggcgctgattgagaccaagcggcctgacgggccgctttttagtgtgttgcgagcggatgccctcacccccgccctctcccaccgggagagggagccgttcaggcaggacgatatccgtcgtcgctacgagacgctgagtaaacgcctgaagcaggtggctcgttatatccttgataacagcaacagcatcgcgtttgataccgtcgcctctatcgcccagcaggcggatgttccgccctccacgctgatccgcttcgccaacgcgttcggctttagcggcttcaacgaaatgaaacaggtctttcgtcagcacctgatggaagagaccgtgaactataccgaacgggcgcgcctgttccgccagacggccaccgacgacagcgccagctcaccggagagcccggtggagatcctcaacgtctttaccatggtcaacagccaggcgctgcagcagctggcgatgcaggtgaatcccgaccaactgaacaaagcggtgaagatgctcaacgaggcggagaacatctacatcatcggtctgcgccgctcgttcagcgtggcctcgtatctggtgtatgcgctgcgccatctggagcgtcgcgcttttctgattgatggcctgggcggcatgttcactgaacagctcagcatggtgaatccgaaagacgtggtcatcgccatcagctactcgccgtatgcgcgtgaagcagtggaactggtggagctgggtgctaaacgtggcgcgcatcagatcgccatcaccgacagccaggtcagcccgctggcggcgttcagcgatgtctgtggcctcgctttgcctggcgcaaaccctggcggtgtcgctggcgctgaataa

SEQ ID NO: 78769 - DNA, 432 bp, Glycine max
  Peptide Sequence Number=SeqID_170454
atggcggcgcagctaatccatgatcgagtagagatggagtgcctagagggagcttgggagaccctcgaaggcaacacgaggtgccgatttcggggcactattcgatttacggccacttcattggtgcatccagatgaacccgtgcgcacgcttcaacgtactgtggagtggatactacccacgcctacaccataccgtctagtggagccagtccaagtgatcgaggtgacgtcatccgaggaagaccctgaggaggatcccgaggagctacctcctgagcctgctgtggatgctcttgactttctagagggtgatgaggacccacttcccgaggtggattctcccgaggaagtcatgtcggcatctgaggcagactccacggaggatagtggcccgagagagatggcgaccagcggaggctcttcatcatag

SEQ ID NO: 78770 - DNA, 336 bp, Glycine max
  Peptide Sequence Number=SeqID_170455
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttttttcccttcaccagttatcccaatttcgtgaatattaatcagtgcacgcttcgtgttcaattaattgcctctgagcctaacttgcgttcatgcttaatggacgaagggctaactg

SEQ ID NO: 78771 - DNA, 237 bp, Glycine max
  Peptide Sequence Number=SeqID_170456
atggatgtagaattcacaaagagatgtgtacctaggagcctacttgaatggggattcaacgacaatcaaggaagtaaatccaaggctattgttagatggattgtagttaaacaacatggaagcactatgtgcgggtactacgtaattcagttgatgtcaatgatagtcctaggaggtttcaaggataactgggaaacgataattgtttacttcaaaactaatttcaatttgttataa

SEQ ID NO: 78772 - DNA, 492 bp, Glycine max
  Peptide Sequence Number=SeqID_170457
atgggtggtggtgcatggccgttcttagttggtggagcgatttgtctggttaattccgttaacgaacgagacctcagcctgctaaatagctatgtggaggtaacctccacggccagcttcttagagggactatggccgcttaggccacggaagtttgaggcaatacagatcattgcaattgttggtcttcaacgaggaattcctagtaagcgcgagtcatcagctcgcgttgactacgtccctgccctttgtacacaccgcccgtcgctcctaccgattgaatggtccggtgaagtgttcggattgcggcgacgtgaacctgcggaaggatcattgtcgatgcctcacaatcagattgacccgcgaacttgtttattcatctaccgtcgggagggaggggatgaccacggcgccccgtgcgcccggcctcctcgtcctcgcgacaaacacaaaccccggcgcttcgtgcgccaaggaactcaaatctgttaa

SEQ ID NO: 78773 - DNA, 408 bp, Glycine max
  Peptide Sequence Number=SeqID_170458
atggataatgaagagggagtgcaagaacagatgaaggccgacatgtcggccttaaaagatcagatggcttctatcacggaagccatgctaaaaaatcaaaaatcaatagaagacaatgctacggcagccgcttccaatacggctagggaagcggaaccggccttctacttcccctcaaggaaccagccccccccccccccccatgagttgccccaaccaaacataatcctccatgccccatctcaatccgcacccgttaaggaactccttcccatttcaaaagacaacggaaagatcgatctgcttgaagagaggttgagagcggtggaaggcctcgggaactatcctttctcggatttagtcgatctgtgtttggtacctgacatcatcattcctcccaagtttaag

SEQ ID NO: 78774 - DNA, 549 bp, Glycine max
  Peptide Sequence Number=SeqID_170459
atgaagaacagtgaagaatctccacgaaatcgcttacggaaacgtctcggaagcattatgaaagcgcctcggcttggattttttccacggaaacaatttttctcagtaattttgagggattcctcaataccagaaaggctaaacccatttactctgccctcccttcccctatttataggagaaaagcaggaggtggttgccgcccagctcgcccgagcaagttgggttccttgcaccagaagccaccgcccattcgtagaagattcaagaaggcccaaattatgcaacaatgcttgttttgacttctggaatgttgtaaaactttacggattacgcaacaatgcttgttttgagggttccgaagggaacaaacaaggttcaaaagtcgaccgcaagtacccccggacgaaattagggaggcatgttgatgcagtcctccctaggaagggaccagtcactagagccataagcaagaggctccaagaggattggcctagagctgttgaagaaggccctaggattctcatgaacctcagggtagatttctaa

SEQ ID NO: 78775 - DNA, 180 bp, Glycine max
  Peptide Sequence Number=SeqID_170460
ttatggccatccgaatttgcgtcggcattcgatttccactttcgagctcaatgatatattattggctcaatgggacatcccagtcaaaacattcgcgtgtcaggattttcccgagtcttccttggttgtttctgggtttctcaatagttttctggccttatgcagagatccggatgaaag

SEQ ID NO: 78776 - DNA, 171 bp, Glycine max
  Peptide Sequence Number=SeqID_170461
atgagcggagttgccaccaaggtttattcgaggaaaacgttagaaaaaccaaaaagacgaaggtctgcggattttgaaaatgagggttcaggagttgtttacgcacaaggaagggtattgcccttgctcctacgtatcctgaggtgcgatgagaaattcagacctacgtag

SEQ ID NO: 78777 - DNA, 513 bp, Glycine max
  Peptide Sequence Number=SeqID_170462
gcaactgtgtctccagcaaaacctccagataggccggatcatgaggtcgatgatcccctatatttgatgacattaaccatcccacaactttttttgaagcctctccaagttatgtgggatgctaccgtgtttaatgaagacttcccattgtacataaagcacgaagatctccatgaaattggcacacggtggcatctgactgagacaagtatgcgagcggggaatttcgatgtgtatggattcctcgagccacagtccattcagagatctgggcaatcacaatttgaatcaaaaagttacatgaagagttggatgcagagttcaaaatgtgatgtctaccttggagcctacctgaattggccagacaactaccttaaaggaataattaacagtgctttgaaaggacttgatgatactccacaacctaaatccaaggctggtgctaggtggattgttgttaagtgtaatagacaaaaaggaagcattgagtgcggctattacgtcatgcactag

SEQ ID NO: 78778 - DNA, 291 bp, Glycine max
  Peptide Sequence Number=SeqID_170463
atggaaaagagcggaggcaaacagaataattttgggacaatgaaagaaagggaatggaaaatcttcagatcagataaattctcggcaagattgccattctcgactggcgatatcccaccccacatgaacaaagtggaaaagactgaaacacccagcttcctctcgaaaaacacttccctcgagaaaatcctattgcttagcccgatgtttccccggcatgttcatttaaaagctaaaagttggcatcctgcccttcattctcggttacaaggaagattacccttggcataa

SEQ ID NO: 78779 - DNA, 243 bp, Glycine max
  Peptide Sequence Number=SeqID_170464
atgatatgtttctacaatctgaccattgggatcttggaaataataacttttggtctcccgctaagcaagaaaggcgcgctaagcgcaattccaactgagaggaattgcgctgagcggcccaaagctacgctaagcccatttccaaccgagaggaagtgcactgagcacccagaaggcccgctaagcgaaagttgcagagacttgcgttggaccaacaagcgtgaacgagagagagacctctaa

SEQ ID NO: 78780 - DNA, 243 bp, Glycine max
  Peptide Sequence Number=SeqID_170465
atgcaaccattactcttctccgtagggggaccgccttcaacagtggaaggaagggaaaagctcgatctcatcgaagagagattcagagcggtcaaagggttcagtgattatccctttgccgacatgaccgaactatgcttggtgccggatgtcgtcatccccccaaaattcaagatttttgtagatcccaaagatcaagagaagactgccttcacctgtccttttgatgtattcacatattag

SEQ ID NO: 78781 - DNA, 292 bp, Glycine max
  Peptide Sequence Number=SeqID_170466
ttcaacggaaagtaacgacggctcacagtacccaccggtggtcttgggtggtggaaaatatggttttagggtttgggagacattttcgggagaagaggcgagtgaaaatcgtgtttttcacactaaggacggctcgcttagtgcaccttttgggcgcttagcgcacttcctctcagttggaattgggcttagcacgactttggtgatgcaatcctacccccaagggtattggataggagactccaagaagcttgggctagagctactaaagaaggccctagggttctcatga

SEQ ID NO: 78782 - DNA, 411 bp, Glycine max
  Peptide Sequence Number=SeqID_170467
atgctgagttcgtcgagaccacccggttgtgcacataacagcctccctcccataggtgatcagcctgggagcccaaaggtgttccctaccagaaaaatcagcatgcaacagggacaagcagttatcctcatagctaggttccctgaccctaactatggtgttaaaatgctacccccgggttcctcgtcacgtcacttggagattttttttcgtctccgctcgtcggttccacgaaatcctttaccatatcaaaacgaaggagacttaatatggatttcaaaaaacaaagctaataacaatgctctcaaacacccacatcactacatgaaagggctgagagcattttgggttgtacaaagggatatcatttggaaattccgaccacgccaatgtgaccggggttcaatgtag

SEQ ID NO: 78783 - DNA, 432 bp, Glycine max
  Peptide Sequence Number=SeqID_170468
atgaggatcttgaagatcctcatagtagcggcaaataacttatgctgcttccatccacctgaattgataggtacaattttggttggagtcatgggaaagagaaacttgaatctgggaagccagtacatgacatttggaaaatggatatctggaatgaaattcaatctgagccttgatgctaggaataaacccatacgggaaggccaagagaaggatctcgtagtgcatagttatcaatgtttgatagcggcagatagtccgtggccaactatgagaatgttctctactttgtgttcggatgcatcagttctaagataccttagagtgcgaaactacaatactaagaaggctgcaaagatgttgaaaggatccataaagtttttggtgagatgttccttggagttggatcctgtcacgaaagcaactagttga

SEQ ID NO: 78784 - DNA, 393 bp, Glycine max
  Peptide Sequence Number=SeqID_170469
atgtggaatctaaaagtatcatttgacctgactggacaatggtatttccatggaggtgaaagtagatatcactattatggaggtatcatcgtttgtaacataccatcattaggcacaccactagttacaactaagttaacctttctagctgaagtattcaacatacgtgaggtcgaatatacctatcctcaaagatcatgtgacacgatacaagaattcatagttgggtatgcacaggaagtcaaagtcggacagaaccaagaggaactactggtcgatggcaccggtgatggaagggaagccaatgttagacagaaccaagagaaactattggccgatggcacaggtgatggagggctcattttcacagagggacattttgatcctagttag

SEQ ID NO: 78785 - DNA, 752 bp, Glycine max
  Peptide Sequence Number=SeqID_170470
atgcaatcacagggactcgcattgtctcctaagcctgaggttggtccttcagctactcgtgttagcacaaaagagagttgtgttgatccctcagggaacgacccaaacacgggtgacttagagaaatgtgggttgtatgtcgaagaaaatcctccccgcctggttgccctaggaagactttatgagggatcgacaaccgttcgcaacattgttttgtgcaatgatcaagtcaagattggtgttgaggaagttagagacacagatgctcccattcttgtacccactcaagaggttcaactagtggggcaggcatttaacacctttgttgcttggccgacacatcttggagctgtgggactggggaaacctatagataggctgtatcatgatatcgatgatcccctatatctgatgacattgatcatcccacagctttatctaaagtcgttgaaggttatgtggaatgctaccttgtttggggtgtttaataacaactttcccttgtacataaagcatgaagatctgtctgaaatagcacacggtggtcaatgtctcagcatctctattatacaattgtggattctgcatatgactaagacaagtatgcgagcggggaatgccgatgtgtatggattccttgagccacaatccatacagagatctgtgcaatcacaatttcaatcagaaagttacattaagaactggatgcagaattcaaagagagatgtgtacctaggagtctacttgaatgg

SEQ ID NO: 78786 - DNA, 165 bp, Glycine max
  Peptide Sequence Number=SeqID_170471
atgaatcaatgtttggacaacactgattttgaaggttttggagcatcgattgaagatatcattcatgatgtctcgcttagtgagctatgctcgtccaacaagagtaattatgaagacaaggtcacaaggcagctcaagagtgaagaagaagtgctaagtcactag

SEQ ID NO: 78787 - DNA, 195 bp, Glycine max
  Peptide Sequence Number=SeqID_170472
atggatgactgtgaaaggattaacgagaggtcgtgggatatgttttaccgcggccctatggtggcgtcaaatgttcttactaaaatccggaaccttgacacatcagggtggacgtggttgaatgggatctcgaacttcacagctcatgtaagcgagatagagagaaaggggcacaggcttgttgtcgtgtgctga

SEQ ID NO: 78788 - DNA, 519 bp, Glycine max
  Peptide Sequence Number=SeqID_170473
atggacttgatgaccactttcggtcaggtgttgcaacctacccttcgatgggagggtgaaggccaaatagataggccaaagcgttcacctccaagggagaaaatgagcaaagccgccaccaacgtttattcaaggaaaacattagaaaaaccaaaaagaggcctgcgaattttgaaaataagggttcaggagttgtttatgaatagggaagctcgcccaggcgagctgggaattagtgctgaaacaatgagctcgcccaggcgagctggtttcttcaccatgaagctatttggtggcctaggcgaggcagaggctagcctagtcgcgcttagcgcgatagaagaatctagcaaagcatcaatattaaggctgcgcgctaagcgcgagatcagtacgctaagcgtagtagttgtcttcagccaggctcagcgcagactggtgctaagcttaaatccacttactcgcactaagcgcgagggtggcactaagcgcaacgtcgcgaattcagagcctatttaa

SEQ ID NO: 78789 - DNA, 180 bp, Glycine max
  Peptide Sequence Number=SeqID_170474
atgactgtgaaaaagaggctaagtcatgaagtgctaaaagtgacagttgagcttagctcattcagtgggctaagagtgcatcatccgctaaaggcagcttcagcgtgcttagggcgacagatgaatctggcagagcatcaatatcaaggtcgcacgctaagtgcgatattagtgcgctaa

SEQ ID NO: 78790 - DNA, 363 bp, Glycine max
  Peptide Sequence Number=SeqID_170475
atggaggccatgaaagagcaaatgaccacaatgatggaagccatgatgagtatgagaaaaatgatggaggtcaacacggctatagtcgttgccgcaagtaccgccattgaggtggacctgactcacccatctagcctcaaccaagtaaatcaccagcctcggacatggtccaaagcaagcattccttcccaccatatggcttgcctcccaactatacaccacccaatgttgcacacactcccgatgagaacatcgataactccactcccatactcattgaaggccaacaaccccaatttggataggcataggtctctcaacccatgggggagacacatgaagtaccccgagaccaccctctag

SEQ ID NO: 78791 - DNA, 171 bp, Glycine max
  Peptide Sequence Number=SeqID_170476
atggagaagatgaatatgtataaaacaacaaagggggaccccctaagggcaaagggtcactttggggcagttgcagctcgcccaggcgagttgagacttagtgctgaagcaatgagctcgcccaagcgagctggagctcgcctagacttagtgctggtttcttcaccatga

SEQ ID NO: 78792 - DNA, 1680 bp, Glycine max
  Peptide Sequence Number=SeqID_170477
atgtctggcaagattggatgggtctccttgaataatgtgtccaaaaagctgttcgagtttgactcaaacatctttcatcgtttcaaggaccatttctttaaggtcttggctattgatgtcgtggctgatggcatgccattgatgttcaatagggacaaggagccctgcttctccaatttcggagtagttgccggcctcgctggacgggcgaaccattttgtctcttctgtcagtataatgggtgactttgcttggaagccactcatgaagcaggttggacctgcaagtgggatcatgccactgtgtattgctgctccgtctgttggaggagggggtcaacctgctgaagtcgaaggcccttatgagccttcacgccctaagataagcggcagggaagctgctcctgctattgctgaagttgttgtgcaagccgctcaggctggttttgctatggttctgccatccatcgtcgttgatcctttattaagtgtcgatgtggcggccattggtgcttccactataccgcctccttcgttgactctgctatggcatcaccttcttcgtcctcgcaccctcatgtctccctcgatcatctgtacacctccagtgatgctgacgcattgtaggaatgcaactggctgtgccaggttgtttctccaaaggagtttggcgattctggagaagaacggactacgacaccaagacagggtgcaaaaggtggcatccttggaggtggaggagaaccatcaactgtcatccaaggttggtggtgctttggccaaactattgcgcacccggttggatggtgatgacctgttcaaacactgcaagggcttgcaggcaaagaagctgaacctgggtggcaaagtggagagcatggagtccaagttgtgggcagctaaggatagggaggccagtaaggagcttgaagaagagctactcttatgcaagaagaagtctggtttatttgcagaggaccttgacttaggtctcttcgatccattcaaggatgtgaaggagggagtcctacttgatgaggaggagattgatgcggaggaggaggctgctaatgaagggcagggtgctgcggagcaaggcgatgatgcctatgaccatgtttgtcttgtaaagagtagagtgacgtggagtcatctcagcttctcccctaatggttgtgaggagttgtgtttgactttcctctggttgaaggtcttgcctaaccagtgtggggataggtcgcttgacctactgagttcctcctctgatggttgtgaggaggtggttcttgggtttgtcgagccttggactagagacgtgtttgtcctgggttttttcaagcctgtggagctgtgtcgaggcttaccaaggacgggccttgggttttgtagacctgtgaagatcagtaagcgtgtagcttggcttgctcgtgcctcttacaaagtggcaggtactagagatgtggtgcaccgtgctcttgcatacatgtcacttgtcatcggtggcatgcactggagatgtggtgatatgctcttggatatatgtcactcgctgtgggtgacacagactagagtcatgatggatgctcacatgcacatgtcgtgggtggcacgtactcaaggcttagtaggatgctcgtctgcacatgttgtgggtgacacttattggaggcttagtagtatg

SEQ ID NO: 78793 - DNA, 1506 bp, Glycine max
  Peptide Sequence Number=SeqID_170478
atgaagctagccgaggacaacaagaacctggaggaccaggtgcttgccctgacaatcgaggccaaggggttggggatgcgtgctattaatgcagaggccttggttaggtcttgggatgctaaaattgctaggatttggttggccttggctgctactgacaaggagaaggaggaggtcattagtgataagaagatgattcaacagaaggatttcaatgacctgatgatgattgatgacatctcagaggacacaactcttacaccagaaaggcagatgaccctgacggaggccttacatgttgaaggtgtcagggagaggaatgttaataaatcatcaagttcaaccttggtcgaggagggtactcgggagggaactattagtgaaccttcgagttcaaccttagtcgaggaggatagtcaggagggaactgttagtgaatcattgagttcaaccttagctgaagagggtacttgggagggaattgttagtgaatcttcaagttcaaacttagctgaggagggtactcgggagggaaatgttattgaattgtcgagttcaaccttggtcaagggaggtactcgggagggacttgttagcaaatctccgagctcaaccttagctgaggggggtactcgggatggaactgttagtgaatcgtcaaattcaaccttggtcgaggagggtaatcggaagggaattgttagtgaatcttcggtgcgtacgagtccaatagaggggggagggagggcacctgcaaaagacactctgtcactcaagttaaggtgttgcacaaaatatgtgggtatatggccaagaggatactcggcttcatatggtaccttctcttggaaggacgcaacttggaaaaagcctatatccttagagaattttgaaggaaaaggaattgttcttcataagaagactcccacccctgaggaagcagaaaaacaaatggcaatggatgcacttattgccaaagagcttgtagaagaagaagtgaagggtgcaacccaaagcaagggcaataagaaaggaaaagggaagaagaataaaaagaatgccttacatattgaggagcaagttgccttggaagaggctatcagaaacaatttgaaggactcaactgttgtttcaaacagtcaaactcgaactccattgaacattcgtccaaacagactgagatttaagccacttagactctttacaagaggctttcatccacacccgaatgacatcatctttgcaaaaaggatcatggtgtgtccaaggatgcctacactagaccctaagaagagaaagaagccaaagccttgtgctccaactctacctatatggcaagcaataaagtcgcaaagattctcattcctcattgctaagaagttgaagcaactatttgtagagagaagaaagttctttgaagatgacgctggacgcatgtgggaacaacatctatgtgatcaaagacaagaaactggaagcttaaatctctctaaagaagaaagataa

SEQ ID NO: 78794 - DNA, 552 bp, Glycine max
  Peptide Sequence Number=SeqID_170479
atgtatgttgcatatctttgtctctgtcgtaactctggtttcgccagcatcatcctcttcgtcgcaactcctccattcacggccagtcttgctgccactgtcgctgttggtgtcaagggaaagaatggtgtgtctcttaaggactccaccttgttcggtctttttttgatagaacctatcaaagctaacttcaactttttgacattgaggtgcaagaaggaatacatggtgaaatgtgtttcttggatagcaggggctgtcactgtaatatataactataagtatataaggagtggcaatgtaatgtttttcaaacaattaaaaagacttagatggttgaaacggttagacttagttggttttctgttgagccttgacttccttgctcgcactctaacccagcttcacactagtttgttgcttgaattgttgttgttctctgagtgcatacttgattgtcagggaattaatctcaccactttcatgtcgtgtacttggagatcaatgcgaaatgctgccaaaattttgtcaaatttaacaaaagggacttaa

SEQ ID NO: 78795 - DNA, 690 bp, Glycine max
  Peptide Sequence Number=SeqID_170480
atggtgttggggagtgaggatggtgtcactagtaatgaagatttcttgcttgatgatcgtgagcttgagagtgattactacttgagtagtaaggataatgatgaagatgatgaagtgaaaataataataatgccaatgttagctactgaagaggttggtgacgaagatggatatggacgtgggctcgtttatttctggtcagatctcgcagatggcccatctctgagccccgccattaatttggcatacatcaggaagaactgctggaacctggataatcccacgatcacttttccagggacccgcaagactagggctcggggaccctctaatgcttccacttctgcccctgcttctacttctacaccagctcctgctcctgcaccttcgcagatcacagcaccatccaacacctccccttctcctgtggggggaggtgagactcctacaacccatgagccagagccagacgccacatcggaggagactccaaaggttacccctgctgccacacctttggaggctactgaggagggagacggcgctgcagatacatattatgccgtagatatggcagcagtgcagggtacttgggatccctggtctactccagcacaggacacatcttcgccagttcaagataccccctctgctcctcaggatgatccggcaccgacacaggaggactga

SEQ ID NO: 78796 - DNA, 1371 bp, Glycine max
  Peptide Sequence Number=SeqID_170481
atgacacaacaaccggacttcagttggatggttcccattgaagtgatgctgggtgccctctaccacggacaagtccaagcctgcagcatctcaagcgtcacggacgagcttcgaagcccgaacgaggcggctttcaagccaaaggaggtctccataggacccttgcacagaggaaccacgaggcacgtgcagctaatggaagagacaaaatggcattacatgcgcgaatttctcgacagaagaggcacgcaggagcagaacagaagatcggagcggaggctcagagagtgtggcaccgatatcctcaagctggataagataatcatggcatgctatggaggtaacatcagatcagaaccgcaagagttggctaaaataatgattgtagatggttgttttctattggaactccttatcaggcttggtgattttatatgtaacaatagtagtagttatgcaaatgaccctatactgaaaaatgaggagaagatggtgtctgttctgaatgatatcacattgcttgagaaccaaattccattcattgttctcaagaagttgtataggaaggtctttcccgatggcagtgacatcaacaacgataaccgggttgctgatatcgtttgcaaagcttttggttacactgaggtgaaagccccggtccacatacttcacttgatgcatttgtccacagttgaacagactcagcaagagggtaaacgcgtggagcaagaactattgcgctgcgccacgagacttcaagctgcaggagtagaaattaaagctgcaaacaccattgctcgccataagttggtggattggttcaattttgagataagtttcagtgacagcgtgttgcggattccaccgctgtatgttaaggacactacagaagtgaggtggaggaatttgatcgcgtgggagcagagcagaatttggatcagatgtaaatacacttcgtatgcattgttctttcaaggtttggtttgttgtaagcatgacattgagctgcttgagaagaatggggtgatagtgaacaaggccgggaagagcactgatgaactgctggatctgtttcgaacgattgcgaagggagcagagtacatggattcgagctatagcgaaattggtgcgaggttgaacatgtacaacaggggaaaaatcacaactgcatttcaaggattgcctgtagtcacttggcacaagtgcagacatgttttgcagatcattgtttactattggggaaactggtacagaattttgatacgcgatcatattcccacggtgtggaaattcataggagtgttggcagctgctgcacttcttgttctcacaattatgcaaacctattactcatcccgcaataaagactga

SEQ ID NO: 78797 - DNA, 513 bp, Glycine max
  Peptide Sequence Number=SeqID_170482
atgtcaataagatttgtgttgagtaacctgattgcaaaagcagtgtggacaacaaggtcaatgtctggagctaacaagaagatgattgaggcactagtagctaggaagaaggaagagtgtctgaagaatccagagcttggtcggatttttaaactatacaaatcagaaaagagattcgaacatgtaatcttgaagctgtgtgcctcaagatgcaagaaatgtctcaagatgcaagaaatgatttcaaagaaaaaagaaatgttacaatatccaacaaaattgaaactttttgagccaagatgttatgatggagcaagagaagctattgtgggatttatgaagaggccgtgtctatttgttgtgagcgatgatctgaaagtgaggcaattgacaactacttctagcattcagtatatgcaagagctggggaatgtcaagtttattgatttgaaggaacatatggtggaaatcaggaagtcacatgaggtaataatattagcaatccactcttga

SEQ ID NO: 78798 - DNA, 552 bp, Glycine max
  Peptide Sequence Number=SeqID_170483
ggaagcaacaacaagctcaagcttagaagggccgaaagggacgagtcaagggtggaaagcatggcattaaaggataaattgaaggcttgtcataggtcaaagagaagtttgaccgaacaatcgagtggaacggaagagaatatgttgacgatcattgatcagtataaggagaaggtaaacctagctgctagtcttaggcagagactagaggatgagcatgcgaaggtattgactctgcaaatggaaagggaagcaagagagagggtgatagaatcattacgctgggaagctgtgaaatggatggatagattcgctctcactctgaatgggagtcaagagcttccaaggttattagcaagaaccaaggcaatgacggaagtatacttgactcccgatgaattgtcataccctaatttcgtccggggattatcatttgatgatatacaaccattgattggccgcttcgagatatttggcaccctttgttgcacaatatgtgaagtcccaagacgtgccgaaaatcaaaaggaagcaggcttacgcgatccgtga

SEQ ID NO: 78799 - DNA, 352 bp, Glycine max
  Peptide Sequence Number=SeqID_170484
gatccccgagcacaaagcatattgggctctcaagttgctcaactttgacaacaacgcatgcggggaaaagaggaagctacagctgctggaattagaagagatgagactgaatgcctacgtgctaaggctattcccaggaggggtgccaatagcaaaggtgaagtgggctgcaggaagccacgcgcttagcgcgcatccgcgcgctaagcgcccaacttcaatgaggtcctttaatggtgattttccaccatggagatgcagcggaagacaaaggagaagaggtgagaggaggcgccatccactagggaataagccatggaagaatgagcttcaccaccaagatgagccttga

SEQ ID NO: 78800 - DNA, 141 bp, Glycine max
  Peptide Sequence Number=SeqID_170485
atgagaaggaaagaagaaaggaggaggaagaaggagcataaatatgaagacccaatgcctatagctcatctctatgtgtctatggagccacttttgtccatgaatgtgcaattcgctgacaaatgcgtccctgcaagatga

SEQ ID NO: 78801 - DNA, 111 bp, Glycine max
  Peptide Sequence Number=SeqID_170486
atgggtgccaagcaccttcacgaggaccaaagaatggtcgcacgtcatcgagcaaaggtgagccttcatatgatgagtcacatgctagagatggagagacttagtctgtga

SEQ ID NO: 78802 - DNA, 750 bp, Glycine max
  Peptide Sequence Number=SeqID_170487
atgaccgcatttaccggtgtgatcctcgcaggcgggcaaggcagccgtatgggaggtcaggataagggcttgctgccattacagggcaaaccgctttatcagcacgttctgcagcgtttacagccgcaggtcaatattgtgttgattagcgccaaccgtaacattgatcgttatcaggcaagtggctgtcaggtgattcgtgattcgctgcctgattatcccggtccgctggcaggcatgctcagcggcctgcggcacagccagaccgaatgggtggcgttttgcgcctgcgatacgccgtggctaccgcaggattttgttgcacggctgtggcagcagcgtggtgcagccgccgccgtgtgggtgacatcgggtcagcgtgatcatccggcgctggccctggtgcatcgtgcgctggccgatgatctggaagcgtggctgctgcgcggagaacgtcgtctgatgcagttcatgcgagaacatggcggacacggcgtactgtttgatgatgatgaagccgccttccgcaatatcaatacgcctgacgatttggttaatgaggaaagtgattccgctactgagagcgcagggcattcgccccgggctgatcaagcatacccatcatcagatggacatcgatacgccgggaaaagacagttatctgctgcgcaaagcgggagccgatcaggtgatcgtcgccagcgaacaacgctgggcgttaatgtgcgaaacgccgcagcagccgcttag

SEQ ID NO: 78803 - DNA, 279 bp, Glycine max
  Peptide Sequence Number=SeqID_170488
atggaattttgtgccctgggcattgtaccctatgtcacaacctacccttttgcgggcgagcgaggcgaggctcacgagtgcgtcttccataggaggaaaatgcgcggagtcgccaccaacgttttattgaaagggaaaacgttagaaaaaaccaaaggaaaactggtcataaagaatattccagattcgggagttatctttacgtttgaggaaggtcgacaaaagcggggctcttgctcctacgtaccctccatcgaagaggaaatcagacctacgtag

SEQ ID NO: 78804 - DNA, 516 bp, Glycine max
  Peptide Sequence Number=SeqID_170489
atggagaatgaagaagaagaaaatggcaacgtgagggagagagagagctgtctgaaaactcaatatgttgatgccagcgactgcattattcttgatgaccatgaaggagaagagcattgttgtggcaaaggaacaaatgcgaggagtgtttcttttttgctaagaagccaagagaagataggagattcagctaaagttgtgataaaacaagacatgaagggaggagagcataaatatgggtttaacaacaataaacgatcatggcttctccacctgcccctcccccctcctcctcctcctcctccttccgacgcatcggcttcgccgtctaccgtgaagcggacacgcaaagcctcatgtctacgatcgttgtctactagaccacctggtgcagagagaccagtggtccatgttgatcctgctactggcaaggccgacggtccccacaggaagaaattaagaacatatttggggattgtggcgtgtgataaggtggacgtcacctacgagaactag

SEQ ID NO: 78805 - DNA, 404 bp, Glycine max
  Peptide Sequence Number=SeqID_170490
atgtccaaatgccctaggtgtggggggtcacggtacaaagtgaaggatgatgaggacgacagttcagatgaaaactcaaagaagggccctccagcgaagatgacgctaaagaccttacctgacatgcaaatgggagaaactctgatggaatggtccgtcatccggctgactgctcgtagtggaagaagattcatggacgaggaggttttagtgtttgatgagtttaacaaggagactactgccattgagcgaccagagcatcctggtcgtgtccgtgctgctggagccggtgtcaccataaagcaatatttcggatcggctccacgaacatcccccagttcttcctccatgcctcctgacgacctacagcagctgactcaacaaatcaaggaccagctagagga

SEQ ID NO: 78806 - DNA, 651 bp, Glycine max
  Peptide Sequence Number=SeqID_170491
atgaagcacttcactgacaccctcatcagtgccaacataggaacaaaagctggtaccgggccccccctcgaggtcgacggtatcgataagcttgatgagcggcaccgtggtcgagtacatcccgaccgccgacctgggccagctgccgctgaccgagatcagcttcgccacctacacccagatcggcaccgacaccctgccggtcccggtagtgctgccgcaggtgctgccgacctcgccgctggacgcgctggaacgcttcgaagccatgcgcgatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 78807 - DNA, 459 bp, Glycine max
  Peptide Sequence Number=SeqID_170492
atggcacagcctccaccccgtgagaggactctaagggaaatggttgcacctgatttcacctacgaaagcttgtgcatccaataccctgatgaggatgtcccatatgttcttaaaactggactgattcatttgcttccaaagtttcatggccttgcaggtgaagacccgcttttcctcattccaaggtccatcacgagctgggatgaccttaagagagtattctcagaaaaaaatttccctgcttccaggaccacagccatcaggaaggatatctcaggtattagacaactcagtggagagagccttaatatggagagaagtatgatagatgccgccagtggtggagcccttggagacatgactcctgctgaagccagaaatttaattgagaagatggcttccaactcccagcagtttagcgccagaaatgatgctatagtcattagaggagtgcatgag

SEQ ID NO: 78808 - DNA, 535 bp, Glycine max
  Peptide Sequence Number=SeqID_170493
aggactgcatgtcctcaccttcagaaggctacacgccctcgccatcagaggactgcgtgtcctcaccttcagagggctacacgccctcgccatcagaggactgcatgtcctcaccttcagagggttacacgccctcgccatcagaggactgcatgtcctcaccttcgtagggctacacgccctcacctttagaggactacacaggactaacgtcctcgccaacgtagggctacacgccctcacctttagaggactacacgtcctcgccaacagagggctgcacgccctcacctttagaggactacacatcctcgccttcagaggactccacgtcctcaccttgagaggactacacgtcctcgccttgagaggactacatgtcctcaccatcagagggctgcacgccctcacctccagaggactacacgtcctcgccttgagagggctacccgccctcgccttgggtactagttaccctcaccttcagaggactacatgtcctcaccttcgtagggctacatgccctcacctttag

SEQ ID NO: 78809 - DNA, 534 bp, Glycine max
  Peptide Sequence Number=SeqID_170494
atgaaggcgcacatgaaggggatccagggagcgccgtatagggcacatttagatgctctgacgatcaaagacgtttcctggttgccctacagtgagcaccgggcagttaggggctttgagcttatttcatgctaccgggggcagcttagatggggtcatgttgtgttcggatacatcgagaccatccctccaccgtcggttactgcttctttgtcatatgacgagatagacgagaggtggatgcatttcagggaccatttggcacccgcgggtgagatttgtgttgtccccgggcaggtatcagcggactacatggagtggtttttcaagatatctcacctatttgtcacaccgacccacgaaggcgatgagcccaaacagccagctaccccagatgtggatgcatacgtcgagccacatgtcccctggaggttccaattgcagctgatctccccatacattcagtggtttcttgtgaaggttgcgaagcgatcgcataaaggttggagtgtgtgctcaaccttaggatggtga

SEQ ID NO: 78810 - DNA, 50 bp, Glycine max
  Peptide Sequence Number=SeqID_170495
gatcccctctagtgaggaagtctaccccatgaagaaggtgactcttaatg

SEQ ID NO: 78811 - DNA, 258 bp, Glycine max
  Peptide Sequence Number=SeqID_170496
gctgcaagtgaaaggggttcccttgtgtcacatcaacgagagctttgtcagcatgggttggatgtgcaagggatgggtcaccatgatacacaaagaaaccccgcaagagcaaccaaattgggtgcggccgtgtcctctagagttcgaattggggaactggacccagactttgattttaagcaactgataaatcaagctgaggaaggggaagatgaggattgggggcttcccccagagctaaagagaatggtcgaatag

SEQ ID NO: 78812 - DNA, 483 bp, Glycine max
  Peptide Sequence Number=SeqID_170497
atggtcattgaccaatccctattctatgacttgacccaattatctagtgaaggtgtaccatttgaaggttcactgaatgatgattggaagtttgatttctctgtgcatgatgcccaccggtttgtttgcaccaaccaagcagatatgaccagaaggcttcttgccggttcattggcttttgaaagccgcatccttcattatctcattgtgcgtattttgcttccaagatcttcaaaccttgcacagggtgctcaacccattgatgaagaaggacacttaccagttggagaagatttctctcttcttcaaaggattttggataggtttgatggtcttcaaacctttgttggtgaaaggtttgatgctttggagttacaagtggacatgcgattcgatgagatggattcaaggatcaccaaggttaaaggagatgtctcttacatccgcacatgctttgatctaccaccaccaccaccatcttag

SEQ ID NO: 78813 - DNA, 240 bp, Glycine max
  Peptide Sequence Number=SeqID_170498
atggccactgatcagcacctggtgatggtcaacaagaagaggaggcccattatatgcagaaccaagctagacctcaacaaaacttctaaggaagctagcaaggctatagaggtggctcaggtatccatctcaaaccagaagaacactgatgcttctattaaaaatctagaagttcgggttggaaaactagcaaaatatttgtttgagcatggaagtggatctttctcagcaactacatag

SEQ ID NO: 78814 - DNA, 306 bp, Glycine max
  Peptide Sequence Number=SeqID_170499
atgtggaccactggtctctctgccccaggtggtctagtggccaaggatcatagccatgtggctttacgtgtccgcttcacggtagacgaagacgctgatgggtctgcaggaggaggacgaggaggcgagccaggtggagtagccatggttcttatgagtgtcgcaacatgcccttttgcgggcgtgcgaggcgatgctcacgggtgcgctttccaaaggaggaaagatgcgcagagtcgccaccaacgtttatttgtggaaaacgtcggaaaaaccgaaggaaaccggtcaaaacgaaaattctaa

SEQ ID NO: 78815 - DNA, 681 bp, Glycine max
  Peptide Sequence Number=SeqID_170500
atggtggcacgggtaatgctcaggcacggttatgaacccggaatgggtctgggcaaggacagccacgagaatgccgatgtggttgacgttaggcgtaacccgcacaaatatgggttggggtatgagcccgggaaacctggaagaaggaatgcaccatcaagactccgggcagatagggcatggcccggtcatgttagccagtgtttcacaagtgccgggataatgttcgaggaagaggtggcggcgataggagaagaggctccacaagatccgccgagtttcctgcgaccgtgcaatcccaatttccaattggggaattggcacgtgacgagccagtcagaagtctataccgctgattcaatatgtgagaatcgatcctttgaggatcctaacagcgagggtttgataatcgatttcgaccgagaagtaagtcaaacaataaacaaagaagaggaagaggacgtcctttcaccagagttggagagattgatcgctcaagaagaacgcgtgtcgcaacatgcccttttgcgggcaagcgatgcaagactcgcgggtgcgctttccaaaggaggaaagatgcgcggagtcgccaccaacgtttatttgtggaaaacgtcggaaaaaccgaagggaatcggtcaaaatgaaaattctaagttcgggagttgtatttacgtttga

SEQ ID NO: 78816 - DNA, 837 bp, Glycine max
  Peptide Sequence Number=SeqID_170501
aagccggatgtgctcaccgttcagctcagcgcgccggaaacctacggtatcgacgccggacagccggtgatgctgtatggcgtgaagatcggccaggtcatttcgcgccggctggatgaaaacggcatcagctttgtggcggccatcaatccggagcaccgccagctggtgcacgccgacagtaagttcatcgttaacagccgtctcgacgttaaatttggcctcgacggcatgcaggtgctgggcgccagcgcgcgcgaatgggtcgacggcggtatccgtcttgtgccgggggcgaaaggtcagccgtccagccgctatccgctgtacgccgactcagagcgcgcggcggaaggcattaccggcgatcagccgccgaccacgctcaaactgaccgccaacagcctgccggatgtgcaggccggctcggtggtgctgtaccgcaagttccaggtcggtgaggtggtggatgtggtgccgcgcgccgatgcgtttgagatttcggtccatatccagccgcagtatcgcaagctgctgaccagcgaaagcgtgttctgggccgaaggcggtgccaaagtccagctcaacggcagcggtctgaccgtgcaggcttcgccgctgaaccgcgcgctgaaaggcgcaatcagctttgataacctgacgggcgcgcaggcagcgaaaggcgttaagcgcgtactctatccgtcagagaccgccgcgcgtgcagtcggcagccagattaccctgcacacctttgatgccagcaaactgtcggccggcatgccaatccgctacctcggcatcaacgtcggtcaggtggagtcgcattggcgctga

SEQ ID NO: 78817 - DNA, 165 bp, Glycine max
  Peptide Sequence Number=SeqID_170502
atggcttctaggaaatgcaagagtattggttcaagacccacaacacaatatgatacaaggagattttactcctttgatgctttgaaccgatacatggataatatcttgggaagaaacattgtgccagaaaggaaggtggagattgttggatcaagtggcctctga

SEQ ID NO: 78818 - DNA, 246 bp, Glycine max
  Peptide Sequence Number=SeqID_170503
atgtccaaccataagagtactgagtcagccatgaaaaaccttgagatccaggtgggtcaactggccaaacagttagcagagaagtcatccagcagctttggagaaaatattgagaagaatcccaaagaagagtgcaaagctgttataacaagaagcagtaagcttgtggcggctgaggatgaggatgttgttgctttgaaggagaaagttgctttgaaggacactactgctaaaaagaagaatgag

SEQ ID NO: 78819 - DNA, 693 bp, Glycine max
  Peptide Sequence Number=SeqID_170504
atgaaaagagaaaaacatgcctcctatagtagtcataactcttgcaagagcctaagtgaagaactttgtgaatattacgaaggaaggcataggtcacatcttagacctcactcccatagaagagaaaaggaaagaaagcctcaagtggctaacattaacctctcatacttccatgggaaggacaatgtagaggctaacttagattgggaaataagggtagagcaacaacttaaaaacaaaggatacattacttctcaatgccccaccacaaaaaccatgattatgaggagccaagacatttatagtagccaagatgaggctactacgtcaccttcttctagtgaaagtgacgaagcaaaaggggaagaatctagtgaagaattctacccccaagaagaaggacaacctttaatggttaaggaggagtgtaaggaggtaagtgcctcctccaagaggttagttaagaaggaaagtcattttgaaataaagaaaaatattaaagaaacttcccctcttagacaacctctacatcttctcctttgtaaaaagacacttgttagcactgccacacctcttgggcttgaggttattcctcaagtaaaggagttgttggatgagggtttggttcgtaagagcttaaatccttgtgctttgttggtgcccaaaatagtcatgcacccaacgtcttcatga

SEQ ID NO: 78820 - DNA, 382 bp, Glycine max
  Peptide Sequence Number=SeqID_170505
atgactagaggcaatccatctgacttacaaccctttgatcctgagatagataggacatttcatagattagttaggcatcattttataccttttgatcattctgagcattccataactggtgaatctgtgcattctgttattggtgattttgaacatcctgatcttgagcattataattttgagcattctgattctgagcattatgattttgcacattctgagaacatggcacaacctccacctcgtgagaggactctaagggaaatggatgcacctgatttcacctatgaaagcttgtgcatccaataccctgatgaggatgtcccatatgttcttaaaactggactgattcatttgcttccaaagtttcatggccttgcag

SEQ ID NO: 78821 - DNA, 1409 bp, Glycine max
  Peptide Sequence Number=SeqID_170506
tcaagaacctagaactagccagcttacgagagctagggcagcggatggatcaagttcgacgtcaagccttcagcaaagcatatgggaaaatctgggatttggccatgatagaagtgtccattgaagccatcacatcccttgctcaatactatgaccagtcgctcagatgcttcacgtttgggaactttcaaatggtaccaaccatagaagagttcgaagggatcttaggatgcccgctaggaggaaggaagccatatctcttttccggattctaccattccatggaaatagtagcaaaagtggtcaagatctcggcacaagagttagaccaaatgaagcaaaataggaatggagtggtagggataccaaggaagcgcttaggggagaaggaagaagctttggcagatcaaggagaatggacctcattcattgacttattagcacttttggtgtttgggaccatactttttccaaatatagatgggcttgtggatttagcagcgattgatgctttttctgcttatcatcacagcaaggaaaacccagtcattgttgttttggccaatgcatatgacacatttgacatgagatgcaaaaagagcggtgcaagaattgtctgttgtacacctgctctttatgtgtggtcatcacatgtgcacctaaaagggaaaagcaaattgggaggaactcttggcaggattcccaaacgtccccttgatgggaacaagggattggtttcaataaaggcaatgcaaaaaatacttcagagaattcgtaaagcgtgggacacaatggaaaggaaagataaggagcttaggggaagcaacaatggtgtcatcggtggctatcataagtggttgaaggctaggacgcaagggataacttggctcccaaaggtaaaaggtccaagtgggaaagaagctgaagtccctgaggaaagcgaagaagtgcaagccttgaaagcagagcttgaaaaaatgagagtggtcaaggaaaagctaaagacgacagtcactagggtcaggaaagagtgtgacaagctaagagatgtcaacatgactgatgtagcaggaaacaaagagggtccgaaagaagaatggagcaggaacaagttccgaggggctctatggggcggcagcaacgagatcaagcttagaagggccgaaagggacgagtcaagggtggaaaacatggtgttagaggataaattaaagacttgtcaaagggaagcaagagagagggtgatagaatcattgcacggggaagctatgaaatggatggataggttcgctctcactttgaatgggagtcaagagcttccaaggttgttagctagagccaaggcaatgatggatgtatacttggctcccgatgaagttcatgagctttttgattactgccaacacctg

SEQ ID NO: 78822 - DNA, 234 bp, Glycine max
  Peptide Sequence Number=SeqID_170507
atggcacgcagcgtgtttgctccgtgcccctattttagggacctacacgggaggaaactaaaagggcttttagtgataattcccaaggtggtcatatctctcttgatggtctctagaggtatcatccccttcgaagaacatattgcgacagtagggactactagcaacaatgtgttatcaaagagaaaaactctagatgagggttcactgttatcaagcaagtcggagacctag

SEQ ID NO: 78823 - DNA, 168 bp, Glycine max
  Peptide Sequence Number=SeqID_170508
atgcctttcaatgttgttgtccctagggaggcatcatccactttgagtctgattcctttggttgcacaatccccacctgtgattgatgatgacatggaggacgctatggagttggagttggagcctgaggaggatcccgaagaggatcttgaggaggacactcgatga

SEQ ID NO: 78824 - DNA, 126 bp, Glycine max
  Peptide Sequence Number=SeqID_170509
atggctaaagtagacataggcaaaaatggtaaaaactaccttttgccaaaactgaaaaagttggccattttaggaaacagagagcaaaactcaaaactcaaaattcaaattggctcgcttaagtga

SEQ ID NO: 78825 - DNA, 225 bp, Glycine max
  Peptide Sequence Number=SeqID_170510
atgttagtcgaggctatgcaggaaatgcattttgtgggggaggcgtttgtggttgagtgggcaatctttgttggatgggtgctggattgggaggagtttcgatgttggctgaataatggcactgatacgaggaatatgggtaagtggggttgtgaggggtttgttgggattttggccatgtgggagctaaagttacaacatgggcgtctctgtccttcttcttag

SEQ ID NO: 78826 - DNA, 381 bp, Glycine max
  Peptide Sequence Number=SeqID_170511
tcggaggaaaaactggaggaatctcaggaaatcgttaaagatgcccttatcgctgttggaagacacgattgtcatcatcaaaaagggggagattgtggaagcaatgacttccaagattattttgatgatgccgaagaatcaaaagttaagcaagttccaaagaatcaggagtcaaaaaagcttcaagaatcaagttttaaagaatcaagattcaagaacaatcaagtttcaagattcaagattcaagattcaagaacaatcaagtttgaagaatcaagattcaagtacaatcaagatcaagattcaagactcaagattcaagaatcaagagaagactcaatcaagataagtactgaaaaagtttttcaaaacattgagtag

SEQ ID NO: 78827 - DNA, 168 bp, Glycine max
  Peptide Sequence Number=SeqID_170512
atggctcccaattcattgggattccttttgagaattctggatggaggtaaaattcaagtgacaattaagaagccgatgacgaggaagttcaaagaccatatcattgaaaatgtgatatatgcaatgagttattttggagtaatcggtaatagagttgtatccgaatag

SEQ ID NO: 78828 - DNA, 342 bp, Glycine max
  Peptide Sequence Number=SeqID_170513
atggggccagtatatttgggacaaagactagggctagtgaatctaggacatagacaagggccagggcatctaggacaaagtcaaggccattgcatgtgggacaaagataggctagtggaagccattgttgagagagacgggaaccaaaaaacacataacagtacttacgtgttagagatctttaggacaaacagagatcagatttgggaagattggcgtgatgttgctggtagaagaggacaccgtcacgccccgacagaagaagacgagtcacgtgatggtgtcaccagtcgaaaatgtcgtcggaacggcgacagtggcgatttgcagcggaaaatgtag

SEQ ID NO: 78829 - DNA, 237 bp, Glycine max
  Peptide Sequence Number=SeqID_170514
atgaccttttcaggagagaactgctggttcttgaagatcttggcatttctatggtaccaaatggagaaggacagggctagccacagaaattcccatgctttgttgaaaatgattctttggatctatggaatagggacccactctattaacccatctcattgtctcccaccaaagactcctagtcttttcacagttgaacataagatgataaatcgtttcttcttcatgatcacataa

SEQ ID NO: 78830 - DNA, 855 bp, Glycine max
  Peptide Sequence Number=SeqID_170515
atgtcaacttcaggccctgttctttctatttctaggacatcctccattggacttttgaagaaagattgcaacttcttccttatctttgtccttgaagcaattgctgtccccggggttcgatctgctttgttgcttctgtctttgaatgtcttcagtcattttcaatctgttaccaatgtatttccagcatgtttcattgtctatttttctacttgtattgttcatcccaagctgaaagtactaatcattctgaaggtcagccccattgtgttgttatctgagtttgagatccctcgttttggtttgaggaagtttatcatggctcagcatcagtttcaaccatctggagcaccctcaacaccaattcctccttccttgtcatctcctcgatcatctacactgttttcttcagatgatcaacgtcaaaggcaaggtgttctatttgagggcacccttgtttatgactgcaagttcaattattcgagtcatgatgctcgccgtatattctgtaatgaccaggctgatatgatcgccagattgctcgctgggtcattaacctttgattgccacatcatgtactacacaattgctcgaattttactaccttgttcgtctaatcttgctcaagcctctgaggaggatttgattctaatgtgggtttttcttaccggtcgtcagatcgaatggacccacttggttcggtatcggaagcataaggcattaccggccaatgcacctctttcttatcctcacgataacttcttttgggcaccgccaattcctgacgagcgtactccgtctcctccgccacaaagagatgtttcctctactcttatgaatgaagtccctttctga

SEQ ID NO: 78831 - DNA, 351 bp, Glycine max
  Peptide Sequence Number=SeqID_170516
atggagctggatttgttttttgcccgagagaaaattttgaacaagaagcttgatgttgctcatgttcctgctatggatcaaattgcagatgttctgaccaaagctttgtctccctcttcctttctttcttttaggcccaaactcaaagtggttgaaagacttcttcccacccctcttgagcttgcaggggagtacaaaaaaattaaagtgcatttggaagtccttctccacacattttatccaggaccaggtgtggaacaaggcatcatccatgaccttttcaggagagaactgctggttcttgaagatcttggcatttctatggtaccaaatggagaaggacagggctag

SEQ ID NO: 78832 - DNA, 243 bp, Glycine max
  Peptide Sequence Number=SeqID_170517
atgttttgtgaggaagcaggcattgagcatcaattaacaactccttacacccctcaacaaaatgggattaagagagacaagctagacaagaaagctgaacatggtatctttgtgggatatagttcagtatctaaagcttatagagttttccaacctcacacaaggaaaattctgataagtagggatgtatacttcatggagaatgagaaatggagctggattgtactgaaaagacgtcgatag

SEQ ID NO: 78833 - DNA, 368 bp, Glycine max
  Peptide Sequence Number=SeqID_170518
atgaaacttaaccaaaaagtaaaagcggaaattaaaagagtagggaagaaggagacaaacacacaagagtttttatactggttcgacaacaacccgtgcctacatccagtccccaagcgacctgcggtccttgagatttcttttcaaccttgtaaaaatccttttacaagcaaagatccacaagggatgtacccttccttgttctctttgaacaacctagtggatgtaccctccactagaactgatccacaagagatgtaccctctcttgttctcagtcaaactcaaggaagaatcaaaagaattctcagactgcgtcgttttgaattctttgacaagggagaatggagacacaaaagaattcaggcg

SEQ ID NO: 78834 - DNA, 228 bp, Glycine max
  Peptide Sequence Number=SeqID_170519
ctgtctctagaatattttccattggatttaatgatgaaatatgttcaatttcagctcaccatttgggctcagcgcgcatccatcgctaagtacagcttcggcgtgcttaacgcgacagaagaatctggcagagcatcaatttcaaggctgcagctaagcataatggttgtctttagccaggctcagcacaggactggcgctaagctcaaatccactaattcgcgctaa

SEQ ID NO: 78835 - DNA, 294 bp, Glycine max
  Peptide Sequence Number=SeqID_170520
atggcttcctatggtggtgagtttgttcttgattcatcttctccttggagtggcatctccaatcatctttcttccttctccattccgctgccaatgatcttcaagaagcaaatgactccattgatgaagaagatccaaggcctacaaactccacatggagctgcatcatgtggtattagagcatcttcatctagggcattggatagaagactccaagaagattgggccagagaggcaagagaaggccctagggttctcatgagccttaggatagattttgggctcatgggctaa

SEQ ID NO: 78836 - DNA, 666 bp, Glycine max
  Peptide Sequence Number=SeqID_170521
atgggccatatccagcaacaagaagggacaagcgtggttggtgtgttgcaattaaaacgaaaccaaggggttacatataatctgatcatgtataagatgatgcgccttaccaagttgagcaaatgtcacaggtcaacaaagtcattgaagtttaaaatatttcatcaggtgatgtcgaccctccctgacccccatcacatgaccccagtgggaaagggacaactgtggaaaaaaaatgtggttagactactaccacctcaagataattttccatcatatacctcatccccgtcttttgtatatatgccagttaggtctcctgatgttgcacctacaccatctccacctccaactgaagttagaccattttcatctcatgttgatgcatgtggaccatccccgattgatgcacgtggatcgtccccggtacttacatcaacaccttccccatccccggctctagccaacatgcctacagatgaagatgctacaaatttggcgatggaaaacccctcccccgcccccttaatgatcgtcctatggtttcatccatctaaggttgcagcaaaggttgtcactttgtccattaggcaacaattttgtcaatctttgtctacatggggagcaacttcaaaagtcatcaggaacttttttccaatgttttaa

SEQ ID NO: 78837 - DNA, 201 bp, Glycine max
  Peptide Sequence Number=SeqID_170522
atgaagagatgcatgatgagatcaaggaaaccagacatgggactatcaacgataatgcatcaccaaaaggggaaaactctagatgaggcttcactgttatcaagcgagtcgaggacccaacatgaccacagattcacctccactccttatgttcccatgaacccgggtatagggcccaatatctcaaagtatgcgcaaaaa

SEQ ID NO: 78838 - DNA, 102 bp, Glycine max
  Peptide Sequence Number=SeqID_170523
atggctatttataggaaaaggccatttggtgcagggaaagctcgcccagaactgacaaaaaaccatcaaaaccctgtgcgaccccttggccttgctctgtaa

SEQ ID NO: 78839 - DNA, 837 bp, Glycine max
  Peptide Sequence Number=SeqID_170524
atgatagagatcttggctaaagctagaaatctgcttctagaatgtgacttcaattcctcaaatttgcttttcttatcagagaggtttctagtattcaaagaagccaaacaattgatggagctagttcatcagacgttgcaggttgtggatgctgctgcttattctttacgaatgatttatcaatcaatgctagctccatatgagaatgaaaatcttactgggctaggtgctggcattgttattcattcttgcaagacaattggcgaacaaaacatattatgccatgctagtattttagagaaacttactagccttcttgatgataaattcaaaatattgagcaagggaagaggtataaggtggtcctatcatgttaaatcagaaagaaagtttgattttcaactgtcattcacgggtgttgatgttataaaagtggcatcaagtagaagaagcttcgacaaaaccttgaacaagatggatctaccatcagcagatgcaaaccaaattgccaacaatctctccaacttgggtcaaatctataatggagaagacccttcaacagatggcttgaaggaaaggggtcaagtcctaggagatggaattcgtgtacatagcatggtccttcccgaacttccttctagtacaacaattcacttctatagtccaggagaggtttactctatcaagcatgatatcatagatgtgaagtgtctcatgccaggcttgctattagccattagaaaagtagtgcacctcaagtttgttggcaaacattatgttgaaggtttgaaaagaagtaacaaaagaaaaacacatcgtccccaaactgctttttaa

SEQ ID NO: 78840 - DNA, 207 bp, Glycine max
  Peptide Sequence Number=SeqID_170525
atggatcttcatgatccattccagcaaaaaggacgtgaagcaatcaaactgagcaatgttggcttcaactccacaaccttggtgaaaggaggaatgaatggtccttatgataagcatagtcatcaagagtcctctttggtggtctattgccttctccatctctaccatctgtcgcaacctacccttcggcgggagggcgacgcgtga

SEQ ID NO: 78841 - DNA, 783 bp, Glycine max
  Peptide Sequence Number=SeqID_170526
atgggagcctctgataaaaattctgaaggtgtctacctcagagcttttttgttctccttaacagggtctgatgaacctctctgtgagacatgggagagattcaaatctttactgaggagatgcccaaactatggtactatgatgtccaagagccctgaggaaccaattgtaatcattgactccatagtagccagtgattatcagagtcaccatgatagggcttcggttcaaaggaaaggtataatgatgctagataatcagaatgcaattttagctcatcacaaactcttgactaagcaaatagaggccttaacaaaacaaattggccaacttcctcaacaatttcagcaaggaggaggaggcccattatttgcagaatcaaggcagcaagataataatgcatattctggtcccactaacccttcttttgcaagtatttctaacaactcttatgcacatcctttaaataggggtccaccaccaccacaacaacaacaagctcaaactgataaaatttcaggttggacaacttgcaaaacaactcatgagcatggaggtggatctttttcaataaacacacagggcgacgcgggggctcacgggtgcgtcttccatgggaggaaaatgcacagagtcgccaccaatgtttattcgaggaaaacgtcggaaaaaccggaaagggcgacgcgtgactcgtgggagcgtgttccaagaaaggaatacgcgcggagtcgccaccaacatttatttgaggaaaacgtcggaaaatcggaaaagacgtga

SEQ ID NO: 78842 - DNA, 358 bp, Glycine max
  Peptide Sequence Number=SeqID_170527
atgaagcgactaacgatagcaactgaggtggacacaacagtgacaatgttgaacaatgacagtgacgacagacacaacggtgacagtggtaatgttcatgcagataaattgctatttgaaccgaaaattgccaagactgaaaggaagaaaaagaaacaagcaaccatcaagccaccaggtgaatcttcttctactgattgtcgctcaattgaaaagccaccacttgtaattgataatagggatgccgaggcgcttccgaaacgtttccgtaacgttttccgtgaggaatttctcgaaggttttcgaccgttcttcgacgttcttcattcgttcttcatcgttattcgatcttcaacag

SEQ ID NO: 78843 - DNA, 1096 bp, Glycine max
  Peptide Sequence Number=SeqID_170528
catcatcggccctttggtcgttgccgaagtaggcgtgggtggcgccggtggccagcagcaggctgtcgtagtccagcgtgctgccatcggccatgcggatctgccgggcctgcttgtcgatggccaccacttcgccgaggcggacttccacattgcgctggtggccgaggatgtggcgcagcggtgcggcgatatccggggcggacaggccggcggtggccacctggtacagcagcggctggaagaggtgatggttgcggcggtcgaccagggtgatgcgtatgcgctcgcgggccagggcgcgggtggcccagagaccggcaaaaccgccgccgacaacaaccaggtggggaacgcgctcgcgactcatcgactcactccagtgggggcattgggggaagcgcctggcatcttcgcacggcggccgcctgtcacgtcagcgcccgggtggatcggcgatactcgggttcaggcaacggcccgtgaggagcccatgagcgaaccggaaaagcgcatcgccctgttgatcgacgccgacaacgcgccggcctcgaagatcgacgaggtcctggccgaagtcgcccgctacggtgtggccaacgtgcgccgcgcctatggcaactggaagagtccgcggttgaagggctgggaggcggtgctgcacgagtacgcgatccgcccgatccagcagttcgcctacagcaagggcaagaatgcctcggacatggcgatggtgatcgacgccatggatctgctgtacgcgcgcaacctcgatgaaaacgccggaaccgttcgtcaacgcgtgctcgaagttcacctatctggaagcgctgggccagacccacgccagcgtgccggataccgaacaggcctccagcgaacaggcctcgaacgagccggtagccaacgacgatgcgcggccgcgcaagagcggtgcggaaatgcgcagcgacacccggctggtgaagatgctgcgccgcgcggtgtcctcggccgagggcgaggatggctggtcgcatctggggccggttggcagccagatcggcaaccaggcttcgttcgatccgcgcaactacggttacggcaagctcagtga

SEQ ID NO: 78844 - DNA, 558 bp, Glycine max
  Peptide Sequence Number=SeqID_170529
atgactagaggcaatccatctgacttgcaaccctttgatcctgagatagataggacatttcatagattagttaggcatcattttataccttttgatcatcctgagcattccattactggtgaatctgtgcattctgttattggtgattttgaacatcctgattttgagcattacaattttgagcattctaattttgaacattctgagaacatggcacaacctccaccccgtgagaggactctaagggaaatggatgcacctgatttcacccacgaaagcttgtgcatccaataccctgatgaggatgtcgcatatgttcttaaaactggactgatccatttgcttccaaagtttcatggccttgcaggtgaagacccgcacaaacatctgaaagaatttcatattgtctactccaccatgaaacccccagatgtccaagaggatcacatatttctgaaggcttttcctcattctttagagggtgtggcaaggactggctgtattaccttgctccaaggtccatcacgagctgggatgaccttacgagagtattcttag

SEQ ID NO: 78845 - DNA, 251 bp, Glycine max
  Peptide Sequence Number=SeqID_170530
atgtcgaccttatcacgagtgacaatccccaactgtgttcttaatttcttcttgtggggaccgtcggccttcccggtcgcaagatcgacctggaccaccggtctgtctgccccagctggtctagtcgccaatgatcttagccgtgtggtttttcttgtccacttcaaggtagacgacaactatgatgttgcttcagtaggaggaggaggagaaggaggagggggagagttggacagagtagccatcggcct

SEQ ID NO: 78846 - DNA, 546 bp, Glycine max
  Peptide Sequence Number=SeqID_170531
atggtttctaatagcaatgagataactcaaaatgacgaacttaaagaatatttagattgcagatacatttctccctgtgaagctgcttggagaatatttgcttttccaatccacgggagaaagcctgctgttgagagattgtattttcatcttccagatcaacacaatgttctttatgaagatcatgatgatatagatgataaacagatcacgacaactcaggaaaaaaaaggatataccattggaagactcatatgggtgccaccaaccacaggagaattgttttatttaagaatgatgcttggcagctgcaaaggacctacttcatttgaggatatcagaactgttgcaaatatccaatatgcaacatatagagaaacatgttttgccatggggtttttacaagatgacagagaatatgttgaagcaatcaaagaggctaaggacaggggcacagctaattatctaaggaaattgtttgtattaatcctattaacaggtgccatgagcaaacctgaagaagtttggaaccaatgttggcattga

SEQ ID NO: 78847 - DNA, 252 bp, Glycine max
  Peptide Sequence Number=SeqID_170532
atgagtatctcatcctccaccgcttcaactagaatcagatatccaattgtgagaccacctgcaatcatccaattcagagcagctttccacaatgaccagagatacccgcattttaccatgaacaatgggcacccaattacccacacgaagttcggttcaaatacaatggagcaacctacccaatacgagtccagcaacatcgaggcagatatttttttgcagatgggctcgcagacgtcagggcagatttaa

SEQ ID NO: 78848 - DNA, 273 bp, Glycine max
  Peptide Sequence Number=SeqID_170533
atgcatagatctcctacaggcactttagttcctttggacttagaaatagaagctacactaagaaggaatagggctgagaggagaaggaaattgttgcaagacagaacagttgtgtccattcttgaggaggagactcatttttctaattcatcatcaccttattcaccttcatcaagggaatccgctaatcaacattctgaagctgttaccatggcagatgagcataatcagaggactacccttgaggactattcaagtggctctgtaccataa

SEQ ID NO: 78849 - DNA, 264 bp, Glycine max
  Peptide Sequence Number=SeqID_170534
atggctagccggatcagctggaagagctcctataccccggatccatctcatggattcccaccacagccccttagtcattttgcagtggaagaaaagatgtcgagcctcctcatgctgacagccacaaagagggcacgtaatatcctgaataggaatgcttcttctggacaaatttcccctagtggggagtctatccaaaaacaacctccaagagattcttaccttgcagacatgaaagccatccccaaacctgatccattgtga

SEQ ID NO: 78850 - DNA, 597 bp, Glycine max
  Peptide Sequence Number=SeqID_170535
atgtaccgaagagacattccggaacagcgtaaggagcagttgattaacgccgccttcgagaccattaacgtcgtcgggctggccggcgtcaccctgtctcaggtggcgaaagaagccgggctgtcgaccggcatcgtcagccactattttggcgataaagaggggctgctgagcgccaccatgcgcaaaatcctgcgcgacctgcgcgatgcggtggccgagtgccgcgcgcaggcggcaagcgacagccagtcacagctgttcgccattatccagggcaacttccaccccagccaaaccaatgccgtgtccatgcgcgcctggctcgacttctgggctgccagcatgcatcagccggtgctgcgccgcctgcagcgcgccaacgatcggcggctctattccaatatttgcagccagttccgccgcgagctgccgctgccgcaggcgcgcgacgcggcgcgcgggctggcggcgatgatcgatgggctctggctgcgcggcagcctggccggcgacgagactgacctgaagcaggactgccgcatcgcctgcgactacgtgatacaacggctcaaggccgcgccatcggcggcgtga

SEQ ID NO: 78851 - DNA, 411 bp, Glycine max
  Peptide Sequence Number=SeqID_170536
atgcgtagtgattggttagtgcaattctccattctcaatcattttcggagccccatgaattgcgttttcgttcatgtgtcctccacccacgagtttggagccattcgtagtgattgcttagtgcaattctcaatcttttttcggagccccatgaattgcgttttcgttcatgtgtcctccacatttgagtttggagccatgcgtagtgattgcttagtgcaattctccattctcaatcattttcggagccccatgaattgcgttttcgttcatgtgtcctccacccacgagtttggagccatgcgtagtgattgcttagtgcaattctccattctcaaccctttttcggagccccatgaattgcgttttcgttcatgtgtcctccacccacgagtttggagccatgcgtag

SEQ ID NO: 78852 - DNA, 315 bp, Glycine max
  Peptide Sequence Number=SeqID_170537
atgtcattgcctatcgctgttcatgtgtcctccaccttcaagtttggagctatgcttcatgattgcctaagtgtggaccctctagtgcaatcctccattctccagtttttttcggagcctcatgaatgtcattgcctagcgctgttcatgtgtcctcacgttcgagtctggagcccctgcgaatgtgattgtctagcgctattcgccaattctccattctccacttctattcggagccccatgaatgtcattgccaagcgttgttcattcatgctccacccaaagagtttggagctatgcttcatgattgcctaa

SEQ ID NO: 78853 - DNA, 1419 bp, Glycine max
  Peptide Sequence Number=SeqID_170538
atggggctgcacatccttgccttcgtagggatacccgtcctcgcctttagaggaccacacgtcctccccttcatagggctacatgccctcactttcagtggactgtgcgtcctcaccttcagagggcttcaccccctcaccttcagaggactgcatcccctcgcctttgtaaggctacacgccctcacctttagaggactacacatcttcggcttcatatggctgcacgccctctgcttcctagggttgcacgccctcgccttcagaggacttcacgtcctccccttcagaggactacacgtcctcggcttcggaggactacatgtcctcaccttcagaggacaacacgtcctcggcttcagagaactacacgttctcaccattagaggactacacgacctcatcttcagaggactacacgtcctcgtcttaagagggccacacgccttcgccttcgtagggctacacaccatcaccttaagaggactacacgccctctccttcagaggactactcgtcctccaattaagaaggctacatcttctcaccttcagaggactacagaggactacacgtcctccccttcagaggactacacgtcttcaccttcagaggattacacgtcctcaccttcagagggccacacgcccttgccttaagaggactacacgtcctcaccataaagggccacaagccctcgccttcgtagggcaacacaccctcacctttagaggacttcatgtcctcgccttcataaggctgcacgccctcgccttcagaggactacgtgtcctcgccttcagaggactacgtgtccttaccttcagaggactacatgtccttaccttcagagggctacacgtcctcagcctcagaggactacacgtcctcaccttcagaggacttcacgtcctaaccttcaaagggctgcatgcccttgccttcaaagaactgcacgtcctcgtctttagagggctgctcgcactcgccttcagaggactgcatgtcctcaccctcagagggctacacgccttcaccttcagaggactacaggtcctcgccgtaagagggctgcacgccctcaccttcagagggctatacgccctcgccttcgtagggctacacgccctcacctatagaggactacacgtcctcgccttcataggactacattctctcacctttagaggactacacgtcctcacctttagagtgctacacgcccttgcctttagaggagagcccgtcctcgccttcgtaggactacacgccctcaccttgagaggactacacatcctcgccatcagagggctacatgccctcgccatcagaggtctgcacgtcctcgccttcgtagggctacacgccctcaactttagaggactgcacgtcctcacctttagagggctacacgccctc

SEQ ID NO: 78854 - DNA, 690 bp, Glycine max
  Peptide Sequence Number=SeqID_170539
atggacgttgataagatccttccatctagcagcaccttaggatggcatagccttaaagttaagggcgaggttcaaacgaagaaaggcttatggtggatacctaggcacccagagacgaggaagggcgtagtaagcgacgaaatgcttcggggagttgaaaataagcgtagatccggggattcccgatataggtcaacctttcgaactgctgctgaatccacgggcaggcaagagacaacctgcctaaaccgtgaaaacggggttgtgggagagctatacaagtgtcgtgctgctaggcgaagcagcagagaatgctgcaccctagatggcgagagtccagtagccgaaagcatcactagcttacgctctgacccgagtagcatggggcacgtggaatcccgtgtgaatcagcaaggaccaccttgcaaggctaaatactcctgggtgaccgatagtgaagtagtaccaatgagccggcgactcataggcagtggcttggttagggaaaccaccggagccgtagcgaaagcgagtcttcacagggcaattgtcactgcttatggacccgaacctgggtccgaaccgactgatgttgaagaatcagcggatgagttgtggttaggggtgaaatgccactcgaacccagagctagctggttctccccgaaatgcgttgaggcgcagcagttga

SEQ ID NO: 78855 - DNA, 486 bp, Glycine max
  Peptide Sequence Number=SeqID_170540
atgtgggcctttcatactggccgacaaattgattgggcacatctagtccggtatcgcatgcataaggcattgcgattaaatgctcatttacccaatccacacttagttactttgttccttcaacattttaacttccctctggattctgaactatatgttccaatcaagagatctttcttgatcggtgctgcggtggttgcctcctttggttaccgcaaagagcgtgatggctcttgggtaaaaaagggtgctcaaccaaatgatgatgggggacacttatcggttgaaggggactcttctctccttcagagtattttggacaggtttgatggacttcaaacctatgttggtgagaggtttgactctttggaacgtcaagtggacacacgattcgaggagatgaactcaaggattgcaaaggttgaagaagatgtcaccaccattcgcgactaccttgatttacctccaccaccaccatcagtttag

SEQ ID NO: 78856 - DNA, 518 bp, Glycine max
  Peptide Sequence Number=SeqID_170541
gagtagaatcgtctcaggccacggtcagaagtcaagacaagtcaatggcagaaatcaaccaagggacggatccaaatggggctagggtcacgaccgaccgatcgttgccccttcccagcgctaaacaagtagagaacgtcgctgcagggcagcccagttcaagtgggcaaacgctaacccataaggaaggaggagacatggttaatgttcccctcaaaaacaaaaatggcaggcttgcggttcttgcttcctcaagccacttttggttgccttttgctttcatttttggtgttattgttcactccaacaagaaatggccccaaggaaacttgcctcaaaaagatccaggaaggataaagcggccgaaggaaccagttccgctcccgagtatgacagtcaccgctttaggagcgctgaacaccagcagcgctttgaggccatcaagggatggtcatttctccgggagcgacgcgtccagctcagggacgatgagtatactgatttccaggaggagatag

SEQ ID NO: 78857 - DNA, 390 bp, Glycine max
  Peptide Sequence Number=SeqID_170542
atgtgggatgctaccgtgttcggggtgtttaatcaagacttcccgttgtacataaagcacgaagatctgtctgaaattgcacactgtagtcaatgtctcagcatatctgttatacagttatggattctcgcacactggcaaatggtcgtcattttacctaaggaaaatcttgttgtctggttttgttccttgcataacaggctagacaactaccttaaaggaatacttaacagtgctttgaaaggacttgatggtactccacaacctaaatccaaggctggtgctaggtggatttattttaatgatgttagaccattggaagcagagagattgaaggcgcttcgcatccagtgtgcacactattatctcaaagttagaaatcaaacttag

SEQ ID NO: 78858 - DNA, 484 bp, Glycine max
  Peptide Sequence Number=SeqID_170543
atcatggttaggactagaggattaggtcgtgccttaggtcaggtcactggcagaggtctgggcagaggagatcgtgatgattccgatgatgctccgcagcgtcgacggcctactgcatccgcacagaggcaacgagtcgctgtgactgtggatcacgtcgatgagctagtcatccctgcgccagatgttcaggatgacccgatggaggcaccagctgttggatttccgggtggtccgagcgacccatccgtgttgacagcgtatgcggatcacgttgcttgcagcgtatggacgggagaggagcgtcctgaattgaagctatcctctcatgggaggaaggtccacagtttaggcaggcatgtccctgccattgagggacttattgctggtacaggactaagtcctctgatcgcgtgttcggtagacaccggcgatcggggacttttgtccgcgtttgtggagcggtggcaccgggagacgacta

SEQ ID NO: 78859 - DNA, 948 bp, Glycine max
  Peptide Sequence Number=SeqID_170544
atgggaacaaatcaaaccggcaagaggttctaccaagtcaaggtcaaaagcccagataccaccagcatcaaggaattagggcggttgatggaacccctccaaatgcaagccttccgcaagacttacggaaagatcttagagttgaccatagcagaggtatccatagaagccattgcatcacttacccaatactacgaccagcctttgagatgcttcacattcggggacttccaattagtaccaaccattgaagaatttgaggaacttctaggatgtcctctcgggggaagaaagccatatctttcctccgggtgtctcccctctctgagcagaattgcaactgtggtcaaggattcagcaagaggtttggaccgcataaaacaaactcggaacggcatagcgggcctaccacagaagtacctagaagacaaggcgagggacctagcagcaattgacgctttccttgcctaccaccatagcaaggaaagtccggtggtagctgtcttggcagatctatttgacacatttgaccgaaggtgtgaaaagagtagcgcacggatcatctgttgcttacccgccctctgtgtttggttggtttcacacttgttccaacaagacacaagacatccatgtccgctcctgagccatcgctcgtgtactgaaaagaggagaatagattgggaccagctcttggccgggataggaggtagaacaatcagttggttcccccgatggaaggaaggaaaagaaggagtccttttctcatgtggaagatacccaaacattccgctggtaggaacgaggggttgtattaactacaatcccgcgctcgctataagacaactagggtaccccatgaggggagcaccgacggaagaaagcatgtctcctttccttgtgagggatctcggcgcacaaaaattccaagactatacaaagaatccataa

SEQ ID NO: 78860 - DNA, 1065 bp, Glycine max
  Peptide Sequence Number=SeqID_170545
atggccggcagcgttaggcctgaaggacgagcgccgcgatcgggctcacatcttctacatgggcataacattggcgcgatgacgcccggtgctgaccgagtacctggccgcaagtctcggtaccgatgccatgccgtcctacaaggtcgtgtcatcgcttcgggcgtgggcatgctgatctcgctggtgtggttctacatcggtcgcgccggcctgaagggcatcggtgcaccgccggccggcgctgaaggcttcggccgcatcatcatggtgctggccggtgccgtggtcgccatcccggtcgcgtacttcctgctggccaccggcgccaccgcgctggcctggatcctgggtgcgatgttcaccgcgctggccatcctgctgctggtcgagggcatccgcgagggcaaggtgcagcgcgaccgcgtgatcgccatgctgatcatcttcgccttcaacgtgatgttctggatgttcttcgaacaggccggcagctcgtttaccttcctggccgagaacatcgtcaaccgccagttcggtgaatggacgttcccgaccgcgtggttccagtcggtcaactcggtggccatcatcaccctggccccgatcatcgcctggatctgggtggccatgggccgcgccaatccgtccatcccgcgcaagttcggcctgggcctgctgttcaatggcgccgccttcgccctgctgatgtacgcgctgtcgcagatggtcgtggacggcaagatcccgttctggaccctgttcatggtctacgtcatccagtccgtgggtgagctgtgcctgtcgccgatcggcctgtcgatggtgaccaagctggccccggtgcgcctggtcggcttcggcatgggtggctggttcctgtccaccggcatcggaaacaacctgtcgggcatcttcgccggcgtggtcagtggtgaaggcggcatgacggtcgagtcggccctgaaggggtataccttcgggttctgggccctgatcggctccggcgtggtgctgttcctgatcgccccgctgatcaacaagctgatgcacggcgtcaagtaa

SEQ ID NO: 78861 - DNA, 315 bp, Glycine max
  Peptide Sequence Number=SeqID_170546
cttggagggattgatggggacccggtgctgagaggaacgaggataagggctacgtgggagtacgtgagctcagttgaaggtgggcaactgaggatagtggattcatgtgtgatttgtggatgtggagagatgatttataccatcgcccgatcgccacctagtaccacatatgacggtggtacctggagatatgtcacgggggtcaggagaccttggggacgtcaggcgagctcctggcagtcaaccaataaaagaataaagaccacaaagcaaggaggcttgtgtggtggctggccagctatggatcttgagtga

SEQ ID NO: 78862 - DNA, 444 bp, Glycine max
  Peptide Sequence Number=SeqID_170547
atggcgttggaccttaaaaatggcattttaggtgatgataaaagtttgctttatgaattgattttagccttaggtgataaaagtttcactttgtttgatttcgggaacttaccggttgaagaccgaagaacgacgaagaacggcggaaaatctttgcaaaatcacccacggaaacatctcggaagcgttacggaagtgtctcggcttggattttcttcacagaaacaatttttctcactaattttaagtgattctcagataccaggagggttgaacatttttgttcagctctccccccctatttataggaaaaagagggagaagcttgccacccaactcgcccaggtgagctgggttgcttcctccagaaggcaccgccttctggtgggacttcctggaaggcccaagtgggccagattgctatttgtaccccccgtttactaa

SEQ ID NO: 78863 - DNA, 654 bp, Glycine max
  Peptide Sequence Number=SeqID_170548
atgttggttaccttagctgatagggagtcaacttcggttgcaactctttcgctggacgcggaggggtatacttccacggaacggccttattactttgatatgcaatatggcgttggcttgggggccgtccgggggtatatgggtgtggagccggtccctttcctagtaaaggatatcactagggccttggggctgcccgcaatccatgagccgctgaagcaattcttccaccacgggacaggtttctatgtcatgcgactccccgagcgtctagaagtaaccacctctcctaacctctttgcccgcgatggcccgtccttttcgatggcgagtcaatattgtgtccgggaactccactatggtacacacacttggcacccgggtcataccacttggggtagggtggctggagaaccttcccaggtcgtgccgggggctgtattattaacaggccggggtgtggctggagctgagcgttgggccaacgctctttctgctgcgggagctttggatattttggggtgctttcatccatgttggggcggtggtgaccgcgtgggcatctccttccttcttcctcgcgcccactactggggctcttctgttgttgttgggggccatattggcagcatattcgaacttgccttttcgtag

SEQ ID NO: 78864 - DNA, 381 bp, Glycine max
  Peptide Sequence Number=SeqID_170549
atggtgagctttgctacaatttccgaaataagagtttcaaaggcaacaagtcaagaggaggatcttctccatagaggtacaaagaagattaaggaaggtgcaaaggtatatatgaagggatcctctatgtcctttgcagataaacttcttcaacctatgggacggggtgacatgtctatcgagacggctatgaatttgcataaggatgtgatgaatgaagttcctaaggagaaagaagtattggaactcacgagaaggatggtccgatcatccctttgtctaatgttagttgtgaacgtatggggggagacaggtgaacttccatattattggagaaaaggttcaacgttaatgggcaagaagtggtactattcagattag

SEQ ID NO: 78865 - DNA, 1084 bp, Glycine max
  Peptide Sequence Number=SeqID_170550
atggcggtcgggactattttatgtttacggtctcagtggaggcctttgtcactttcacatacggattggttgttgaggctaaatgtgaggggtgcctatgatccctcttcaggtactgctgcatgcggaggtatactcagagactaccgtgatagattcgtgcttgggttttcgattgcaaggaagtatgatatttggggtatttatcatggtatgaagattgcaaggaggtatgaaatttgggatttatatcgtgatattctatggcagcatagcattcgaaaaagtcctaagattgcaaggcagcatgattttggtaaaattgtagtgggatcgggctctgaggaagccattgggtttgtgttagatggatgccctacatctacatcggtgcagcattgtttcccactctgtcatgagttgaaagctctaacctctgctactaatcacttatacttctttctcacaccgcacgatgcggctgctgattccttcgccgaattcggtttatccatgaaacagcaggccgccctctccattgaacaaaacatggagcactcagatacacctcacatattagctataccctttccagcagaaggacacatcaaacccatgtttaatttagccaaacttctttcccatagaagccacagaatcaccttcgtgaacacacatcacaaccacaatcgcctcctccaattcacagatttaccctcattccacactcaatttcccgatttccactttgcatccatcactgatggcataccctctgacaatcctagaaaaggtgccctaataaactaccttccaatgcttatcactcctagcgccagatccttagttgccaaagagttccgagaattgttctcaagacttctcgagaaaaatggtgatcagtggcagcaaccatcttgcatcatagttgatggactcatgtcaacgattgtcatgggagttgcactagagtttaggattccagtgattgctttccgaacctacagtgctacttgcacttgggtcacaatcttcatgagcaaacttgccaaggagggagcacaactgcttcggagtaatcaag

SEQ ID NO: 78866 - DNA, 1738 bp, Glycine max
  Peptide Sequence Number=SeqID_170551
atgaacatcaacttaacaagtaagcaacaaggaatttcaatcatacagtcttggctcatgggaaagaaggttctcttgattctagatgatgttgacatacacaagcaattacaagcaattgctggaagacctgattggtttggaccgaacagcaaaatcatcatcacaactgggaacaaacagttgctagcatctcatgaagttaataaaacatatgaggtaaaggaattgaatgtgaatgatgctcttcagttgcttacatggcaagcttttaaaaaggaaaaagcttgtccaacttatgtgaaggtcatgaaacgtgcagtgacttatgcttctggtcttccattggcgttggaagtaatagaagaagagaagaatatttttcttgacatagcttgttacttcaaaggatggaaagtgacagaggttgaacatatactttgtggacattatgatgactgcatgaaacatcatattggggtgttggttgaaaaatctctcatagagtttagttgggatggtgtagttaacatgcatgacttgattcaggacatgggcaggcgaatagacgaacaagaatcctcaaaagagccagggaagaacttgccatatgcaagttacctcaaagttgcattacgtcatttgggttccatggctcaaggaaggcaaaagttcaggaatctaaaggttttgaattttgacgattgtgaatttttaacagagataggtgacgtatctgatctcccaaatttggaaaaactttcatttgatcgcaagcttaccacatttccacctctcaacttgacctctcttgaaatacttgaactttcacaatgttccagtcttgagaattttccagaaatattaggagagatgaaaaacttattgtaccttgaattggttaaccttggcttaaaagaattgccagtttcatttcaaaatcttgttggactcaaaactttatccctgcgtgattgtggaattcttttgttaccaagtaacattgtcatgatgcctaaattggattttttggacgcttcaagttgtaaggggctgcaatgggtgaaatcaaaagagggtgaagaaaaacttgatcatgtggtgactttaaacctaaggaacaataatttcacattccttcctgaatgcatcaaagaattgcaatttttaagaatacttgaggtgggtggttgcttgcatcttcaggaaattaggggggttccaccattcttaacatatttcacggcaagagaatgtatatccttgtcttcctcgagttcaaggatgttgtcaaatcaggaattgcatgaggctggacaaactaagttttggtttccaggagcaactattccagagtggttcaataaccaaagtaggggaccttcaagttctttctggtttcgtaatgaattccctgtcaatgttctttgtcttcttctagcacgtgtggaacgcatagatgtagatgatattttcatgcctgcggtgttcatcaatggcaaacttcataaaaatccctctcggggcactaaagtaggaaaggtgaaattggattatacatatctatttgacctaaaatcagctttggagcttaatgatatatatgaagtggctttagaaaaggaacggaaccaggtggaaattacatacgcaggtctgatagagacctcactggttaaagcaaccggaacccatgtactcagacaggatgatattcgatatgatgatccttattatg

SEQ ID NO: 78867 - DNA, 699 bp, Glycine max
  Peptide Sequence Number=SeqID_170552
atgactccaccaatcggtgtgatcaacgtgtttttggttcccgatgacttcaaagttgattcctccactggggatgatgatcatggaatgtgggaggtgatcaacaacctcaacggaagaggacccaagcagaaaatgaggaatggacgggggaggtttgccatagactgtttgataagcacagagatattgttcgaatattcgattaaggacttccgtttgcccgtcaattttaggatgataagcagtgctcatgcaaagctaggtgcccttgagtttgaaaagttcacaccaaaatttgctaatgaaaaatggggtcacaataaaaaactaagctataggcattccgtgatgtttgcaaaccagctcaaggaaagtttaagcaaccttaaaagtgtcgagaaagagaacctcccacacagcaactggaactgtgcattgatgcacaaaatccctgacattgttagaaacaaaccaaggtttggcaacacccatgtgtcccgcgataggtctttgatggaattcctacaacaaagtggtcctgaaatgtggtgtatgatcaatccatatgcggcccttgaagatgacaagcctttgatgaactcggtaatcccgataatcggtgggttagggattgatattttgaagtggaattcctcactagagcacaagcttcattgtagttcatccaaaaagtga

SEQ ID NO: 78868 - DNA, 522 bp, Glycine max
  Peptide Sequence Number=SeqID_170553
atggtgtcgtttttaaacattttttcaggggtgctatttttgcacgtactcagcatgcaagttgcaagtgggagtgacgatttagggcagaagtggacacgtggcatgcaacgcgccagttggagtggcgacttcgtgcatgatcgacacgtggcaagggctaggggacacgccaggctcattggcgattttcgcctgccacactggaagcgccagattgattggcgatttgagcctgctatgtcatgtctcgtcggagcagtgcaacagcttaggagcagtgcagtgcagaatctacaggtttgcagcagaaatcgcaaacgccataaattggccaagaggttcacttaccatgcacataaagtggaagggaagcagggagtagtagtttgtcccaggaccgggacacatgaaataacctactccttgcttgcacggccaagtgctaagtgccaaatgcgaatacatgctaagtaccaaatatgtaggatacttaggatccgttcgtttgagttaaaatag

SEQ ID NO: 78869 - DNA, 528 bp, Glycine max
  Peptide Sequence Number=SeqID_170554
atggagcactcaaatgcacctcacatattggttttaccttttccagcagaaggccacatcaaacctatgtttaacctagccaaacttctttcccttaaaggacacaaaatcacctttgtcaacacacatcacaaccacaatcgtctcatccaatttacagacttaccctcattccacacccaattccccggtttccactttgcgtccatcaccgatggcgtggccgacaaccttcctcagaacgagttcgaacacatgatctctccgaccagcaggtccgaggttgccggagagttccgaggtttattgtcgaggcttgttgtcgagaaacctcgtcagtgggacccacctccttcttgtgtaataatagctgatgggttgatgtcaacggtttctatggacgttgctaaagagttcggggttccgctgatcgcttttagaacctacagtgccacggccacgtgggtctcaattcacgttagcaaaattgttcaggagggagtcatggatctgcaaaatccgggttag

SEQ ID NO: 78870 - DNA, 324 bp, Glycine max
  Peptide Sequence Number=SeqID_170555
atgggtttgaagatagaaagattgaagaacatcttcatcaatcttgagatggtggtggtggtggaggctttactactaagttatcaaaaagtaaagaacaaaaacaataacttagacaaaagtaaagtggaaataaaaagtgcacagcggaaaagtaaggagcatagggaagaagaaagcaaacacaagttttatactagttcgacaacgacccgtgcctacatccagtcctcaagcaacctcttgagatttcctttccttgtaaaaatcctttacaatcaaagagccacaaaggatgtaccctcccttgttctctttgaataa

SEQ ID NO: 78871 - DNA, 132 bp, Glycine max
  Peptide Sequence Number=SeqID_170556
atggtggttctgaaacatctaattgtgagtgcatgttttcggaaggaaggggagttcaaagaagaagaagaagaagatgatgacaaggtcaacgaggtggtgatgaccattgtagttgtacagaacatttaa

SEQ ID NO: 78872 - DNA, 306 bp, Glycine max
  Peptide Sequence Number=SeqID_170557
atggaggaagttagagaagttattgaagcagaaggatcttttaccctacaaacattgaaaactttcaaactgggttgggatgcaaaccttcaagatgaagttaatggttctcttcttgatagtaaaataagaggagagttcatagctaagtccatcagagttgtttttgaacccattttaactgttgagtttggcaatgagatcatggatgaattattctcaaggtttgcaactaagatttcacaactcatagagttcgaagcattggagtatacaaacttggtcatgtccatgggaaaagcataa

SEQ ID NO: 78873 - DNA, 777 bp, Glycine max
  Peptide Sequence Number=SeqID_170558
atgggtcaaattaggatgactaaccctttcaagcgcactggtcgtgcttcttcacctcgacttcttcatcgcgacactgagggagttgatgcctcatgtgagatgaggaagaaaatcgtagatccctcctttgtctccgatgaatctcacacaggactagtcgaggacacaccgtcgaactcccccaatcacgtcatcctcatcagtgccccgctgccgctgccgacagtgaggcctccacggcttagggggcgctactcaaggatcaatggtgacaatgagagggtggagcaatggcttgaagtagtgtcgtgggagctgagagcttttgtttatcacaattttctgtcttcacttcttccaaaatgtggccttctacatagaccttggttagattctagtggttctgagaatgttcctctagagcttcatgatatgtctggaggggtagatgcttttgaactctgtgctaagttctactatgaagtgatgcaatcctaccccgcaagggcattggatagaagactccaagtagattgggccagagatccaagggaaggccctatggttcttatgagccttaggctaagctctagcttctttaggaatcttttcaaggaagcttctcaaggagcatcatctccaagcttcttatccaaggctcatcttggtggtgaagctcctttttccatggcttattccctaatggatggtgcctcctctcacctcttctcctttgtcttccgctgcatctccatggtggaaaaccaccattag

SEQ ID NO: 78874 - DNA, 591 bp, Glycine max
  Peptide Sequence Number=SeqID_170559
atgcttgtgcaaatgaaaggaactttctacctgaagctggtgaaagttttctatacttgtgcccgtgccgatatggaaggtaatctgttttctactattaatggcgtagaaatggttatcaatgctttagtttggaaagtagtagtcggactggacatggctagaattcgcaagtttgaagaatctgttgatggttacaacaagatgcagacttacagaggtatgctccttgacccagcaaggaatttgagaaatttcctaggtgtaggtagtttaactactgaaaatagaatgctcatgtaccttataacctacattctcacactaaggtccatcaaccatgcacaagtgactaacgatgatttaaagatcatgtatggtctaaaatcagcctgtagattcattgattattttaatatcgatgtttctaataagatcgtagacttcaccaaagcatttaatgaggtaaccgaaaggcatctcaagaagcttaggatgaggttttttgaacacaaatggatcatggctagagagccaccagcagcagcaaacatggaccaaatggaagaagaagcgaaagatgaattttag

SEQ ID NO: 78875 - DNA, 557 bp, Glycine max
  Peptide Sequence Number=SeqID_170560
atggcactaagaggcgctaagcaaagtggcatccttggaggtggagtggagagccttaagatagccagtgccaccgttgccttcgctgaagctgtgaagtcgaaccatcagttgtcgtctaagggggataaaaatgagttagctgaaaaggtggaaaaggataagcttgccaaggtggtggtggacctcgaggctcgactgaaggagtcgaagtccaggctggaggagtctgagctgtgggtgggagaaaccggccaaaaacacgaaaataggagtgtatttagcaaagtgaggacgtttcagaaagaaaacaaccaaaaacacaaaagcaagggtgaacttatcaaacacgagggggttgtttcaaaaatgttcatgatccctaggctatgcatttcagctattttggatgaaaaaatgtgtttctgtgaagaaaatccaagccgagatgctaccgtaacgcttccgagacatttccgtgagcaaatccatgaagattttccgccgttcttcaccgttcttcgtccattcttcgttcattcttcggtcttcaactg

SEQ ID NO: 78876 - DNA, 315 bp, Glycine max
  Peptide Sequence Number=SeqID_170561
atggcatacgggaggtcgtacctacatataaggtgtttccaggtgaatttttccacctcattggccgtaatttctcatagtggtcttgcctcgatcttcttggtgaagtacttgatggcaattagtagatatttgactgctccaagagcattttacagtggttccatcaagggtattggccctgagtgccagctattactagtcggcacgcaccaccttggttgcaaaggagcgtcccccagtatggagaccacagatcccttcgtaaagctctcacgtgacataatttgcctattggctgttcaggcatcttaa

SEQ ID NO: 78877 - DNA, 50 bp, Glycine max
  Peptide Sequence Number=SeqID_170562
atggcacctacacctcgcacacacgttgagatattaggccctatacccgg

SEQ ID NO: 78878 - DNA, 157 bp, Glycine max
  Peptide Sequence Number=SeqID_170563
atgagggaggtctatggacgactagaagctttggagaaccaagccaatcagaatgttagacgaaatatagatgggaatagaggtaacaatggcggtaatgacggatcgaggcataaccgggttgagggagtaaagctcaatgttcctcccttcaaag

SEQ ID NO: 78879 - DNA, 393 bp, Glycine max
  Peptide Sequence Number=SeqID_170564
atgaccacagattcacctccacttcctatgttcccgtggactcggttcccagtggagtcaccagttgtcgcaacctacccttctacgggaaggcaacgtgagactcacgggtgcgtcttccaaggaaggaaaatgcgcagggtcaccaccaacgtttatttgaggaaaatgttagaaaaaccaaaagggggtctacgaattttaagaataaaaggttcgggagttgtttacgtgtggggaaggtttcagcacaaacaattggttgaattttacttttacaattgttggaacctgcccttcttcggcgggggcgcaaaaaggccacttggatgggccaagggtgcatcttccattaaaggaaaacgcgtggagtctccaccaatgtttatttga

SEQ ID NO: 78880 - DNA, 195 bp, Glycine max
  Peptide Sequence Number=SeqID_170565
atgttggtcaatgcctatgacacattgaccgaagatgcgagaagagtggagcaaggattgtctgtggcacacccgctttgtatgtatggctggcttctcacatttttcgccatgaaagtagacatgcatgtcccctacaaggtcaccgcatgtgtgccgagaaagggaaagcaaattgggagcagctcttggctg

SEQ ID NO: 78881 - DNA, 321 bp, Glycine max
  Peptide Sequence Number=SeqID_170566
atggactatggagagatcgtgatggccttaatcaaacttgaaagttcaaaccctaaggtggcgcttggttccctcgttttctattttcattttcgcttccatctctttcctttcccacatatctccgctcaatctatcaccgtttccaacaatcttctcctctttgctgctagcctgctaccacatgtgtacccctcgaatctccccaataattggtatcagagccgatggttcaagttggtgaccggctcagacgagtatgcaggtggccatgactatactcgagggggagactaccatgtggaagagactcacacttga

SEQ ID NO: 78882 - DNA, 126 bp, Glycine max
  Peptide Sequence Number=SeqID_170567
atggagatgcaacggaagataaaggagaagagcctagtgtcataccctaatttcgtccggggacctttgctcgatgacgtgcgaccattctttggtcctcgtgaggtgcttggcacccatcattag

SEQ ID NO: 78883 - DNA, 420 bp, Glycine max
  Peptide Sequence Number=SeqID_170568
atggctccattgtcgtcactccaaaatggtcaaggtggcccttgggtactagtacctatcttctttagaggacttcacgtcctcgccttcagaggacttcacgtcctcaccttcagagggctacgcgccctcgcctttagagggctacacgccctcgccatcagaggactacacgacctcaccttcagaggactacatgtcctcaccttcagaggactacacgtcctcgccttcgcctttttagggctacatgccctcaccttcagagaactacacgtcctcaccttcagagaactacacgtcctcaccttcagaggacttcacgtcctcaccttcagagggttacacaccctcatcttcatagggctacacgccctcaccttcagaggactacatgtcctcaccttcagaggacttcac

SEQ ID NO: 78884 - DNA, 213 bp, Glycine max
  Peptide Sequence Number=SeqID_170569
atgggttgccaactgtcgcaacctacccttcggtgggagggcgacgtgagggctcacgggtgcgccttccaagaaagaaaaatgcacggagtcgccaccaacgtttattcgaggaaaatgtcggaaaaaccggaaaggtgtggtctacgaactttaatcgtgaaaggttcgggagttgtatttatgcacggggaaggcgaggaaatgacttaa

SEQ ID NO: 78885 - DNA, 330 bp, Glycine max
  Peptide Sequence Number=SeqID_170570
atgactaaccgcctgagaattcttttgattcttcccttccccttaagtaaaacatttcaaaggactaaccacctgagatatcttttgtttccccttacaaagattcaaaggactaaccgcctaagaattctttgtcccaacacattggagggtacatcctttgtgaacaagaaagggtacatctcttgtggatcagttcaagtggagggtatatccacttggtttttcaaagagaacaagggagggtacatcccgtttgcttggggactggatgtaggaacggttgaaagaaatctcaagaaccgcaggttgcttgggtactggatgtag

SEQ ID NO: 78886 - DNA, 592 bp, Glycine max
  Peptide Sequence Number=SeqID_170571
aggactacacgtcctcaccttcagagggctacacgcgctcgcctttagagggctacatgccctcgccttcagaggactacacatccacgccatcagagggttgcgtagcctcaccttcagagggctacacgccctctccttcagagggctacacgccctcgccttcagaggactacatgtcctcacctttagagggctacacgtactcgccttcagagggccacatgtcgtcgccttcagaggactacacgtcctgaccttcagaggactacacacctcgccatcagagaactacacgtcctcaacttcagagggctacacgtcctctcctttagagggctacacgccctcgccttcagaggactacacatcatcaccttcagaggactacacgttccgactttcagaggactacacatcctcaacttcagaggactacacatgcacgacttcggagggctacacgtcctcaccttcagagggctgcatgccctcaccttcaaaggactgcacatcctcacctttaaaggactacacgtcctcaccttcagagaactacacgttcccacttttagaggactacacgtcctaa

SEQ ID NO: 78887 - DNA, 436 bp, Glycine max
  Peptide Sequence Number=SeqID_170572
atggcccgcaccaaaaaaattggtcagatgatgtctaaggcagcaaaggaaattgctgagaagattgattcgttggaggagcaagcgtcacagggttcgttcatcccccatggatgtcaggatgtcctgactgctgccattgggcgaccagaacaccctggtcgtgtgcatgctactagagccagtgtgaccattaagcaatactttggaccggctcaacggacctctcacacttcttcctccatcgctcccgaagaactagagcaactgactcaacaaatcagggaccagctggaggaccagatgcaatctcagttccagtcacagatgcaatcacatggacttgcacagcctccggagcttgaggttggtccctcagctgctcatgtcagcacaaaggggagttgtgttgatccctcaacgaccgatccagacg

SEQ ID NO: 78888 - DNA, 129 bp, Glycine max
  Peptide Sequence Number=SeqID_170573
atgacgtatgtgttgacacccagggttttccaggaacgtccagagttgaagttgtcctctcatggaaggaagatacaaaaacttggaaggcctgctccagagattgaaggcatagtggctgtgacatga

SEQ ID NO: 78889 - DNA, 180 bp, Glycine max
  Peptide Sequence Number=SeqID_170574
atgaaacgatgtccgttcgaagccttgggctcaatagccccaatcacatctattccttacatggagaatggccaaggcgctgccaagatgttcaaaggaacaggtggagcattgacattatccacaaacgtctggcatttgtggcattttcttacatggataccacaatcattttccatg

SEQ ID NO: 78890 - DNA, 375 bp, Glycine max
  Peptide Sequence Number=SeqID_170575
atggcagcgcaattaatccatgaccgagtggagatggagtgcctagagggagtttgggagaccctcgaaggcaatgtgaggtgccgatttcggggcatgattcgattcacggctacttcattgcacactgtggagtggatattacctacacctactccatatcgactagtggagccagtccaagtgatagaggtgacgtcatctgaggaagaccctgaggaggacccagaggagctacctcctgagcctgttgtggatgctcttgactttctagagggtgatgaggacccactccctgaggtggattctcccgaggacgtcatgtcggcatctgaggcagactctacggaggagagcggtcctggagagggatag

SEQ ID NO: 78891 - DNA, 234 bp, Glycine max
  Peptide Sequence Number=SeqID_170576
atgccagccgacgtcggccaggaaaagatgacagatcgaggtctcaaaaagaagcatgaccggatgactccgatcgaacatttccaaatcgacatcgtccaaaggaagctttttttgttcggtatcgcctataaaatttgcaatgtagttcggctaggtttcttcgtgcgagctcaaccgaagttgtatttcggccgacaccggcattttgtcgttatgccaggaaaacattaa

SEQ ID NO: 78892 - DNA, 276 bp, Glycine max
  Peptide Sequence Number=SeqID_170577
atgtttggcaccctttgttgcacaatatgtgaagtcccgagacgtgccgaaaatcaaaaggaagcaggcttacgcgatccattcttcctccagaaggctgttgcttctggaggaagcaaccttgctcgcctgggcgagctaggtggcaagctcctccactacttcgctataaatagggggaggagtgaagggagaaggggttcagccttcttggcacttcttattctctcgaaattgctgaggaaaattatttccgtgaagaaaatccaagccgag

SEQ ID NO: 78893 - DNA, 483 bp, Glycine max
  Peptide Sequence Number=SeqID_170578
atgtttgtcgacccagacaatacaaacgcagctacattgggtgaagttgtggagactttacactatatggtgtcaccacaagggaggaacacatggacagttgatgatctcgtgccttacgtggaaaagttagcgattatatccgaagagcaagagagaatcactgagccagtgtcacatggtccagcatcagatcgtgaattcccagcacaagagtttcacattcttcggtcaagtgttgaaactcagagcataggcagacgaagggagcctgttgaagcggaagaatattcccaacaaatgatggagcgtggtcatggaatgtattacacgccagcaacattttcccaatatccttcacagatgtatcagtatccttttgaaggtcatcacactgatacttctgcgagcgaacattcttttggtggtgttgcggaaacacaacctcatttttcatggcccactatcactccttcgcagtaa

SEQ ID NO: 78894 - DNA, 153 bp, Glycine max
  Peptide Sequence Number=SeqID_170579
atgaatgaagagtcattttgggtgatggtcagcaccacaccaacttgggtgagtctaggggcaagtgaaaaggtactaacaggtgctaggcccatgatcagatcgatcaccacccagcatccggctaaagacgttaaagaagcactcctatga

SEQ ID NO: 78895 - DNA, 996 bp, Glycine max
  Peptide Sequence Number=SeqID_170580
atgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttccaaacagttgcgcagcctga

SEQ ID NO: 78896 - DNA, 910 bp, Glycine max
  Peptide Sequence Number=SeqID_170581
cggcaagctttttcgcaaagcttacagtaaaatctgggacctagccatggtagaagtctccacagaggctattgcctccctcgcccagtattatgatcagccgttgaggtgcttcacctttggggacttccagctattgcccatggtagaagaatttgaagagatcttaggatgccctctagggggaaggaaaccatacctcttctcagggttttatccctcattagctagaatttctaagatagtccaaatctcggtgcaggaattagaccatagaaagcaattcgaaaatggggtggttggaataccgagaagatatttggagggaaaagcaagaattttggcaggtaaaggcgaatgggccctgttcatagacattctcgcactgttgatcttcggaggagtcctctttccgaatgtggatgggttggtggacctagcagcgatcgacgcttttctcgcctatcataaccatagggaaagcccggttgttgctatgctagccgacctatatgacacttcgaccgaagatgtgagaagagcagtacgaggattgtttgttgtactccagctctttatgtatggaagaactggagttcttatttcatgcggaggattttcgaatgttcccttgatggggacaaggggttgcaacagttacaatcccgtcattgctataagacaacttggctacccaatgagaggggcaccgctagaggaagagatcgcgcctttcatttcacgaggtttcgataagaccaacgtggagacgcttcagaagtggttgaaagcccacgtgcaaggtttggattggctcccgagtttgagaatcgctaaaagggaggaagttgaggcaccagaggaagaaacagaggtgcaggaccttagggcagaactcgagcaagcctaa

SEQ ID NO: 78897 - DNA, 997 bp, Glycine max
  Peptide Sequence Number=SeqID_170582
atgtctgacggctggaatattgcgctactgggcgcgacaggcgcagtggggaacgctgtactggaactgctggcggaacgccagttcccggttggtgagttgtatctgctggcgagtgaaaacagcgccggtgaaagcgtgcgttttgacggccgctcgctgcgcgtgcaggacgcggcggaatttgactggtcgcaggcgcagctggcgttctttaccgccggtcgcgaggcgtcggcgcgttatgccgaagaagccgccagccagggttgcctggtaatcgacagcagcgacctgttcgcgctggaggccggacgtgccgctggatgccgttatggctggcagcgccagaatgaagtacgcagcgtgcaggaaaagctggaaaaagcgctggcgaaagtggccaatcacccggtgaacgtgttctgcgccggacgcaccgacgcgggcgtgcacggcaccggccaggtggtgcattttgagaccacctcctcgcgtgccgacagcgcctggacgctgggcgtgaacgccaacctgccggacgatattgcggtgcgctgggtgaaagcggtgccggaaagctttcatgcgcgcttcagcgccaccgcgcgccgttatcgctacgtgatctacaaccagcggttgcgcccggcgattctcggcaacggcattacccatttttaccatccgctggatgcggaaaagatgcaccgcgccgctcaggctttactgggtgagaacgattttacctcgttccgtgcggtgcagtgccagtcgcgcacgccgtggcgcaacgtgatgcatctcaacgtcacgcgcctggggccgtacgtgattgtggatatcaaagccacgccttcgtgcatcacatggtgcgcaatatcgtcggcagtctgctggagattggctgcggcaatcagccggaaacgtggatggccacgctgctggcggcaaaagatcgcacgctggcggcggcaacggcgaaagccgaagggct

SEQ ID NO: 78898 - DNA, 1080 bp, Glycine max
  Peptide Sequence Number=SeqID_170583
atgaggaacgcattcctttcccgtttaatgacaccctgcgtcatgcttgtcatgctgatattctgcagccagcagggatatgtcgtttataaagattataagaaagttacgaataagttagcgaatgctgataagccggcgctaaaaaaacctgatgctgaaaaatcctttgggcttttcaccgccgcagtgcgtcaaagcgacgcgccggccgcggcaaaagcgccactgtcggcagagattgagggcattattcgtagcgatgaatcctggttatcgttcgccgtgatcaagacgcccgccggtcagcagagctaccgggaaggggagccgctggtgggctttgacgatgcctattacgagggggcgaaacagacgctggccctcaataaaccggcgtatttcaagggcggcgttgacagcgccccggttaccaaatcgaaaaaagatgccggcgccgacagcctgcatctcgatgattatctggtgttaaaaccgttaatcgataaaggccaactggaaggctttactattaatccacggaacgcaacgcctttttaccataatgcaggactggaaaaaggcgacgtggtgttgaaagtcaatgacgtcgatatgacgcaagaagcgcaggcgaaaaatatcatcgccaactggtcgaaaatgaaagaagcggatgttgtcgtcagacgtcacgctcaccttgaaaatattcggattaataaatttccgtgggcgtgcgtggcgctgaccgcattgtcgttatattccggttcgctgcttgcagccaactttagcgccagttttaaaaataccgatatccgcgaatttatcgatacggtaagtcgtaatctgaataaaaccatactcgtcgacccgtccgttcagggcaccgtgtcggtgagaacctataacgtgctgtcggaggaggaatattatcagttcttcctgagcgtgctggacctgtatggtctgtcggttattccgatggataacggcatggtcaaagtggtgcgttcaagcgtggcgcgtactgccggtgtaccggtgccgaccagcaaaatccgggcaaggagatga

SEQ ID NO: 78899 - DNA, 141 bp, Glycine max
  Peptide Sequence Number=SeqID_170584
atggagcttttaggcctaggatcttcttcatcaatggattcctttgcttcttggaagatgaatggtagtggaatggagaaggaagagagagagcccactaatccaagatctagtcaaagattctccactaagtgtttctag

SEQ ID NO: 78900 - DNA, 117 bp, Glycine max
  Peptide Sequence Number=SeqID_170585
atggagacagtttccatgattttgaagctgtgtaactcgagtttggcctctggtaatcgattaccaagggatgtaatcgattaccagagaagaaaacccttgaggcagaccttttaa

SEQ ID NO: 78901 - DNA, 249 bp, Glycine max
  Peptide Sequence Number=SeqID_170586
atgacgttggatcaagtgagggtccttttcctcggagacggttcaaatcacatgatcgtcctcggcggaaaacataaaaataaattgcttgtggttggtggtgtttggtgtttgacgcggtgcttgtggttgtgtgggtgtgggtgtttgacgcggtgcttgtggttggtggaggagggtgttgctgagtggtggctggtggtggctagtggttcacggagggggagggtggtgttgagcggtggctag

SEQ ID NO: 78902 - DNA, 507 bp, Glycine max
  Peptide Sequence Number=SeqID_170587
atgttgagtggtgataacctaactaagggcattttttggttagttcggggaactcacaggcctcacttggcattcttgactacaacggagctatatccatggttggtgagagctccatgtcctgtaccaacaagtaacgtgtcctcccaattgtcattcatatgttgcgaccagatgacgagcctagtgttgcatctcccattctatattaatgctattaagaccaagtgggaacatgatgacgtatccatgtggatcacttctctgagttcctatgttgttgtccctatgtcatcctataatcgcttcgtgatgcccgtgcctgaggttgtcattccgtctaagtcgtattcatcatctgccagcattaagatgtcttctactagatctaacttatcatccaaggatattgatgcgacttttccttttctgatgtctccttattcggtgttgcttgagtcttgggtaccactgattgaggccgtactcgaatcaaataaacattaa

SEQ ID NO: 78903 - DNA, 546 bp, Glycine max
  Peptide Sequence Number=SeqID_170588
atgttgagtcctatgaaaaataaaggcgaggacgttaagtcctatggaaacataaaggcgaggacattgagtcctatgaaaggtaaaggcgaggacattgagtcctatggaaacataaaggcgaggatacaaaggacgttgagtcctacaaaaaataaaggtgaggacgttaagtcctatggaaacataaaggcgaggacattgagtcctatgaaaggtgaggacgttgagttctatggaaacataaagacagagggcgttgatcctatgaaaaaaagacagaggacgttgattcctatgaaaaataaaggcgagaatattgagtcctatggaaacataaaggcgaggaagttgagtcctatgatagatagaggcgaggataggacattgagtcctataaaaaataaaggcgaggatgttgagtcctatggaaacataaaggtgaggacattaagtcctatgaaagataaaggcgaggacattgagtcctatggaaacataaaggcgaggacgttgagtcctatgaaacatgccaataggtactag

SEQ ID NO: 78904 - DNA, 177 bp, Glycine max
  Peptide Sequence Number=SeqID_170589
atgactccattgatgaagaagattcagggcctacaagctctacatggagctacatcaaggggggctcacatgaagggaccaatcactagagccatgagcaagaggctccaagaggattgggctagagctgctgaagaaggccctagggttctcatgaacctcagggtagatttctga

SEQ ID NO: 78905 - DNA, 291 bp, Glycine max
  Peptide Sequence Number=SeqID_170590
atggagcatcgatcgagtgtgggcataggggaacacgtagaactacacccgccagtcagggaagcaatcgtcgttatccatcacgcagtggaggtgctcgacggcgtgaagggtccagaaaatgaatgcaaagagaagagaaaatatggttggtgtgcttccaaagagaagaatattgatgcagcatggagagtcacagggaaaccgggacacggcagcatacaccaccacatccgaccacaacattcagttaacgacgcaaggcatggcctaggcccttcgcgccggtga

SEQ ID NO: 78906 - DNA, 549 bp, Glycine max
  Peptide Sequence Number=SeqID_170591
atggaagtgttggtggaagaggatggctctaaaatcgattatagcatagtccttcaacactcgtctgcagggatggtccgaatggttcaaaggaatcttagggaaatgaagagtggtgataacctgactaaggacaatagcgtcaagaaggatttccacttgtgggttagcatctttgagtgtgagaggatcccaccaagagttcttcaccggattctcattgtgggttcactttcgtctggcacgccacctaacctatctcataaaaatgacgatcttggactcattcaccgttggatcgtcatgaaatttgagaaccacgttcgcaacccaattactagcattctcaccgttgggaatttcgatattatgtctgagctaagagaaatacccctcgcattggagaaaaataaatcgcatgatgacagtacaagtggaggcttcaatcccttctctgtctctttgacgtttgggaactctatcggagttagaggaaaaaaattggaggaatctcagggaaccgctagagatgctgctatcgctgactga

SEQ ID NO: 78907 - DNA, 633 bp, Glycine max
  Peptide Sequence Number=SeqID_170592
atggttagaactagaggttttgatcaggctttaggccgagcaataggaaaagtgttggggaggagagacgagagtgatgttgatgcccccagcggtgaaggcctacttcatcaacctggttttccaggcggaccccatgacacatcagttctgagtgattttgaaaatcacattgctttgagagtgtggaatggagaggaacgttctgagttgaagctatcttcccatggaaggaagatggctaagttcgggaggcttgccccagagattgaaggccttgtggtggctagtggactgagtcctttgatcgcttgttcccttgatacgagcgatcagggactaatgtttgcttttgtggaatgttggcataaggaaactagcagtttccatttgcccgtcggagaggtgactatcaccttggatgacgttgcatcgttgctacattttcctattgtaagggcgttccacagcttcgagctacttcatgtcgatgacatcgtcgagatgttggtggaattgcttgtggtcagtgctgcagaggcgagagctgagacgattcagtgtcatggctcttatgttcgattattgtggctgcgcgatgtgtatgagctgaagatcggggcatgtgactag

SEQ ID NO: 78908 - DNA, 270 bp, Glycine max
  Peptide Sequence Number=SeqID_170593
atgggaaacaaccatagggcgaagacgatggcagaggcacttattggcgacgtgacgtggacagagggacaaacaacagcgtttgacgacacgattgtggagaacgcagaagtgaaggacaagagggtggaacatcgaagaatgtcacataaagtaaacaccattgaagagattgatgactctaaagagacttggaaaatggttggggataaaatagttgtatctgtgaagaatatagacaataaaaaatggccaagccaattgaaatag

SEQ ID NO: 78909 - DNA, 363 bp, Glycine max
  Peptide Sequence Number=SeqID_170594
atggatcgcgcccacaaggcacctagtggacccggggaagtccaacagggccctggggtttccagctctggttatgggcctctgttagtcctacagggtgcccgtcccccccagcaagggatcgtgcccgcaagacacccagtggacccggagaagtccaacagggtcttgggttctacggagtgtctgccgcccccagcaaggtcatcaggccccctgctaaccgagctttcatcaagaagtattgcgcccctaggcaggcgcagggcgatacaccacaacagcttggggatggccggcagtgggcaacagatgcaccgccgacacctccagagcacctcagctcatccacaaaaaggttag

SEQ ID NO: 78910 - DNA, 564 bp, Glycine max
  Peptide Sequence Number=SeqID_170595
atgagggtgtgcaaggattcggggtgggaatgggagttctcttggaggagaccgctgtttgataacgaggtaggtatggcaatctcatttctgaatgatgtggacagtatgcagatttatcctcaaagagaagacgcatgggtgtgggaggcagattctagtggtcattattctgcaaaaagcgcttacgacacgatgagggagtttctacatgaagggacagtggacaaggctcatgaagaattgtggaagataaaggcaccaagtaaagtattagtgtttgcctggaggcttcttagggatcgtttacccacaagagcaaaccttcacagacgtcaagtggaagtaaatgactcgaggtggaagagctggtggttagctttgacttggaccatatggcaacagcggaatgcaatactcttctccaatgctactttcaacgccaacaaaatcatggacgatgcagcttttctactttggacatggcttcgcaatctagaaaaggattttgggaccagctttaatcattggtccagcaatctcagtttaggtttcacttgttag

SEQ ID NO: 78911 - DNA, 368 bp, Glycine max
  Peptide Sequence Number=SeqID_170596
atggttgcctttgtttcgaaagctcaatttgcagtggaggagttaaaattatcattggaagccgataaagttgaagacataaaggcgaaacttgataatctatatatggtgttggtactacatgggatgcatccagattttgatcatattcgtgaccaattgacaatattgaaacttctgccatggtatctaatcgacggggacaaggtggtgggggaaaccgaggaggacaagctggaagaggatgtcaccatcaatgttcttactgctgactatcaagagtatctccagctaaaagctgccaaggaatctcaaacatcatctgctataggtggtcataactccactgcctgtatttcccaatctgg

SEQ ID NO: 78912 - DNA, 297 bp, Glycine max
  Peptide Sequence Number=SeqID_170597
atgcaatgcataaaaaagtacatgttgaaagcaccgaagcaaaccaaacatagcaggatactaatgaggagagaatttataagagcactagagagaatgatcaaagcaccaggagaactatattgggattactttattattcaatcactgaataagcacaaaagcgtaatacagagcttgtggctcttcaaggaaaattttttgcctatatggaactcaccaaaaacatgccttcgacccctatacacagtctataatgtcactgatgcaattctaccccccaagggcattggatag

SEQ ID NO: 78913 - DNA, 210 bp, Glycine max
  Peptide Sequence Number=SeqID_170598
atgaatgagttcaagatgttcaagatgtttaagatgttcaagattgaatcaagaacacttcaaggttcaagaggaaatttgattttaagaatcaagattcaaggttcaagcttccaagaatcaagatcaagattcaagactcaagattcaagaatcaagagaagacttaatcaagataagtatgaaaaagatttttcaaaaaatgagtag

SEQ ID NO: 78914 - DNA, 252 bp, Glycine max
  Peptide Sequence Number=SeqID_170599
atggaaacagaaatgattgttggtgctcttgtttatactttcgttcagacgacaattgacagcttggcttctcgttttgtggactactttggtggaagaaaacacaataagaagctgatgatggctgatgatgcagaacaaaaacagtttagagatccacgtgtcagagattggcttcttaaggccaaagatgtcgtcgtgtttgaaacaaaggatctcttggatgaaatagactatgaactctccaaatga

SEQ ID NO: 78915 - DNA, 690 bp, Glycine max
  Peptide Sequence Number=SeqID_170600
atggagagagaaaaaggaatcgcacaaagacaatacatatggaggcttcaatcccttctccgtctctctgacatttgggaactctatcggagtagtcggaagaaaaactggaggaatctcaggaaatcgctagagatgtcgctatcgctgtcggaagacatatcgagtgtatgcgataaattgagtatgcacgtgattgagatgttgtatgcattgagttgtaaactatggattaagggagaggccctgatggactcttcggagtgtaggccttggaggtcacccggtttgagtgctcctttaagcctgtgccgatcccacatggttggagcattctcgcaaaacactatgaccctaattggtctccctatgatattacctaatggtgtcacagtttctcctgatgagagacctagatatcgtaatagaaagggtgatgtctctacaaatgtgttagccgcttgtggttcaaatttaagagtcactggtcatggagctgaaactgctatggatgttaatgaagcgatgagtagaaaaacaaatgaggtggaattcatgggtttaggtgctactgctactatagacttagaagaaccaaactctaatacaaaaggaaaaagacaaggttcaacttcttctgtcacacacacattctcacaagagaaagatgggagaaaaaagaaggaataa

SEQ ID NO: 78916 - DNA, 375 bp, Glycine max
  Peptide Sequence Number=SeqID_170601
atggagtactctaatggattccctagtaaaagagatgtttctcttcaggaacttagcaaaaggcttgatgagtttgctaaagtaaaaggatgggatcaatatcacagtcccagaaatcttcttttagctcttgtgggagagctttctgagatcttacagtggaaaggagaggttgcaaagggattgcccaattggagttctgatgataaggagcacttagaggaagaactttcagatgttttgctttatttagtgcatcttgctgatgtttgtgggctagatcttggacaagctgctctgactaaaatagtgaagaatgctcataaatacccagttactagtactaattacaccaacaattccacttacaactag

SEQ ID NO: 78917 - DNA, 927 bp, Glycine max
  Peptide Sequence Number=SeqID_170602
atgactacatcctcgattctcgcattactatatttcactcaagagttcatcattgagagtgatgcatctgaaaatggcttaggtgcccttctgactcagaaagggcaacttgtggcttactttagtaaggctttgactgaacacaatctagctaagtcagcttatgaaaaggagctcatggctgtagagaattatcgggttgaggagaatctccctattaatttggaggatgacaattcctatcagcctgaggtagttttggctgctcatactataaccaaagcagagcttaggtcgaaagctaaacttctgttcatagctttcgcatcgattcctactcaggattctcctccttcctccccactaccaaaaccaacttcgtcaaagaattctttggacactaatgttgatcatcatggaaaatttgggagcgaattcaatcatactttcaatcttttatgtgagctatggtttgtcaagttcgtaatgagctttgaaatctctcttgataattgctctatttcagattatcttttgcatgttcagacacttgttaatgagcttacttcaattgctgaaactgtttccaattctgaacatcttgatctaattctcgatggtcttcctgatgagtatgagtcatctcgtaagagagctttaagttctattaatcttactcaaggtttaggatctgttagtctcaactctggaagttcttctctcgataattctgttaatcctaattttgcacagtctataaaccctaacttaaagttcaagtttgctgatgcacagtgtcaactttgttacaaatttagacatgatgctttttactgctatcatagacaagaggagaattatgttcatacttttcctccactagctttactttctgttactcaatctacttcaacttcaagtgcttag

SEQ ID NO: 78918 - DNA, 510 bp, Glycine max
  Peptide Sequence Number=SeqID_170603
atggagtatcaaaaccaaagggccaaggagggtagattctgtgagaaactcaagataaagaataaaccaatgtttgtaggagtgagacaaagggcttcagggaaatgggcagcagagatcaaagacacatcaaagaagattaggctttggcttggaacttatcaaactgctgaggaagctgcgcgagcttatgatgaagatgcatgcctccttcgaggttcaaacactcgcaccaatttttatactcaagggaaccttacctcgatgaagattgaaagaatggagctcacggaagaagaagaaacactcgccggaagacggaggaagaagaaacggctcgtgggagagcaccagcaacatcatcgcgagggagaagaagaaccagcagcagctcgcacagaagaagggagaagaacaatgctcgcggaagaaggaaatgaagaaggaagcagaatgactggtgctgggtgcactagcaaaaagcacctagcaacacccgaactcttttga

SEQ ID NO: 78919 - DNA, 1482 bp, Glycine max
  Peptide Sequence Number=SeqID_170604
atgttttggcctttttcacagcttgatggtcgtgtcaaaactttgcaccctaacatacatgggggtatccttgcccgaagggaccaaaaacatcacattgacgccctcagtgctcatgggattgtgaacctgtacccattttacgataaagtcacatcagctggaggcgttgaatttgaggatggaattgaaaatattgacatcggtggtcccgccatgattagagctgctgcaaagaaccacaaggatgttttggtagtggttgatacagaagactaccctgcccttctggaatttcttaaaagaaaccaggatgatcaaaagttcaggctaaagctcgcatggaaagcttttcaacatgttgcttcctatgattctgcagtatctgagtggttgtggaagcagagtgtgggagatttacttgttagcattttggtaacagataaattcccacctagcttgacagtgcctctttcactcaaaagttctctccgttatggtgaaaatcctcatcaaaaagctgcattctatattgacaaaagcatttctgaggttaatgctggtggaattgctacagccatccaacaccatggaaaggagatgtcatataataactacttggatgctgatgctgcttggaactgtgtatgcgagtttaggaaccccacgtgtgtagtggtgaagcatactaatccatgtggggtagcatcgcgtgatgatattcttgaagcctacagactagctgttaaagctgatcccgtgagtgcatttggtggaattgtagctttcaatgtggaaattgacgaggcacttgctaaagaaattcgagaatttagaagccccacagatggggagacaaggatgttttatgaaatagtggttgcgcccagctatacagagaagggacttgagattctctgtggaaagtctaagactctaaggattcttgaagcgaaaaagaatgaagctggaaagctttcactcagacaagttggtggaggatggttagctcaggattcagatgacttaaccccacatgacatcaagttcaacgtagtctctgagaaggctccacaggatgatgagcttcgtgatgcagagtttgcatggttgtgtgtgaagcatgtcaaaagcaatgctattgtgatagctaaggttgtcatctctcatatcatgaaacttttctatgcctcaatgaaaaagaacaattgcatgttaggtatgggaagtgggcaaccaaaccgtgtcgagagtttgagaatagcaatgaggaaagctggagatgatgttaaaggagcagccttggtcagtgatgccttcttcccatttgcttggaaagatgctgtggaagaagcatgtgaaagcggaattggtgttattgcagaaccaggtgggagtatcagagaccaggatgccatagactgttgtaacaagtatggtgtttcactgctctttaccaatgtcaggcactttaggcactga

SEQ ID NO: 78920 - DNA, 456 bp, Glycine max
  Peptide Sequence Number=SeqID_170605
atgtttgccaccactttcaacactccaccttctgcatataatctaccaccattgacttcttgttatcttccatcattacctactcaaatacgtgacatgagtcatgaagatgaggaggacgatgatcatgataacaacaataacgacgacgacgacaatgatggtggtggtgatgatgatgacaatggtggtgatcatgggaaggggcataaggaagggatgaaggataattttgtccctttacatttctttgaaaaaggtgagggtgataataaccatataaggaaggtgatgctaggtgcatccaacattattgctggtgcacctagcattttaagtgaatcgatgaaaatgtccttcactcaagttgatacggatcatgttgatccgttgatccgtatgagtcatacggatcatgttgatcagtatgagttatatggatcaagatcatgttga

SEQ ID NO: 78921 - DNA, 315 bp, Glycine max
  Peptide Sequence Number=SeqID_170606
atgataacaaaagatgatgacaaaggtgatgacaaaaagctcaaaggtcaatcaaagaatgagttcaagatgttcaagatagaatcaagaacacttcaagattcaagaagaaagttgaattcaagaatcaagaatcaagaaaaggctattcaagaatcaaggaaaagcttaatcaagataagtatgaaaaggttttttcaaaaactgagtagcacatggatttttcacaaaacatgtttaccaaagagttttttactctctggtaatcgattaccagattattgtaatcgattaccagtagcaaaatggatttga

SEQ ID NO: 78922 - DNA, 387 bp, Glycine max
  Peptide Sequence Number=SeqID_170607
atgcaagcagtatcattgaagaagacactcatgagagctcaagctcaagtcctcaatactacaccttcattcctaacttgtgataaatgtgggattgtgcatgggccaagagaatgcactattgatggcaagctagttgtagctaaggatgagatcaactttattaagggagtaaacaattattataatcaataccctgacaatttcaatcaaggacagggcttcaggcagagtcggggaatgtttaggagtcaacaacctatgacaaagctaaagaaggagaaagtcactccaccacaggaaaaaaaggctctaatggaagagagccaagagacagacaaaaagggtgagaataaggtattgacacctccttatgtttgttgttga

SEQ ID NO: 78923 - DNA, 543 bp, Glycine max
  Peptide Sequence Number=SeqID_170608
atggttgaccatgaccctccgaaattgaccacaattgtggtaaattttgtggaagcaatgccttccaaggttattttgatgatgccaaagaatcaagagttaagcaaattacaaagattcaagaatcaagtttcaagaatcaagattcaagattcaagaatcaagtttctagaatcaagattcaaggatgatcaagatcaagattcaagactcaagattcaagaatcaagagaagactcaatcaagataaggtacatcctttgtggtacaagtaaagggtacatctacttgggttgttgtactgagaacacgagagggtacatctattgtggttcagttcaagtggagggtacatccacttggctgttcaaagagaacaagggagggtacatcccttgtggatctttgtcttgcctaggatcttcttcatcaatggattcctttgcttcttggaagataaatggcagcggaatggagaaggaagaaagagaggagacgccacttcaaggagaagatgagtctagaagaagctcaccaccatag

SEQ ID NO: 78924 - DNA, 231 bp, Glycine max
  Peptide Sequence Number=SeqID_170609
atggcttcagaaaaagctgtggatgatcaatgtcatcagatatacgggatcattgttcgatatccgacaagtgcaccggatcgcgcaagtagtataaaatgcctagtcctactcaagtatcatcctcagattcctcatgttggactaaacttgaccagaaccgcattaagacatacataccaacaactaggttaccgtaccccgatccctggtgacgatacgataaactag

SEQ ID NO: 78925 - DNA, 870 bp, Glycine max
  Peptide Sequence Number=SeqID_170610
atggctccgaagaaactctccacgaagaggtctagaagagacgccacaggagaaggatccagtgccgccctaaagtttgatagtcatcttttctggagtgtcgagcaccagcagcgctttgaggccatcaggggatggtcattccacagggagaggcgttttgaccctgagatagtcctagagttctatgctaatgcttggcccacggaggagggagttcgggacatgcgctcgtgggccaacagtgtgagttcagttagaggaggaacatggccgacgatttcgatgaggaagccattgcccagctgtggtgcataccgggagaacattcctatcgaggagatttttgataatctcaaatgcaaaaaagaaggtttaagctccgagcaagtacaacaaaggcttgacttgtttggatacaataagcttgaagaaaaaatggttgcttcctctgatcatcttattctcttcgaagctcttatgttggttaagtctcttaatgttgttgaagataatgtgtttgttgttttgtctcagagactaggacctgattataagctaggaagtcctagctcctttcgttacttaaatcaatccaaatgctatgcacttgatggagtggatgatgctaaagaatatcttgcaactcgaagggcaatggatgttgttggaatcaacaagaaggagcaagctatttttagggttattgtagcaattttgcaccttggaaatgttgaattttccaaaggagaggagattgactcttctgtcatcaaggatgagaagtctaggttccatcttaatcttggaagatgcactaatcaagcgtgtgatggtaacgatagaggaggttattacaagaacccttga

SEQ ID NO: 78926 - DNA, 1299 bp, Glycine max
  Peptide Sequence Number=SeqID_170611
atgggatcgagtcaagtgccttcgcttaaaaagaggttctatcaagtcaaggtcaagagcctaggagtcaccagtctgaaagagttagggcagttgatgggtcagctccagcgacaagcttcccgtaaagcttacggaatattagaccacagaaagcaagtcgaaaatggggtggttggaataccaaggaagtgtttggaagcaaaagctagagtcttggcaggtaaaggcaaatggaccccgttcatggacatcctcgcacttttgatcttcggaggggtcctctttccaaatgtggatgggttggtggaccaggcagcgatcgatgcttttctcacctttcatgactgcaaggaaagcccagttgtcgctatcttagccgatctatatgacaccttcgaccgaagatgtgaaaagagcagtacaaggattgtttgttgtactctggccctctacgtatggttggtttcacaccttttccgccaagatgtgagacatgcttgcccgctagaaggccaccgttcatgcatagagaaaaaagaggcaagttgggaccgactcttagcaagcaaagaagaagcgtctgtcaactggttcccccgatggaaagaaggaagaaccagggttcttatttcgtgcggaggatttccaaatgttcccttgatggggacaaggggttgcatcaattacaatcccatcctcgctataagacaacttggctaccctatgagaggggcaccactagaggaagacctcacacctattattgcacgaggtttcagtagcaccaacatggaggcacttcagaaggtctgcaaggcatgggagatggtgcaaaagaaggacaaggaactcagaggcagtaacaacgggcccatcggcggctactataggtggttgaaagcctacatggaaggtctgcattggctcccaaatttgagaaccactaagggggtggaagttgaagctccagaggaggacgaagaggtgcaggccctcagaacagaactcgagaaagcccaaatagtcaaagaaaagttcaaatcagcagctcttagaatccgaaaggagaatgctgaactaagagacgtaaatatagccaccaccaaggccttggaacaagagaccaaaagggcccatagggaagaacatggccggaacaaattccgaggggctctgtggggcagtaatagcgagcttaagctccgaagagaggaaatggaccaatcacgagtagacagtttgatcttgaaggatgaattgaggatttgcctaaggtccaagagaagcttgtcttag

SEQ ID NO: 78927 - DNA, 744 bp, Glycine max
  Peptide Sequence Number=SeqID_170612
atggcttgtgcattgcaagcaaccttagcagccaacgcctatgtcttttcttccaggagattctccttgaagctccaaaagaacagtaagagaaggttttctttgttcactgttagagttgattctgatgaatctgattgcaatgaggaagaatgtgccccggataaggaaatcacaggggagaaattgggaggaagaatttggctagtgcttataagttatggacttttagtcaatttaaaggtagggaaggtcagtgtggaatggttagctggggagaagacgaaagtagtgggtacattcccacctcgtcgtaagccgggttggactggctatgttgagaaggacactgctgggcagaccaacatatattcagttgagccagcagtttatgtggcagaaagtgctataagttcaggaactgctggctcttcttctgatggagttgaaaacacagctgcaattgtcacaggccttgctctgatctcgattgcagcagcatcgtcaatactgctacaagttggtaagaacgctcctcctcagatccagacggctgaatactctggaccatcacttagttactacatcaaccagttcaagccactggaaattactgaagtgtccgtgcctagtgaggcagaactatcgtcatctgttcaacttgaaagctcgcctccggaagtttcccaggttcaggttgaagctcaagctcctgagacctctagtgtgaacattgtatcgtag

SEQ ID NO: 78928 - DNA, 623 bp, Glycine max
  Peptide Sequence Number=SeqID_170613
atggcatctagctcaatgtcatccactggctcatggagtaccaaggacaacaaggccttcgaaagggctctagctgtgtatgacaaggacactcccgaccgttggtacaatgttgctaaggctgttggaggagggaagactccagaggaagtgaagaggcactatgagctccttctcagggatgttaggtacattgaatcagggaaagtgccattcccatacaagcaaagtggagggtctgaagaagagaaaagtcccttagtgttttttgcttctctcgcctctctctctcctgcgcatgctcttcttcttcctccaacggttctgcttcttcagttttcttcttcctcccacgcagcttcttcattctttttcttcttcttcgccgccatcgccgccattgttgccgtgtttaggaggaaggtgtgggtcttcgcgtttgtggtgtgggtcttcgcgtttctgcttcttcttcgaggtaagtttgtcgttcgcgttttggtttttgccggtgatggcggaaatcgctgtcgggaaattgctgggttgtttacggatcacttgatccataagcattttccgaatcaagttgatccggaagatgcttacggatcaagtgatcc

SEQ ID NO: 78929 - DNA, 561 bp, Glycine max
  Peptide Sequence Number=SeqID_170614
atggcatccaagttcattccttcggagtccggtccaaaacgcatggtgttagttcagtggaagggcctgccccctgaagaaacgtcttgggaagactggtcggctttcaagactactcaccacattgaggacaaggtgttgcttgatggggatgggagtgttatggatagtaatgatgggggtctacaggaagcagtgtgggtgcaagaaggaaatgcaagacccacaaggaacaaaaggtcaccagcatattggaaagattacggacttggtcctcgaaatccaaggggtatcaacaacctattggcattgggaaggattcagctaggagacgtgcccaaccaagtgaaagttttaagttggaattgtcgagacctggttaaccttcgggtagttccagtgctcaaggacattcttggagtccacaaacctggcactttatttttgtctaaaactttagttcattccaatagagtagaggagattagagtagcgttgggttttcagaaagtgtttgtggttgataaggatggtaggagtggagggctagctttgttttag

SEQ ID NO: 78930 - DNA, 366 bp, Glycine max
  Peptide Sequence Number=SeqID_170615
atgatgcaagatgtcacagctccaccagaggcttttttccaaaccattttcggtgaagttggtaaggtatatgctgtcaagtggaaggacgtacttgacagtgtatggcatttggttgacaaagacgaaaattatcataacattgtgtacaaccaagatttggaccaaccagccattgtagcagggtggacaacattgcgcgatttttaccagttgaccgaagatcatctagtatccttgcatcattatggttttgtgaccttcaaggtttatctcactgagcagaaagtttcttgtagcagtctgaaagttgctgggtgccccagcaaaaacgttggatgccccaagcaactccgacaggtttaa

SEQ ID NO: 78931 - DNA, 2136 bp, Glycine max
  Peptide Sequence Number=SeqID_170616
atggcggaggatattccttcttcttctcctccaatagcagcatcagatactgctcctttgggttcgagtgtgatctccttagtgaatcgtcttcaggacatattcgcccgcgtcggctcccaatccaccatcgacctcccccaagtcgccgtcgtcggaagccagagcagcggcaagtccagcgtccttgaagcactcgttggccgcgactttctcccccgcggcaacgaaatctgtacgcgccgccccctcgtcctccagctcgtccagaccaaggcccctgaagacgacgagtacggcgagttcctccacttccccggccgcaaattccacgatttctccgagattcgcagggaaattcagattgaaactgatagggaagcaggagggaacaaaggtgtctctgacaagcagattcgactcaagattttttcaccaaatgttcttgatatcacacttgttgatctcccaggcattacgaaggttcccgttggtgaccagccttctgatattgaagctcgaatcagaacaatgatcatgtcgtatatcaaaactcccacctgtctcattttagctgtcacaccggcaaattcagatttggctaattctgatgctcttcagatggcagggattgctgatcctgatggtaatagaacaatcggtgttatcacaaagttggatatcatggacagaggtactgatgctcggaatctgttactaggaaaagttattcccctccgacttggttatgtaggtgttgtaaatcgttgccaggaggatattcaaatgaaccggagtataaaggatgctcttgctgctgaagagaaatttttctgcagtcgttctgtatacaacagtctagcagatagttgcggtattcctcagctagcaaagaggttgaaccagattctagctcaacatataatggctgtgctacctgggctgagagcacgtataagcacttcactagttgctgttgcgaaggagtatgcgagctatggggaaatcactgagtccaaggcatgtgttaatactgggatatgtatcttggatatatctccaatccccatacttgctggtcaggctgcacttcttctgaatattctttcaaaatattgtgaagctttctcctccatggttgagggaaataatgaggagatttctacatctgaactatttggtggagcacgaatccattacatttttcaatctatctttgtcagaagtttagaggaggtggatccgtgtgaagacctgactgatgacgacattcgtactgccatacaaaatgctactggacctaaatcagcagtgtttgctccatctgtgccatttaaagtccttgtgcgaaggcaaatatcctgtctattggatccaagtcttcagtgtgccaggtttatatatgatgaattaataaagatcagccatcgctgtatggtgattgatctgcagcgattccctttcttgtggaagcgcatggatgaagctctagggaactttttacgagaaggcctagaagccttggagaacatgattgcacacttaatagcaatggagttgaactacataaacacttcccaccataattttattggtggaagcaaagcattagaaattgcctcgcaacagaccaagtcttctatggtttctatacctgtttctcggcagaaggaggttctggaatctgacaagggatcagtctctgaaagaagtgtgaagtctcgggccattcttgcgagacaagctaatggagtagttactgaaccgggtgtccatgctgcatcagatgctgaaaaagttgtatcctctggaaacactggtggatcaagttggggtatctcatccatttttggtggaggtgatagccatacgattgtgaaggagaatgtagctagtaaaccacatactgaaccagttcacagtgtggagcaatcattctctatgatccatttgagagagccacctcctgtcttgaggtcatcagagagctattcagagacagaagctattgacataacagtaacaaagttgcttttgagatcatactatgacattgtcagaaaaaatgttgaggatttggtccctaaagcaattatgtatttcttgggactaatagggtttttaagtagagactaa

SEQ ID NO: 78932 - DNA, 321 bp, Glycine max
  Peptide Sequence Number=SeqID_170617
atggttagggtggtgatatatagacaaatgcttgtgctaacatccgtagagcatttgattaagatcttccttgaagtatcatattcatatctcacctttatgttgtctatcactcatttcacccactattctcttccaaaaccaatgttcttgccacactttctgatgcaatcctactccccaagggcattggatagaagactccaagaagattgggccaaagatgcaacagaaggccctagggttctcatgagccttagggtagggtaccctagaagtataggatttttcagcccttgtattttagggcacctagactag

SEQ ID NO: 78933 - DNA, 1182 bp, Glycine max
  Peptide Sequence Number=SeqID_170618
atggccaaaaagatactaggtggtgatcgaaagggtactaggctagggtcgagccaaatacctaagagtgagagcatgcttttctcgccggcactcgacgacgccaagcactgcttctctcggccggagatgtacaaggaaaacctcgccagcaccttggaggcctacaaccaccacgagttcctctgctacaagagccacctcgcctggccgccgcgcctcgaggccttcgacgccgatcctcttcccctatgtgtcgccaccgtctggagagctcgcaaaaacgacatcgccgtcaagatgaaaatcacgatgtgcgaggcgctggtggttgatagtctgtcaagcactcccactagagtggagacacttgatgttattgaccttcgtaagcagcagaggaaggaacctaaaaagcctctttatcaagtacttgaagagaagaaggaaaaaattgctccaggaactttgcttggaactacacacacttatgtggttaacactggcacccaggacaagtcaggggctaaaagggtaaaacttaaaagagtttcctctatatttagggagaaaggggagaaggggtttttgtgtgatgatattgattggtgggataacatgtttcatgttttccagattgatttacttagaggacaaaagtcacataaagtagatgtcactttactgccacaagagttggatgccatggaaaatgttttacccgcgaatgatgttaacatcacgactctgatttgttacctctcctggaactgttccaagtatgaagaagcaagggaggaaaagaagttacgaaatcagtgtgaggattccagtgacatggtggcagaggctcgaagggaaaagattagtgaaaggatgaaaattcttcaagatttggtccctggttttaataagagattccttccgtcaaattttcgggtggaagaggatagagtaaaccctcttcctccgtttcaagctgttctcgataagaaaagaaaaattagaaggaaaattgaagcagttgggatcccttatacctttgtctctgcaaattgttttggtgcatactttgttaattatttgcttcgttcttatgagaaaaagaacaatattactgtctatggcaacagtgataccaaaggtacatattcccacgagccacatcactatggtgttgag

SEQ ID NO: 78934 - DNA, 129 bp, Glycine max
  Peptide Sequence Number=SeqID_170619
atggggaaaggagtggttacagtggcgtcttccggaagaaccgcgaaggcttcttccggaacttccggaagaaggtgttccgaaaaatttccggaaaaagggttcttccgaaattgtttattgttataa

SEQ ID NO: 78935 - DNA, 255 bp, Glycine max
  Peptide Sequence Number=SeqID_170620
atgaggtcgaggcactaccgaatcacgacggtgagtgatttctacatcgttctttgtgcagtgttcctcattcgtcatccgcattttcctcgaaaaaacattggtggcgactcccacgtgttctccttttttggaagacacaccttttatctcattttgccctctcgtcgaagggtgggttgtgacagttggcaactccactggggacttgttagagagttaggccattcaatcagtgtgcaatatttatcgtga

SEQ ID NO: 78936 - DNA, 163 bp, Glycine max
  Peptide Sequence Number=SeqID_170621
atgtcacatcctatcagagcattgggtcttgacgtccttcagcacaagaatgctccaaccatatgggattggcacgggcttaaaggagcactaaaaccgggtgtattttccccaaaggcctacactccgaagagtccgttagggcctctccctcctgattcag

SEQ ID NO: 78937 - DNA, 531 bp, Glycine max
  Peptide Sequence Number=SeqID_170622
atgagacttgttagtggtgctctgcgcactgaatcattcgacaagaatgtcaaagttgtctatggacctgggtgggagtccaccgtaccaggcagccagatgctcgtctggatctgttgtcccatcataccactcaaggttgagtggcttccaccccaagggctcaaatcatctatagtgttgcctgtgcgttgggggtgtgattccccttggatgcgttcaggcaaggttttagctttgtcaactcttcctcatggcgtcactccatctccacaacgcaatttggagttgttggcagtctcgcatttgaggccagaccgagtgctatccatggatgagtgtgagaggattggcgagaggccatggggtatgttttaccgtggccccacgatgggtgccaaatgttcttaccaaaatccagaatcgtggcacgtcatggtggacgtggctgagtggggtcccaaacttcacacgtcggcttggcgaagtgcctttgatagaaggggggacctacaaaacaaaggactctaa

SEQ ID NO: 78938 - DNA, 405 bp, Glycine max
  Peptide Sequence Number=SeqID_170623
atgttcgaagggatcttaggatgcccgctaggaggaaggaagccatatcttttttctggattctatccttccatggcaagaacatcaaaagtggtcaagatctcagcacaagagttagaccgagtgaagcaatataagaatggggtggtagggataccaaggaagcgcttggaggagaaggcagaagctttggtagatcaaggaaagtggacctcgttcattgacatattagctttgttggtgtttgggactatactatttccaaatgtaaacgggctagtggacttagatgccatcaatgcctttcttgcttatcatcaccgcaaggaaagcctgatcatcgttgttttggtcgatgcatatgatacgttcaacctgagatgcaagaagagaaatgttaattag

SEQ ID NO: 78939 - DNA, 1470 bp, Glycine max
  Peptide Sequence Number=SeqID_170624
atgagagagagaaaggagagagaggagagagatgagagagaggagtgtgtggagagagacactgggtgggtaagagtgacgagtagagccaagagaggtgtgaggaatcgtgtgagccttagaaaggaaccccatgtgaggtatgccgagacaagaggaagagcacagcagaaggcagctatagtaaactggagagatcacacagatatctcttcattttactttacaaggtttacggatgatatcacagagaatgaactctggcagcatttcaaaagatggggtgatcagatggcaaggcagctagataacattgtcattggaggtcagaagctctttgacaatattcccaagtataatcaagagagacgaacacatgaagacatgggtagacaagcaaagaacgaaagaggagacatgcccacacgatttcagcgaaccatgcagcaatgccagagaacagcactaccgtacgcggatgtcgtgagaaagaaaaacaccactcagccacgaagacaggaccaaaagcaacctgacgcatgggttggacgactgaccaaccccgccaggttcgaaatgttggaagaggagttgagatgggagctgggactggatttagccccgcgatacttaggggatgatcaagttcttttaactggaatgaatgaagacgaagctgaacgactcatgaacggcggattacatggaactatatctcatttctattcattggagaagtggaagccaaatcttcgcaccggaaatagaatggtgtgggtccactgctggggtattccacttcaagtctgggacaagaatcgtatcaggcagatagttgggactatgggagacatggtggatgtagacgaggatgtcgaaactaaacgacaagtggatagggcacgagtcctcatcaggaccccatggccgccgacgatcaagcactgcgggtccatgagttgtgagcaccacagtaggggcagcagttacagtgactcgtcggaagaaagggaatctgccgatagccttgccggagacgaatttctacaagcgacaacttttgcgggtacaaaccgagagctgacgcgagactcgccgttgaatcagcgctccaactccccacatagctctattgtgccaaacaccggcgtcggagacacgacaatgactggaatgcccactagatggaagcagaccgaagacccgatggataaggaggaaggcccgcgggtaatgactggaaagaatgatgaggaaacggtcaatgccaatatcgagacgcatgcagcaaagttcccaactgtggaaagctacttcaacggtcaagagatacgagcctgtgtctttcaccaaaataggcagagagagaagggggagactagtggtgtacagtgtcagcccccttcacctccacgtgattatgcagcaaagaacacatcaacaaaaggaaagcaggcttttggtaaatga

SEQ ID NO: 78940 - DNA, 879 bp, Glycine max
  Peptide Sequence Number=SeqID_170625
atggctaaggctaaaaggctaaactgcaatcatctcttccatcttgcatgtttgagatcttggttggatcaaggcctgactgagatgtatacttgtccaacatgccgaaagccactttttgcgggtgtgcctgaaaatcaaacaaactccgatgtggggacgatatctagtgatgagcaacttgcacggcaaataagtgctggattggatcggccaaactctgctaggcataccatgcctgcaggattgtatccaaatcagacactaaacactcctgaaggtgttccttggaggggtgcagggctggactcaggttggtggcattcttggccaaatcaaggtgttgatggggctggtccatctactgctatcagaacagttggattgggaagagttcaaatgatgatgaggcatcttgcatcggttggagaaacctatgctcagactgcctttgaagataccgcgtggaacctttggcccattaatccctctcaggcttctgcaagtggttcaaccatttctccccctggtggaagattgccagaaagaactggtagtttacatttaaggaatgcttcacagtcagctaatgatgatgttgcaaatatacttgccatggctgagactgttcgggaggttctacctcatattccggatgacatgatattccaggcccgagaggaaaggcactttttaagttcaaccaagacatcgattcccaccaaattggttggatcaagatgcaatggaagaacagatgagatgcctcctcttcagcacccctgcaaaaaggacaacgcaaatcctgaatctgtacttgtctcctatgcagattcatccttgttggtagtctgtccacttgaagctttgaatatgtga

SEQ ID NO: 78941 - DNA, 234 bp, Glycine max
  Peptide Sequence Number=SeqID_170626
atggtggagttaagaagacagtgtgccaaaactgacaacaaccagaatttcaacctagaaatcaagagtagtgtttatatagaggaagcaaaagaacatcacctagatgaagatgctctgatagcacatgatgtagctccatgtggagcttataggccttggatcttcttcatcaatggagtcctttacttcttgaagatcaatggcagaggaatggagaaggaggaaaggtga

SEQ ID NO: 78942 - DNA, 516 bp, Glycine max
  Peptide Sequence Number=SeqID_170627
atggaatcaagcaatgtgaagaacaagtcaagtggaaaaagaaagatgtctagtgaggacacaagaagttacttcacatggaacttggaaatggtgcgtgtgctagctgatgtgcttagagataaaagaaatttgggtaataaaggtgatggaaattggaaagcagtagcatatagtactacacctcaaattttgtccaagcattttggagttcacctcatggcagataatgttaagaaccgttttaagctttggagaacatggtatggaattgtgagtgacattcttagtcaaagtggatttgattgggatagcacaaatgcaaaggatagagctattggaatcagagcagaaaatgcattagatgcagatgatatcatgagcaaagaaacaaatgaagaggaagcaattcatagtaaaagatgtgaaggaattcgtgtgctaaagcaaatgcaattagaaaatttggaattattttggaagtttgacttattttgtgactatattttgatttag

SEQ ID NO: 78943 - DNA, 351 bp, Glycine max
  Peptide Sequence Number=SeqID_170628
atgattatgaggatccaagacatttatagtagccaagatgaggctactacttcaccttcctctagtgaaagtgaagaagcaaaaggggaagaatctagtgaagaaatctacccccaagaagaaggaaaacctttaatggttaaggaggattgtaaggaggtaagtgtctcctccaagagtgatcaagggcttcccatggaccctaagagaataaaggtcattcctgagtggcctacttcaccaagtgttgcgaaaagaatccatgagtttcaagaacctctggatttgaggtcaaatccttttcaagggggagggaatgatgcaatcctaccccgcaagggcattggatag

SEQ ID NO: 78944 - DNA, 1446 bp, Glycine max
  Peptide Sequence Number=SeqID_170629
atgtccaagaagctgtttgagtttgattcaaacatttttcgtcgttttaaggaccacttttttaaggtcctggctactgatttcatggctaatggcatgccactgatgcttaacagggatggggagccccacttcctgttctattggcagttcgatcgcacgaagttcaagtcatatgacgaggatatgttgacccttgtggagagggtcaacaaagcaattttggagaagtttcgggtctcgctagacgcacgaaccattttgtctcttccttcggcaagcaatcctctcactgccttggatggtattatgggtgacttcacttggaggccactcgtgaagcaggttggacctacaagtgggaccgtgccatcttcttctactactctgtctgttggagaaaagggtcaacctgctgatgaggttggccttattgctgttgctgctgaggtcaccccagctctccttcctctgttttgggctggggcctactgcgagtcacccatgactatgcaagatgtgcctccgactccaccagatgtcgaggctcctgctgctactgttgtgactccagccaatcctactgaggttactaatgctactattgaagctattgtgccagccactcaggctgacttggttgttatgttatcgtccactgttgtggctcttttgctaagtgccgatgtggcgaccattggtgctcctgtagtgatgcctccttctttgtcagctctggtgatcctcccttctgctgttttggcggctatggagtttccttctttgtcctcgtgcccttgtgtctcccttgatcatctgtacacctctagtgatgttgactcactgtggggtgcaacttacaaaccggagcagaagacctcgacaagctttgtgtcaacctttgaaaagaaccttattaggccggctggggtgcaaaatgctactgactctaccaaagcttttctccaaaggagtttggcaattgtggaggagaacaaactgtggaaccaagaggtggtgcaaaaggttgtgtccttagaggtggaggttgagaagatggacctaggtggccgagtggagagtatggcggctgagaaggatgagcttgccaagagagttgctgagttagaggtttgtcttagggagtcggagtccagattcgggaagtccaagatgcgggatgccaaagagagggaagccaacaaggagctcgaggaagagctaattctgtacaaggaggaggccgtggagcaacatgagaaagactttcagaatgttgttaggcaggctgttttctttgcaaaggaccttgacttgggtttcttcgatcccttcaaggatgtgaaaaatggtgtcctacttgatgaggaggagattgatgcagaggaggaggttgctaatgaagggcagggtgctgcggagcaaggcgatgatgcttgtgtctag

SEQ ID NO: 78945 - DNA, 573 bp, Glycine max
  Peptide Sequence Number=SeqID_170630
atggctagaacacgaggtttaggtcgtgccataggtagacttgtaggcagagatagacatgatgaccatgatgcagctgatgttcccgagaggcgtaggcctactgcctcagctcgtaggcaacgggttcatcagatgactacgattgcatgtgatatggctgaggacgttgctaacatgactgacgatgtccctgatctggctgcggaggcacctgagatgcgtgcgaacgtacatggtgctgatggtgctgaggggtcagatgctgatgatgctgctgagggattccctggtgggccacgtgacccgtcagtactggcatcatttgcggaccatgttgcacatgctgtttggagtggacaagaacgtcctgatttgaagttggtgtcacatgggaggaaggtgacactgattgggaggccagtgcctgagattgaaggactggttgctgccacaagattaagtccactgatcgattgttcagttattactggcgatcttggactgatatccgcattggtggagaggtggcacggtgagaccaacaccttccaccttccggtaggagagtga

SEQ ID NO: 78946 - DNA, 1119 bp, Glycine max
  Peptide Sequence Number=SeqID_170631
atggcggcttcggggccaagaacacctaaaacaagaacaagcagaggtccttccattcgtcctgtgtatgaaactttcgagcccatgtcagagatgaaggaaaaagaggaagcatattttcttcatatttaccttcctggtttcgtaaaggagaagataaagatcaattttgtgagatcttctcgagtagtgagggttgtaggagagcgaccattaggaggcaatagaataagcaatttcgagcaaacgtatcctgttccagaaaattgtgaggtggagaaacttcaaggtaagtatgagctaggaactctcattattacaatgccaaagaagcctatcatttcacgagttccacctaaagcacaagttgaaacaaccccaagaataggtccaactccattaataagtccttcaaagaaacctgtgcctgatcaattaccaaagcctaaagaagtggtggccaaggaagccatgcctccaaaatctccaatcactagaatggaacaaggagaaaaatctaatggacacaagacaaggcctcaacatgttcaagaggaaagcatgctgaaatccgccgcaattgcttcaaccccaagaaaagaaacaggaaaatctcaaaagggtcatgaggaaattgtgccaaagatagaggaatataggaatgaagagtccaataagcaaaatgacatcacaacatatatagaaaaagtcaaggagaaacaaaataaagatagagaatatgagaagcttcatgagacaagaaagcaagatcagaaatatattgttcacaatgtggttttgaaagaaagagaaatcaagacaacaagaccaaaggaaacagtttcttcctctactccaaaagctccacagaagggaaaagaaaccagcaccaccataattgacaaaggaaagagcaaagaagaggatgaaatctacacaatagggaagggaatcaaagaagtagtagcttcggcttcggaggttgtcacaaaaattggagaagggaagttgaatgatgaagaaaagcctttggttgcaaacatgggtgctgcaattcttgtaattgtggcattgggagcttacgtgacctataagtttacctcttgtagcagagcatga

SEQ ID NO: 78947 - DNA, 453 bp, Glycine max
  Peptide Sequence Number=SeqID_170632
atgcgagaaatcaaagtccagaaactcgtcctcaacatctccgtcggcgagagcggggatcgtctcacccgcgccgccaaggcacgtataagaaagaacgagaagatcgcgtgtcatgtgacagtgagaggggacaaggcgatgcagcttctggagagtggcttgaaggtgaaggagtatgaattgctcaggaggaacttcagcgacaccggctgcttcggatttggcattcaggagcacattgatttgggaatcaagtatgatccttcgactggcatttacggaatggatttctttgtcgttctggagcgccctggctaccgtgtgggacgacgctgtcggtgcaaggctcgtgttagaattcagcatcgtgtcacgaaggaggatgccatgaagtggttccaagttaaatacgaaggtgtcatcctaaacaagtcccaagcactcgtttaa

SEQ ID NO: 78948 - DNA, 357 bp, Glycine max
  Peptide Sequence Number=SeqID_170633
atgaaccccaaaggacgttactcctttgtgtccagtgattacaccaagaagcaaatttcacttcttgcaatgaacctcaaaggacgttactcctttatgttcagtgaatcaaccaagagttttgatgataacaaagatgatgacaaaaagctcaaaagtcaagatcacttcatgataacaaagatgatgacattcaagaatgagttcaagattgagtcaagaacacttcaaggatcaagaggaaatttgatttcaagaatcaagattcaagattcaagattcaagaataatcaagatcaagattcaagactcaaagattcaagaatcaagaaaagacttaatcaagataagtattaa

SEQ ID NO: 78949 - DNA, 159 bp, Glycine max
  Peptide Sequence Number=SeqID_170634
atgaaggatcatgtgcacacgccactaagacactatgatgcaatcctccctaggaagggaccagtcactagagccatgagcaagaggctccaagaggattgggctagagctgctaatgaaggccctagggttctcatgaaccttagggtagatttctaa

SEQ ID NO: 78950 - DNA, 312 bp, Glycine max
  Peptide Sequence Number=SeqID_170635
atgttgcccaggtcattaatcctgccccttttgaggatgtcactatctcccccatgtcaaacagcccaacaatctgcctcgactgttactgtcacgactcagtctggtaatcctatagcctttgtctctcaatcatcctcacttggaccttggatacttgactctagtgcctctgatcatatgaccgataacaatcttttttctctcaattgtcattatcagattctttgccttttgttactctcacaaatggctcttagattaaacttcgtggcattggtcaaacccacccccttcctaacctccctttga

SEQ ID NO: 78951 - DNA, 2115 bp, Glycine max
  Peptide Sequence Number=SeqID_170636
atggagatgtacatgtgcgtcgaggttgtgagaagattggtgacggtgttggaagtgtggggtgcggcggttgtcctcggccctttgcgcggtgcagcggtcatgacggtgttgagtgttggcagtgtcgaagtatggggtgcagagcggcgatgctttgcggcggtgcgttgccgggtggcagtgctttgtggcggtgcgggcgatttccctgaagtgatagaggagtatttggaatatggttgtatgaaatgcattgccttcaatcgccgtggcacccttcttgctgctggatgcaacaatggaagttgtgttatttgggattttgaaaccagaggcattgctaagattctgcgtgatgatgaatgttcttctcccataactagcatttgctggtcaaagtatggtcatcaaattcttgtatctgctgctgataaatcattgatattgtgggatgttatgagtagtaagaagataacacggatagttttgcaacaaacccccctacaagctcgtcttcatccaggatcctcgaccccatctctttgcttagcatgtcctctttcatgtgctccaatgattgttgatctgaacacaggaaacacaactttacttaaagtttctgtcttagagacatgcaatggaccaacaccaacccctccttcacgtaataaatgttctgatggaattacctccttcacaccaactgctgcttgttttaataagtatgggactctggtttatgtgggaaactcaaaaggggaaattcttgccattgattacaaaaatggtgacgtgcgtgctgtagttccaatctctggtggttctgttgtaaagaacattgtgttcagcaggaatgggcagtatctgctcacaaattcaaatgatcgaataattcgaatctatgaaaaccgtctacccctgaaagatgaagtcagagcccttgatgacctgagtgagaaccacaatgttctaaataatatcgagaatttgaaggctgttggatcaaaatgtttaactttattccgggaatttcaagattccatcacgaaggtacactggaaagcaccttgtttcagtggtgatggtgagtgggtagtcggtggttctgctagcaaaggtgagcacaagatttacatatgggatagagctggacatcttgtgaaaatccttgaagggcctaaggaagctctgatagatttagcatggcatcctgtgcatcctattgttgtatctgtttcgctgaatggtttggtttatatatgggcaaaagattatactgagaactggagtgcatttgctcctgatttcaaggagcttgaggaaaatgaggagtatgtagagcgtgaagatgaatttgatctgattcctgagactgagaaggtgaaaggacctgatgttaatgaagatgaggaagttgacattataacagtggagaaagatgctgctttcagtgattctgatatgtctcaagaagagctatgttacttgccatcaacccctagtcgtgatgttcctgagcagcaagagaagtgtgtagaaagttcttctaagttgttggacagcaataacactggatcccctctttcggaagaagctggaccaaatggacatatgatgaatcatgcatctagtcctcttgaagatgatgctgggcgcatgaaaagaaagcggaaaccttcagagaaggtgttggaattacaagcagaaaaagttaagaaaccctcaaaatctagcaaattggcaaaacctaagagcaaatctttggccgatcaagataatggtaacggttttcatgtgttattaaaaagcggccatggcggaatggcgtcgcggaattttggaaaaacgccaccaaatagcagtggcgttgcaggggttgggctgacccgagccaaccatacccgagtttctcctcttcagcggtacgaccagcagcagtctccagcgcgacgaatggcggtgtgggcgccggcgacacaaacgacaaccgcagacgacgttctcgagcatgacggcagcagaccagcagacgacgcatgcgagagacagacgaccgacgaccaatgcaccaacgcacgtcgacggcgacggcagtgctttggtgcgttttaa

SEQ ID NO: 78952 - DNA, 546 bp, Glycine max
  Peptide Sequence Number=SeqID_170637
atggctgtaagagcttctctcctagaaaacccccaaatgtttgttgaaatagcttatcaggccctcttgatgtttttcatggacttggtgctgaaatcaccattcatttcaagttctcaaaatggaaataattcaaacaataatctgaaaaacaccggcagtggctcatgtcccttccaccagagcaacgcttcccatgttactcatgatcttcctcttcacctcattcggctccatcttcattctctactactcccacgaagaacaaccccaggcgcttccacaagccatgcacgcagagttgacccgtgcatgctcgccatgtgtcctttcatgtcctacttcgtagtcaaaatgaggaccccgcaaaaccctgcgtttcagtgtgcggtgtgtttggcggagttcgacaacaccgatgatgcgctccacttgctatccaagtgtggtcacgtgttccacgcgcactgcatcgacgcatggctcagtagcgttttatcgaagaaaatcgaacatagaaagaaaggaaagaaaattgtggaatga

SEQ ID NO: 78953 - DNA, 195 bp, Glycine max
  Peptide Sequence Number=SeqID_170638
atgaaatttgagtatcgcgttcgaaacccaatttcgagcattctcaccgttgggaattgcaaaaacatggagaaaaaggaatcgcatgaagacagtacaagtggtggcttcaatctcttctccgtctctctgacgttcgagaattctatcggagcagtcggaggaaaaactggaggaatcccagggaaccgctag

SEQ ID NO: 78954 - DNA, 438 bp, Glycine max
  Peptide Sequence Number=SeqID_170639
atgaaatcagtcaccaaaactgtagagggaaagccacctcaacatggacctcagtggattgaagcaaagagtcatgttcaaacaggaaactacgagtgtggatactatgttatgcattggatatggtgcatcgtaagtggtggattgaaggatgactggattcactggttttctgatcgatcagcggtaacttcttctcagggtggtggtgacaaggactacaaggaggtacccccagctcctttgtttaaacctgtagggggacacatcaaccaagttgtgaccttcaacagatcttattacaagaaaaaaagattccaagacggttctatcgacaagaccgtcgtagaacctgcacatttctacaacggtcaccgtgacgtcaccgtagtagaattgagtctctcttacaacggtcatgggacacgaccgtcgtag

SEQ ID NO: 78955 - DNA, 1137 bp, Glycine max
  Peptide Sequence Number=SeqID_170640
atggctgcatgtctacgacaggtagcggcaaacgtcgtcgttctcatgcccttaattacgaacatgccaccgcttcaccttctacgacggttctgtgaaaccgtcgagaaaatgatagagaccaaggaaaacctccaagaagagaaggaagacctaagaggaagaatccctcaatcaaagccaaaagaatctaaggagaaaaaaggtaaagaggataagcttgggcttgaaatacctatgaggggaaaagtaaagaaaccccagaagcatttagaagcgatcatcggactacaacctcaaggccaaagtgagagaagagaactcaagatgggttgggaagggaagggaaagaggaggtttaggaaggggttagaagggaattataagagttgggaagaagaagggtcggggtttgtgtgcaaaggaagggaagagaaggaaggaagaagagggagcgaggaagaatttgaattggagggtagagacttttcatcaagtgatggtattagcggaaagagtgatgataccgctagaaggagagatcagttggtgttgtcaaagattcaacaaggagttgactattccattttcagcaaaatcgtaaatgccaaaactgataaggaagtgtgggatattttgaagttgtcttacaaaggtgctgagaaggcccataaatctaagtttcaatctctgcgaagggaatatgaaagacatcctagacaacaaggtggtggacaaaactctacacaccatgtagatgaagaaagcattgaaagtaatgtgagcagactcttggagaagataagcaaagtagaggccaaggaaattatagaggtagaggaatggggaaatatcaatcaaggtagaaacaacaatttagggtcatttggccgaggaagaggtggagatacttttggtagtgctaaccaaggaagaggcagaggtaacaattaccaagatgaaatagtaaaatctatcgtgagatttgaaaataatgcaaatattcctattatggggaaaggccaaattactatcagattgaagtatggttctcaaaattttatctttgatgttttcgatgttcctggtcttcatcataatttattgagtatgagacaaccatcaaagaaagggtaa

SEQ ID NO: 78956 - DNA, 425 bp, Glycine max
  Peptide Sequence Number=SeqID_170641
ttgatgcgcaggtggcctggccaagagcccatccttctccttctagagggggtggggcctccgcaacccaggagcctgctcctgaggagccagtagcagagggggaggatgagctcacccctcccgagcccttttattttgatgtagatgcacacatggctcaggaggaggagacttccataaatcagatacctgagtcatctcttgcacctgttcctgaggagacccagccatctacaccagtcatggagccagagcagcctatccaggattcatcagcagctgtagcactggatcttaatgaagatcaaccacaggatgagcaggatccattagaagagaatgagcatgtgattggaagtatgactaaaaatgttagtcagtttgtcagattgattgtgaaggaatgcgttaaccgtatcccg

SEQ ID NO: 78957 - DNA, 444 bp, Glycine max
  Peptide Sequence Number=SeqID_170642
atgaaagggataccagtcgtgggtgcctctgaaaaggggaacctagcaaacatggcaagtccctcgcatcaagagcttgatgatcactcgttgatcattgacctgcaaagagagattaatcccttgaagcaaagaaacacccaagagatggagaacgccattcttagagagtatgttcctacaacattgaaaggtgcatcgctccatcggtatactcgattgccaagaaactccattgactcatttgtgacacttgtcgcatgttttggagcccagtacgtgtcaagaagaccacaccatctaacagctatggcattcaccaacattaggcaagtagaagatgaatcacttcatgagatttcatggaaagcctatgtaagaagcctcctacaacattggatgagtttagaacaagggttgtcgggttcatccaaatggaagtga

SEQ ID NO: 78958 - DNA, 2085 bp, Glycine max
  Peptide Sequence Number=SeqID_170643
atggccgaagtgatcaacaatatgccccccgaatccctagaccacgaccaatctccctccgcttccgctcctcctccgccggccgcctcttcctccgccgccgacgatctccctccgccgcctctccctcttccgccgcgccgccgggaccgtagggacgaccgcgatttcgaccgccaccccaaccgcagccgcgattactacgaccgcgacagggacttcaagcgccgccgcagccctagccccggttaccgtgaccgccgctactcacccccgccgccgtcgcgccggtcgcctccgccgtacaagcgatcccggagaggcagcccccgcggcggggcctatgtacctgatgatagatttggctatgattattctggtggctatgaacggggagcaggtggaaggactggttttgcagatgaaaagtcttatggcaggcttgctcatcgatctgctgggggatatcataatgggatttctgatgtggataatagtcgcggttatgcagatttgccaagtggaggtgcacaaagagaggggttgatgtcctataaacaattcattcaggagctggaagatgatgtgctgccagctgaagctgagcgtaggtatcaagagtacaaatcagagtatatttctacacaaaagcgggcttattttaatgctcataaggatgaagagtggaggaatgaaaatgctcgacggcttgcaaaggattttttgcttgatttgcaaagtggaacattagacctaaatcctggtttgaactccacttcatccggtaaatcagggcaagccagtgaacctaattcagaggaagaaacagatggtaaacgaagaagacatggtaggggacctaataaagataatgatttctcggctgctccaaaggctcacactatcagttctgaacctagacggatacaaacagatattcaacaggctcaggctgttgttcgtaagcttgacagggaaaagggtattgacgataatattttatgcaccagtgaccataataaaaatgatgacaaggctcacagtggatctgtgggccccatagtaattgtccgtggcttaacatctgttaagggattagagggtgttgagctactggacacacttattacatatctttggcggatacatggtgttgattattatggtatgattgagactaatgaggccaagggttttaggtatgtgaggccagaaggaacagggcatgaagaaacaagaaaatctggttctgactgggagaagaaacttgattcattttggcagggaaggttgaatggtcaggatccattggaagtgatgactgccaaggagaagatagatgctgcagcaactgatgtgttggatccacatgttaggaaaattagggatgagaaatatgggtggaagtatggttgtggagctaagggctgcacaaagctttttcatgcggctgaatttgtgcacaaacatttgaagctaaaacaccctgagcttgtgatggaactaacatcaaaattgcgagaggatctttattttcaaaattacatgaatgatcctgatgctcctggtggaacgcctgtcatgcagcaacctcaggataggcctcttaagcgaagattaggaggtttagagggccgattgaaggatgaccgtggtaaccggcgagaccaggacaggagtgacagaataaacggagataggcctgatggttccccatcccatgaaaggcaaatgggaaatcatgatgaagcaatgtatgatgcatatggagggctcggtgtacctcaatttacctcagatatggcccctccgccagttttgatgcctgtacctggtgctgggcctttaggaccctttgtccctgctccaccagaagttgcaatgcagatgttcagggagcaaggaggaccttcgtcatacgatgcctcaggaaggaagattcgatctggtcctcatatgggtggaccagcacccataattgctgttcctccatcctttagacctgatcctcgacagatgcgaagttatcaagatctggatgccccagaagacgaagtcactgtgatagactatcggagcttgtag

SEQ ID NO: 78959 - DNA, 483 bp, Glycine max
  Peptide Sequence Number=SeqID_170644
atgaccagctcgctactcttccacttacccacttcaccaaatgaatcgttgcactcgcactgttactcttcatcttgcaccactcaacacttctttggggagaggaattgttgttgtagagtgaggtggaggggttggtggaaatggttcgaggcattgttggagttcaaggatttaattattgtgtggacggtggatgatgataaggattataacaagggtggagttttaggtttagggtttttcccctttgtaagtgaaaaatttaggaataggatgattgagaggggctgcggggttagggtgttggctggggttgttatgtgggaaacgcttttgctgaagttatgtttggcattcgagaaagggattggtagagtggagcaggagaagaagctcatggctttcgcggttcagaccactactcactctccaactggccccacttctccatggatggaagctctcgttcttggaacataa

SEQ ID NO: 78960 - DNA, 159 bp, Glycine max
  Peptide Sequence Number=SeqID_170645
atggcttcctatggtgtggcatctccaatcatatttctccttctccattcccctgccatcaaacttcaagaagcaaaggagtccattgatgaagaagatccaaggcctacaagctccataggagctacatcatgtggtatcaagagcatcttcatctag

SEQ ID NO: 78961 - DNA, 513 bp, Glycine max
  Peptide Sequence Number=SeqID_170646
gaagaatttgaggctaaactatctcaagctaggtctgatgctgcatcaagtgttggtgaatcccaactcactcccttagaccctgctgaagaacaaagacttaggagtcggtgttgggttgcagttgcaggaccaaagtgtaagggacgcctttatggtactggagaccttgctcatacttataactgcggaaagattaaccgcctgagggaggagctgcgtcaatcaaaagaggatatgcacatttttcagtcagtactccttcagttcctacctccagaggcacgaaacattattaatcaacatcaacaacctcaccagcagcatcaagaccagcatcaggaccaggcagatgaccaacagaatttccgtcggaaaggatccttggtgatgcaatcctaccctacaagggcattggatagaagactccaagtagattgggccagagatgcaagagaaggccctagggttctcatgagccttagggtagatttcgagcccatgggcgtatga

SEQ ID NO: 78962 - DNA, 282 bp, Glycine max
  Peptide Sequence Number=SeqID_170647
atggctgtctcgccagcaccgtgggcgagaccgtaccagctgggtgtgtcgccagaggggctagcggtaccagctgggtgtgtcgtcgttcccattggcgacaccctcctctctccatcctacgtggcctatatcgccactggtagtgacaatacacccttctctccagctttgccgccactggcaatggcgggttcagccatgccgccagtggcaatggcggtttcctccacaaaacaaactccctccgttatttcttttggaacagaccccatcccgtaa

SEQ ID NO: 78963 - DNA, 183 bp, Glycine max
  Peptide Sequence Number=SeqID_170648
atggaactctcaaaggcccccaacagtcagaatgggcgtagtccaacatggcctttgttttgtgcacaacctttgggaactttgtctgataatatccagacctttttcacttatgtggcccagatgcaaatgccacagagaattattagacgagccattggacgcatggtttctagattgtga

SEQ ID NO: 78964 - DNA, 189 bp, Glycine max
  Peptide Sequence Number=SeqID_170649
atgattggaatggagaaggagaaagatgattggagacaccacttcaaggagaagatgagtctagaagaagctcaccaccataggaggccatggataagagcttggaggaagaagaagatgaatgaagggagaggaagagaagagcacgaaattttgtgctttaaaagaactctaaaatatgaagtttaa

SEQ ID NO: 78965 - DNA, 711 bp, Glycine max
  Peptide Sequence Number=SeqID_170650
atgttgtccttcagccagatgcagtcccagtttcaatcgcacaagcaatcacaaggactcatactgcctcctgagcttgaggttggtcctttagcttctcgtatcaacacaaaggagagttgtgttaatccctcatggaatgacccagacacgggtgactcaaagaaatgtgggttgtacgtcaaagaaaatcctcctgacctagttgccctaagaagactttatgaggggtcaacaaccgttcacaacatccctttgcgtcatgatcaagtcaaggtcggtgttgaggaagttagagatgcagatgctctcatttctatacccactcaagaggttcagttagtggggcagacacttaacaccttcgttgcttggccgacacatcttgtcaagcgtttattagaacaggttatgtgggatgctaccgtgtttggggtgtttaatgacaacttccccttttacataaagtatgaagatctgtctaaaacaacacatggtggtcaatgtctcatcatctctgttatacaattgtggattctgcatatgactgagacaagtatgcgagcagggaatgtcgatgtgtatcgattcctcgagccacagtccatacagagatcagggcaatcacaatttgaatcagaaagttatattatgaactggatgcataattcaaaaagggatgtgtacctaggagcctacttgaatggttaa

SEQ ID NO: 78966 - DNA, 246 bp, Glycine max
  Peptide Sequence Number=SeqID_170651
atgtccaactataagagcacaaagtcatccatcaagaacctagagatacaagtgggacaattagccaaacaaatggctgaaagacccactagcagctttggagccaacacagagaagaacccgaaggaggaatgcagagcaatgttgactagaagccagaggaaagcgcaaggagaaggagaggaagctgaaggagaccattttgaggaaggaagggcagacaaagaaggagagaaggaggaataa

SEQ ID NO: 78967 - DNA, 300 bp, Glycine max
  Peptide Sequence Number=SeqID_170652
atgggctttggctatgatgattcaaaagacacttacaaagaggttgcaatggttgtgaataaggaagctttggaaacaaaagtgatagttcactgcatgggtgatagctattcgaaaaagattgcaagttggtggtctggttttcctagattaggtttgatttttcagaagaagatagatctcctccagcatcaagaacttgcagcccagaatcgtacacggctatataatcatggaggctgcacgagttctgtaccaagtccgggattgaagagttattttgtgagttttgggacttga

SEQ ID NO: 78968 - DNA, 534 bp, Glycine max
  Peptide Sequence Number=SeqID_170653
atgaaggagtttggaatggtagactcttggactatgttgctgaaagttaattgtgagggtcttcaattctttaattattattattatcagcaattcccattgtggatgactgaaaatggtgatttcttactattggataacagactagagcaaattgaaagtcgcaccaatgttgttaaattaaaaacacaacccctggttttctccccgcgcttgtcgaaatctctttctcctctcgtgagtttgtcttccctgcgctctcgtcgaaaacccaaaccattaaagttttccatcgtcgtcattggtgtccgccagctcaccgtggtgtccgccatcatcagcattgttcgtggcacagtgcaacctaaggtgtgttcgctagttagttgtttcataggttttagacacagtcttagctcctggagtgggtttaaagttattttggatgctatcaaggctgccattgtgcttgcattggggaaggagttggaagcagctgatagagcttcttgctccaagttccttcacctttaa

SEQ ID NO: 78969 - DNA, 231 bp, Glycine max
  Peptide Sequence Number=SeqID_170654
atgccaaaagaatcctacaatccaaatgtaacttcttccagggggaaaaatgatgtagctccatgtggagcttgtaggtcatggatcttcttcatcaatgaagtcttttgcttcttgaagatcatggcagcagaatggagaaggaagaaagatgattggagacgccacttcaaggagaaaatgagtctagaagaagcttgccaccataggaagccatggataagagcttga

SEQ ID NO: 78970 - DNA, 180 bp, Glycine max
  Peptide Sequence Number=SeqID_170655
atgaagctccatgtggagcttgtaggccttggatcttcttcatcaatggagtcctttgcttattggagatcaatgacagtggaacggagaaggaagaaagatgattggagacgccacttcaaggagaagatgagtcaagcacaagctcaccaccataggaagccatggataagagcttga

SEQ ID NO: 78971 - DNA, 615 bp, Glycine max
  Peptide Sequence Number=SeqID_170656
atggagtcgcgaagggacccattgtttcacctcaccattagaaccgacaatggatactgggctcatcatcctggcactgatcatgatactttttatgttaatgttacacttctctttttgcctattggtgcatcactcaatgtgcctcctattgaagtaccattgccactcattgtcattgatgcccatgctacaaggtacacctacatcactcctacttctcttacaccatcttgtgattcacttacatcttttgactcgtcgtcatttttgaattttgttcatcttggtactaatgttgaggagatgctctctgacactgttgtccctatggaggcatttcccaccttgaatttgattcttttggttgcacaagccccatctatgattgtgattgaagacagcgcagagaattctatggaggaggatcctgaaaaggatcctaaggaaggggagggtagcatagatatagtatcagtattgaggttttctattctgccttatgatatacttgtactttatatccccagtctaaatgaagttacaaaaaggagcattgcccatgccacacttgtggcgagtgccacacccaaggtgtgggcactattggagtag

SEQ ID NO: 78972 - DNA, 477 bp, Glycine max
  Peptide Sequence Number=SeqID_170657
atgggtcagctccagcgacaagcctttaacaaagcttatggtaagatctgggacctaaccatggtagatgtctccacagaggccattccctccctcgcccaatattatgaccagcctttgaggtgcttcacctttggggacttccagttaacatccacggtggaagagtttgaagaaatcctgggatgccctctaagaggaaggaaaccatatctcttcttgggattctatccctccttggctagaattgctaaaatagtcaaaatctcaacacagaaattggaccacgggaagcaagtcgaaaatgaggtggttggggtaccaaggaaatgtttggaagcaaaggcgagagtcttggcaagtcaagacgaatgggccccgttcatagacatcttggcacttttgatcttcggggtgcgattgatgcttttcatgccttttacgaccgcaaggaagctcggttgtgggatcctctag

SEQ ID NO: 78973 - DNA, 387 bp, Glycine max
  Peptide Sequence Number=SeqID_170658
atgaaggctgatatggaggccttgaaagatcaaatgacctccatgatggaggtcatgttaagcatgaagcgaatgatgaaagatcaaatgacctccatgatggccgccaccagcgccgccactaaggtagatccaacccatccatccgccataaaccaagcgaaccagcctatcccggacgtggtgggtcaaggaagagaggtgctgggcagcaccgacagcccacacatggggcataataggaatgcttacctctatggcttaccacccctcaattatatgccgcccaccatgcacatgcccaatgagaacattaatcatgtcgttccccttactgttgtgggtcagcaaccccagcctgtagggggcgcccgtgaagaaccttga

SEQ ID NO: 78974 - DNA, 477 bp, Glycine max
  Peptide Sequence Number=SeqID_170659
atgggaacaagtggttgtatcaattataatcccatccttgccgtaagacaacttggctattccatgagaggagcaccgtcggaagaaagtatcatgcctttcatcgcacggggtttcagtgaccccaatgcaaggatattccaaagaatccgaaaggcatggagtgtggtgcaaaggaaggataaggaacttaggggaagcagcaatggaatcgttggcggctatcacaagtggctgaaggctagaatgcaagagataacctggctaccgaagctaaaaatctcaactaaggaagaggccgaaatccctgaggagagcgaagaggtgcaagccttaaaggtagaacttgaaagggcgcaagcgatcaaagaaaagttcaagacgacaaccatcaaggtccagaaagaatgcgacgagctgagggacatcaacgtggccacaactgaagcattggaatgggaaacaaagagggcttga

SEQ ID NO: 78975 - DNA, 1926 bp, Glycine max
  Peptide Sequence Number=SeqID_170660
atggtgatgagtttgtcaagcccccatgtgtggatgagtgttgtccggtttcggttgtccgtgatggacatgtctttggcgtgtcaagaaaggcgcgcacgtcacacgcgcagtactcttgcatacgtgtcacatgtgaagtggacacgtaatggagtaaaggcggttcctcgtttgaggatactccttgaggtgcctcaaattgtgagtcctcctcttcatagatggcaaggacctcatgccgaactgggtgcgaggagagctagtggcgacggagatgtaaggtcgtctccccacgcaagacctaacgtgagggctagatcgttgtcgtccacccctgccgttgctggctatgagtgggtgagggatgatgtgttgaagtacaatgtgtctaagaatctgttcgagtttgacacaaacgtctttaaccatttcaaggaccatttctttaaggtcctagttattgatgttgtggctgatggaatgccactgatgttcaatagggatggggagcccctcttcccattctactggcagtttgatcccatcaggttcaagtcatatgatgaggatctgttgaccattgtggaaagggtcgacaaagaaattttagagcaactgccggcctcgctggaagcgcgggccattttgtctcttccttccgcaagcgatcatttcacttccttggatgataatgttatgggtgacttcgcttggaggccactcgtgaagcaggtcggacctacaggtggagatgtgccaccatctgttgatgcttcatccactggagaagagggccaacatgctagtgaggttggtcctattattgttgttgttgaggtcgtcgctagtgctccttcctctattttggtaaagaggaagagggacgatgctactgggccgtcgagccataagaagttgaaggcccctatgagcctctacgccttaaggcaagctgcagggctagggtccattgcgggtcgcctcatgattgcgcaagatgaggtttttcccattgttgttaaagttgttgtgccagccactcaagctgactctgttgtggtgtcgtcgtccaccattgtggcccttttactaagtgtcggtgtggtgacaactagtgctcccagggtgttgcctctttcttcgtcagctccgatggtcctctctgctgctgttttggcggctatggggtcgccttcttcgttctcccaccctcacgtctcccttgatcatttatccatctctagtgatgctaactcactatgggccattgacaaaaatctcatcaggttggccggggtgcagaatgctactaactctgccaaggtgtttctccaaaggagtttggaaattctggaagagaacggactacgacaccaagaggcagtgcaaaaggttgtgttcttggaggcagaggccttaagggtgaactgccaactgtcttccaaggttggtgatgcactagccaagttgttgcacacccggttagatggtgacgaattgtttaactgttgcaagtgcttgcaggctgagaagatagacctgggtggcaaagtggagagcatggcagctaaaaaggatgggtttgccaagaggattgctgagttggaggcccgacttagggagtcagagtccacattggaggggtccgagctacgggcttccaaggagagggaggccagcatgaagctcgaggaagagctgattctgtacaagaagaaggtcgttgagcaacatgagaaaggctttcagaaggctgtcaagaaggtcggtttctttgcaaaggaccttgacttaggtctcttcgatcccttcaaggatgtgaaggagggtgtctggcttgatgaggagcagattgatgcggaggagaaggttgttgatgaagggcaaggtgttgtgaagcaaggcgatgatgtctgtgtctag

SEQ ID NO: 78976 - DNA, 258 bp, Glycine max
  Peptide Sequence Number=SeqID_170661
atgaggggacttggttgttctgcagctcgcccaggcgagctattgcttcaacttgaagtaagtaaagataaggacactaatttcatcctagcaatcttgctatccaaccgacagctggaagaaatcaaagcagtgaaacctgtcaaaaagaaaaaatgtatgaagtatcaaggacaccaaacaaaagactttgaagttttgaaatgtaaggaagacgttgaagtctcaacaaaagagattgaagcctttgaaaggtaa

SEQ ID NO: 78977 - DNA, 345 bp, Glycine max
  Peptide Sequence Number=SeqID_170662
atgacccctacagtgaagtacgatagaatggcagtgcatagctgccaggcaccactactcgctgccatgctgctatttagattcaggagtattggttgcatgcaaagcagcaaaacatgctcagatctggagcttgtattatattctgaatttatagatattgagcttgcagttgagtaccaaaacaaggcgctgattgttaaagttgatacagatgacgagtatgaatttgcacgcgacatgcagctgacaagaatcagtattttattaattggtgtttccactttcaagactagattacatcctcaaaagggaccattaccaacagatctagacacaggctga

SEQ ID NO: 78978 - DNA, 345 bp, Glycine max
  Peptide Sequence Number=SeqID_170663
atgcaccacgccccacgacagctatatataccatccaacgccattctacctctcttccacgcacttgtggaagtgaagttacggttttacccttcttctggtggtgccggagaggaacatgttcgtaggaagatcatcatcgacatggcgcgttgtttcggcttaggttccgttctggttctggcggcgctcgcggcgtcgatggtggtgctgccgttgatgctcccgccgctcccgccgccgccgctggttcttctcttcttccccgtcgggatcatggcggcgctcatgttgcttgtgttctcgccgtcggatcaaaacggcgtcgtttacgccaccacgtaa

SEQ ID NO: 78979 - DNA, 399 bp, Glycine max
  Peptide Sequence Number=SeqID_170664
atggcagtgggatggagaaggaagagagagaggagatgccacttcaaggagaagatgagtctagaagaagctcaccaccataggaagtcatggataagaacttggaggaagaagaagatgaatgaaggcagaggaagagaagagcatgaaattttgtactctaaaagagctttgaaatatgaactatggttcagtccactaattcaagatcaagtccaagattctccactaagtatgcttaggtggcatgaggcatcccatggacttgaaatctaccctaaggctcatgagaaccctagggccttctcttgcatctttggcccaatcttcttggagtgttctatccaatgcccttggggggtaggattgcatcaattagggatttcatcaatgggatga

SEQ ID NO: 78980 - DNA, 576 bp, Glycine max
  Peptide Sequence Number=SeqID_170665
atgtgtcattttcaagggtttttcaaaggaagtgtaaaaacatccaataatggttcccaatggtggtggagaaggagcttgggggtgttgagggagggtttaggggaagagaaggaggaagaagatggctcttttacgctactggacgtatttgtagcctgcaacactcgcccaggcgagccaaacttgcctaggcgagctgatccacagctcaaattttttgcttcgggtgttacaacttcaccttcctctagtgcaagtgaagaagaaaaagggaaagaatctagtgaagaaatctactcccaagaagaaggacaacctttaatggttaagggggagtgtaaggagacacttgttagcactgccacacctcttgggcttgaggttattcctcaagtaaagaagttgttggatgggggtttgattgcttcaacaaacaaagtcgctctagagatcccacctttaagatcaagccgcctcaaaacaaagtgtttccaagacatgcaaggctctggtaatcgattaccagacagtgtaatcgattaccagaagacaagtttgaaaaatagctattaa

SEQ ID NO: 78981 - DNA, 491 bp, Glycine max
  Peptide Sequence Number=SeqID_170666
atggatttgaaaaagctttccgcgaagagatctaggagggacgccgcggctgaagggaccagtgccactcccgaggatgatgagtacacaaattttcaagaagagatagctcgccgacattggacgtcgttggtcacccccatggctaagtttgacccagatatagtcctggagttttatgccaatgcttggcccacagaagagggagtgcgggacatgcgatcatgggtgaggggtcagtggattcccttcgacgcagatgccctcagccagttcctgggtgacccgttggtgttagaggaaggccaggagtgcaagtttagtcagagaaggaacaaagctgatgggtttgacgaggaggccattgcccaactattatgcataccgggtcaggattttgcccggaccgctgccggaaggcgggtgtggatcatgcacaccagcatgacccatattgacccagatgtggatgacgttgatggctcaccaat

SEQ ID NO: 78982 - DNA, 432 bp, Glycine max
  Peptide Sequence Number=SeqID_170667
atggagattgagagaaagcaaattgaagtccagagattaaaagaatcaagagttaagcaagttccaaagaatcaggaatcaaaaagcctcaagaatcaagtttcaaagaatcaagattcaagaataatcaagtttcaagaattaagattcaagaataatcaagatcaagattcaaaactcaagattcaagaatcaagagaagactctatcaagataaggtatatcctttgtggcacaagtagagggtacatctacttgggttgttatactgagaacaagagagggtacatctcttgtggatcagctcaagtggagggtacatccacttggttgttcaaagagaacaaggaagggtacatcccttgtggatctttggcttgtaaaggattttacagtctcaagaaccattggttgcttggggactggatgtag

SEQ ID NO: 78983 - DNA, 396 bp, Glycine max
  Peptide Sequence Number=SeqID_170668
atggtcgaagctcttgctatgcacactatagcggatgacagaaatgttgttcagcaaagaaaagggtgggaaaaactgaaggaaagggtcatcaaacctaacattgatgccttggtgaaacaaaatcaagttagtgctaaagttattttctgcaactctagggaggaagccatatctgcagcctcactcattctcccatatgtctttgaagctcatgttgctaaagttagtgccctgagatgggctatggaaacaactcttcaactgtccttctcttttgttcattttaaattggattgccaaaagatggaagcttactggattgaagaatgtcctcctcaaattcagccatttcttttggatgatgtaagaccaatggtctctttatctcaatga

SEQ ID NO: 78984 - DNA, 165 bp, Glycine max
  Peptide Sequence Number=SeqID_170669
atggatcagagcttgaaggcaggagaagatgagtggagggagagggagagaaggggcacaaaattttgtgcctcaaatgagctatggttcagctcactagtccaagatcaagtccaagattttccactaagtgtgcttaggtgtcatgagacatgtaaagcatga

SEQ ID NO: 78985 - DNA, 1038 bp, Glycine max
  Peptide Sequence Number=SeqID_170670
atgctgactgagaatacaccattgattgaggacccttcatctcccattgaagaacatgtcaagtggaagatagctctcacaaagcgatatgggcagatgacatctcagacagcgcaagaaatatctaatagaattgactcgctacaagaacagacgacacagggtagttttgttccaaatagttgtgacaacatactcaataccaccattgggcgactagagcatccaggttgtgttcatgtagcagggtctggtatgacaatcagtcaatactatggaagggcatcacgtggctccagcagttcctctacaacaatcactcaacaacagttgactgagatcattggaagccttaaggaagagtggagcaatgagattatcggaaacctgaaggaagaaatatggaatgagattgaagaagaaaataagcggagtctagagaaaatgaaacaggagttgaaggatgtcatcaaaattgaattctcccaaatgggatcacagtactcacccctgattgatgcagatatacaggcattaggtgcacgtatcagcacaaaagggagcaatgttgaaactgttgtgaacccatcaggcaaagaacatgatgatcatgtcatactgactatggggttgtatgtgcaacggaacgtagcttatgccaatgatgtggtaagggtcagtgctgaaaaatttttagacggtgacgccagggaggcccttcacagattcattgcatggctgacaaatcttgtgaaacttgtggcacaggaggattcacatattagtccaaagaaactagttgaacctcttccaaggtcaaataatgtttctgcaaaggatcctttgcgtcaattgactaagagtctatatgacatttacgataagtctgttgagttgatgtgggatgcaaacattaaagaccactgtggatggaaaaatgatcaaggaactcctaagtggattgaagtaaagagccatgttcaaagtgggggctatgagtgtggctattacatgatgcattggatgtggaacatataa

SEQ ID NO: 78986 - DNA, 183 bp, Glycine max
  Peptide Sequence Number=SeqID_170671
atggcgagttcgctgcgcaacgcccacatggcagggaaaccgccattcgtgatggcgagttggtgtcaggtggaactcgccacctctgctggcgagtttggtcatggttttggaaaccgctactttgactggcggtttggctttgcatggggtgcaggcttggtgcagctacggtgcaggtga

SEQ ID NO: 78987 - DNA, 398 bp, Glycine max
  Peptide Sequence Number=SeqID_170672
atggagaggaaacgtcctgagttgaagctatcttcccatggaaagaagatggctaagttcgggaggcttgccccagagattgaaggccttgtggcggccagtggactgagtcctttgatcgcttgttccctagatacgggcgatcggggactaatgtctacttttgtcgaacactggtataaggaaactagcagtttccattttcccgtcggagaggaaactatcaccttggatgacattgcgtcgttgctacattttcctgtcgtaggggcgttccacagcttcgagctacttcatgtcgacgatgctgtcgagatgttggtggaattgctcgaggtcagcactgcagaggcgagagctaagacgattcagtgtcatggctcttatgttcgactatc

SEQ ID NO: 78988 - DNA, 174 bp, Glycine max
  Peptide Sequence Number=SeqID_170673
atgaaagaaataagaaaccagagattagggggaatatttttctgtcaggaaggtgatgcaatcctacccccaagggcattggatagaagactccaagaagatgaggccaaagctactgaagaaggccctagggttctcataagccttagggtagatttttggctcatgggctaa

SEQ ID NO: 78989 - DNA, 196 bp, Glycine max
  Peptide Sequence Number=SeqID_170674
atggcttctaaaactgtaaatcgagttgactctgttgatgatattgagtttatggaagatgaggaagaagtcaggttgaacctaaaccaaatacaaaagagaaaagaagtgacaatgatgaaaaagagagtaaaaaagttaaggtttgcacgtaatgcatgtgggcaacaacatgtaattggtgggagtaaagtag

SEQ ID NO: 78990 - DNA, 348 bp, Glycine max
  Peptide Sequence Number=SeqID_170675
atggtcatcattgtcaatgcagaagcttgtggttacgtgagcatgaactactaccaatatatagatgttgtttacacaaatgagcacatcttaaaagcttactccgcacaatcgtggcctcttgggaataaagcggctattcctccttctgatgacgcatggacacttatccctgacccaactacaattcgtgcgaaaggtcggccaaaatcaacaaggataaggaatgagatggattgggtcgaaccatctgagcaccaacccaaatgtagtagatgtggagccgaagggcataacaggcgtcgctgtccaatgcaatctgagcgtgggagttgttcaaatcattga

SEQ ID NO: 78991 - DNA, 225 bp, Glycine max
  Peptide Sequence Number=SeqID_170676
atggcttcctcgaatggaaattttccagcatctatgcttgttctcaaaggcaagaactatgatgattggtgtgctcagatgaaggtaatttttcgatttcaagatgtgacagaaatggtgcaaaaaggggttcaagaacttgacagaaacccaactgatgcacagaaggtggctcaccgtgatttgatgaaaagagatgcaaaacattgttcattattcatctag

SEQ ID NO: 78992 - DNA, 198 bp, Glycine max
  Peptide Sequence Number=SeqID_170677
atgttggtggcgactccgcgcatctttcctcctttggaaagcgcacccgtgagcctcgccctcgctcgcccgcgaagggcacgttgcgacagttggcgactccactggggacttttttttgggccctatacccgggttcatgggaatttaaggagtggaggtgaatctatcatcatgctaggtctccgacttgcttga

SEQ ID NO: 78993 - DNA, 201 bp, Glycine max
  Peptide Sequence Number=SeqID_170678
atggagaaagatgcattgcacgtaggatcatggagtggaggctttaatcccttctctttctctctaacatttaggaaccttaacagagcaaccaaaggaggaactctagagagcaccagaaatgtcacaattgataatagagaacacttgagtgactacatcgagtgtgattccaaaaattattcaagtgttggagtttga

SEQ ID NO: 78994 - DNA, 627 bp, Glycine max
  Peptide Sequence Number=SeqID_170679
atggcaatattggtggttgagtttcagcaagaactggcacagatggttcagatgatgatgtcgaagatacctgaaccacttcaacatccttatgaggtgcttgtgaaggctgagctgaagaaactatacttggtccaggctgcaataatcgacctgggattacgagagaagggcaagcttgaacctgaaattgcatgcggtttgctggagatgggtggcactatagcatttatatctggaccagaaatggtcagtgatggcaagttagcagctaacatggctgctgaagttgaaacaatgggtgcctcatttgttactgatactggcaaaatttcagaagcaagtgttgcagaaggtgcgggagataaagcagaagatgaaggagatagagcggacggtgcaggaggcaaagctgatggagcaggagccaaagcagaaggtgctggaggcaaattagatggaggcaaggaagcagatgttatactaggaatactagcactcgcaggaagtaaagatgatggtaattcaggcaaattagaagatacagtaggtaaagagggggtgatgttgggatactgcattggctgctgcatagatgaaggcattgataaaccaggtggtggttga

SEQ ID NO: 78995 - DNA, 372 bp, Glycine max
  Peptide Sequence Number=SeqID_170680
atggttgggttgcaaccgagtcaaggcgacccgacccaactctcggcaaatttccccagatggggcccttttaaaaactatttccccaaatggggtagttttgaaagaatttaccaaaccgccattgccaatggcgagttcgctgtgcaacgcccatgtggcagtgaaaccgccattcgtgttggcgagttgatgcaggtggaactcgtcacctctgttggcgagtctggtcatggtttcgtaaaccgccagtttgactggcagttttgctttgcaggaggtgttgcaggagatgcaggcttcctttgcagtgcaggtttgcttttttcaggcgtaggcacgtttttcagtcgtgatagggttgctttttaa

SEQ ID NO: 78996 - DNA, 57 bp, Glycine max
  Peptide Sequence Number=SeqID_170681
gatggttaccttaaaatcttgggagggtatttggagaaatctaacatgttgcaatag

SEQ ID NO: 78997 - DNA, 576 bp, Glycine max
  Peptide Sequence Number=SeqID_170682
atgactaacaaaaagatgatagaaatctccgtgggaagatacctctactctctcatcctagggccatgcaacagtggctctgaactgctcgggagtaggccacgggtaaggcttggggtcctggcactgctggtgcagtgtatactggtagaagttgtcgctcaactgcacctagcctctatggtttgccgtctgctggtcaaccaaatgttgcattggtggtgcatctgctgccggctgctgctgctggtcttgccccgactgttgtgcctaccttggcatgcaatacttctcaatgaaggacctgttaatggggaggtggatgagctttgtcggcgagatcggtatctcgtagaactggcaaaggcctgtgatcaatgctggaaatcccagtgccctgttggacttctttgggtccactggatgtctcggaggtgcaatacctacaaactagtaggtggcatccgagataagttgtgctacatgaacattgatctgagtcaggatagaatagaccaactggcatttaggcaatgggagataagaattatggtcactggggaggatgttgcttag

SEQ ID NO: 78998 - DNA, 423 bp, Glycine max
  Peptide Sequence Number=SeqID_170683
atgaagggagttgcagggaccagctcaagacctttggtgcaagaggtttgcaccacctgtggcaaacatgactcttctgagcagatgtggatgatgtttccaggaactgatctgtttgccagaatttcatttcatgcgtctcgtactatattggaaacagttagtaatgttttggccataacccataagtcctactatatttttttcagtgcaatgggcagtggcaaacctatagcattggatgaaatgaaaagctgggtttcatgcattagtttggagtctgggctatcaacacttttcctatttgatgcaatttctttatgtaattgcaaatactactacactgtaatgaatgtaattttacctaaatgtggccttgtctactacactgttgaggttttcaaatgccacttaatagagtga

SEQ ID NO: 78999 - DNA, 405 bp, Glycine max
  Peptide Sequence Number=SeqID_170684
atggctccaaagaagcttcctgctaaaagggctaggaaggtcaccgcaggggagggatctagtgcagccctgcaagcggagattgagtttgacggacaccgtttccgaagcgaggagcatcaacgccgttttgaagcgattaaggattggaggcagtggactcagctaacagagcccatgcctaagtatgaccctgagatagtcatggagatctatgcaaacgtctggtccattgaagaaagagtcatggataagcgctcctgggtgcgggtccaatggatcccctatgatgaagatgctatcaaccaattcctggggcatccgttgatcttgggagagggacaacattgtgaatacgctgaaagaagaagccaggtgtcaggttttgatggcatgaccacttag

SEQ ID NO: 79000 - DNA, 462 bp, Glycine max
  Peptide Sequence Number=SeqID_170685
atgcacttatcacggtggtgtcccggggcactctatcaagcagtgtgtagccctcaagtacaagaggatagtccgaatatgaggactaatatgcttgccaatcatggaggctcgacgatgaatgcagtggaagaatgggagtctcgagggctgaagcatataagggatgtgtcgacttccaggtggttcatattggaagcattgcgcgaggccaatgtaattgaccttgacagtgacaaaggagatccgtgcttaatgcatccaggggcgtcgcacgatgtggaaacatgcccggtaactgaggagctactgcagggaatgataaacagggggcaaattgaaattcgtagctcaaagaaaaaggaaggggaggtatgcatgcaatcgggtgacagaaacccgagtaagcctaagctttcggcgatccatttcaccagggacattaccactaaaaggccctga

SEQ ID NO: 79001 - DNA, 342 bp, Glycine max
  Peptide Sequence Number=SeqID_170686
atgaaatggatgaatatattcgctctcactctgaatgagagtcaagagctgccaaggttgttagccagagccaaggcagtggctgacacatactcggcttccgacgaagtccacgtaaccatagtaaccaaaaagaatgtatgcgctttacggcacccttaccgaacctgtgccaaggctaaaatcatgagcaagatagaggaagttcaggaacagttgaaggctgacatggatgccatgaaagaacaaacgactaccatgatggagaccattatgagcatgaggaaaatgatggaggtcaacacggatgcagttgccgctacagtgctgccattgaggtag

SEQ ID NO: 79002 - DNA, 550 bp, Glycine max
  Peptide Sequence Number=SeqID_170687
atgggcaacattcgtcgatgtattagctctgctagtgtttgggaagtactattcctgaatgtagacgggttggtggatctagcgacaatcaacgcctttctggcttatcaccacagcaaggaaagcctggtcatcgctgttttggcggatacatatgatatgttcgacttgagatgcgagaagagcaatgcaagaattgtctattgtacacttgctctttatgtaaggttggtatcccacgtttttaatcatgaaggcatgacgggagcgtccattagttggttctcatggtggaaagaaggaggggcaggagtgttatgctcgtgtgagggattcccaaatgtccccttgatggggacgagaggttgtattaattataatcccatgctggccataagacagttaggctaccctatgagaggtgcaccgtcggaggaaatcatcacgtctttcatcgcgcgaggtcttaatgaagctaatgcgaagatacttcagaaaatccgtaaagcatggaatagagtgggaagaaaagataaggagcttaggggaa

SEQ ID NO: 79003 - DNA, 240 bp, Glycine max
  Peptide Sequence Number=SeqID_170688
atggcatttggaaccatggcaactcgcccaaagcataagaaaaagctggttaaagatgcaagacttgttgacttagcagacaagacatctgaagaaattcatgaagacgttgttctggaatctcttaagacattgtctactgaagaagttcaaaggcaaagttcagagaaagacaccatgatgcacatagatggtgagctagtgcttgaagttgtaatagttgagtccattctagcatag

SEQ ID NO: 79004 - DNA, 669 bp, Glycine max
  Peptide Sequence Number=SeqID_170689
atggcaggagctagtgacggtggcggtgaatatcatcaactggacggatctcagcaaggactagagaaccatctgaatcagaatgctaaaagaccttatagtgggaacagagagggcaatgatggaccgaggcaaaacagaatggagatggcactagtgagagtcaacattgaagagaaaactggggatacaatggctcgttttttgaatggtctaaatcctaacattagagtacaggttgaacaacaactcgaggaaaagtgcatcaagaaggaactcatccaatactttcaactagaactagaccaacagatcgaagaagaagggaggcaactcatccaatccatcagcagcgtcccctcatggaaagtcagcagcagaagacatattgcttttgaatgtccaaccaggaggaccataatcatgaaggcagatggagaaatcaccagtgaatctgaaatcaatgaagaagtaaaagaagagcttgagaaggaagctacgcaaggtgatatgttattggtgagaaagctgttggaaatgtccaaactgaatttggaaactaagcctcatcctagaccatacagactccaatggcttagtaaagatgaagaggtaaaagtgactcagcaggttgagttgtgtctcaccattggaagatacaatgataag

SEQ ID NO: 79005 - DNA, 2852 bp, Glycine max
  Peptide Sequence Number=SeqID_170690
atgaaaatcccgtgttgttcggtttgccaaacgcggtacaacgaggaggagcgagttccgcttctgctccaatgcgggcacgggttctgcagagagtgtctctcgagaatgttttcggcgtcttcggacgccacgctggcgtgtcccaggtgccgccacgtgtccaccgtcggaaactcggttcaggcgctgaggaagaactacgcggtgctcgcgctactccaatccgccgctgccgccgccaacggcggcggtggagggcggtcgaattttgattgcgactacaccgacgacgaggaggacggtgacggcggtagagaggatgaggacgaggaggacgacgagaagcggcggcggaacagccgcgagtcgcaggcgtcgagctccggcggtggttgcgcgccggtgatcgagctcggcggcggcggcggcggcgcgcacaatgacctgaagctggtgcggcggattggggaggggaggagggcgggggtggagatgtggatggcggtgatcggcggtggtggcggcggcgagggaggaggaaggcagcggtgccggcacaacgtggcggtgaagaaggtggcggtggcggaggggattgatttggattgggtgcaggggaagttggaggatttgcgtagggcttcgatgtggtgcaggaatgtgtgcactttccatggcacaatgagggtggaagatagtttgtgtcttgtgatggataagtgctatggatcggttcagtctgagatgcagcgtaatgaagggaggctcactttggaacaagttctaagatatggagcggacattgcacgaggggttgttgagcttcatgctgctggagttgtttgcatgaatttaaaaccttccaatcttcttcttgatgcaaatggtcacgctgtggtttctgactatggacttgctacaattctcaagaagccttcctgttggaaggctcgaccggagtgtgactctgcgaagatccattcctgtatggaatgtataatgctcagcccacattatacagcaccggaggcttgggaacctgtcaagaaatcattgaatttgttttgggatgatggaataggtatatcttctgaatcagatgcgtggagttttggttgtacattggtggagatgtgcactggtgccattccttgggcaggtttaagtgctgaggaaatctatcgagctgtcgttaaagctaagaaactgcctccacagtatgctagtgttgttggtggtggaattccgagggaattgtggaagatgattggagagtgcttgcaattcaagccatctaaaaggcctacttttagtgcaatgcttgcagtatttctccgtcatttgcaggaaataccacgcagccctcctgcaagccctgataatggcttagataagggctctgtgtcaaatgtgatggagccttccccagtacctgaaatggaagttcctcagcaaaacccaaaccatcttcatcgacttgtgtctgaaggagatactgcaggtgttagagatcttcttgcaaaggctgcatcagaaaatggcagcaactacctatcgtcgctattggaagctcaaaatgctgatggtcaaacagctcttcacttagcttgtagacgtggtagtgcagaacttgttgagacaattctggagtgtagtgaagcaaatgttgatgtattggacaaagatggagatcctcctcttgtttttgcattagcagctgggtccccagaatgtgttcgtatccttatcaatagaaatgctaatgtgcggtcacgattgagagatggttttggcccatcagtagctcacgtttgtgcctatcatggtcaaccagattgtatgcgggaattactattagctggagctgatcccaatgcagtggatgatgaaggtgaatctgttctgcatagagcaattgccaagaagtacacagactgtgctcttgtgatattggagaatggaggctgtagatcaatggccatcttgaattcaaagaatctgacaccgttgcaccattgtgtggcaatatggaatgttgctgttgtgaagagatgggtggaagttgctacttctgatgagattgctgaagcaattgacataccaagccctattggcactgccttgtgcatggcagctgcttctaagaaagaccatgaaaatgcaggagctgatccatctgctcaagattcccagaatgggaggacagctttgcatacagctgctatgactaatgacgtggacttggttaaggttattttaggtgctggggttgatgtgaacattcgcaatgtgcacaacagtatacctcttcacttggccttagctaggggtgcaaaggcatgtgttggactgcttcttgatgctggagcagattataatttgaaggatgatgatggtgacaatgctttccatatagcagcagagacagcaaaaatgattcgtgaaaatcttgactggcttattgttatgctaatgaagcctgatgctgacattgaagttagaaaccacagtggcaagacactacgtgacattttagaggctctcccccgagaatggttatctgaagatctgatggaagcactcgtgaataagggagttcatttgtttcctacaatatttaaagtgggagactgggtgaagtttaaaagatctgtcacaactccaacacatggatggcaaggtgctaaaccaaagagtgttggttttgtgcaaagtgttctagacagagataatctcattgtttcattttgttctggagaggttcatgttcttgcaaatgaagtcataaaagtcgttccattggataggggacaacatgtacacctgaaagaagatgtaaaagagcctag

SEQ ID NO: 79006 - DNA, 642 bp, Glycine max
  Peptide Sequence Number=SeqID_170691
atggggggtgcagtgaccttgttagatatccctggtggaggtaatagagtgggtgacctcgacacttactgcctagttttcctaagtgagagtgtcatgtggacacgcttaggctatttccttggggatggtaccacattgcatttgagagttgaagtcagtggtgatatcatagcaacgaggcgggtcgttacagatgtcttggtccattttgttggaatgaaacatgaaccatgtgaaatccacaacatggatcctgacaagtttggtgtttactatgtgatagacgacatcaactcatttgtagaaaacttaggtttgcctcattgtcatccttttatcatagatgagttttggcacgaacctcgattggctgcacctttttcacttgttgtcaatgaacttgtcaatgaaggtataaatgaattggttcctatagttgaggatgatgtgggtagcaatggaaattgcccaatacaggttgatgaagtgtatgtaagtgatggagatttgacttctaaggggttgagtgaaggatcttcatctgatagtgagtatagtccttttgataagtatgcagaattgacaaatggggatgccctaagtgactttgatgaatcagtggatgtaattggagcatga

SEQ ID NO: 79007 - DNA, 612 bp, Glycine max
  Peptide Sequence Number=SeqID_170692
atgaagcatctcaatctcgattttcagctcattactaatgaaaatggtaaaaggaagttgaagattgatgcttggtttggttctcggaaaacatctgtcgccattcgcaccgccctaagccacgtcgagaatctgatcaccgacgttaccaagggctaccgttacaagatgaggcctttggttgaaatacatagagcaataagaatgcatgagagaaaaattaagaaatttgtggcaaagaaaaaccttgaatgtgcaaataggttgcgcgagaaaacacccaaacccaagatcaataggattattcggcagaggtacctgagaattgtggatgcactcagagaattggatgactgtcttacaatggctgaggttgaggaccaaactataacatggttaactcctcattcactacaacaggttgtatctgatgattttgacatcactaccatgctaaactttctgcaattgtatgagcttgtaggccttggatcttcttcatcaatggcagtggaatggagaaggaagaaagatgattggagatgccacttcaaggagaagatgggtcaagaacaagctcaccaccataggaagccatggataagagcttga

SEQ ID NO: 79008 - DNA, 342 bp, Glycine max
  Peptide Sequence Number=SeqID_170693
atgcataacataggggttaataaccctttggaacagcccccctcgtcctatttattgaaaaaaaggggtggagcttgccgtccagctcgcccaggcaagctctgctcgccccagaattttacagaagcattagggaagccacgaaagccatttttcaacaaaacgggggaagaggttgccgcccagctcacccagaactttacgaattccacggcgatgggtgttaaacattttgaagtggtcaaacgaaggtcgcatgccgacaaacgatggtccccgaacgaaattagggccactagcgcaaatccaagcagtaaaactgtgaaggcatggagacattga

SEQ ID NO: 79009 - DNA, 516 bp, Glycine max
  Peptide Sequence Number=SeqID_170694
atgtcatctactgtttgcaaggatcacgcccgcaagacacccagtggacccgaagaatttcaacagggtcctggggttctagctctgattacgggcctctatcggttctacggagtgtccttcacccccaacaaggtcatcaggccccctattaaccgagctttcatcacgaagtattgtgcccccaggcaggcacagggcgaggcaccacgacagcctggggacagccagcagctggcggcagactcatcgccaccacctttggaatccacctcaactcatctacaagggctagagcattgcctacgatacatggttgaccagcaggcacccaaccaccgggacagaagctccccgcaaagaagtccaggaagggcaccattgaaaaggattgcaatgtggccccacaagccaacacaggttttgacaaacattgattctagagcgtggaacatcgatagcgtttcgaggccatcaaaggatggtcattcctcagacagagacagacgcaactga

SEQ ID NO: 79010 - DNA, 495 bp, Glycine max
  Peptide Sequence Number=SeqID_170695
atgcaggggtaccgtatggttatccgcaccttttgtcatcccgaggcggcgagcccgatgacatatggaggtaccgtatggttatccgcatcttttgtcaaccaggaggcaaacgagcccattgacgcgcagagactaatgtcgtctcctgcacctttcttcaaccaggagggaagcgagcttgttaacgcacagagaataacgtcatcttctgcaccttttgtcatcctgagaaagcaacctgatgacatgcgggggtaccgtatggttatccgcaccttttgtcatcctgagacagtaaatccgatgatatacgggggtaccgtatggttatctgcatctttcatcaaccaggaggcaaacgagcctgttgacgcgcagagactaatgtcgcctcctgcacctttcgtcaaccaggagggaagcgagcttgttgacacgcagagactaacgtcgtcttctacaccttttgtcatcctgagacaacaagtctga

SEQ ID NO: 79011 - DNA, 353 bp, Glycine max
  Peptide Sequence Number=SeqID_170696
atgaccagccctctcaatgagtcaatcttatgctttctcatatgggtggacccttgggtactagaacctattgcctttagaggactacatgtcctcgccatcagagggctacacgccctcaccttcagaggactacacgtcctcaccttcagagggctgcacgccctcaccttcaaagggctacacgtcctcaccttcagagggctacacgccctcgccttcaaaggactccacgtcctcgccatcatagggctgcatgccctcaccttcagaggactacacgtcctcgccttcagagggctacacgcctcaccttcagaggattgcacgccctcaccttcagagaactacac

SEQ ID NO: 79012 - DNA, 213 bp, Glycine max
  Peptide Sequence Number=SeqID_170697
atgaagatgaaagacaacaaaacaagaaatgaattaaaactttcggattcgaaaacttaccggttgaagaacgaagaacggacgaagaacggtgaagaacgatggaaaatcttcacgaaattgctcatggaaatgtctcagaagcgttacggaagaacctcagcttggattttcttcacggaaacacgttttttcacccaaaaaccagcctga

SEQ ID NO: 79013 - DNA, 147 bp, Glycine max
  Peptide Sequence Number=SeqID_170698
agagaatctcctttatccccgcattacaaattgtttgaggggacacatgtcccagacattgtctcaacatcagggaaagctgctgaggaagaggaagatgcagcagaggatactgaatcagatgatgattctgaagccaccccatga

SEQ ID NO: 79014 - DNA, 540 bp, Glycine max
  Peptide Sequence Number=SeqID_170699
atggatgccaagataactttaatattgcaccatggaggaagattcactccacgtgccaatgatggaaaggttgaatatataggcggagaatttgacatttgggaggatatatctacaaattacatgaacatatttatcctatgtgatctggtgagctatacaatagatggagatatattatacttagtgaaggatgctttggaaaatgagaatgagataaatgtttattttcatcatgaagttgatccaattccagaagaagtcccattgatgttggacttgaaatgtcatccaattctagaagctagtaatgaggatgatttagatgatgtacctgttgctggccatgaggaagatgttggtggtggagagaaagtagcaaggtataagttaaacataagaagacccaaacaaaagaacatttcaaacacttcaacagtagacacacctattgtagatgtcccaccaacaacacccttacttttcatgccaacaccaaggttcactagaaggaaggctgctgataaagatccagtataa

SEQ ID NO: 79015 - DNA, 402 bp, Glycine max
  Peptide Sequence Number=SeqID_170700
atggatgaacatcaacagaactggaaggaaatggctaacacaatgattaagattaacaaaaaagcaaaggaaatgttcaacattgttcatgttatggatcggtcttacggtgaagtcagtaggtcatttgttgtaagatggaaggatgaactagagcctacttggcatctgctacactttagtggcaacatgcactctgtcacatataaccaagatctggatgtgtcaagtaccaagtactcattcatgaaagctacaagattcacccatctaaacttggaagggactatggagtgtatgatagtttataatcatcataggaagattgcaaaaattggaaatggatggaggaattttgcacaatcaaagaattgcttcctagaactcaaattatatatttga

SEQ ID NO: 79016 - DNA, 558 bp, Glycine max
  Peptide Sequence Number=SeqID_170701
atgaatctgcagacgaggttgtcagagagtctgttggaatggagaaggagggagaaggcattagtagatgtctatgtggtgaggcggtttgtcgttgcgggatttggtcttggagatgtagagggcgaggaaaatggcttcgaacctcatgagggacggtggctccaggaagtagacgcgggagaggtagaggccgacgaggactacaaggtggagttagggtcaaaggagaggcaggcattcacttctaagacggtgttcgaaaaccattgtcaaatgacggttcttgatgaggacacaaataagggtaaggaccatgaagcacttgaagggcccttgaccagaggaagacttaaacacgcccaacacgtcatagagacaaggaacttttggcatttgataaaatttggtgagagcttctctctgggttccttgttgaaccaatctcagacttatcaaggtaatccttgtggcgtctatccagacttatcttccttcactggaagtggcgtcatccaaatctccatagcctgtatcaagcgatctgctcctagttag

SEQ ID NO: 79017 - DNA, 288 bp, Glycine max
  Peptide Sequence Number=SeqID_170702
atgatgcagttagtagaagcatacaaatccttgacattgaagaaatcaattcaagaaaccactacaggcaatcattggaagctggtgatcaaagtatgccatatggtggtggtggtccagagaattctcactctcaaggcttcttccaaccattatacatcaaagaagtatccaagcttttccaagtcagcagggtattatatctcatatctaaatgcatgtttggtccttacccatcctttccatgtccaaagcccgtggttggtttccccaagtgcattaaaataa

SEQ ID NO: 79018 - DNA, 171 bp, Glycine max
  Peptide Sequence Number=SeqID_170703
atgacgacaacgattaaggtgacagaggtggtgacaattgacaacgatggtggggtcattgatgacagtgatggtggcgacgacaataattatgatggtagatgcgacagtggtcatggtagagacaacgacaatcgtgataatgatgatggagataaggagaaactttag

SEQ ID NO: 79019 - DNA, 1230 bp, Glycine max
  Peptide Sequence Number=SeqID_170704
atgatgagtttgaaaggaagttttacagatatcgtcctcatgcatgaggatttaacggaaactatccttgatcgttatggcattcaatgcatggtagcccacacagaagcgtcatgtgtcgtcatgcttcttaaccagcagaacaggggaggagaaagggctggtactagggcggataagtcctttctgcaacatgaagtctacttgggcttcaatctcttgtttctgaaaatgggggtaccgttacagccgcacattaacgggttcagaattggggataagaagaatttgggtagaggacgtttgggtcaaaggaagctctgtaggggtaatggaaatgtgaaaatatgcattgacgtcctttgtgtggatgatgtgatgaagttgtggtggagtaagcatttgaagtgtagagtcaacttcgcctttgagctccacgagatgatgaatgtcaacaaggaatatgatgccctggacttgaacgggaaccacctcgcaaagaaagtggcactgaaggtcatgagcgacaggcgggtcgggtgggtttatatgatgggagtcctccttagtgtcgtcatcatcatcaacgatgataaggaaaaccctagaggcgcatttgtggtcgcggtggaacttctcatcgtaattgaagcaaaggtcgcactcgtgcccctcgaaggagtgggtaacaatggaggaggaagtgtcgaagaagtgggtaaaggtggagagcaaggcacaggctttaatggttgcaaggcctggacctcgggacggatttccgacgtgagtccagagatgaaacagctcaaaaggaacgacgaaggaagaccaataatgcggttagctaagtcttcaaactcggagagcgaatcgtgtttaaagggattgcaggaagactggccaggacgtgagttgaccattattggtcatccactaaaaccaggccagagtgcaaccatccatgtagaacgaagcaatggtcaagcacttgtgttctggagtggagtggtactcaaaaaattggttgatcttgaagatccaaccgaggggtgcacggaagttgctgaagaaggaggagcagtcgaagaagaaggggaagaagtagcagagtccttggtggctaagctatggatcagttcatcaagcttgagtgtctgggacaacgagagcaccaaaatgttaggttcttcactcacaactttggacttcgagggccagtacctctag

SEQ ID NO: 79020 - DNA, 1281 bp, Glycine max
  Peptide Sequence Number=SeqID_170705
atgacagctgttgctgaagatggaagctggtcagttgtaaaaccgaagttgcagaactcaattgaactaactgttgctgctcatgatacaactggtgggatgaaaacaaagatagcagaagctgcaatgatagccaaacttggaattgatgtctacattgtaaaggcagcaacaagccactcattaagggccttaaatggagatctgagaagcagcatccctgacgactggctcgggacgttagctaaaagtgcttttaacaatatcagaaaggatactcttaagataaacaagcggtattggattgatctaaaagatgcagcttatgagctggatgacatcatggatgagtgtgcctatgaagaattggggatggaatacggaggagtcaagtgttgtctatcagaaatggaaatggaaaggataagtgagagattaaataaaattgctgaagaaagggagaagtttcatttgactgagacaactccagagagaagaaatgctgtcactgatcaacgccaaaccaacccattcatcaacgaaccacaagtctatggaagaaatgcagagacagaaaaaattgtagactttttgcttggtgatgcctctcattctgcagacttatctgtctatcccatcctagggttaggaggacttggaaaaacaacactggcccaactcatttacaatcatgagagggtagttaaccacttcaagctaagaatttggatatgcgtatcagaagattttagtttgaagacaatgataaaagctatcatggaagcagcatctgagcgtacttataattggcagaagttgaaatctgcactggtttgtggggcaaagggtgcttccattttggttacaactcgcctttcaaaggttgcaggaatcatgggaacaatgcctcctcatgaattatcagagctatccaagaattattgttgggaatttgtggggagtgctgctttcagcaaaagagagaaaaaagagtggctctatgttaaggaaagcaacctatggagtttatctggcgatgcaaactctataatgcctatgctgagactgagttacttgaacttaccgataaaacacctaaggtacttgaatctttctgaagctcttcaggagctatctttgattgagtgctcaacactatcaagcttgcctcctcaaatagggaagttggcaaggagagagagttcccaattcttgatctcaagatattctttaagcttcaatcttcccaattctgccaaaagaggccaatatgtcaagtaa

SEQ ID NO: 79021 - DNA, 579 bp, Glycine max
  Peptide Sequence Number=SeqID_170706
atgaagcttcaatgtgtcacagacatagacgatgctaaacttggagaacctaacgatggttatgacgaaatcaccatcccagatgagtttcttatcaaggactttcaagatcctatccaggcaattgttgaagcaacatatccagacttattacagaactatagcaatggaaatttcttgcaaaaaagagttgttctagcctctacgaaagatgttattgacaaaataaatgactatgtcctatctttgattcctagtgaggagaaagagtattgtagtgctgatagtgttgataaatcttatgaactactcagtcctgctttcggagtactaacacctgaatttctaaactcattgaaaacatcaggaatacctaatcacaagctcaaaatcaaggttggtactcccatcatactactacgaaatttggaccaagctgatgggttatgcaatggaactagacttattgttacaaggcttggttcaaatgtggttgaagcagagattattactggacccaatatatgtcataggacatacataccaagaatgaatttgtctccttctgattctccatga

SEQ ID NO: 79022 - DNA, 483 bp, Glycine max
  Peptide Sequence Number=SeqID_170707
atgaaattagctaagattttttatattctagctctactttgtaaagttgatcaaaaaacatcagctaatacacttcacaagaaatttcaaataaccggccactgtactcagtggaacagcatcaatgtaagagcttcaccaccattattacagactatctctaaaagaatccactatggaaaatttgttgctgaggcgaagtttcaagatgctcctcatgaatatgaagccgccattaaagcgagagacaggaaactgttgctggagttgttgacatatgaaacagtggataaatttgtcaagaagagagtagaaattatggcacagcaatatgccgcggtggagaagatcggtgaaacaggctatatacccaattctgtgtatagaataaatccaagtttgattgcagatctttatggagattgggtaatgcctcttgcaaaagaagtgcaggtggaatacttgttgagaagacttgactaa

SEQ ID NO: 79023 - DNA, 732 bp, Glycine max
  Peptide Sequence Number=SeqID_170708
atgggtggaattagtatgggtaaaaaacttgatcgagttattgttgatacttttgagcacattatatttcctgatgcctacgctatagaacctatgtggggtgcactcggatcgctaccctatgtgggatgcactcgtaacaaattggataaactgaaggatacatccaaaattttgaatccatctgatgttgatggaagttgtttatatccattgaatcttattggttcaggtggtgtattgcataatcacaattctcaatggcttttgggattctcatcctttgctggtactagagacgcagagaaggcaaaacttatggctattcttaacggtctacggacgaagaagaggaacccaatcttggtgggggaatcggagctcaaggcagcgatcaaagaagtgataaagaagattgagaacaaggaattgggagatggggctttcgcgaatgtgaatgtgattcatttggacaaagcaggattgggaattcgggtgtggactgtggagtggagggttttcattgacttgggtgtcttcaagtggctggtggagcagcctgtggggtttggcgttgccggtggtttgggtaacatgcagcaactgaccctcacgaaggccaacaaggtggcagtggcggtggcggtggcggtagcggcagcggagatgagaaagatggtgagcaagttcggtgagggtggcattggaggattgttaggtcatgctacttag

SEQ ID NO: 79024 - DNA, 372 bp, Glycine max
  Peptide Sequence Number=SeqID_170709
atgcgggggtactgtatggttatccgcacctttcgttatcccgaggtggcaagctcgatgacatgcggcaataccgtatggttatccgcatcttttgtcaaccaagggcaaacgagcccattgacgtgtgccgcaacgtgccctttcgcgggcgagcgaaggcgaggctcacgggtgcgctttccaaaggaggaaagatgcgcagagtcgccaccaacgtttatttgtggaaaacgtcggaaaaaccgaaggaaaccggtcaaaatgaaaattctaagttcgggagttgtatttacgtttgaggaaggtcgacaaaagaggggcttttgctcctacgtaccctccatcgaagaagaaatcagacctacgtag

SEQ ID NO: 79025 - DNA, 312 bp, Glycine max
  Peptide Sequence Number=SeqID_170710
atggcgagaatagccaaggtagtcaaaatctcggtgcaagagttggaccgagtaaaacaaaatagaaatgggatagtcagaataccaaggaggcatttggaggaaaaggtgaaggcgttggtggatcaagtgctattggtttttggatttgtcctctttccaaatgtggatgggctaatggacttagcgacgatcaatgccttccttgcttatcaccatagcaaggagagttcggtcgttgttgttttggccgatgcctatgacacctttgaccgaagatacaaaaagagtggcgcaaggattgcttgttga

SEQ ID NO: 79026 - DNA, 309 bp, Glycine max
  Peptide Sequence Number=SeqID_170711
atggcacctacactttgcacacacattgagatattaggccttatactcgggtctataagtgctgaagttgatgtctcgctaagcgagctcaatgcgcttagcgagtgtcatccgctaagaaaggcatcaacgcgcttagcggataggaggaatctagaaggaaatctgccatgcaggcacgcgctcaacgcatcatcagctcacttagcgagtcgtttgtcaccttccaggcttagcgcgagtttggcactaagaaaaaactcacttactcgcgctaagcgcgagaatggcgctaagcacgacgtcgag

SEQ ID NO: 79027 - DNA, 126 bp, Glycine max
  misc_feature (37)..(37): n is a, c, g, or t
  Peptide Sequence Number=SeqID_170712
atggagaattggcgaacagcgctacgcaataacttcngcggggctccagactcgaagcgctacgcaataacttcgcggggctccagactcgaaggtggaggacacatgaaaaccgctaggcaataa

SEQ ID NO: 79028 - DNA, 297 bp, Glycine max
  Peptide Sequence Number=SeqID_170713
atgtatgaatatcctaggagaacccgtgcattaacgcataagcattcctttcaaaattcatatggatattcatgctttgttggaaaaagggaaatggctccgaagaaactctccacgaagaggtctagaagagacgccataggagaagggtccagtgccgcccctgagtttgatagtcatcatttccggagtgccgagcaccagcagcacttcgaggccatcagaggatggtcgttccacagggagaggcgtgtccaactcagggaggatgagtatacggactttcagaggagatag

SEQ ID NO: 79029 - DNA, 219 bp, Glycine max
  Peptide Sequence Number=SeqID_170714
atgtcggctttgaaagaacaaatggtttccatgatggatgccatgttaggaatgaaacaactaatggagagtaacacggccaccgccaccgctgttagttcggctgccaaagcagacccgaatctcccaactaccacacacttccctattgcaaacatggtggaacgagagagaagcacaccggggcacatcagcaacccccatccggggtacaactga

SEQ ID NO: 79030 - DNA, 333 bp, Glycine max
  Peptide Sequence Number=SeqID_170715
atgaagtcaggtgacatgcggagatacccaagtggttatccgcacaaacgatttctgttaatcctaacccgtgaagttaggtggcaggcggagatacccaagtggaagtcaggtggcaggtgggggtaccgtatggttatccacacctttcttcaaccaggggcaaacgagcccgttgacgcgcagagactaacgtcgtcttctaaaccatttgtcatccaaggacagcgagtcaggtggcaggcagagataccttatggtcgtccgcacctttcgtcaaccaaggtgaatgagttcgacggtatcaggatgatgttggtcgtccgattctga

SEQ ID NO: 79031 - DNA, 249 bp, Glycine max
  Peptide Sequence Number=SeqID_170716
atgactaatgttggttggggttgcatggaggttgcgacggttacagagggggcgatgatggtttgtggggtggaagcgagaatgaatgttgaaaaggctctggcagaagtagaaggaagagcacacgaagcaaagctagcagaagatgttaacatgcgaatattggttgatcgtgctaatgctgaacaagaaaaatgggttgcagccataaatactacttttgaacatatcggaggaacattttgttag

SEQ ID NO: 79032 - DNA, 1237 bp, Glycine max
  Peptide Sequence Number=SeqID_170717
atggctacctcaccaaaagaaactgcagcttctggttcaccatctgtcccgtcatctccacaccaggaacaacctgaattcaacatccaacccatccaaattattcctggtcaagcctctgtccctgagaaactggttcccagaagaccacagggagtgaagattgctgaaaaccctagccctgcaacgagtcctagggaagtagacacggagatggacaagaaaatacgcagcattgtgagtagcattttgaaagacgcctctgtgcctgaagctgatgaagatgtcccaacatcgtccaacccaaatgtttctgtgcctgatgtcaagaaagatgttccaacatcttccgctccaaatgctgaagcactcccttcacccggtgaagagggatcaactgaggaagatgatcaagccgcagaggagactcctgcaccacgggcaccagaacctgcaccaggtgatctcattgacttagaagaagtcgaatctgatgaagaacccattgccaaccggttggcacctggcattgcagaaaggttacaaagcagaaaagggaagacccccattaagaggtctggacgaatcaaaacaatggcccagaagaagagtactccaatcactcctgccacatccagaagaagcaaggatgtcgaactagatgtctcgacatctaagaaggccaagacttcagggaaaaaggtgcctggaaatgtccctgatgcaccattggacaacatctctttccactccattggcaatgttgaaaagtggaaatatgtgtatcaacgcagacttgcggttgagagagaactgggaagagatgccttggattgcaaggagatcatggacctcatcaaggctgctggactgctgaagactgtcagcaagttgggagattgctatgaaggcttagtcagggaattcattgtcaacattccctctgacatatctaacagaaaaagtgatgagtatcaaaaggtgtttgtcagaggaaagtgtgttaaattctcccctgctgtgattaacaaatatctgggcagacctactgatggagtgatagatattgatgtttctgagcatcaaattgccaaggaaatcactgccaaacgagtccagcattggccaaagaaagggaagctttcagcaggaaagctaagtgtgaagtatgccattctgcacaggattggagctgcaaactgggttcccaccaatcatacttccactgttgccacag

SEQ ID NO: 79033 - DNA, 189 bp, Glycine max
  Peptide Sequence Number=SeqID_170718
atggctccgagaaagctttatgcaaagagatctaggaaggatgccgcggttgaagggaccagtgccgctcccaagttcgacaaccatcgtttcaggagcgttgagcaccagcagcgtttcgaggccatcagggacgatgagtacacagatttccaggaggagatagcctgtcggcgttggacgtcgctg

SEQ ID NO: 79034 - DNA, 402 bp, Glycine max
  Peptide Sequence Number=SeqID_170719
atgccgattcgtgttcctgatgagttacctgcggtcaatttcttgcgcggtgagaatgtcttcgtgatgacatcctcgcgggcaaaaacacaggaaatcaggccactgaaagtgctgatcctcaacctgatgccaaagaagatcgaaacggaaaaccagtttctgcgcctgttgtccaactcgccgctgcagattgatatccagctgctgcgtatcgacagccgcgaatcgaagaacacgccggccgagcatctgaataacttctactgcgacttcgaggatatccagaacgagaacttcgatggtctgatcgtcaccggcgcgccgctggggctggtcgatttctgcgatgttgcctattggccacagatcgagcgcgtgatcgactgggccaagcaccac

SEQ ID NO: 79035 - DNA, 900 bp, Glycine max
  Peptide Sequence Number=SeqID_170720
gtctctttgtatgtgttgtctggaaagaggaggactcaatgattattcgttcaccggaaccagaagtgaaaattttggtagatagagatcccataaaaacttctttcgaggaatgggcaaaaccaggtcatttctcaagaacaatagctaagggacctgatactactacttggatctggaacctacatgctgacgctcatgattttgatagccatactaatgatttagaggagatttcccgaaaagtttttagtgcccatttcggccaactctctatcatctttctttgggctgagtggcatggggagggttccgaggaaatacaaataacctccggtttttttcagatttggagagcatctggaataactagtgaattacaactctattgtaccgcaattggtgcattggtctttgcagccttaatgctttttgctggttggtttcattatcacaaagctgctccaaaattggcttggttccaagatgtagaatctatgttgaatcaccatttgacagggctcctggggttgggatctctttcttgggcaggacatcaaatacatgtatctttaccaattaaccaatttctaaatgctgcagtagatcccaaagagattccacttcctcatgaatttatcttgaatcgggatcttttggctcaactttatccgagttttgccgagggagcaactccctttttcaccttgaattggtcaaaatacgcagaatttcttacttttcgtggaggattagatccagtaactggaggtctatggctgaccgatattatacaccatcatttagctattgcaattcttttcttgatagcgggtcacatgtataggactaactggggtattggtcacagtataaaagacattttagaggcacataaag

SEQ ID NO: 79036 - DNA, 498 bp, Glycine max
  Peptide Sequence Number=SeqID_170721
atggagaataacgtggccactgctgccgctgttagttcggctatcgaagcagacccaactctcccagctaccgcgcaccatcctctcccaaacgcggtaggacgagaaagaagcatactagggcacaccagcaacccctatttgggatacaactgggtggcttacccttatggattaccacctaattacacgccaccagtcatgcatgatgacgcgggtcttatcccttcccccatccttgaaggggagcctcctcgacaggccgacgagcacaatctcacagcacaaccaatattcttgtccacagaaggaccacccccggcggtggaagaaagaaggaaactcgatctcatcgaggagagattgagagatgttgaaggctttggcgactatccgttcgcggacatggcggatctttccttggtaccggatgtcgtcatccccccaaaattcaaggtacctgatttctacaagtacaaagggacgacttgtccttag

SEQ ID NO: 79037 - DNA, 381 bp, Glycine max
  Peptide Sequence Number=SeqID_170722
atgtcttttaaggttgtaatggggccaaggacaaggtatggaaaaatatggaataagaggctaaatcccaaaggaatagaggagcaatggggaataacctttgagaaacagcatctcattcagcatgtccaacatttaaccaatatacaatttaaggcttgtagtgagctacaaaacaaggaaagggaaacaaggctcaaaagggctatcaaaggaattaattcaaggaagcatcaacaagaatcaagccaaggctattgtgcaagcaatcaatggggcaaaacacaccaaatgattatgatgatggatggctcaaattctaacaaagaggaaaagcaaggatttcaaatcgcaaaatgtcaagaggccttttttaaataa

SEQ ID NO: 79038 - DNA, 831 bp, Glycine max
  Peptide Sequence Number=SeqID_170723
atggatgggttggtggacctggcagcgatcgacgcttttctcgcctatcataaccacaaggaaagcccggttatcgctatgctagccgatctatacgacacctttgaccgaagatgtgaaaagaacaatacaaggattgtttgctgtactccagctctttatgtatggttagtctcgcacctttttcgccaagaagtgaggcatgcttgcccattagaaagccactgttcatgcacagagaaaggaagggcgaattgggatcaactcttagcaagcaaagaaggagcatctgtcaactgtttccctcgatggaaggaaggaagaaccgaagttcttatttcttgcggaggatttcaaaatgttcccttgatggggacaaggggttgcatcagctacaatcccgttcttgctataagacaacttggctatcctatgagaggagcaccactagaggaagagatcgtgcctaaggtccgcaaggcatgggaggtgttgcaaaagaaagacaaggaactcaaaggcagtaacaatgggcccatcggtggctaccgtgagcggttgaaagcccacgtgcaaggtttggattggctcccaagtctgagagccactaaaagggaggaagatgaggcaccggaggaagacgaaggggtgcaggcccttaggacagaactcaagcaagctcaaacagccaaagaaaggttcaaatctgcagctcttaagatccgaaaggagaatgctgaactgagagatgtaaatatagctaccaccaaggctttggaacaagagaccaaatgggcccgtagggaagaacatagccggaacaagttctga

SEQ ID NO: 79039 - DNA, 105 bp, Glycine max
  Peptide Sequence Number=SeqID_170724
atggtcattctgcgtcttgtatcagccaagaggaacaagttcgacagtatcgggatgatgttccgctggcaggaaggttcactggccgaaaggtgtttcgcttga

SEQ ID NO: 79040 - DNA, 255 bp, Glycine max
  Peptide Sequence Number=SeqID_170725
atggccaaaatacaatgcccaaaagaaggaaaaacctattctaatatttacaaagaagagtggatccaaccttggcccatgggctcagcaatctaccctgaggttcatgagaaccctagggatgtgagtttagttattagaagggtgttggtagttaaaactctggcttatcaaagaagcctcatgaggaagcttctcaggatactaccggagattcatagaaggtttctccaagttggctttacctttgactaa

SEQ ID NO: 79041 - DNA, 366 bp, Glycine max
  Peptide Sequence Number=SeqID_170726
ggacttagcagcatggagaggagtatgattgatgctgccagtggtggagctcttggtgatatgactccggctgaggctaggaatctgattgagaagatggcttccaactcccaacaattcagtgcaagaaatgatgctattgtccttagaggagcaaatgaccatccaaaatatgcaatttcagcaagagacaagagcctctattcagagtctgacaaattagatgggaatccgaaaaatatgagtgtcatcaccttgaggtctggcaagcaaattgaagtgcctccaccagtagcaccacctgtgcctgaacctgtcaagcttcattctacacctgaaaaagaggatgagctagctgcacaatag

SEQ ID NO: 79042 - DNA, 1557 bp, Glycine max
  Peptide Sequence Number=SeqID_170727
atggcaatgttagaaactagttcaggttcagaggttgataaagatgcaccagtagaagttgacactggttctggcagtcattctggtaccaaggatattattgaatgtaatgatgaacatgttggaaagtcagtatcaaatgatctggtagatgatagtcaacaaacctctacccttgaagattcttgtaagaaaagtgaactaactgaatctcaaacaacaacttgcaatgaggacgaccaaagtcattctgctttgagtaagagactaaaagctaacaactggtttgagacctcactttgtggtcatgaacttaaagcgggtatgggtttggctgctgctgccaaggtttttgaagcacatcgaatatctgcagaagaatttagaagttttgcattatccataattaagaatgaaaatcttattctgaagttcagagagaggtatctgctgtgggaaaaggatgctcctcttgtacttggaatgaccgtatttggtttagacttacctgttgagcccaaagatacaaatctagtgggattggatgatgcagtgaaggccaagtgtgatgctcctggaccagcttcatttggacgtagatggagactttggcctatgaattttcaaagattcaagacaattgatcacactaatagtgtatcaagtgaggaggtatttgtagattctaagtctgattgccaaacttctgttgtcgagccatctccaacatctgctatgcccatttccaaattcatttctatttcacaggtaaccactaccattgaatttggttctccaaacaaggctaattccaacagtgttcatgggagtgcattaggtgccaaagaagtggatgcttcaaggaagaatcttggatggccatacaaccctttccatgtgccagaagatgtcaagaagcatggatggggaggtgctaaacttgaagctgagtggaatgacaagtttgtggaatatgagaaaaaatacagtgaggaagctgcaaagctgaaggctattattgctggcaaattaccagctggttgggagaaagcacttccggatgggccaactcatcagccaatagagaatttggcaagcttcaaggcaatgccaaacactttgatgcttcgtccagctgatggtaatgaaactgctggatcatacaaagttgctatggttaacaggaagagaccctcaattgttgcactttgtaggcaaaagttcacccaaattctaggaactcctattgagggagttgaaaagggtggctacaccatttcagacaactcatcaggtaacaagcctgatgttattttcattcgaattggttttgagttggaaattgttgttgctgctgctaaggatctaaggaaggaaggaaaaacagttatagttgtttcttttgttagctgggaactttttgatgagcagacagatgaatacgacgagaatgttctacctgcttcagtaatagctagagttagcattgaggcaggatcaacatttggttggcacaacattgctggacgcaaaggaaaggccataggcattgattga

SEQ ID NO: 79043 - DNA, 454 bp, Glycine max
  Peptide Sequence Number=SeqID_170728
atgactattattatatatgtatttggggtagaaaaaatttccaatattgtggaagctctccataggctggatgagtgtatgactagaggcaatccatctgacttacaaccctttgatcctgagatagatagggcatttgataggttagttaggcatagtgtgcatcctactttccctgaacattttgtaccttttgagcatcctgagcattttgttattggtcagtctgagcattttgtggttggcaattttgaacatcctgattttgagcattatatttttgaacattctgagaacatggcacaacctccaccccatgagaggactctaagggaaatggctacacctgatttcacctacgaaagcttgtgcatccaataccctgatgaggatgtcccatatgttcttaaaactggactgatccatttgcttctaaagtttcatggctttgcag

SEQ ID NO: 79044 - DNA, 411 bp, Glycine max
  Peptide Sequence Number=SeqID_170729
atggacttgggatccctcatcttaggtcagatttctctcatcgcacaacatgactcctcgaggctagatgaccctttagtcactttttggggaacccgcaaatctagggccagaggatttgaggcaccatctacttcagctccccctacctcagctccttctacctctcctctctctccagcaccagcagctccagttcttctagatccttcttctcagagcttcgagccttccttgtctatgctgcagagcctgcatcagggccaactcctgatcatgtggcctggccaggagtccagccttcacctttgggaggaggtgaggcctctgcaacccaggagccttagcaggattagtaggaggacattccaaaggctacagagcctacacctcctaagccattcactttag

SEQ ID NO: 79045 - DNA, 411 bp, Glycine max
  Peptide Sequence Number=SeqID_170730
atgcgaggtaaatttcttgtagataaatcatcatttgatccagaaattaccaagactgaaaggaagaataaaaagaaaaagaaacaagcaaccattataacaccagaaaatatcatggctgaaagaggagaaggaagtagaccaccaaggaggactctgggtgactatgcttatcaacaaggcccaaaacattacaatagcatagtcattcctccttttagcaataagcagaatagagaaggaagagagagaggagatgccacttcaaaggagaagatgagtctggaagaagctcaccaccataggaggccatggataagagcttggaggaagaaggagatgaatgaagggagaggaagagaagagcacgacattttgtgctctaaaagagctttgaaatctgaaatctaa

SEQ ID NO: 79046 - DNA, 840 bp, Glycine max
  Peptide Sequence Number=SeqID_170731
atgcaaatttcattgttcatgaaaggaatcaccaatgactgtaggagaatgatcaatgcatcgaccggaggaaactacctcaataaaaccaccacccaagtgaagaccataattaaagatttggcgactagtgagagaactatagacacaaattggtcaaatctcccaaaaggtatgtatgaacttaatgctcaagataaccttttagctcttcaacaaaagatagagatggtaatagaagcaatgactaaggcaatccaacaaatcccacaacaactgcaaggggccatctcaaagaaaccccaacaagtgttcacgtgtgaagaatgcaaaggatgccatcaaatatcaaaatgcaccaaggtacaaaccgaggaagttaactacatgggaggacaacaacaaccatacaataacttccaacaaataggttttcaaaacatacatggaaactacaaccaattggaagaagccttgaccaaactcaccgaagtggttgtcaccaaccacaaaaacaccgaagtcacgaacaaaagcatggagactcaaaaaggcaagctaagcatccataagcaaggagacgatgagaggatggccaaatttgagaaatacatggagatgctacaaaggaagaaggaagaaccacctattaaaaaactcaaatgggatgtgctacatcaagtaagacccacaagacatttggaggacaagggatgttttactatccctgtcacattgaaaaatttccctatcgaccatgcactacttgacttaggcgcaagtagcaacctcatgcctattggttgccttaacctaaagctcaccaacatgactctataa

SEQ ID NO: 79047 - DNA, 324 bp, Glycine max
  Peptide Sequence Number=SeqID_170732
atgggatcgagtcagacgccttggcttaaaaagaggttctatcaggtcaagatcaagagcctaggagtcaccagtctgaaagagttaggacaattgataggtcaactccagcgacaagcctttcgcaaagcctatggaattggaccggggaaagcaagtcgaaaatggggtggttggagtaccaaggaaatgtttggaagcaaaggcgagaaccttggcaagtcaagacgaatgggcctcattcatggacgtcctggcgcttttgatcttcagagtggtcctctttccaaatgtggatgggttggtggaccaggcagcgattga

SEQ ID NO: 79048 - DNA, 439 bp, Glycine max
  Peptide Sequence Number=SeqID_170733
atgagtcatcattcatctagtgttaatggcaagggtactagtcataaggaccccctatctagaatcttagatgagttgagtcccctcaagagggaaataagggtagagcaacaacttaaaaggaagtctacttcaaaatcttatggctctcactcttatccaaagaaagaccaaggtcaaggcatcttaggggtgacaccttctaagcccaaatatgataaggggaagacaatagaaaagcaaccccttaaggctagtatgcaagagaagactagctccatgaagtgctttaaatgtcttggaataggacacattacttctcaatgcccaaccaagaaaaccatgactatgaggggccaagacatttatagtagccaagatgaggctactactccaccttcctctagtgaaagtgaagaagcaaaagcggaagaatcta

SEQ ID NO: 79049 - DNA, 231 bp, Glycine max
  Peptide Sequence Number=SeqID_170734
atggcagcggaatggagaaggaagagagagaggagatgccacttcaaggagaagatgagtctagaagaagctcaccaccataggaagccatggataagagctttgaggaagaatgagatgaatgaagggagagggagagaagagcacgaaattttgtgctctaaaagagctctgaaatctgaacctactaatccaagatcaattcctagattctccactaagtgtgcttag

SEQ ID NO: 79050 - DNA, 369 bp, Glycine max
  Peptide Sequence Number=SeqID_170735
atgaagcaatacaacatcttggagctttttttttggacagcaaaggttgctagacaacatcttggagctgattcctttctactaagttgtgaccaacatcagatgcaagctgcaattggtgctttcgatggtattattgacacagtttctacagttcatcctctcttacctctcattggtttgctcaagtctcatggaaagattgtaatggtgggtgcaccagacaagcctctggaactgccaatctttcctttacttgctgggagaaagatagtagatggcagtctgattggaggcttaaaggagacacaagaaatgattgattttgcagtgaaacacaagaaagatagtagctgccaattaacttag

SEQ ID NO: 79051 - DNA, 550 bp, Glycine max
  Peptide Sequence Number=SeqID_170736
ggtacatcctttgtggtacaagtagagggtacatctacttgggttgttgtaactgagaacaagagagggtacatctcttttggatcagttcaagtggagggtacatcttcttggttgttcaaagagaacaagggagggtacatcccttgtggatctttgcttgtaaaggttcttacaaggttgaaagaaatctcaaaaaccacaggccaccctgtggaagcaatgctttccaagattatgttgatgatgccaaagactcaattcaagaatcaagagtcaagcaagtttcaagaatcaaagagtcgttcaatcaagattcaagattcaaggtacatcctttgtggtacaagtagagcgtacatctacttgggttgtaatactaagaacatgagagggtacatctcttgtggatcagttcaagtggagtgtacatccacttggttgttcaaagagaacaagggagggtacatcccttgtggatctttgcttgtaaaggattttacaaggttattggaaatctcaagaaccggtgattgcttggggactggat

SEQ ID NO: 79052 - DNA, 225 bp, Glycine max
  Peptide Sequence Number=SeqID_170737
atgtgtgtcaagggtgtgattcccttgagtacactcatgcatagtgtgggcacagtgtccatcaccctagggaagtcccacatgagcctccaactagttgtggttggccttcagctttctgagttcctcctcatgacgccacccaatctccacaatgcgggtttggagttgctagagagtatcggtgtctatcatagttgttgggggaggattggagccttctag

SEQ ID NO: 79053 - DNA, 462 bp, Glycine max
  Peptide Sequence Number=SeqID_170738
atgtcaggatttacacgcgattctcctcaaatttcagccagcccgcatcaattagaccttgcaccttacgcttcagggtcctacaatgctcaatgggacaccccggggcttctccatgacaagcacatgttgcgttcgagtcgaattctaggagaaatggaggttgatgaaccttggctggggttatggctaccattgaattatcaagtagatatgggagcaagtcagcaaaggacaccggaattgggggttatgtgctttctccttgagttttctacttccaatcccaaagcattaacaatccaaaggcttcaaaagtgcaagaaaacgaattgttttctggaaaacgcgatgaactcgctaaccgagcatgctgcactaagcgagttcatcagtactcattatttgcatgctaagtcgtgctttcctgggccaagcacgatttgttgcggcatccactga

SEQ ID NO: 79054 - DNA, 342 bp, Glycine max
  Peptide Sequence Number=SeqID_170739
atgatcaagcatcatccgcagatcctcttgactttagagtcagaccagtttccactgttgaatgaccctaacaaagcatgcatctacgtgatcaagggaagatccaacaaaggatttagctttccaccaggaagccttctttacaacaaagagaagaaaaagatgaaagattgcaaaaatacaagtggtgaggatgtctccttcacctctatgatctcacaatcactcgcaaactcatctcaagctctcaaactggctcctacttcaagctctggtctctgcagatcttcacacagcaaaatctctcaaaactctccggaacttggacctttctctctctag

SEQ ID NO: 79055 - DNA, 243 bp, Glycine max
  Peptide Sequence Number=SeqID_170740
atggaagacgatgagaaaaaaaaagtacaagaagatcaaaaagctaaaagcattttaacttctgatgatgacaaaaagctcaagagaatcgaagaacatccatctcaagaaaatctagaacaagtcaaagagttcaagaatcaagaagaattcaaggctcaagaagaaagcctacaaacaagaatcaagattcaagatctcaagaatcaagatcaagattcaagactcaagattcaagaatga

SEQ ID NO: 79056 - DNA, 731 bp, Glycine max
  Peptide Sequence Number=SeqID_170741
atgcacagaaccagtacatggataatgtattggggagaaacatcttgctagagaggaaggtggagttctatgcaaacctatacaactttgagggtccttcaccaaagcaagccagggtcagaggccatctagtgaagatcaacactaagagcctcaacacattcctagagacacctgtggtattggcagagggtgagactttgcccacatactgtaggctgccttcagatcctagggagattgaggttgccctatgcataactgtgtggaatgttctctcatactccaacctggccctaacatcgcacacctctgacctgacagtggatagagctaggctgatctttggcctagtctctcgcatgggcatgaacataggagctctcatttctggccagatgacttttatagcccagtctaactcttctagacttgggtttcttactctgatcaccgccctatgtcgaggcagaggggttgtctctaacaacctcacttttgagcgcctgagcctgatcattaacctggcctacatcaggaagaactattggaatcctgatgatctgacagttgctatccgaggggctaggagggcgagggcgaggctagctaatcttccttccacatctgtagctcctactcttgcatccacttcagcagctccttcagacccagctcaaatggattctcaatgctttgaagccatgcttcagagcattcatcagggatag

SEQ ID NO: 79057 - DNA, 609 bp, Glycine max
  Peptide Sequence Number=SeqID_170742
atggctttgaagaagcttccaaccaagaggtccaggaaagatgccgttggagggggttctagtgcggccccacaggactttgcccggagcataacggggagacaggtgcggatcatggacaccagcatgaccaccctcaagcagatttggatgacattgctactcagcaacgttctccctagcgacaatacctcagaactccccctgccgaagtgtcaactggtctacgccatcctgactcaggtgagtgtacatgttgcccagctaatatcagatgctatgtaccattttgtagaggtagcgcctcctagacacccagtggacctagagaagtctaacaaggccctggggtttcttgctttgatcacaggcctatgccaattctatggagtgtcggtcaaccccaccaagcttataaggcctcccatcagcagagccttcattgagaagtactgcatgcccagcagagttaggaccccaatcctttcccttggcctacccccgagcagttcggggccacagttgcatggctcagagatgaggccaattttgagacacgggcaggatctacaggggccctgggaaggacggaggagcttaggcggatga

SEQ ID NO: 79058 - DNA, 561 bp, Glycine max
  Peptide Sequence Number=SeqID_170743
atgaacctagctcaatgtcaagtcttccgcaaggcatatgggaaaatatgggatttggccatgatagaagtgtctgttgaatccatcgcatccctcactcagtattatgaccagctgctaaggtgcttcacgtttggggactttcagttggcgccaaccatagaagagtttgaagggatcttgggatgcctgctaggaggaaggaagccgtatctgttttccggactctacccctctatggcaagagaagcgaaagtggtcaagatctcggcacaagagctagaccaagtgaaacaaaatagaaatagggtggttgggatgccaaggaaacacttggaggagaaggaaaaagctttggcagatcaaggagagtggacttcattcattgatgttttagcactgttgttgtttgggatcgtactctttccaaatgtagatgggctggtggatttagcagtgattgacacttttcttgcttatcaccgcaacctatctgccccctataaggtcatcacatgtgtgccgagaaaggaaaagcaaattgggagaaactcttggcag

SEQ ID NO: 79059 - DNA, 249 bp, Glycine max
  Peptide Sequence Number=SeqID_170744
atgtacaaagctaattggacccaaccttggcccatgggctcaaaaatataccctgaggtttatgagaaccttagggccttcttcagcagctctagtccaatcctcttaaagcctcttgctcatggctctagtgactggtcccttcctagggaggattgcatcaaaggttcccatacatgctggagaacaactcgttcaatggtgctgcccatgaagatcatatgtagaacccaaggaagtttattttaa

SEQ ID NO: 79060 - DNA, 486 bp, Glycine max
  Peptide Sequence Number=SeqID_170745
atggcgggttggggcctatggcgggtgttccttgatggtggagacgaccaagatggatgggtgatggaggtgcttgcttccttcaaattatgggatggtggaggtatgttcttgtatgagaggaatctctacatgtggagaatcagtggcagcagcattaaaggcttacttgcccgttggatgcttggcacaatggtctcatccgaaggtggtgcaacttccctctttctaaacaccaatccatcttcatcactgtcagtctcactaagtgcctttaggcattctacagtggacgatggttgttggttcttcttgaatcaagcacctccatcacccatccatcttgatcgtctccaccatcaaggaacacctgccataggccccaacctgaagcaatcctatcccccaagagcattggatagaagactccaagaagattgggtcagagatgcaagagaaggccctagggttctcatgagccttatg

SEQ ID NO: 79061 - DNA, 219 bp, Glycine max
  Peptide Sequence Number=SeqID_170746
atgagtcaagaacaagctcatcaccataggaaactgatggaagcttgcttcggaagacaaaggagaagaggtgagagaaggcaccatccactagggaataagccatggaagaaggagcttcaccaccaagatgagccttggataagaagcttgaagaggatgcttcaatggaggaaaagaaagagggagagaaagagagaggggggaacacgaaattga

SEQ ID NO: 79062 - DNA, 867 bp, Glycine max
  Peptide Sequence Number=SeqID_170747
atggaagcctttggctatcaaacgtgcttagaagcgagtgactgcaccatcggtgttcctttttattcaataaacccacttgttcccagtgatgttggagtgttcttgctttgggacgagagtccatgtgctagtagcaatgaaggcattgaactattcagacatggcagatttccactcttggtgtttgagagccttcgagaggcaagatggttaactaggttcaggggccaagaatatgagcgagtcaacctgcttgcgtttaacaatagcatttttggaccttgttaccatggaatgagtggaagtggaaaccagaacttctgtgaggagcgaggtgtccaagttgcaagatttgtgggtggattggatatgttgtttctgtttgtttcggcaattgtattggataaggaagttggttggggtgctgtttcggatggtgaagagtttggttttgtggagaatgggaaaatattttcaacaaaaataagtctagatgtatatggactttaccggattgtagatcataacaaagataggcactttgggttttgctataaccgaagaagccgcgtgctggaaaaccttgccctccctcttctctttgtcatcctcctgcctgaaatcgctcctttttctcctcccgccttaaatctgtcggaaaccgctccctcgacacccacattgtcgtcggtcgaagccacagaaccccctacactgccggaaaacccacattgtcctcgctggaacccacaaaaccccctacagtgccggaaaacccatattgttgtcgctggaaccccacagaacccacattgtcctgggtcgaagaaaaccctacatacactgttgctactagggtgctga

SEQ ID NO: 79063 - DNA, 408 bp, Glycine max
  Peptide Sequence Number=SeqID_170748
atgtggatgcattttgcggagcacgtactacctgtgggtgagctttgtctagtgcctgggcaggtatctgcggattacatggagtggtttttccgcatatctcacccattcatgatatcgacccaggcaggtgaccagtcgagagatgcaccagctgcagaccctgaggagtacatacagccacccagcctccaggttccagtggcatttgacccccatccacatgtggatgattatgatggatatgaggtgattgcacagaggttggagcgtgtgctcaaccttaggatggtcattgcaagcacagagttatatgagattatgcaagactgcctgacgatcgccagagggggagccagtgctgatggaagtgtcagggcttgtcagagacgccgcacagagcattga

SEQ ID NO: 79064 - DNA, 141 bp, Glycine max
  Peptide Sequence Number=SeqID_170749
atgtcgcgaaacttcacgaattgcttaacgatgggtttcaagttcctcgaagtggtcaagcgaaggttgcatgccatcaaacaatggtccccggacgaaattaggtatgattccgaaaattattcaagtgttggagtttga

SEQ ID NO: 79065 - DNA, 1355 bp, Glycine max
  Peptide Sequence Number=SeqID_170750
gctacgggcctcactttagaggactacacgtcgtcaccttgagagggctacccgctcttaccttcagaggactacacgtcctcaccttcagtgggctgcgtgccctcaccatcagaagactacacgtcctcaccttgagacggctacacgctcttaccttcaaagtattacacgtcctcaccgtcagagggctacacgctcttaccttcagaggactacatgtcctcacctttagagtgctacgcactctaaccttcagaggactacacgtcctcactttcagagggctacatggtcttaccttcagaggactacacgtcctcgccttcagaaggatgcacgctcttaccttaagaggactaggactacacatcctcaccttcagagggctacaagctctaacctacaaaggactacacatcctcaccttcagagggttgcacgccctcaccttcagaggactgcacgtcctcaccttaagagggctacgctccctcaccttaagaagactacacgtcctcaccttgagagggctacacgctcttacctttagagtaattcacatcctcaccttcagagggctacatgctattaccttcaaaggactacacgtcctcgccttcaaacggttgcacgtcttcaccttcaaaggattgcacgtcctcacctttagagggctgcgcaccctcaccttcagaggactacacatgctcaccttcagaatgctacacgctcttacctttagaggattacacttcctcacctttagagtgttgcacgccctcaccttcagaggactgcacgtcctcaccttcagagcgcttcgcgctctcacctttagaggactacacgtcctcaccttgagagggctacacgctcttaccttcaaaggactacacgtcctcgccttcagagggttgcacgccctcggattcagaggactgcacgtcctcaccttcagagcgctacgcgccctaaccatcagaggactacacttcctcatcttcagagggctaaacgctcttacctttggtggactacacgtcctcaccttcagtgggctacacgcttttacctttagaggagtacacgtcctcgcctttagagggttgcacgccctcaccttcagaggactgcacgtcttcaccttcagagggctacgcacgcccacctttagaggactacacatcctcaccttcatagggctacacgctcttaacttcagaggactacacgtcctcgccttcagagatttgcacgccttcaccttgagaggactgcacgtccttaccttcagagggctacgcgccctcaccttcagaggactgcctgttcttgccttacgaggactgcat

SEQ ID NO: 79066 - DNA, 423 bp, Glycine max
  Peptide Sequence Number=SeqID_170751
atgggagtaccgcttccatcccgtaaaccaaggaacacggcgttgccccacctccatagccccgttcatctttggccgatagggggtggagttatgatgctggatcttgaaatccccgcacatttcctacatttgagggtgaacgaggcagctaagtacatggatgaaaacgtaggagcaagagccccgcaacctacccttttgcgggcgagcgagacgaggctcacggatgcgtcttccaaaggaggaaaatgcgcagagtcgccaccaacgtttatttgtggaaaacgtcggaaaaaccgaaggaaaccggttatgaagaatattccagattcaggagttgtatttacgtttgaggaaggtattagcacctctcacgtttgtccctgtcgcaacatgcccttttgcgggcgagctaggtga

SEQ ID NO: 79067 - DNA, 347 bp, Glycine max
  Peptide Sequence Number=SeqID_170752
atgagaggccctctcgatgagtcaatctcttgctttctcataggggtggacccttgggtactagaacctattgcctttagaggactacacgtcctcgcctacagaggactgcacatcctcacctccagaggattacatgtcctcgccttcagaggactgcacgccctcgccatcagaggactacatatcctcgcctttagagggctacacgccttcaccttcagaggactacacgtcctcgccttcagagggctacacgccttcgccatcagaggcctgtacgccctcgccttcaagggactacacgtcctcgccttcagagggctacacgccctcgccttcagaag

SEQ ID NO: 79068 - DNA, 426 bp, Glycine max
  Peptide Sequence Number=SeqID_170753
ctttatctgaagaactcgccaagtgcacttactatgcaaagcaagttcatcctttgaggatgaacattcatcctcttgctgaactaactgtgtctaagatcctttcggaaaggaatgtggaactttatcattctgagttcgatgagtttaaagtagaattggaaaggcgaaactttcataaacgcctcactaaccttcaggaaggaagcatagatgtggcagtggttaaagaattttatgccaatttctatagtccagcagatcaagctcctaaatgtgttagaataagaggccatttaatcaagatagacacagatagtttgaataagttcctccagactccagtgttattggaggagggggaatccttacccacttattctagattttgcagactaaggtctgatcctagagagatggaggctg

SEQ ID NO: 79069 - DNA, 360 bp, Glycine max
  Peptide Sequence Number=SeqID_170754
atgccgatctccccctacggaagtatcagttggggtcactcccacaagacacccagtggactcggagaagtccaacagggccttggggattccagttctggttacgagcctctatcagtcctacagggtgcccgtactccccgacaagtcaaactgatttctgatgttagttctacggagtgctcgtcacccccagcaaggtcatcaggcctcctactaactgagctttcatcaagaagtattgcgcccccaggaaggcagagggcgagacaccacaacagcctgttgatggctagcaacatgcaacaaatgcaccgccgccacctccagagcccctcagctcatccacaaaaaggttag

SEQ ID NO: 79070 - DNA, 420 bp, Glycine max
  Peptide Sequence Number=SeqID_170755
atggtcactgttcaacaccttgtgatggacaacaagaagaggaggcctattatcaatggaaccaagctagaccttaacaaaactttcaaggaagctaccaaggctatagaggtggctcaggtccttctaacaactcttgtcgaggtttttcaaatagaggatccacgacaacaacaagcccagccagatagaatgtcatatatggaagatactttaacacattttatgtggtggactggggttggtttgaaggataatgatgagaaaaagaataaagaaggagttgaaaaaaaaaacaagaaaaatgatgaagttgtgactagtgaaaaagtggaagaaaaaggtggcattagagcagatgccaacatatgcaaaattgatgaaggattttcttatgaagaagaaaagaattatggatga

SEQ ID NO: 79071 - DNA, 750 bp, Glycine max
  Peptide Sequence Number=SeqID_170756
atggacctcatcaaggctgctggactgctgaaaactgtcaccaagttgggagattgctatgaaagtttagtcagggaattcattgtcaacattccctctgacataacaaacagaaagagtgatgagtatcagaaagtgtttgtcagaggaaagtgtgttagattctcccctgctgtaatcaacaaatacctgggcagaccaactgaaggagtggtggatattgctgtgtctgagcatcgaattgccaaggaaatcactgccaaacaagtccagcattggccaaagaaagggaagctttctgcagggaagctaagtgtgaagtatgcaatcctgcataggattggcgctgcaaactgggtacccaccaatcatacttccactgttgccacagagaatctcctctatccctgcattacaaactgtttgaagggacacatgtccccagacattgtctcgacatctgtctcgacatcagggaaagctgctgcttcaggtgctgtgtccaaggatgctctgattgctgaactcaaggacacatgcaaggtgctggaagcaaccatcaaagccaccacagagaagaagatggagctagaactgctgatcaaaaggctctcagagagtggcattgatgatgaagaagcagctgaggaagaaggagaagcagctgaagaagaagaagaagctgctgaggaagaggaagatgcagcagaagagacagaatccgatgatgattctgaagccaccccatga

SEQ ID NO: 79072 - DNA, 255 bp, Glycine max
  Peptide Sequence Number=SeqID_170757
atggattcatccagaggctcaaaaaatgaagtcgtgaatctaagtctcatggccaaaaactatgaaagcgaagaagaggattctttgaagaagagttggtacattgatagtggatgttctaaatacatgacgggagatgcatcaaagtttactcatatttctcccaagaataatggacatgtgacttatggtgacaataacaaagataaaacatcaaatcatgttcaatgctttttaagcaaagtgaaattctga

SEQ ID NO: 79073 - DNA, 156 bp, Glycine max
  Peptide Sequence Number=SeqID_170758
atggggacaaatcaaaatggaaaaagatttcatcaagtcaagattaagagtctagatgtcaccagccttaaggagttgggacggttgatgggacccctccaaaggcaagccttccgcaaagtgtacggaaagatcttggatttgaccgcagtggag

SEQ ID NO: 79074 - DNA, 237 bp, Glycine max
  Peptide Sequence Number=SeqID_170759
gattttggacagattgagaaggcagcttgtcatagttttgtgattgagcttggttcagctagatggccatctgccccatctgatttgttaaactctgaattgagggctagaccatctgagattagggtgattccttcatccgagattgtatctgttgctggagagattgctgcacagaagggcaaaggtctgtatggtggtcgacaaaggaacataaaccacagagtattgcgacag

SEQ ID NO: 79075 - DNA, 174 bp, Glycine max
  Peptide Sequence Number=SeqID_170760
atgcgtggagttgccaccaacgtttatttgtggaaaacgtcagaaaaaccaaaggaatcggtcatgaagaatattccagattcgggagttgtatttacgtttgaggaaggtcgacaaaagcgaggctcttgctcctacgtaccctccatcgaagaggaaatcagacctacgtag

SEQ ID NO: 79076 - DNA, 324 bp, Glycine max
  Peptide Sequence Number=SeqID_170761
atgcacacacaaagtttcacaattccacaatttcctaaaataggcctaactcacaaaaatagtccccaggggagtcgccaactttcgcaacctaccattttgcgggcgagcgaggcgaggctcacgggtgcgtcttccaaaggaggaaaatgcgcggagtcgccaccaacgtttatttgtggaaaacgtcggaaaaaccgaaggaaaccggtcataaaaaatattccagattcaggagttgtatttatgtttgaggaaggtcgacaaaagcggggctcttgctcctacgtaccctccatcgaagaggaaatcagacctacgtag

SEQ ID NO: 79077 - DNA, 648 bp, Glycine max
  Peptide Sequence Number=SeqID_170762
atgcgctgcctgtactgccataaccgcgacacctgggacacgcacggcgggaaagaagtgaccgtcgacgatctgatgaaagaggtggtgacctaccgccactttatgaacgcgtccggcggtggtgtgacggcgtccggtggcgaggccattcttcaggccgagtttgtccgcgactggttccgcgcctgtcacaaagaaggtattcatacctgcctcgacacgaacggttttgtgcgccgctacgatcccgttattgatgaattgctcgaagtgaccgatctggtgatgctcgatctcaaacagatgaacgacgagatccaccagaatctggttggcgtgtccaaccaccgtacgctggagtttgctaaatatatctcagcgaaaggcattaaaacctggatccgctacgtggtggtcccaggctggtcagatgacgacgattccgcgcaccgcctgggcgaatttacccgcgacatgggcaacgtcgagaaaattgagcttctgccctaccatgaactgggcaaacacaaatgggtggcaatgggcgaagaatataagcttgatggcgtgaagccgccgaagaaagagaccatggagcgcgtgaaaggtattcttgaacagtacggtcacaaagtaatgtattag

SEQ ID NO: 79078 - DNA, 258 bp, Glycine max
  Peptide Sequence Number=SeqID_170763
atgccttccaagattgttttgatgatgccaaagaatcaagatcaagattcaagattcaagaataatcaagatcaagattcaagtaaagaatcaagactcaagattcaagaatcaagagaagactcaatcaagttaagtattaaagagtttttcaaaacattgaatagcacaagaatttttcaaaaagaaaaatcttttaccaaagtgttttactctctggtaatcgattaccagaaggcagtaatcgattaccagtag

SEQ ID NO: 79079 - DNA, 351 bp, Glycine max
  Peptide Sequence Number=SeqID_170764
atctgcaccgacgaccgctccgcccgggctcgcgccctgggttttgcagcgaccgccgcgccctcctactcatcggggcttggtccttgccccgacggccgggtatgctctcactcgaacccttcacagaagatcagggtcggtcgggcggtgcaacccacagggggaatcccaccaatcagcttccttgcgcctttacgggtttactcgcccgttgactcgcacacatgtcagactccttggtccgtgtttcaagacgggccgaatggggagccccacaggcccgacgccaggaggtcgcaggtgccgaggcacgccaagggctcgctctgctatccacaatcgcgatga

SEQ ID NO: 79080 - DNA, 258 bp, Glycine max
  Peptide Sequence Number=SeqID_170765
atgtctctggatagcaaaaagggtgcggatgaccataatttgtctccgcgtgccatcggacttgattgtctcgggatagcaaaaagggtgcggatgactatttggcttctgacaagtgcaccggatcgcacaagtagtataaaacgcctagtcctgatcaagcctcgtccgcagattcctcttgtaagactaaactcaaccaggaccgcattaagacacacatattcaactgacttatcgcaccccgatttcttgtga

SEQ ID NO: 79081 - DNA, 567 bp, Glycine max
  Peptide Sequence Number=SeqID_170766
gtagttgtgtctccgtcaaaaccaccttcgaagctcgatccggaggttgatgatccgctttatctgatgacattgaccatctcagagcttttcttgaggccttatcaggttagatgggatgccaccgtgttcggggtctttaatccagatttccccctttatataaagcacaaagacctcttcaaaatcgcacacggttgtggattctgtaagcatctaactgaaacatgtatacgagtggggaattctgatatttatggattcctcgagccacagtccattcataggtctaggcaatcgcagtttgagtctgaaagttacataaagagttggatgcagagttcacaacgcaatgtctatcttggagcctacctaaatgggttccactgcagcggacactggcagatggtggtcatcctgcccaaggaacaccttgttgtctggttttgttcattgcataacaggccagacaactaccttaaggggattattaatagtgctttaaaaggtcttgatgatgcttcacagcctaaatcaaaggcttctgctaggtggattgtcgtcaag

SEQ ID NO: 79082 - DNA, 396 bp, Glycine max
  Peptide Sequence Number=SeqID_170767
atggggttgtttttaaattatttccaagaggggacagtttttatacgtgaaaagcatgtatgcaggacccaaaccgccagaatcggtggcgagtttggtgttcttgagcaaatcgccagtgtcaatggcgataccagtgagacatgcacaccttttgggaaccgccagtttgattggcgagttccatggattaagctttttggcaccgctttggttccaattcatattcatggaactcgccagtgtgactggcggttcccaaaagctgcgcatgtcgccatttcaagtggcgatttggtcactggtatcgccattaacgttggcgatttgttcaaggacaccaaactcgccactggttctggcgatttgggttctgcatgcatgtttttcacgtaa

SEQ ID NO: 79083 - DNA, 321 bp, Glycine max
  Peptide Sequence Number=SeqID_170768
atggtggaaaaagcaaaacgcgaagaagaaacgaacctcgaagaagaagcaaaaacgcgaagaagaagcagacccatagtcctaatcacgacaacaatgcgaagaagaaacgcaaagaacaatgaagaagcagaaacgcgaagaacaatgaagaagatggaatcgcggcgcagaagaagaagactgaagaagcaaacaaatgaagaagcagcagactccgaggaagaagaagctgaatcgtggcacgggagagagagaggcgagagagttgtttttttaaaaaaaaaaatactcaagggcttaaaggacttttcccaataa

SEQ ID NO: 79084 - DNA, 423 bp, Glycine max
  Peptide Sequence Number=SeqID_170769
atgaagataattaagcagagtacattaaagatcgtttgccaacaaggacaaacctacggcttggaggaagacgcagcacatctatttttcccctgcacaaaaacattacctctatggtgggaaactcagtcatggataaactccttgggtgcattcccacataatcccaaagatcactttctgcaacatgacaacagctctgctgatggagtaagagctagaaggtggaagtgttggtgggtagcgctcacatgggtcatttggaagcatcgaaatggggtagtatttcataaccactcttttgatggaagcaaggtcatggatgatgccatttttctattttggtcatggctcaaggttatggagaagggattcacagtgccatttagctcctggtcttcacagctcaaagcagctttctaa

SEQ ID NO: 79085 - DNA, 1005 bp, Glycine max
  Peptide Sequence Number=SeqID_170770
atgtcatctgagaagaattatgcatcaaaactggataagcaaaaagattgcaaagtatcttctctcttagatttgcctgagtggaccttggattgcattcttgagtgccttccaccacaggatttgtgcagagtggcacaagtgtgtaccagtttgagggatagaatcagaagtgatgctttgtgggagaaaaaaatcaagcacaaatggggtaggctacttggtgatgttgctcaccaagagtggcagttgcacacaacaaagataaacacacaaagcttcttgttgttacagcagaatcagagtggatcctatggatctttcagtggtgtttggcctttccttatctttcattcttatttggaaaatttcattgacttgattagtttgtttaaaaattgttcaaaaatggctttgtatatctctcttgagagtggccttttttggtttcctgttcaagtgttcaagattacaaatctattctgttatgatgctattgtcagctatgactctagaacggacaccttcaagtcaaggtctccaactggtggatggcgaatgattgagggaaatattcagcgggataggttgagattagcaccagctgaaacatctccaatgactttttatatgtctaactctatgaatgatttgaaaccaggagatcatattgagattcagattagaagacgcaaagaatccccttataattggtggtatgctgtaattggtcatttggaaacatgcaaccagaatgtgaatcattgccattgccaatatagtgacgggtctaatatgaaatgttattgctgcattgttgaagattcgttggtagtggagttcaaacaatatcagcccgagaatagaatgagaagagcaatgttgaatagaaacgtaaatgtggaacagggttctacatttcggcttcgctggttcggtggaatcagaaaactatataaggaagaggagattgaaaagtggaacaacctcttagcctctagataa

SEQ ID NO: 79086 - DNA, 378 bp, Glycine max
  Peptide Sequence Number=SeqID_170771
atggaactcgttagcatgtctgaagtgtgtacttgtttgagggatagatgtcgaagtgatcctttgtgggaagtccacataaagaagaaatggggtggagtcattggtgatgttgcttacaaggagtggcattggcatatcacaacaactaaggagaaaggaattaaccaactgcatcaacagcacaatattcagaatggatcattagggcctttcagtggtacttggcctatgttatatctcaggtcttatttagaagattgtagccatcttaatacctcattggcaaatagttttatgatggctttgtatttctctctagagaatggcaagttctggtttccagctcaaatctacagggtgaagtatcctttctaa

SEQ ID NO: 79087 - DNA, 1314 bp, Glycine max
  Peptide Sequence Number=SeqID_170772
aaagacgatgaaatgcctcctattgaagctattattgcacccctggaggcagaactcaagcttgctaggatggaggtggcaaagctgcaggatgacaacagagcactggatcggctaaccaaatcgaaggaggctgctcttcttgaggctgagagaactgttcagattgctttggcaaaagcatccttggttgatgatctgcaaaacaaaaatcaagagttaatgaaacagattgaaatatgccaggaggagaacaaaatcttggacaaaatccttcggcaaaaggttgctgaagttgaaaaactaactcaaactgttcgtgagcttgaagaggctgtcttggctggtggggctgctgctaatgctgtccgtgattaccagcgtaaagtgcaagagatgaatcgggaagtagctcgtgccaaagttactgcaaacagggttgcgactgtagttgcaaatgagtggaaagatgctaatgataaagtgatgccaggtgaaatgcaacaattacgtgataaattggctatagctgagcgcactgcaaaggcagaggctcaaatgaaggaaaaatatcaattgcgcttcaaagttttggaagaaagggttaagacatctaatggtaattccaaattcactgtatcagatggaagaaacattggcactgggccttcacgacgacaatcttttggtgaagctgagagtctctctgcctcttcttccaatggatatcaatcgaggaaaaactcaatttcaagatcagggtctctaagatcaaacagtgctaatgtgctactaaaacatgccaaactttcatcgagatcgttcgatggtggtagtagaaacctggagagagagaggccaacttcagatgcaaatgggctagataacatgccaacaaactacaataatcagaccatcaccagggaaacaattactacacatgaggagagtgcaaatggtactccagtcgaaaaatctaaatcagaaaatgaagactatgtttcaggaatgctgtatgacatgttgcaaaaagaggttatatctctgaggaaggcttgtcatgaaaaagaccagactcttaaagacaaggatgatgcaatagagatgttggcaaagaaggttgatacattgagcaaggctatggaagttgaggccagaaaaatgcgtagggaagttgcttctatggaaaaggaggttgccgcaatgcggattagcaaggaacatgatcatagggcatggcaagcaagtgctcctaggggggctgtaaattcccagtcaatttcttccagcatggttatcactgtcaaaatctag

SEQ ID NO: 79088 - DNA, 582 bp, Glycine max
  Peptide Sequence Number=SeqID_170773
atggaagggttagtggacctagcagtgattgacgctttcctcgcctttcatcatggcaaggaaagcccggtcgtcgccattttggccatgcatgacacgttcgatcagagatgtgaaaagagcggcgcaagaattgtttgttgtacaccggctctctatgtgtggctggtttcgcacctttttctccaagaaggtaggctcgtctatccgctaaaatgttcccttgatggaacaaggggttgtattaattataatcccgtcctcgccataagacagcttggctaccccatgagaggagtgccatcagacgaaagcatcacgcctttcatcacacggggtttcagtgaccccaatgcgagggacagagagcttaggggaagcagtaatgggagcatcggcggctatcataagtggctgagagtccggacacaaggattggattggctcccaaatctaaagactatgagagatgatgaggttaaagcttcggaagaaagtgatgaggtacaagccctattggcagagcttgaaagagcccgggtagtcgaagagaagttcaagtccatagccatcaaagtctga

SEQ ID NO: 79089 - DNA, 573 bp, Glycine max
  Peptide Sequence Number=SeqID_170774
atggtcttctttctgcggcgcgccggaaatgctgatgctgccgacgcagccgaggccggtcagggtgagcgggaaggcgccgccgtgcaccgaatagtcgcgcacgttcagcccgtagcgttcctccagcgacgtttgccgctgctgcaggcgcaggccgatggcgtaagagcttttgtgaaaatggttcaccagattacgcttgcgccgcacccagtcggcgatgtccggcgtggcgcccggcatggcgtaataaaacagcgtttgcccggccagttggatctcgatggcgatgctcaggccgcgccgctcggcggcggttttcagcgccgcgcccagttcccaggcggtggcggcatcaaaatgggtaaaggccagcgtcgcttcctgttcgctgagcgcctgcaggcacagagtagcctgaagcgcctggggagggatagaaggcttggcgataagatagaaccgcccggccgcagccggggatgggagcgtgcgccccggcgagcggggcgcgtggcttcaggccgccagcgtgtgttcgcggaaggcgtccaacagctctttcggtga

SEQ ID NO: 79090 - DNA, 270 bp, Glycine max
  Peptide Sequence Number=SeqID_170775
atgggtagcacaccacttgaggcagtatatgttaaattacactacttggttggtgtccaaaatggatccaatcaagtagatcttcgaaaagcccgcttttactgggagaatagctcgatggcagtaaaaagaagcactttggcagattatctagctcaacagcccataaatgattatcagcctatgcatccagaattccctgacgaggatatcatggccctatttgaggaagagggtgaggatgaagacaaagagaagtggattgtatga

SEQ ID NO: 79091 - DNA, 303 bp, Glycine max
  Peptide Sequence Number=SeqID_170776
atgaaggtccaagtggagaaggatgaagaaacttttggcattttgatcaaatttggtgagagtttctctccgggttccttgttgaaccaattatcagacttatcaagtggcgtctaccctgacttatcttccttcactggaagtggcgtctacccagacttatcttccttcaccggaagtggcgtctaccctgacttatcttccttcaccggaagtggcgtcatccaaaccttcgtagcctgtatcaaacaatccgctcctactcaggttcacatcatctggtatcagagcttcggctcttga

SEQ ID NO: 79092 - DNA, 1515 bp, Glycine max
  Peptide Sequence Number=SeqID_170777
atgaaggtgcgttcgccgttcggctccaccagcgccaggcaccagccgttgtccatctggccgtggcgtaacagcacctccagccccagctcgcccatggcggcttcgaccgccgcgccccattcaccgttgccaaccggcatgccgttaatcaccggcgtttccaggcgcaccagcgcgcgcgccacgttgaacgcgcagccgccgatttgccgcgcctgcggctgggcttcgatatcttcgccgctggtcggcaggcgcggcagcgtcatcaccagatcgccgaccgcgcccccaatcaccaggacaggtgtacagaccgtaagcgatcagactcaccgcgaacgacacaaacagccccaggctggaatcggcgaacaagcctttggccagcgggccgtcgataaaaccggttttggtgaccagcaggccgcacagggcgccgaggaaccagcagaacagcggggctttgcgcacgccgcggttctggccatgcaggccgtacaaagcgttgccatcatacccgtggcggcggcgcaggcacaggtaatcgagcaggaaaatcgcctcccaggccgccaggaagacgccgcagaacaccaggaaggagatgaacggccccatgaaatcaccggagatgaacagcacatacagggcgatacccaacaccaccaccgcgtcgatcgataccgccagccactgcttgacctgcacgccgatggtcagcaggttaaggctggcggaatacaggctgagcaccgcgatggtgacgatgccggcggtagcggccagcagataaggaatggccatccaggcgggcagcaccgagcctatcagcgcgatggggttggcggcgctggccagatcgggcagctgcacggaaagcaggatgccggccagcatcagcagcatcagcggcaaacaggcgccgcccatcaccgcggcgaaaatgcttttgctcgacgagctcgggctttgatagcggctgtaatcggcgccggcgatcgcccaactgatgccggtgccggcggcgatcaccgataccgccggcaggaagccggtcaaccagctgccggaaggcagcgccagcacctggctccactcggtgttgaacaggatatagagcaccacgatcagcgtcatggtgccgaagatgcggctgaaccagctttgcatccagaccacggtattttgccccagcaggctgacgacgacagtgagcccgccgaacagcagcaggctgagcgcggtcagcaggtggctgctacccaacccgaaggcctcgaacagcgccgccagcgtcagggtgccggtgatcacgttgactgcttcccagcccatcaggttgatccaactgaacagggtgggcgccacgttgcccttcaggccgaaaatcacccgcgagagcgtcagcgtagaggtgcgcccgcgcttgccggcgaagctggtgaggccgaccagcacgaagctggcgacgccgaccagcgcggcgagtaccgattgcaggaaggataa

SEQ ID NO: 79093 - DNA, 642 bp, Glycine max
  Peptide Sequence Number=SeqID_170778
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggtgaagttgctgccacacgaagtacgagacaccctcaatgtaaaagcaagcaaggggatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 79094 - DNA, 606 bp, Glycine max
  Peptide Sequence Number=SeqID_170779
atgtccaaatcttgtggatttgggatgaccggccctctcgatgagtcgatctcttgctttctcataagggtggacccttgggtacttgtacctatcgcctttagaggactacacatcctcgccttcagaggactgcacgtcctcaccttgagagggctacccgccctcgccttgggtactagtaccctcaccttcagaggacttcacatcctcacctttagaggactacacgccctcgccatcagaggactgcatgtcctcaccttcgtagggctacacgccctcacctttagaggactacacgtcctcgccaacagagggctgtacgccctcaccttgagaggactacacgccctcacctccagaggactacacatcctcgccttgagagggctgcacgccatcaccttgagaggactacacgtcctcgccaatagagggctgtacgccctcaccttgagaggattacacgccctcacctccagaggactacacatcctcgccttgagagggctgcacgccctcacctttaaagggctatgtgtcctcattttcagtgtgctccacatccgcaccttaagagaatttaaggtcctctatccttaa

SEQ ID NO: 79095 - DNA, 195 bp, Glycine max
  Peptide Sequence Number=SeqID_170780
atgcgtgataaaaccgccgggctgaaggataagggaactaaaatagttattaccccaatgtggggtatggaggtgcttatgtcagaacgacccgatgatgtcactccgttgcctgatgatgcgcaggtgcccggtgaagagccgcttgatgacgatgatgacaccggcgaagacgatgggcagaaaccgatctag

SEQ ID NO: 79096 - DNA, 418 bp, Glycine max
  Peptide Sequence Number=SeqID_170781
atgattggcacgctcaccattctgagcatttttatcggcgcgattgtcggtcaggccaaaacgccgcgcaccggattgctgacctttgccgctgcgccgttaccaactgctgccgttgcgaatatggccccagcgcggggtgatattctgctccagctgatatatcagcgccagaatcaggttgaggttatagcggcccgaggtgcggtaacacttcctgctcgcgctgatgatcggccagagcaccgggcttatctctcccatcatcgctttccccacactgggccaaatctggcttgcatagtcaccgagaaaaaactgcggtactgcagtaataatgtttctgatgttgtggcggataccaaagtagagcgcggcactgccgcctttcgacgcgccgagaatgtcacgtcagaag

SEQ ID NO: 79097 - DNA, 568 bp, Glycine max
  misc_feature (493)..(493): n is a, c, g, or t
  Peptide Sequence Number=SeqID_170782
atgggtgaagtagaggaggtacaagagcaaatggccacaatgatggaggccatgatgagcatgaagaagataatggaagccaatgcggtcacagttgccgctaccagcactgttgctaaggtgaacccgatgccctcatctggcctcaaccaaatgaatcatccaaccttaaatatggtaggcaaagatttgggaagtagggacggcccccatgatgtgcaaattcaaaataagtacaccttcccgccatatggctcgcctcccaaggaggatgccaataacttcgctcccatactcattgaaagccaacaacctcaaactaatcatgcacatgtctctcaaaccgtggaggagacacatgaaattgcccaccacaatccagctaactctgagccttgcctcggatatgccactgaagggcaagcagttggtgatatacccctgcaaaacactttggagggcccacaaccacaccccttggattccacaatgngtaaaaaccctcatgctatggcagaaatgggaaagttggatcatctagaggaaaggctcagggccattgaaggag

SEQ ID NO: 79098 - DNA, 375 bp, Glycine max
  Peptide Sequence Number=SeqID_170783
atgaagatagaatctcctctatcccggcattacaaactgtttgaggggacacatgtcccagacattgtctcgacatcagggaaagctgctgcttcaggtgctgtgtccaaggatgctttgattgctgaactcaaggacacatgcaaggtgctggaagcaaccatcaaagccaccacagagaagaagatggagctggaacggctgatcaaaagactcatagacagtggcattgatgatggtgaagcagctgaggaagatggtgaagcagctgaggaagaagaagaagcagctgaggaagaagaagaagcagctgaagaagaggaagatgcagcagaggatactgaatcagatgatgattctgaagccaccccatga

SEQ ID NO: 79099 - DNA, 849 bp, Glycine max
  Peptide Sequence Number=SeqID_170784
atgctcatccatccatccgacaaccttccgttctctggcgatccgcgtaaggaagagctgcgccagcggctgatgcgaccggatgcgcccaaagtcattgccgtgtcactgtcgaaggagctggatcgcgagcgacgcacgcatcgtcatgccgccggtcagctgttttgtctgcgccagggattgatgacggtgaacacctcgtcgggcatatttgctaatccgccgcggctggtcggctggattccgccgtggtttgaccacgcccttgtcgggccggggcgcgtgctgggctggacggtactgattgacgaagcgctggccgcgccgctgccggatcggccggtgctgctctcctgcccgaccgtgctggagccgctggctgaacggctggcggtgctggagcctgaactgtggagcagcgcgcgctatgcccggctgggtcaggtctttcttgatgaactgtacgaatccacgccgcaggaactcaccctgccgctgccggaagagccgcgtctgcggcagattgcgcgcctgctgatggacgatccggctgatacacgcaccgggccggagctggcgcagtgggctggtctgagcgcgcgcagcctgagtcgccactggtcgagcgcggttggcatgagcctgagtaaatatcgtcaggtatcgcgcctgctgaaatcgctggaagggctggcggcaggccacagcgtgcagcaggttgcctggcaggtgggcttcgacagcgtcagcagctatatcagcgcgtttcgcgccgccttcggctcaacgccaggcaaatactttacgacgccagccgactctgcgaatgcagcatcagcaggctag

SEQ ID NO: 79100 - DNA, 192 bp, Glycine max
  Peptide Sequence Number=SeqID_170785
atggccagaagaactcatgacaggcgaagtccaaagatcactatgaattatatcaaaaggagaagcagtgtgcgacatagaatcagaaaacgggatctaagaacaacatcaccaggatggcctaggcgagtatgccaaagatcggatgaaataacggtaaacactgaattattgactggaggagcggcttga

SEQ ID NO: 79101 - DNA, 300 bp, Glycine max
  Peptide Sequence Number=SeqID_170786
atggcccgcaccaagaaaactgggcagatgatgtctgaggcagcaaaggaaattgctgagaagattattctttggaggagtaggcgtcacagggttcgcttgtcgcccatggacggacttgcagtgcctccagagactgaggttggtccctcagctactcgtgtcagcacaaaggggatttgtgttgatccttcatcgatcgatccagacatgggtgactcagacaaatgcggccaagtgaaggttggtgttgaggaggttaaagatgtagaggctctcgttcctgtacccactgacgaa

SEQ ID NO: 79102 - DNA, 177 bp, Glycine max
  Peptide Sequence Number=SeqID_170787
gatggttatgtagcaattgctgataaattggagaggctactgaacttgaggatcctgactgaaggaacagaagcctatactgttgctaaagaatgtccgagcattgcaagaagctacattggccaaccaactataggtcacagatcgaggcgtaggcggcgtatggatggtcattga

SEQ ID NO: 79103 - DNA, 175 bp, Glycine max
  Peptide Sequence Number=SeqID_170788
atgggggtgcaaatagcaaccaggcccacttgggccctccagaagattcctccagaaggctgttgcttctggaggaagcaaccctgctcgcctgggcgagctgggaatttggcgaagtttcgaccgttcttcgacgttcttcattcgttcttcatcgttcttcgatcttcaacgg

SEQ ID NO: 79104 - DNA, 969 bp, Glycine max
  Peptide Sequence Number=SeqID_170789
atgtccaccgtggccagtagatggaggcaatttaaatgtaacctgacgactagatttgtgtatggtaactccgaaggtcaacatgaacataatcctccggtcaaatatgacgtagataaagaaacttgggagcaatttgctgcaagccgcaaaactcctaactggcagggaatcaggaagaagatgcaagagatccaaaaatacaatgactgcccccatgtactttctcgtggggggtatgatttgcttgaaaagaagatgatggaggagaagatgaacaaaagacaacatgacgcaatgacaactgagaatacaccaaactctgcggatcccccatctcccattcaaagacatgcctcattggaagaacaaacgagacagggtacctttgtcccccatggtcgtgaagacatactgaacactgccatcgggcgaccggatcatggaggccgtgttcgggcagcggggtttggggtcacaataagtcaatactttggaagggcagcacgtggctccagttgttcatcagggtcgatcagccaagtacaaatggctgaaataattggaggcctacaggaacagtggaaaaatgaaatacaggtattgaaagatgagttgaaggaacaaatcatacttgagatgtcgcagaggggatcgttgatcccaacacatattcagccagatatacatgggttaggagcacgagtgagcacaaaagggagcaatgcggagagtgttctcaacccatgtctgcctaatgatgttgctcctgtcgaaccccttatggggttgtatgtgcaacaccaagattcaattgagttggtggccttgggaaaaacatatgatggaggctcgaccatacacaatgtgccttatgcagacgatgtcgtaagggttagtgttgagcaagttattgacggtgacgctgaggtcccattcccaacatcagagattaagtgtgtcaggtag

SEQ ID NO: 79105 - DNA, 363 bp, Glycine max
  Peptide Sequence Number=SeqID_170790
ggattaaggttccgagggtctcttgttgtaaagcaatctgaacacaaaggaagggttgtccttgtgtggtttagaacttgtaaagggtttttgcaagatagtggaactctcaagcgggttgcttggggactggacgtaggcacaaggggttaccactactggaaaacccgaatgcaaattttcattgaggcattagacttaaacatttgggaagccatagaagttggaccttatgtacccaccatggtggctggaaatgcaacaatagagaaacctagagaagagtggactgaagatggaagaagattagtgcagtacaatttaaaggctaaaaatcattacttctgccctaggaatggatga

SEQ ID NO: 79106 - DNA, 426 bp, Glycine max
  Peptide Sequence Number=SeqID_170791
atgggtaaagcagaggaggtacaagagaagatgaaggccgatatggaggccatgaaagagcaaacggccccgatcatggaggccatgatgagcatgaggaagataatggaagccaatgcagttgcagttgccgctaccagcgctgtcgctaaggtgaactcgatgcccccatctggcctcaagcaaatgaatcgtccaacctcagatatggtaggcaaagatttgggaagtatggatgaccccacgatgtgcaaattcaaaacgagcacgccttcctaccatatggcttgcctcccaactatacgccacccaatgtggcatacactcccaatgagaatgtcaataactccactcctatacccattgagagccaacaaccctaaactatcatgcacatgtctcttaaaacgtgggggagtcacatga

SEQ ID NO: 79107 - DNA, 219 bp, Glycine max
  Peptide Sequence Number=SeqID_170792
atgatgataacaaaagatgatgacaaaggtgatgataaaaagctcaaagatcaatcaaagaacaactcaagtgaatcaggaacaattcaagagttcaagataagaatcaagaagaattcaagactcaagaagaaagttaagagtcaagaatcaggattacaatgttttggtaatcgattaccagtgcctttgaatgttgaaattcaaattcaaatgtga

SEQ ID NO: 79108 - DNA, 369 bp, Glycine max
  Peptide Sequence Number=SeqID_170793
atgatgataacaaaagatgatgacaaaggtgatgacaaaaagctcaaaggtcaatcaaaggatgagttcaagatgttcaagaaggaatcaagacaattcaagatcaaggctcaagaggaaaagttgaagaacacttcaagattcaagaagaaggatgaattcaagattcaaattcaaggatcaagcttcaagaatcaagatcaagattcaagattcaagattcaagaatcaagagaagacttaatcaagataacacatggagtttcacaaaacatgtttaccaaagagtttttactctctggtaatcgattaccagattgctgtaatcgattaccagattgctgtaatcgattaccagtaggaaaatag

SEQ ID NO: 79109 - DNA, 303 bp, Glycine max
  Peptide Sequence Number=SeqID_170794
atggagcaatatggagaattggtgatggcagtctttttccctctgccatattcaaacagtctcaatatatggagtgacaaatggttcccaaactctcttgataatgttattcactgggatcagaatccagatattgatgtatcccaaacagtttctgacataatcattccagattcaaaccagtggggtgttgagaaaatgagaggtatgttctctgaatccacttgcctgaaagtctgttctattcccttgagaagaaccaggatgtgtggaaatttgctgatgatggaatctacacagtaa

SEQ ID NO: 79110 - DNA, 417 bp, Glycine max
  Peptide Sequence Number=SeqID_170795
atgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccaggcgtttccccctggcggctccctcgtgcgctctcctgttcctgcctttcggtttaccggtgtcattccgctgtatggccgcgtttgtctcattccacgcctgacactcagttccgg

SEQ ID NO: 79111 - DNA, 219 bp, Glycine max
  Peptide Sequence Number=SeqID_170796
atgggggagattattgtgaagtatggtgtcccacagaaggcagtggcgggattgcccagtcaacccatcccgtcattgttgttggcggtaccccctctctcctcagcctgtcctgcaaatgctaatagcggcaccccctatcccgccattgtcactggcggttcaagcttcccgtcagtgtcaatgacagtacccacgtccagaaatgaccccccgtaa

SEQ ID NO: 79112 - DNA, 345 bp, Glycine max
  Peptide Sequence Number=SeqID_170797
atggccagagggtcagtgtttgttggaaaggagaacagtgggtgccacttcataacagagtgcaagaaggtggctgagaaagtatggttttcagttctgattcaaaggaagcaagagatagaaggatacagcaaagtgtgcgagattaacgatggtccaagcgatgccaggggaacaaccgaagacggagagtacgaggatccaagaaaagaaaaggatgaggatgtatgtggtccaaacgccagggtacgtgaaccactccgtgttcctgttcagatccgccggtggcaccgccttcacgtacaggtttgccatcaatcagttccgaagataatacccttttaa

SEQ ID NO: 79113 - DNA, 1201 bp, Glycine max
  Peptide Sequence Number=SeqID_170798
cactttagggtttcttagcaaagaaattgtcttcgtggggatagtgataaaaggggtggataagggttttggacattgtgggttttatgcccctttctctgtctcttgtttgctggggaagaagaagatgaggccgatttttgctgggaacttggagtacgatactcgtcaatcagagcttgagcgcttgttctcaaagtatggaaggattgaccgcgtggacatgaaatctggaacttctactaagggaaaatatgctgagcttctgtcttggtttgccaacctctctgcaaattttttttgggaaggaaaacttcctgcttgtctgctctccttctactcacagatctgcattttcacatctgatcactggtcactcacctcatcatctcccaacattgacatttccatcagaatgttgaataacatgccgatgtctttcataatcatttctgcctctaatactagttatgttacaggttttgcttttgtctattatgaggatgagcgtgatgcagaagaagcaattcgtgcacttgacaatgttccatttggtcatgaaaagcgaaggctgtcagtggagtgggctaggggtgaacgtggacgtcatcgtgatggatcgaaggcaaaccagaagccaacaaaaaccctttttgtgattaactttgacccaatccgtactagagttcgtgatatagaaaaacactttgaaccttatgggaatgttcttcatgttcgaattcggcggaactttgcatttgtgcagtttgagacacaagaagatgctaccaaagctatagagtgtacaaatatgagtaagatcctggacagggtggtgtctgtggagtatgctctgagggatgatggtgagaggggggacaattatgacagtcctagaagaggtggttatgagagatcacccagtccttatcacaggcgaccaagtcctgactatggtcgtccacgcagccctgtctatgataggtacaatggtggtggaccagacaggcggaggagtcctgattatggcaggcacagaagtcctgattatggcaggcgcaggagtcctgattatggaaggcgcaagagtcctgattatgggaaacccaggagtcctgaatatgccgttcgccggtgcgaagtcagtgccaatggttctataggacctgaatatgagaccggaaaccctgtttattgttga

SEQ ID NO: 79114 - DNA, 186 bp, Glycine max
  Peptide Sequence Number=SeqID_170799
atggatttggttactaccatctgcagcaacaaagggaagagtcaaagtcaacacatacctgagggagccatgaggattgagaaaccccgtttcagcaaagacaactacaacataactttccctgagaaactagatcctatatcacagaggctgagattacaatatttgaaagagcttaaaaattga

SEQ ID NO: 79115 - DNA, 1242 bp, Glycine max
  Peptide Sequence Number=SeqID_170800
gacacatcaatgataaagcatatccgtattttgcccggcgggctggcggtgctggccgccgtttttctctgcctgctgacggcctgtcgcgatcacagtcgcgacgggatgagcggcgctgatataaatgtctataaccacggtccagacgccattgtttctatgcaggttgacggctacggcgggccaagggcgaatccctacggcggcggcggcggcttctgctgcgtgatggtgcccaacgactggcgaccgggcctgacggcaaaaatcacctggacttccgaccctaactcctggatgaaatcgagtgagatgccggacgattatgaaactcactatcagaaacatgggccgattactgtccctatcgaacgttgggagaaggggccaggccttgcggatagtgcgttcctgcatcccgcctgggcagccgggctacccgagtccacgctgaatgccctgaaggcgcttattgccgcctttcagaccggcgccaccccggtcgcggtcaaaacctccaccgcggaagcggccagcttaccgccgaagtttcccgggccggatgataaaaacggagaaaagtctgccgataactctgtgcagcagaaagccgaatacaacgagcgcggccgcctgccggcgagcagaacgcaggccgaaggcaactacgccaggcagtatctggaaggatatgtcggggagtctgaacatcaatcggacaaaaaaacggagccgggctgtcccgccagcctgcatatcagcctgttctttgacggtacctgctgtaatgaaaagggggccgatgaggacacatcaatgataaagcatatccgtattttgcccggcgggctggcggcgctggtcgccgtttttctctgcctgctgacggcctgtcgcgatcacagtcgcgacggcatgagcggcgccgacatagctgtcttgaatcatggtccggacgccattgtttcgatgcaggtgaacggctacggggggcctggagctaatccctacggcggcggcggcggcttctgctgcgtgatggtgccagatgtctggcgcccgggattaacggcaaaaatcacctggacctccgatcctaactcctggatgaaatccagcaatatgcctgacaattattcgcaatactatcagcgccatgggccaattaccgtgccgattgagcgctgggaaaaaggccagggatgtggctttgatgtacatatttttccctgcgataag

SEQ ID NO: 79116 - DNA, 117 bp, Glycine max
  Peptide Sequence Number=SeqID_170801
atggctaggggactccaagaagattgggctagagatgcaggagaaggccctaggattctcatgagccttagggttctatcttttttcagtcatattcttcttgtgctgaagctttag

SEQ ID NO: 79117 - DNA, 240 bp, Glycine max
  Peptide Sequence Number=SeqID_170802
atggccaaaatgaaaggccagaaagaagaaaaacctattctaatatttacaaagaagaatggacccaaccttggcccatgggctcagaaatctgccctgaggttcataagaaccctagggccttctttagtcgctctagcccaatcctcttggagtcttctagtcaatacccttgggggtaggattgcatcatcccatcccccttggaaaggatttgacctcaaatccagaggttcttga

SEQ ID NO: 79118 - DNA, 2174 bp, Glycine max
  Peptide Sequence Number=SeqID_170803
gtagccctcgccgttgaaggcgcggaagctgaccttgcccgattcggccccctgccgggtttcggtgagctggatgccgggcatctgccccagcagttcccagctgtgcgagacgttgcggtcttcgatctggtccgcgcccagcacatccaccgaggtcagcacctggtgcgcgctcagttgcccctcgctgtgctggtgcacatcgaccttgccgagggggcgaacggggcggccgcgagcgcggccaccagcgtggaggtcttcatggggggggaaggtcgagcatggctcgacgctgcaaaggcgggggtggagcggtgcttacaccgggtagccggtggcttccctggccttcttccaggcgctttcgaattcgcgcgcggagatttcgtcgtcctcgtcgaaatccaggaacgacaccggctggtcggccagcaggaagcggtcgtcgctgtgggcatgctcgtcggcccagaccatcttggtgccgtagatttccacctggcgcacgatcttctcgccgcgtgcttccatcagcacgttgcccttgcccaggcccgattcggcccagtgcttgtagtacttctttgcagcggatttcgcgccggatcttgcgttgtgctttgcgtaggtcattgcggaggtcctggccgcagacgcggccggaaagttcggaatggcgccattatcgcccgaccttgcagcacgcaggtgagcgcttcattgggccggcgccggcaacgccacgcccttcggccacagcatccagatgttgcccttctgcttcatgtcaccggccagcttgccggcggcatcgccgctgccccagtacaggtcggcgcgcacttcaccggcgatggcaccgccggtgtcctgcgcggccaccgggcgcaccaccgggctgccgtccgggcgcgtggtggacagccacagcaggctgcccagcggcaccacggtgcggtccactgccacgctgtaaccggcggtgagcggcacgtgcggatggcgtccattggtgacgtcttccttcttcagctggccctggtccaccagccagcgaccgatggcgcggtacgggtggccattctgttctgcataggccagccgcacctgcgtgccatcgcccagtcgcacccggccggatccctggatctgcagcagctgcaggtccatcggatcagtcagccaggccagcaccggcgccttggcgcccttggccgcgatggtaccggcgtcgtcatagggcttgagcaccttaccctcgacgcgcccgcgcaggcgcttgcccttcagttccgggtagaggctctccagctgcaccaccaccagatcatccggcgtgccgtacaccggcaccgtagcagtggccgtgcgggtgaggctgccgggatagatcggttcgtagtagccggtaatgagcccgtcggcctggtggccgccggcacgcagtgcatagacatccaaatcgcgctgcaggaactggcggatcgcggccgggtccttgtccgccaccgtcgcggcggtggcgcagggtctggcccagaccgcatcgttcttcaggcgggtgcagctgctgcgccaggcaacgaagccggcctgcagatcgctgtcggagaccggcggcagtgcgctccatgcgaccttggcgtaggtggccgccggcggtgtgacggccgtcggcacttcggatccggtgcggggggcggtggtggagcagccggcgagcacggccgctgccagcaggatgcagtgcttgcgcttgaagaaggtggcggaatcgatcatgccgccatggtggagtgccggccgctgggcggcaacccagcgcggggtcaagcgttcatgcgcggggtcacggcatctgcagcaacagcgaatgcaggatgcgggcgtcctcggcatccagcgtcttcggcaagtcgtcgcggccacggaaacggcggtggaaggcggcgacggtggcttcgcggttgtccagcggatagccgaagcgggccagtgcattccacgcatcgaagccttccggcgcagcaccatccgcagcgcgcggccagaccccgaacccggcctcggccagctgctgccaggggaagaagcggctcggatcctgcttgcgcgtcggtgccaggtcggcgtgggcgatcacctggcgcggcgggatgttcaaccgg

SEQ ID NO: 79119 - DNA, 756 bp, Glycine max
  Peptide Sequence Number=SeqID_170804
atggccgagctgctgggacgcctgttcgagcggcagatgccgccggccgcacagctgggcgcaccgcgcttcccgccgggccactggcgcaactatcgcgacgtgatgagcgccgcctttgccaagctcaccccgattgcggtgcgcctgggttacccggaagacctgaccaacggcgcgccgatcgaccgcgagttcgccgctggcgatgccgcaggcttcgcgccggaccgcaaccctcacctggcctggaacggcgcgccggaaggcacgcgttcgttcctgctggtgtgcgtggatccggatgtgccgaccgttccggaaatggtcggccgcagcgacatgaccgtgccgcgcgaccagccgcgctgcgacttcgtgcattgggtgatggccgacattccggcctcggtgcaggagatcgccgctggcagctgcagcgatgccttcgtggtgaagggcaagaccgcaccggcgggcccggccggcagccgccagggcctgaacgacttcaccggctggtttgccggcaatccggacatggccggtgactatctgggctacgacggcccgtatccgccgttcaacgacgaacgcgtgcaccgctacttcttccgcgtgtttgcgctggacgtggcttcgttggagcttccggcacgcttcaccgccgcagatgcgtaccgtgccatgcacggccacgtgctggccgaagcggcgttgcacggtacctacacattgaatcctgcgctgggttga

SEQ ID NO: 79120 - DNA, 327 bp, Glycine max
  Peptide Sequence Number=SeqID_170805
atgcgtagtgattgcttagtgcaattctccattctctaccctttttcgaagcctcatgaattgcgtttttgttcatgcgtccttgtcgcaacctacccttcggcgggagggcgacgcgagactcacgggatgcgtgttccacgaaaggaatacgcgcggagtcgccaccaacgtttatttgaggaaaacgtcggaaaaaccggaaaagacgagatctacgaactttttagtgaaaggttccggagttgtatttacgcacggggaagggtgtttccctttgctcctacgtattcctcaatttgggatgagaaaatcagacctacgtag

SEQ ID NO: 79121 - DNA, 264 bp, Glycine max
  Peptide Sequence Number=SeqID_170806
atgaccacaggatcaacaatgggtaaaagacagctatggcagtctttgagtacaaggaagcttcaatctcaattgggtagaggtattaagtgggcctctatcagcaatttggttgggaaacataagatagatcttctttgtttgcaagaaacaaagagggattccattgacagggcactttgtcaggctctgtggggtcactcagactttgattgggaatggtttcctgcagacaatacagctggggggcttctctgtgtctag

SEQ ID NO: 79122 - DNA, 441 bp, Glycine max
  Peptide Sequence Number=SeqID_170807
atgcagctaccgcaagagcccttgaacaagaaaccaagagggctcgcaaggaagagcatggtcgagacaaatttcatggagctttgtggggcagcaatacgtttatgcgagatagagaccaacatgttaaccatcgtcagcaagtaccaagaagaactaaatctagccacgacccacaagcataaagtggcggacgagtatgcccaagtgtacgcggaaaaggaggctagaggaagggtgatcgactcgttacatcaagaggcaacaatgtggatggaccgatttgctcttaccttgaacgggagtcaagaaattccccgattgctagccaaggccaaagcaatgatgaacacctactccgcccccgaggagatccacgcacttctcagctattgtcagcatatgatagacttaatggcccatataattagaaaccgctag

SEQ ID NO: 79123 - DNA, 797 bp, Glycine max
  Peptide Sequence Number=SeqID_170808
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgacgggactcgaacccgcaacctctggattcgaagtccaacgcgctatccattgcgccacccggatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 79124 - DNA, 393 bp, Glycine max
  Peptide Sequence Number=SeqID_170809
atgtcgtggtctagctttgttcagtgcatagaaggcctgattcgtttaacctattttaaagttggaggctgcgattctgaacattatatttacatgatattaatcttccaatgcaatgcatttaagaaattaaacacgactgctgatgggaaagttcctaaaactgcaccccagtggcttgaactgaagactcacgttcaacgcggaggctatgagtgtgggtattatgtgatgcattggatgtggaacataattggcgcgaagttgaagagtgattggaatgtgtggtttggtgatggctcggcactagacccagaggcgatcacaacattacataaaaaatgggcagcttactttttgaaacttagaaccatccaatgtacaaagctgtaa

SEQ ID NO: 79125 - DNA, 273 bp, Glycine max
  Peptide Sequence Number=SeqID_170810
atgcatgtggaggatgagtcatctgaggccaccatcccaaagccatttgttataagagaggaggcagaggagacacaggtgagacaggtagctactgccacacctaaacgatcccttgaggctacttcagagccttctgtagaaggggaggatataccatcacctcagcttgcagtagacccctccactcttcttctagagatgccagaggaccgactacatcaatcctggctatggacacttctcctccagccactccagtattacatctga

SEQ ID NO: 79126 - DNA, 171 bp, Glycine max
  Peptide Sequence Number=SeqID_170811
atgggcctaaaatctactctaaggctcatgagaaccctagggccttctcttgcatctttggcccagacttcttggagtcttctatccattgtccctgggggggtaaggtctgaaaacccctttcctgggcatcttcccatgagggaacatggttcctcaccaactcaataa

SEQ ID NO: 79127 - DNA, 249 bp, Glycine max
  Peptide Sequence Number=SeqID_170812
atggtgggctcacaaccgtcatcatggtacccaacacataggaaaatgcaaggatcatgcatgagtgaacatattacgcgaacaatgaaaataaaatgtatgcagctgcaactatcagatacaatgcatcaccaaaaggggaaaactctagatgaggcttcactgttatcaaacgagtcggagacccatcatgaccacagattgacctctactccttatggctcacatagactcaactatagggcctaa

SEQ ID NO: 79128 - DNA, 309 bp, Glycine max
  Peptide Sequence Number=SeqID_170813
atggccgccgcgcacgtgtgggcgcgaagcgtaaacgcgccgggactgcggcttgaaacccaaaatgtgaacgtctcggcctgtctgttttaccgaaactacggtttcaccctgggcggatacgaccgttatctgtacaacgctttaccggaaaaagacgaagttgccctgttctggtattacatgctggcttcggcagaaacgccccagcacgtcgttaaacaaccggcgggcggttaccgcgtgcaggtcggcgatgtcattgtcacgtcttttaccgacgggaactgtcgcgcaggatctgcataa

SEQ ID NO: 79129 - DNA, 354 bp, Glycine max
  Peptide Sequence Number=SeqID_170814
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggctgcgcaactgttggggaaggggcgatcggtgcgggccttcttcgctattacgcccagctggcgaaaggggggatgtgctgcaaggcgattaagttgggtaacgccagggttttcccagtcacgacgttgtaa

SEQ ID NO: 79130 - DNA, 300 bp, Glycine max
  Peptide Sequence Number=SeqID_170815
atgcttccatttgatttccggtgtgtcacggaaacttacggattgtgcatcaaatcgttttcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatcccccctttcgccagctgggcgtaatagcgaagaaggcccgcaccgatcgccccttccccaacagttgcgcagcctga

SEQ ID NO: 79131 - DNA, 225 bp, Glycine max
  Peptide Sequence Number=SeqID_170816
atgaaaggaaaccaacaaagggtggagtcgccaactgtcgcaacctacccttcggcgggagggcgacgcgagactcgcgggatgcgtgttccacgaaaggaatacgcgcggagtcgccaccaacgtttatttgaggaaaacgtcggaaaaaccggaaaagacgcgatctacgaactttttagtgaaaggttcgggagttgtatttacgcacggggaaggtattag

SEQ ID NO: 79132 - DNA, 414 bp, Glycine max
  Peptide Sequence Number=SeqID_170817
atggctactccacctgcctcgcctcctcctcctgttcctcttcctcctcctcctgcagacgcatcagtgtctctatttacgttgaagcggacacgcaaggcgacacagctacgatcattggccactagaccacctggggcaaaaagacctatggtcaacgtcgattctgctaccggcaaggtcgacggtccccacaagaagaaattaagaacatatttggtgattgtcgctcgtgataaggtcgacgtgacatatgacacctggaaggaagtccctactggtcagaaggatttgatatggaaggatattcaggcagaatttgaaatccctgaagcttctgacagtaagacaaagaagaaaattcttcagacagtcgacgagcactggaggcagtttaaatctgacttgacttga

SEQ ID NO: 79133 - DNA, 184 bp, Glycine max
  Peptide Sequence Number=SeqID_170818
atgatggtggcccgggtgatgttggggtatggctacgagcccgaaatgggttttggcatgaacaacgatggcagaaccagcctggtaagcaccagaggaaatcgcgggaagtttgggttaggctataaacccacgcaagcggacataaggaaaagtatcgcggaaaggaagagcagaggccaag

SEQ ID NO: 79134 - DNA, 585 bp, Glycine max
  Peptide Sequence Number=SeqID_170819
atggcaaaccttactttatccttagcgccttccctgcgagataagccgatgaaaaccagcgaacttgataacctgatcgtcgtttattttggtcaagattatgacctgataaatgcagaaggcgatattactgcgctgatcgcagagtacattcgtctggcgactcatcagcagcgcgaggctttggtcaatgagatcgatgagctactggcgcaggataatgtggagtccttattcaaccaacgtttcggctttaccttcagcccggagctatggggaaccacagttcctgcattcctgcaacaggccagaagcgctgcggattatgatctgtttactgatgccgaaacggccgagggggtgattgacggcttccttgagcaaaacggtagccaggtcatccgcgatatcctcgaggaagccaaaaaatttcaggccacctatgcggggcgtataaacgagggcatggcggagcatttttcagatgagtttgtgccggagagctggggcactacagcggtaggggtctttgccatattgcaacgaaaaacagagcaaaagctggagcagcttaaacgaatttaa

SEQ ID NO: 79135 - DNA, 2130 bp, Glycine max
  Peptide Sequence Number=SeqID_170820
atggaatcgagtcgaagagcggtggaatcatactggagatggcgcttgatcgactcagctacctccgatgaagacaaagtcacacctgtctacaaactcgaagaaatctgccaactcctactctcttcccacgctactatcgtcaaggagctctcagaattcatccttaaacgcctcgaccataaaaaccccatcgtcaaacacaaggctttaagattgatcaaatacgcggttggaaagtgtggtgtggagtttagaagggaaatgcagagacattcggtggcaatacgtcaattgttacactacaagggtccttcggatcctctcaaaggcgatgcactcaacaaggctgtgagagacactgctcaagaggccatctctgctattttttctgcagatgataacaaaaacccacctccttcagctcctcctgctgcttctgatctcaatagacggatagaagggtttgggaacacgaacttccaagcgccttctcatgataagaaatcgtttctcagtgaggtggttgatattggaagtgcaaccattaagcaagggctcagtgccttcacacagggccattcttctctcatcaagaatgaggctgggactggaacctacaagggccccaataatcttcatgcctcatttacagcagaaacagaacgtggcgacagatatgaacccgttgcgtatcgcggtggaatgcaaggtgcttctggactttcaaggaatcattctggtggccctttgaatcgggatactagtgtaactaggatcgaaatgtcgattgcgaaaagtgatgctagttatgctgagagcaagacacaagaggatagattgctggagacagttgcaagttctggtggtgtgcgcctgcagcccactcgagatgccattcaagttttcctaagagaggctgcaaagttggatgccatggctttatgtcatgccattgaacgaaagctccagtctccgatgtggcaggcatccgtttgtgtccttgagtccatcgtcagaaagaaagacgatgacgatcatttttcacgtatggcgtcttactttgctgaaaataatgatctggtgttgagatgttctgaatccccccaagcatctttgagggaaaaggcaaacaaggttcgtggtcttttaggtggaaaccaactaaacagtgctattaactcggagaaggctgtgaaaacggatagtgctgccgttgctgagttacctgacttgatagacactggtgatttgaatgactatcatggaacagatgatactacaaagagtaagaatgatcaaaatatagcacatttgacaccatccacacctccagctctggctgatgatttatttggaaattttatgaactctggagtagctagtaatgaactaaaaaatgatgatgatccctttgctgatgtgtcatttcattctaatgacaacaaagagcctgcagatatcttttcaagcatgactgctggtgatgataaattgggtcatcatgtgagtcatggtctggggaatagaactgaacctgaaaatgatgatttattggctggcttgtccattgatgaaaatacctctagtactaaacagaaagtaacatctcctgccatgcaatccgaatcttcattttctggtttaaacaatcatgttagccatctgggacctgaaaatggtttaggtggcatgttgggcacacaagcagttgggttcgatgtaaattccatatttccttctggtcatccgccttgtactgtacagcctggcattatgttgaaccagtcatattcttctcagccacttaattatggtgccatgggaaatctcttggctcagcagcaacttctagcaacaatggctaatttccagcaccttaataatgtcaacaagaatgatggtggtactgctcaaaatgctggatccaatggaaaaacacctcttccggacatattccaatcaaaattttcaactcaagctcctagctcaatgatcaacagttcaaagaaggaagaaactaaagcatttgattttatatcggtaagtcttggagtaaatcatttatttaccatccaacgatttactttaagcattgtaatgatctgcaatgatttgtctgctttgtag

SEQ ID NO: 79136 - DNA, 4269 bp, Glycine max
  Peptide Sequence Number=SeqID_170821
atggagggtgtgtttgcaagtgggagatattctcgaaggacttcaaatgttgatgaggatgaagaggctctcaagtgggctgccatagagagattgccaacctatgacaggctaagaacaagtatcctccaaacatttgtggaggctggtcatgatcatgctgatgctcgtccaagcacattgcaacacagggaagttgatgttcgaaagttggatgtcaatgaaaggcaagagtttattgacagaatcttcaaggtagctgaagaagacaatgaaaagtacttgcgcaaattcagaaacagacttgataaggttggtatccgactcccaacagtagaagtgaggtatcaaaatttgactgtagaggctgattgctacattggcagcagagctctgccaaccttaccaaacgttgcattgaacattgctgaatcagctcttggattatgtgggattagtaccgcaaagaggacaaagctcacaattcttaaaaatgtctccggcattattaagccttcaaggatggcccttttgcttggtcccccttcttcagggaaaacaacccttttgctggccttggctggaaaattggacaatgatttgagggttaatggagaaatctcctacaacgggcacaagcctaacgagtttgtccctagaaagacttcagcctacattagccaaaatgatgtgcatataggagaaatgaccgtaaaagaaacccttgatttctcagctagatgccaaggagttggaacgagatatgacctattagccgagctagctcgaagggaaaaggaagctggaatatttccagaggcagaacttgaccttttcatgaaggctactgcaatggaaggaacagaaagcagtctcattactgcctatacactcaaaatattggggcttgatatttgcaaagataccattgtgggtgatgaaatgcagagaggtgtatctggtggccaaaagaagcgtgtaaccacaggggaaatgatcgttgggcccacaaaaacattgttcatggatgaaatatcaacgggacttgatagctccacaacatatcaaattgtgaaatgcttccaacaaattgtacacctcactgaagcaaccatattcatgtccctactccaacctgctccagagacgttcgatctctttgatgatatcatcttaatatcggagggtcagattgtttatcagggcccacgtgaccacatcgttgagttctttgaatcttgtggctttaaatgtcctgaaagaaagggaacagcagatttcttacaggaggttacttcaaggaaagatcaagaacaatattgggcaaatagaagcttatcataccgttatgtcacagtgagcgagtttgcaaatagattcaagcaatttcatgttggaataaagcttgagaatgagctttctgtgccatttgataaatcaaggggacatagagcggctcttgttttcaagaaatatacagtgcccacaatgggacttcttaaagcatgttgggacaaggaatggctactaataaagaggaatgcttttgtctatgtatttaagacaggtcaaatagtcattattggtatcatagctgcaactgtgttctttagggccaatatgcatcaaaggaatgaggctgatgccgcagtttacataggctcaattttgtttaccatgatcatgaacatgttcaatggttttgctgagttaccactcacgattgcaagacttcctatattctacaagcacagagaccaccttttccatcctccttggacttacactctccctaatttcatcctacggatccccattactatgtttgaggctattgtttgggtacttatcacatactacacaataggattagcacctgaagctagcaggttcttcaagcacttgttgctagtttttcttgtccagcaaatggcagctgggatgtttaggttcatatctggagtttctaggacaatgattattgctaacactggtggatccctcatgctcctccttgtttttttacttggaggtttcatccttcctaaaaatggtagaaccccgatcggtatagctacattaaataacttcgatgtttttactgagaaacgatggtactggattggtgcagctactcttttgggtttcattatcttgtacaatgttctcttcacctttgcacttatgtaccttaatcctattggaaaaaaacaagcaattgtatctgaagaagaagcaagtgaaatggaagctgaaggagactttagaaaagatcctagacttttaaagccagagcccaacagagagatagcccttcaatcattatcttctactgatgggaacaacacacgagaagtggcaatgcaacaaatgagtaaccgaggtaatcctagtggaataagaagtgttgattcaatgcatgaatcagccactggagttgcccctaagagaggaatggttctaccttttcaaccacttgcaatgtcttttgatagtgttaattattatgtggacatgcctgctgaaatgaaagggcaaggagtgacagatgataggctacaattacttagggaagttactggtgcctttaggcctggagttttaactgctttaatgggagttagtggagctggaaagacaactttgatggatgttttagcagggagaaagacaggtggctacattgaaggagatgttagaatatctggcttccccaagaaccaagaaacatttgcacgaatttctggttattgtgagcaaactgatatccattcaccccaagttactgttcgagaatctttgatctattctgctttccttcgattgcctatagagaaatttgttgacgaagtaatggagttggttgagctaaataatctcaaggatgctatagttgggcttccaggtgttacagggttgtcaaccgaacaaagaaaaaggctaacaattgctgttgaactcgtcgctaatccgtcaatcattttcatggatgaaccaacttcaggtctcgatgcaagagcagcagccattgtaatgaggactgtgagaaatactgttgacactggaagaacagttgtatgcacaattcaccaacctagtatcgatatctttgaagcctttgacgagttgttgttgatgaagagaggaggacaagtgatctactcaggaccattaggaaggaattcacttaggattatagaatattttgaggcaatcccaggggtcccaaaaattaaggataagtacaacccagctacatggatgttagaggttagctctatagcagctgaagttcgacttcgaatggattttgctgagcactacaaatcatcatctttgtatcagcgaaacaaagctctaataagggagttaagtactagtcctccaggagtaaaagatttgtacttccccactcaatattctcaatccacttgggaacagttcaaatcttgtttatggaaacaacggttgacttactggaggagtccagattataaccttgtcaggtttttcttcactttagctgcagctttcttggtggggacggtattttggagggttggcaaaaacaggggtaactcaggcgatctgactactattataggagcattgtatggttcagttttttttgtaggtgttaacaattgccaaactgttcaaccagtagtagccgttgaaagaacggtattttatcgagaaagagctgctgggatgtattctgctttgccttatgccattgcacaggttatttctgaaataccatatctatttgttcaaactatatgtttctcattcatagtgtatgctatggtgagctttgaatggaaagtagccaaggtcctttggtttttctttgtaagtttcttttccttcatgtacttcacatactatgggatgatgactgtttccattacaccaaaccaccaagttgcatcaatccttggagcagcattctacggaatcttcaatctattttctggtttttttatcccaagaccaaaaattcctaaatggtgggtttggtattattggatttgcccagtagcgtggactgtgtatgggttaattgtctcacaatatggagatgtagagatagagattagtgtgcctagtgcgaataaccaaactatcaagcattatattgaagaacattatgggtttaaaccagacttcatgggaccagttgccgctgttttggtcgcttttccagtcttctttgcctttgtatttgccttcgcaatcaaaacactaaacttccaaacgagataa

SEQ ID NO: 79137 - DNA, 867 bp, Glycine max
  Peptide Sequence Number=SeqID_170822
atgtacgggatgggctttgaccacagctttgggctttggtttattgcccgctggctggagccagatctgatgatcgagagtggtgctttcaaaggacattcaacttgggttttgcggcaggctatgccagatacaccaattatttctctttcacctaggcatccagaaaagtacctgaaaaagggacctgcttatgttgacggtaactgcacgtattatgctgggaaggactttgtggattttgggagcgttgattggcccaacgtgatgaagaaacacgggatttcggaccttaatcgggttcttatattttttgatgaccaccagaatgaattgaaaagaattgaacaagctttgaaagctgggttccgacatcttgtctttgaggataactatgacactggaactggtgatcattattcattaaggcagatatgtgatcaatcttatattagaggtggggggcacagttgctttaaagacagtgatgaagctaggatcaggtcaaggaggaagaaattctgggagaaagcagttgatattgaagaactttgtgggccaaatgaagcatggtggggagttagaggctatatgcgggataactttaatcatagtaatgagccaatatcttatgctcaacatttccagaatagccggtatattgaatctattcttgatgtttactgggaactccctccggttgctggtccttccctcacccatcaaaccagatatgatcctgctcgtgcacccagtcctattgttgaagatgggcggtatggcttgttccgaaggctgggtttggccaaccttgacaattctgtatttaatggatacactcagatggcttatttacagatatcttaa

SEQ ID NO: 79138 - DNA, 1131 bp, Glycine max
  Peptide Sequence Number=SeqID_170823
atggctgtgaaaggatcaccacaacggtgggacatgagattagttttgacaattactcttcttttaatctcggtctctgtttctgctcttcaacacgtaagtcacaaaaacattaatcccaccaccgttgagacaacccaaactagttttcttggtaaagtcgtgaactttttgtggagctcatctggctctggataccaacatacttggccggatatagaatttggatggagaataataacgggtacgataattggattcctgggatctgcatttggaaccgtgggtggtgttggtgggggtggcatctttgtcactatgctctcccttattattggatttgatgcaaaatcagctactgcaatctccaagtgtatgattacgggtggagcagcagcgacagttttctacaatttgaagcaaaaacatccaacacttgacatgccagtgatcgactacgacttggcacttcttttccaaccagtgctggtgcttggaatcagcattggagttgccttcaatggatcagttcttgaaaatgttcgttggaaagcacttggagttcttttcactgtctgggtccttatacttgcctccgagattgcaaaaagtcacacaacaacttgttcagtggaatactggatacttaatctactacaggtccctgtggcattaggagcgacttcatatcaagctgtgcttctgtacacaggcaagagagtgatagcatccaaaggagatcaaagaacacaatggcgagcgcaccagttagttctgtattgttcttgtggcatatgcgctggtatagttggtggcttgcttggtcttggtggaggttttattttgggaccccttttcttggagctaggaatccctcctcaggtgtcaagtgctacagccacttttgccatgacattttcagcatctatgtcagtggtggaatattaccttctaaaacggtttcctattccttatactctttactttgtggctgtatccacttttgcggcctttgttggacaagttttagtgagaaagctggttgccatactagggagagcatctctgatcattttcatcctctccggcaccatttttgttagtgcaatatcactaggcaagtgtcattag

SEQ ID NO: 79139 - DNA, 351 bp, Glycine max
  Peptide Sequence Number=SeqID_170824
atgggagttgctacgtgcacccagcattattgctggggcacccagcaaacagtgaagtggccaaattgcccttcaacaattcttcttccggaagaagtatttccggaaaccttccggaaaagcttgttccgaaaagtttacggaaatacttcttccggaaaaagaatttgggaattccggaagtactcacgaacttcgtccggaagatcttccggaaactgttgccggaaaacacatccggaagaccgtcttccggaagtttctgcggcctattccggaagcacttccggaaccacttcttccggaataggccgcagtaacttccggaagaaggtcttccggaagtgttaa

SEQ ID NO: 79140 - DNA, 813 bp, Glycine max
  Peptide Sequence Number=SeqID_170825
cagcgatcgacacttttctcgcctatcacgaccgcaaggaaagcccggttgtcgctatactagccgatctatatgacaccttcgaccgaagatgtgagaagagcagtgcaaggattgtttgctgtaccccggccttctatgtgtggttggtttcacacctttgtcgccaagaagtgaggcatccttgcccactagaaagccaccgttcatgcacagagaagagaggggcaaattgggaccaactcttagcaagcaaagaaggagcatctgtcaactggttccctcattggaaagaaggaagaattggggtttttattccgtgtgcaggatttccgaatgttcccttgatagggacaaggggttgcatcagttacaatcccgttcttgttataagtcaacttggctaccctatgagaggggcaccactagaggaagagctcatgcctattattgcacgaggtttcaataagaccaacgtggaggcgcttcagaaggtccacaaggcatgggagatggtgcaaaagaaggataaggaactcagaggcagtaacaacgggcccatcggcaactatcgtgacgaagaggtgcaggcccttagggcagaactcgagcaagcccaatcagtcaaagaaaggttcaaatcaacaactcttaagatccaaaaggagaatgccgaactgagagacgtaaataaagctaccaccaaggccttggaacgaaagaccaaaagggctcgtaggaggaatacagaggggctttatggggcagtaacagcgagcttaagctccggagagaggaaaaggacaatcacga

SEQ ID NO: 79141 - DNA, 285 bp, Glycine max
  Peptide Sequence Number=SeqID_170826
atggatggtgaagagctaccttcacccgtgaattctgatgtcgctgcatgttctttatctttatgtgttttctggatttccccaagggatttcccgtctgctgtatctctcgttacaatctttcaaagaaatgaacgtggattcgaggctttagtcctcactttggtttcaaaccttgcgttgatttgtgatcacctgagcccttccgctcagttcatcggatgccccaagcgcttaattaaaattgaacctaaaccaactttcgctaatatttgctgcgtttga

SEQ ID NO: 79142 - DNA, 415 bp, Glycine max
  Peptide Sequence Number=SeqID_170827
ggccctgggatttcccgctttgatcacaggactctgccagtcgttcggggtccccgtcgtacctagcaaggccgcagacgcgccgccacctcatcaggctggcccagctggatcatttgatacggagcagtatttacggcatttggttcgccagcaggcagccaaccaccgggcgcatgtacagacccatgattgtctttaccagttgagcctcagcctgcagagccagggttttacttcttttccatgccctactccggatcagttcagggcagaggtcgcatggcccggagattggcctaaggcctgggcaggagaggcaccagcagaggctcccgacgaggcagatgaggcccgcgaggacgaggagatgaccgatttgcttgatttcttgggagggagcggagccacatga

SEQ ID NO: 79143 - DNA, 156 bp, Glycine max
  Peptide Sequence Number=SeqID_170828
atggagaggaacttgaagtgcatcaacaagttgattctgatgccttcaatacttctcatgagtattaatatgatttttttgttgttaaagtgttatctacccgtgatgatgttttacattggatttgatctattgctcatgatattggttttgtag

SEQ ID NO: 79144 - DNA, 386 bp, Glycine max
  Peptide Sequence Number=SeqID_170829
gactctgccagtcgttcggagtccccgtcgcacctagcaaggccacagacgcgctgccacctcatcaggatggcccagttggatcatttgatacgaagcagtatttacgacatttggttcgccagcaagcggccaaccaccgagcgcatgtacagacccatgattgtctttaccagttgagcctcagcctgcagagccagggttttacttcttttccgtgccctactccagatcagttcagggcagaggtcgcatggcccggagattggcctgaggcccgggtaggagaggcaccagtagaggctcccgacgaggcagatgaggcccgcgaggacgaggagatgaccgatttacttgatttcttgggagggagcggagccacatga

SEQ ID NO: 79145 - DNA, 1179 bp, Glycine max
  Peptide Sequence Number=SeqID_170830
atggctccgaggaagcttgcctcgaagaggtccaggaaggacaaggcagctgaaggaactagttccgctccggagtatgatagtcaccgctttaggagtgctgtacaccagcagcgcttcgaggccatcaagggatggtcgtttctccgggagcgacgcgtccagctcagggacgacgagtatactgatttccaggaggaaatagggcgccggcggtgggcatcactggttactcccatggccaagtttgatccagaaataatccttgagttttatgccaatgcttggccaacagaggagggcgtgcgtgacatgagatcctgggtaaggggtcagtggatcccgtttgatgccgacgctatcggccaactcttaggatatccgttggtgttggaagagggccaggaatgtgagtatgaccagaggaggaaccggtctgacgggttcgatgaggaggccatcgcccagctgctatgtataccgggacaggattttgcccggactgctgcagggaggcgagtgcgaatcatgcgcaccaacatgaccaccctgacccagatatggatgacattgctcctcagcaacatcctgcccaccgatcataattccgacctccccatgccgaagtgccagctggtatggcgcccactaggcaccctttggacccagataagtccaacaagggccctgggattccccgcactgatcacaggactctgccagtcgttcggggtccccgttgcacctaccaaggtgattcggccgcccaatcacccgggctttattgagaagtactgtacccagagacagggtcagggtgatgctccacaggccgcaggcgcgccaccaccacctcatcaggctggccaggctggggcatttggcatagagcagtatttacggcatttggttcgccagcaggcggccaaccaccgagcacatgtacggacccatgattgtctgtaccagatgagccttagcatgcagagccagggcttcgcttctttttcatgccctactccagaccagttcagggcagaggtagcatggcccggagattggcccgaggcccaagcaggagaggcacccccagaagctcccggcgatggagaagaagcccacgaggatgaggagatggccgatttgcttgacttcttgggagggagtggagacacgtga

SEQ ID NO: 79146 - DNA, 342 bp, Glycine max
  Peptide Sequence Number=SeqID_170831
atgcatgctaaagctagagtgatgagtgaaatagaggaggtacaagaacagatgaaggcctacatgaaggtcatgaaagagcaaataaccacaatgatggaagccatgatgagtatgagaaaaataatggaggtcaacatggctacagtcgttgctgcaagtaccgctaataatgacaaaaagctcaaaagtcaagatcacttcatgataacaaagatgatgacattcaagaatgagttcaagattgagttcaagattgagtcaagaacacttcaaggatcaagaggaaatttgatttcaagattcaagattcaagattcaagattcaagattcacgaataa

SEQ ID NO: 79147 - DNA, 946 bp, Glycine max
  Peptide Sequence Number=SeqID_170832
agggctgcacgctcttaccttcagaggactagacgttctcgactttagaggactagatgtcctcgccttcagagggttacacgtcctcaccttcagggggctacatgttcccaccttcagagaactagacgtcctcacgttcagaggactacatgtcctcgcctttagagggcgacacgcccccaccattagagggccgcacgccctcaccttcagaggactgtacgtcctcacctttagagtactgcacgccctcgccttcagaggactacttgtccttgccttcagaggactacttgtcctcgccatcagaggactacacgtcctcaccttcagaggactgcacgtcctcaccttcagaggactagacgccttcaccttcagaggactagaagtcctcgccttcagagggatgcacgccctcggctttagaggactagacgtcctcgccttcagagggctgcacgcctttgccttcagaggactagatgtccttgtctttagaggactagatgtcctcgccttcaaagggctacacgtcttcaccttcagggtgctatacgttctcaccttcagaggactagacgtcctcgccttcagagggctacacgcccttgcctttaaaggactacgcgcccccacctttagagggcttcgcgccctcacctttagaggacttcatgttctcacctttagaggattgcatgtcctcacctttagagggctacatgccctcgccttcagaggactacacgtcctcgccatcagaggacaacacgtcctcgccttcagaggactgcacatcctcaccttcataggactacacgtcctcacctttagagagttgctcgtcctcaccttcagagggctacgcgccctcacctttaaagggctgcacgtgctcgccttaagagggttgcacgccttcaccttcaaagggcgatac

SEQ ID NO: 79148 - DNA, 213 bp, Glycine max
  Peptide Sequence Number=SeqID_170833
atgggcatacacaaaggagtaacgtcctttggggttcattgcaagaagtggaatttgcttcttggtataatcactgaacacaaaggagaaaggtcctttggggttcattgcaataggtgggattgcctcttggtgttatcactgaacacaaaggatgaaggtgttggatcaagtggccttggaataattaagaaaggggggggggtgaattaa

SEQ ID NO: 79149 - DNA, 213 bp, Glycine max
  Peptide Sequence Number=SeqID_170834
atggaaaaggaaaaacttgttgggattttggagtctcaccatgacgagaaagtgggagatataatcttcgatgaccacaatgcatctgaaacattaaggaagttagtaggtgggcctaaaagaaattttataacttggcaaggatacgatatcaacaagtattcgttctacacaaaatcaaaagacgacaagagtacaatgcaaaacaattgt

SEQ ID NO: 79150 - DNA, 207 bp, Glycine max
  Peptide Sequence Number=SeqID_170835
atgatgcaatcctaccccgcaagggcattggatgaaagactccaagtatgttgggccagagatccaagggaaggccctagggttctcatgagtcttaaggaagggtggagcttatcaataccttctcttgacagggaaaacaacttagctattagagagcttcccaaggaagttatctcaagaaatcttctcaaggaagctacctag

SEQ ID NO: 79151 - DNA, 270 bp, Glycine max
  Peptide Sequence Number=SeqID_170836
atgaagatgaaagcaaacaaaacaagaaaggaattgaaagtctcggattcgaacacttaccggttgaagaacgaagaagggacgaagaacgatgaagaacacaggaaaagcttcacagatttactcatggaaacgtctcggaagcgttacgaaagcacttcgactcgattcttcttcacgaaaacaaattttacggaagccatgaaagccccaaaaaccatttttcaacaaaacgtggaggagcttgccgcccagttgcttcctccttaa

SEQ ID NO: 79152 - DNA, 126 bp, Glycine max
  Peptide Sequence Number=SeqID_170837
atggataagagcttgaaggtaggagaaatgagtgggagagggagagaaggggggcacaaaatttatgcctcaaatgagcccactaatctaagatcaagtataagattctccactgagtgtgcttag

SEQ ID NO: 79153 - DNA, 816 bp, Glycine max
  Peptide Sequence Number=SeqID_170838
agggctccatgccctcgtcttcagagggctagacgccctcgccatcagaggactacatgtcctcaccttcagagggctacacgccctcaccttcaaaagactacacgtcctcgccttcagagggctacacgccctcacaagcagaggactacacgtccttcccttcagaggactacacgtcctttccttcagagggttgcacgccctcgccttcagaggactacatgtccccccttgagaggactatacgtcctcaccttccaaggactacacgtccttgccttcagagggctacacgctctctttttcaaaggactatacgccttcgccttcagagggctacacgccctccatttcagaggactacaagtcctcgtccttagagggctacatgccctcgcgttcagagggcaacattccctcgcctttagaggactacatgtcctcaccttcagagggctacttgccctccccttcagaggactacatgttctggcctccataggactacacgccctcaccattagaggaccacatggcctcgtcttcagaggactacacgtcctcaccttaagaggactacccttcctatcctttagagggttgcacgccctcgccttaagaggactacacgtcctcaccttcaatggactgcacgccctccctttcggaggacaacacgtcctcacctttagagggccacacgccctccccttcacaggactacatgtcttggcctccatagggctacacaccctcaccatcagagggctacacgtcctcaccattcagaggactacacatcctcgcctttag

SEQ ID NO: 79154 - DNA, 771 bp, Glycine max
  Peptide Sequence Number=SeqID_170839
atgatctatgctatcaaaaacttgaggatccctaagtatctggacttagaatggttctctcaacaagggtctaactttcctaatctgctggaagcacaaggaatgtcaaagttagtgcagatgaaaggaacattttatccggagctagtcaaggttttctacacttgtgcacgtgccgaccttgaaggtaatctcttctctactgttaatggagtagaaatggtcattgacgctgaagtgtggaaggaagtagtcggtctggacatgggtggagtctgcaagttcgatgaaacaactaatgggtacagcaagatgcaggcctctaggggagtgcttcttgaccccgcaagaaacttgagaaattgccaaggagtaggtgtcctgactgtagaggacagaatgctagtctacctcattacctacattctcactctgaggtcaagtattaagatgaattgggtactgttgattgaagacattaagctaaagagtcatcgtttggtagattacgaattttcttatgttgtacttgcctcaagattcattgactacttcaatgtatctaatgagattgtggattttaccaaagcgtctggtcagattaccgaaaggcatctcaagaagcttgtaatgaggtttgttgaccatgaatggatagtggctggagatccagcagtaggaaacttggaacagatggaagaagatgctaaagctgaagctccacaagagtctgcacatcaatggagtccttttgagtcgcctatgatttag

SEQ ID NO: 79155 - DNA, 212 bp, Glycine max
  Peptide Sequence Number=SeqID_170840
gtatgcgctctctatgggttggcggtcgcttactcgaaccctctccttaaggatactaggcttcctcccagctgcgcttcccgcttttccagagttgggcatgggacgacgatccatcgatcataggcctagcctctactcgccgaaagctggtcgggttcagtttcaattaagcgcttggggcatcccatggactgagcgaaaaggctcag

SEQ ID NO: 79156 - DNA, 1293 bp, Glycine max
  Peptide Sequence Number=SeqID_170841
atgcagcagagttcaagatcacgaaaagcggcattgagagtcagagttccttcgcggaagctcatgattctctctctcgccattttcgccattctccctcccattttcttccacttccgcctccgacgcctccaacagctgcaactcacaaagtgccgttggctcaacgatcctcctctagtctgcgcccacggtggcgattcctccaaggcttctccaaacactatggcgtcgtatttccacgctcttcagtctcgcgtcgactgcattgagatcgacgtttctcgttcttctgacggagttctctttgctctccatgacagggatttgcagcgcttaaatggaaacactagttctaaagttggttacatgaactcagaagagataagaaagctcagtgcttcacatcagtctacctcaaagtttactgatgaaagtatacttacaatccaagatgctctgatgttgactgcaaattcagtacgacagatagttctagatgttaaggttggacccccgttttatgagaaaaagcttgccaaagatgttctctctattgtaagtataatacttccgttccttactgtccatctactgccttctgaaagggctatcaatactcccggtctcagaaatgtctttgtccttaaagacagttgtgagagcaggttgagtggtgttggaaggtccgggagtgcattgccgcccttgggagtccatagcagaagtgccacatggagagtcattaatggttgggtgatggaggattctggcccttgtatttacgaaggaggctcacatggaaaactggatgaatcttggctgtctctggtaaagcaagcttgtaaacaactgtgccaattcacttttctacttgatacagtccacggaaacatcgagatagcttggaatctcattgggaacgaacagaggactgatgatagtgttggagtttcaaccatgcccattcacctacgtcgaaagaaatggcagtgcgacggtggacatttggcagagtggtgttgtgaacatcataatccgcaatggagggagggctgtgtccatacaaagcctgccaggatcggtgctgaaaacttagaaggtatgtggcttggcttgcacatacttggattgctaacaaatgaggcactgagttacaaatcccttaacatcttgggatattccaggccaaaaaaggatgaagccaatctagctaaagtagctttggttcctgaatgtcccccttcaacagaactgtggaaggcattcatgagagtctccctcatggattga

SEQ ID NO: 79157 - DNA, 270 bp, Glycine max
  Peptide Sequence Number=SeqID_170842
atgaaaatagagatacctagcttcaactcactggcagagatagccctctgtcaaggcaaaaatgtgcaaaaagtgtttgatccagtaacaaagaatgttagatgtactagagataagagtgttattaaggaagggcacaaaagttttccaagtggacatacctctcgtaagtacctagaacaaactttaaggttcatgaacgttatgtcacaaggttgcggaagaagttgcagtttgaggagaggaagcaagctaatcaaagaagggtag

SEQ ID NO: 79158 - DNA, 131 bp, Glycine max
  Peptide Sequence Number=SeqID_170843
atgataatgagcaaatttgactaccgttcaattagcaaggctcaggttgagaaggttaagaaggctaaagctaagaaaatccatgcggagaaagataagggaagcaaaaagaaaatccccaagatgacttg

SEQ ID NO: 79159 - DNA, 306 bp, Glycine max
  Peptide Sequence Number=SeqID_170844
atggtggaatgtcccaacatctccaatttcagttggaactacttcattttctggcagctctcacagtccaaatccagtgactgggttctaggttggggagacgggtgctgcaaggaacccagcgaggaagagggtgctttatcacgaacggagagaggtagaaaagaaaggtctaaggaagtgaaatcttatttctctcctctttcaaggaaatcaaagtacaccggaaagaagtcttcctatggaaaaaggtacaagccttcctatggagaaaggtttcaagatcctgttgtttcctataattga

SEQ ID NO: 79160 - DNA, 237 bp, Glycine max
  Peptide Sequence Number=SeqID_170845
atggctccacctaaagaaattgcgaccgtcatttaccacaatggtcacattgtagacgacctggttcagagatcgggtcagacacgttatatttcagcacaactactcgacaatgacgatctcagagccaaatgctatgctattatggaccttattcctcaaccacgaccttcgcctccacaaccgtcatgtccacaactacaactactgcctccacaacaaattaccgtaccttaa

SEQ ID NO: 79161 - DNA, 384 bp, Glycine max
  Peptide Sequence Number=SeqID_170846
atgcctgaaatacacacctttcaccttccatggggtaagtgcaccatcatactcgaagatgttgcactgcatctaggcattagagtcgatggtcgtgttgtgactgaacctaacttcttacattgggataagttatgcgacaagttactaggggaggtccctccaaaaaatgcacgtaagaaagctgcactgaagaaccaacaatacaccaacaacaatgcagagaactatgttgggcatcatatgaggttggtaaagttgtgggtgattgtgccatactattgcagtcatgagcttggtaccgcatgccttttattgcaccaagagtcacacgacctgaaacaacttatccactggctaaaagatgaagtggtggtagattag

SEQ ID NO: 79162 - DNA, 312 bp, Glycine max
  Peptide Sequence Number=SeqID_170847
atggcaatggatcctgacatatttgcacacggtggccttctggtgaatgttgctagaggtggtcttgtagactatgaggctgtgatcaaccaccttgaatcaggtcatttaggagggttaggcactgatgttgcttggactgagccatttaaccctgatgatcagatatttaaatttaagaatgttatcatgactcctcatgttgcaggcgttacagagcattcttatagatccatggctaaggctgttggtgatgtcgttcttcaacttcatgccgggcttcctttgacagggatagagttagttaactga

SEQ ID NO: 79163 - DNA, 585 bp, Glycine max
  Peptide Sequence Number=SeqID_170848
atgtggaaagagttgcagattaaggtggctgaattacctaaggccaaacctcaaaagaggaaactacaccaaggaagaggaggaaactattatcaagctgcaccgacatctaggtatgcaacggagcatagatgtggagtagttgttaaaggaccaaatctgagtggaaatatatcaggaacagagccattgaaggacaaccacatacttttgaaagcagaagctttagatgattcccatgaaccaagtaatattgctgttgttgttaatgagttgtccaaggaaataacaaaaaatttggtttctcatcctgtgaatgctaaatgtactgcagaagggaagagcatagcaaatgtagtccttttaagaggttgtggcattcaaattgagagaatcactgagggacagaacaaagtgacgttgaacaaattttcatgtatagcattggctgggatgtctactgagtatcttatatatggattttttaaaggaggtttagacgacataagaaaggtagcgacaattcctagagagagaaagaaccaagaaaaagagattggagaagaagataacaaactccaataa

SEQ ID NO: 79164 - DNA, 1104 bp, Glycine max
  Peptide Sequence Number=SeqID_170849
atgtcacctactgttgatgaagagagtccaacgctaattcctaatctccctgatgagttatcactccagattattgctagacttcctagaatttgttacttcaatgtaaggctggtatcaaagaggtggaagtcaactatcatgagttcggaattgtataaattaagaaaggaacttgggacaactgaagagtggctatatctgttgattaaggttggagaaaataatcttctgtggcatgctctagatcctcattctaagacatggcagagagtgcctaatgcatttgatgaaatgcccttttgcggttgtgcaattggagctgttgatggatgtctttatgttcttggtggattctctaagacttcaaccatgagatgggttagtcaaggtcaagctggattggttcctctccaatctgctgaagtttttgacccctctacagatacatggtcacatgtacctagtatgccattctctggagctccagtcttgcccagtgcttttttggctgacatgccaaagcctgttgccacagggttaagctcatacatgggaaggttgtgtgttccgcagagtctgttttcatggatttttgttaatgttgggggacaaatctacgatcctgaaactaactcgtggatagaaatgccggctggaatgggtgagggatggcatgtgcggcaggcaggtaccaaattgagtgttgtggtggatggtgaattatatgcttttgacccttctaattttgtggatggtggaagaatcaaggtatatgatcaaggtgaagatgcttggaaagtagttattggaaaagtccccatatatgattcttctgattctgagtctccatatctacttgctggtttccatggaaagcttcatgtcattaccaaagatgccaatcatgatattgcggttctgcaggctggcctgcgcgataatttggattcttcaccatcactctcaactctgtcaccaagtacatcgcaagaatctccagaagtggctgccgaatcagaagcagcaactgtttggaggatagttgccaacagggattttgggcaagccgaactagtcagttgtcaagttattgatatctag

SEQ ID NO: 79165 - DNA, 5403 bp, Glycine max
  Peptide Sequence Number=SeqID_170850
atggagaatcatgttcattcaagagtgaaattgaaaagagaatctaaagatctcccccgtatttcttcacttgaaggagaatcaggggtaaatgaagattatgctgactcagctgctggctttgatggctcgtctagtacttctgaaagcatatatacagagaagcatgatatctccagtacacatgaagtggacagtcttaaaagcacaatctctggtgatttaggtggactatccctcagtcaaagtcctcagccagagaaaggagaggcacctgataatcagtttccagcacagggtagtgagcgggttcatgattggagcatagactattcagctgccaatagtttggctgctgcttctgaagataggagcagtaacagacttatgggaaatttggatgcagttgagtcgtctattcttgatctaaaactgaaggtaagttctttgcaaaaccatgctgatgaaataggtgttgaaacacacaagttttctgagcaacttgctgctgagatttcatcaggagaagagttagtaaaggaggttgcagtactaaaatcagagtgttcaaagtttagagatgagtttgagcaacttaaaagttctaagttgagcttagcattacctcacaaagaacctactggtacagatcgggacaaattatttcaaaatttacagcataaatggcataaggggcttttgctcatggaagggaagataagagatattcagaaagtgtctttgggatttcctgaaagggattttaggttccttaacttggagttagaagcactggctgagattttgcagaatctcaaacaagaatctggagagccaatttcaggggccaaagttgtcaacgaaagagagaacaagaaaatggatatgcataaaagtgaacaatttttaacagatattgggtctgatacaggtttatttcaacctgaaagcatgactcattatcttaccatacctggccttgtgtctcatgagtttgattctgttgatcctgcccttgctatgaaagaaaaagtttttgaacttctaagagagttagatgagtccaaaactgaaagggaaagccttgtacggaaaatggaccagatggagtgctactatgaagctttgattcaggaacttgagcagaatcaaaggcagatgatggctgagttgcagaacctcaggaatgaacattctacttgtatgtacacaatttctgctggtaagtctgagatggagaaaatgcaccagaatatgaatgagcagataatgaaatttgctgaagacaagcacattttggaatctctgaacagtgactttgaaagaagggctatttcagctgaagcagcccttaaaagggccagattgaactattctattgctgttggtcaattgcaaaaagatcttgaactgctttcttgccaggttctttctatgcatgagacaaatgaaaatctcataaagcaaaccctttctgattcttcacttccaaacgctgatggtagcccagaaccagtgacatatcctaaaatttcagaaggtcgtactttcaatcgatcgctatgtcaaaatcacagttcttccttacaaagacaacatttgggtgaagacattttacttagcgatttgaaaagatcacttcagttgcaagaggggttatacagacaggttgaagaagaaatcagtcaaatgcattttgtaaatatatactcagatgtgttttctaaggctctgcaagaaacattgcttgaagcaagtcttgacattcaactcatgaaagagaaaattgttcaactctctcagcagctggagcttacaaatgaatccaacgagttactggtgttgaggttgcagaatgctatgaatgatatcctctcgctaaatgagtacaaggagatttgcactgcaaagagcaatgatattgctctccagaaccaaattttagaggcaaatttaaaagatcttgctcatgaaaacaatctccttactgagaaaattaatgagttggaagttcttctgacagagtatagaagttatgagggcaagtacatggcatgcagtacagaaaactcagagttgagaagtttattgaaaaaagagagcctaggaaagaaacatcttcatgatgaaatatccattttgcaggaagagttaaaatctatcagaactaaatttgacgagcaagtttcaatgaaggataatctgcagaataatgccatctttttatctaaaaagttgcagaaattgcttgcatcatatgaagaaagacacagtgaactttctctttgtagtagatctgcttgtttggattcagaatgtgaagatgtagaaggtctcttattgcaactagaagagctgcaacaaagtgcatttcatagaatcctactactcattgaagagaaggagattttagtgcatgaaaaacttatggctcaagtatctttaaataccgcagaatcagatgttctagtcatgaaacagaaggttgagcatgatttgcaagagatggtacagaagataactgtgtcaggtgccctgttgcagaaacttcagttaaattttgaggtgatcattaacaggattaatgctggttttgaagctgaagaattatattctcagcatcacaaagagtttttgtctggtctggaccatttggaagctgagctacaacaacttaattccagaaatcaggaccttgctcaagaaataataaagctagatacttcatcaagtgaccttgaaatgtgtaagctgaccttagcaacaatcaaagaggaaaagaaagatttagagtcgtctttacaggaaaaaacagaagaatctactaagatttcatctgagcttgattttttgaagaagaacttggattctctacataatgagttgcatgctgagaaaactgtaagagaaaaattagagaaaacagtttccgatcttaccacagaattgaatgagaagcaacgtcagctgcagggaaagaaagatttggagtcatctttacatgaaagagcagaagaagctgctaagatttcatctgaggttgattttttgaagaagaacttgcattctctgcattctgagttgcatgctgagaaaactgtcagagaaaagttggagaaaacaatttccgatcttaccacagaattgaacgagaagcaaacccagctgcagggaaagaaagatttggaatcatctttacaggaaagagctgaagaatccgccaagatttcatctgagcttaattttttggagaagaacttgtattctctgcatactgagttgcatgctgagaaaattgtcagagaaaagttggagaaaacagtttcagatcttaccacagaattgaatgagaagcaatgccagcttcaggattctgatctgaaaagacaagaacttgtccatctcaagcaaatggtgacagacttagaatttgaaaattcaagaatatcagatttgctacagaaatctgagaaacatcttacagatgctttaaaagaatcttcttctattagttgtctggaaactcagttatctgaaatgcatgaattttgcatagctacagatgttgtcatgactttcaccagagctcagtttgaggatcatatggaggagcttgctcagaagcttcattccacttgctggcaacttgatgtggtccacaagaagaatcttgatgtagaatctgaattggatggctatctttcaagagaacggacttgcattgaagaaaatacaagattgttgacgagtcttgactttgtgaaatctgagatagatgtcttgaccactcagaatagagcactaattgatcaaaacagtgcaaatatgttggagcttaaggagcataagagtaggacagagaagatcagtgatacttatgtgcgtgaaagacagagtgtccctgaggttgcaaggctggagcaattgctggcaagttgttgcagaaatgctgaagaactctttttgtccaaggaagcagcagaattcaagtgtatagttctcctgggcaaattggatgaactggaaactgcattcacttcattaaaacaatctgataatgagctgataaggctgcagaaccaatgcaatgaacttaccaagaggcttgctgaacaagttttgaaaacagaggagtttaagaatttgtctattcatttgaaggaactgaaagacaaagcagaggctgagtgtgctaatgctcatgacagaagaggacctgaaggaccaccggttgctatgcaggagtccttgagaattgcatttatcaaggagcaatatgaatcaaagttgcaagaactaagacaacagctgtctttgtcaaaaaagcatagtgaggaaatgctgtggaaactacaagatgcagttgatgaaactgagaaaagaaaaaagtctgaagcttctcaaataaaaattaatgaagagttggggatgaagatcttggaattggaggctgagttacaggctgtactttctgataaacgcaatttgttaaatgcttatgacctgctaaaggctgaaaaggagtgttcagtgataagccttgaatgttgtaaacaagaaaagcaagagcttgaagcttctcttgtaaaatgcaatgaggagaagtccaaaatcgaagtagagcttaccttggcgaaggaattggttgagacttcgggatctcatgtgaattctctgaatgagggcaatggtacattctcttcattgaatcctcaagaaaattctactcatgctgcttgcagtcatgagccagagagtgcaagcatcaatatgcaatccaaggatcctcttgcatttagtgttatgaatggatgccaaactcttggaactgaaaaggacttgcaactagaagaagtaatgaagcatgtggcatcaactcaaagtttgaaatctagcattgatcacttgaataaggagttggaaaggatgaaaaacgagaatatgcttccttcagtagacggtcaaagccacgagtcaagttttccaggtctacaaagagaactgatgcaattacacgaggccaatcaagagttaggaaacatattccctgttttcgataaattctctatcagcggtaatgcattagaaagggtgctcgctttggagattgagcttgctgaagtgctgcggacgaagaggtcgtcaaacatccaatttcagagttctttcttgaaacagcacagtgatgaagaagcagtattcagaagttttagggacatcaatgagctaattaaagacatgttagaactaaaggcaagacattctgctgtggagacagaactgaaagagatgcatgaccgttactctcagttaagtcttcaatttgcagaggttgaaggtgagaggcaaaaactcatgatgactattaagaatacaagagcatccaagaaggcttcaaattaa

SEQ ID NO: 79166 - DNA, 507 bp, Glycine max
  Peptide Sequence Number=SeqID_170851
atgggccttagtaactttcggaagaagtgcttctggaagttactaaggcggattccggaagaagtacttccggaagtacttcttcaggaatgggccttagtaacttccggaagatgtgcttccggaagatatcttccggaagaagcttcttccggaaacattctggatgacgttcttctggaaagagtttctgagtacttccggaatcacgaattcttcttccggaagaaggttctttcggaaaaagagtcttctggaatgattccggaagaaggttctttcggaaatggttttcgcggaagggcattttcgccacttcactgtttgctgggtgccccagcaataatgctgagtgcacgtagaaactcccaagtggtgaggatgcctcctccacctctaggatctcacaatcactcacaaattcatctcaagctctctaaccagctcttgcttcgagctttggtctctgcagatcttcacatggcaaaatctctcaaaagtctctag

SEQ ID NO: 79167 - DNA, 440 bp, Glycine max
  Peptide Sequence Number=SeqID_170852
gtaagtatgcacatggctcaactgatttctggtgtcatctactatttgcagggatcacacccacaagacacccagtggacccgaagaagtccaacaaggtcctcgggtttccagctctgattacaggcctctgtcatttctacggagtgcccatctcccccagcaagcgggcaacagacgcaccaccaccacctccagagcccctcagctcatctacaaaggctggagcgttgcctacgacccgtggccgaccagcagtcatcacgtgtccggctcaagacgttaaagaagtgctactaggaggcaacctagaattggctacgaagaagctccccacgaagcagtccaggaagggaaccattaaaaagggttccagtgcggccccacatgccaacacaggctttgataaacaccgattccagagcgcggaacatcagtag

SEQ ID NO: 79168 - DNA, 273 bp, Glycine max
  Peptide Sequence Number=SeqID_170853
atgctaaataatggacatccttgtctctctcatcctctcacaaacacatctgtgcttattcaacttccatcggaatgtgagtgcaagccattggtctgtttgctcaagcgacctgcgcttctgagtgttgacttccaagaccgttcaataagagattactcgtcttgcacgttagtgagggttgtgaaaacaaagatggatacctcagagccctacactggggcaatgaggggcatcgtgcatgaacctcaagtgaacctaggggtagattag

SEQ ID NO: 79169 - DNA, 678 bp, Glycine max
  Peptide Sequence Number=SeqID_170854
atgccgctcagccctgtgatattggttaccttggccgacaacgagctgatgtcggtggcttcttccttcctttcacttggaggtgcatacctccacggaactgcgtggctgttttggtatgaaaacggaataggtctaactaccgaggggtattggggcgcttggggagctgcgtctctgggcctcgtagataaaccttctgggggtcgtcgcgtccttcaaaggtttggacctatgcagcctacccgactcgacggcattaaccgctccccctccatgattggcaagcgggccaggcattattcggttgagtggcccggggttttcccatgggatggcaagaggtcttcgtacgtcattgggatcggggtgaatcctggagttggcctcgaggaaaatttccttgtcgcgttggaaccaatgccaaagtgggcattgctggccgggcgaatcagggttggagccggagcttgggggggctccctctggatgggtgcaggcgccctagtttgtacgagtgctgagttggaggagtccccggtgcgagcagagaagctcggttgctccgatccacctagcattggtacctttggaggagacataatcgaacttccctctcttcaagcccacttcgattctttccccagcgaataccaagtctgcaaagttggagggcat

SEQ ID NO: 79170 - DNA, 474 bp, Glycine max
  Peptide Sequence Number=SeqID_170855
atggagtcggaatattgggaaaagaatccctttaaagctatagccaagtggtgggacttttttggaccaatcccaaaaattttccctgagcagtatagcaaaatagaaaacaacaagcaatttccatcccttcagcgacatggatttgtcaagtggtgggatcaatttgacacatcaaaagcacaaccagataaggtgaaaatctggtttaaagctcatctagagttcctgaaagcacctgatccagagacttctttgtttctcaatcagaagtcccaattagctgccttcctagcaagatctaactccaaggaacatctcacggaaaaattaaaagaagttttgcaattactccaaagccaagaagaagggagttcttcctcaaagaaagaagacaccaattcttctaatcatgataatgatttttaccaaaatgaagatgattgttttggtatttgtttgaatgaacattaa

SEQ ID NO: 79171 - DNA, 219 bp, Glycine max
  Peptide Sequence Number=SeqID_170856
atggactcatttgaagattcagaaaatgaagttgtaaacgtgagtctgatggccaagaattatgaaagtgatgaagaggtttccttgaagaagagttggtacatagatagcggatgctctaaacacatgacaggagatgcatcaaagttcactcatatctctcccgagaaaagtggacatgtgacttatggtgacaacaataaaggtagaattcttgaa

SEQ ID NO: 79172 - DNA, 456 bp, Glycine max
  Peptide Sequence Number=SeqID_170857
atgataaatgatggaacatacggatttggggatcccacggtccggtggcttcgcatgccatcgaactcttgggacacggtaacaaaaagtggggtggtcgacaaaagcagggcttttgctcctacctatcctcaatttgtgatgaggaactcagacctacgtagttcttgcctactcatttcatttctaaacgaccatttagaggaaacactgggtccaacaaagataggagaaaatcactcaaagtgtatcaatctcacacagtgcggggcgagaaagtcactagcgcacaggattttggttggcaatcaaagggagacgacaactttaggtcgtgggaaaggattgacattctcacccagggtcaaggtttatgataagttgggatttttgctcaaggcttctagaacggctagtcatgatatatgtcaggtttggccagcggttcggggataa

SEQ ID NO: 79173 - DNA, 501 bp, Glycine max
  Peptide Sequence Number=SeqID_170858
ccggtgagcgtgggtctcacggtatcattgcagcactggggccagatgaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgaccacttctgcgctcggcccttccggctggctggtttaattgctgataaatctggagccg

SEQ ID NO: 79174 - DNA, 734 bp, Glycine max
  misc_feature (633)..(633): n is a, c, g, or t
  Peptide Sequence Number=SeqID_170859
ttgtaactgacgatcctggacttatatccgcatttgtggagaggtggcacagggagactagcaccttccaccttccagtaggagagttgacgatcacactatatgatgtgtcgtcactcctccatctccctatcagtggtgccttgcacaacttcgaggctctttccgtggacgagacgatatttttgttgattgagttgcttgaagtgtccggtgaggaggctagagccgagacagcttttcgcgacatgggtcagagtgggggctatgcctggggagctgcggccctggttcatatgtatgatcagttagatgaagtttctagaaccatgacatggcagattggggggtgctggatctatgagcatttttcaagtgtgcatcagtgcatcatcaatgatgcgtatgaggagacgtcctctcgtgcctcccggtggctgacgatgaaggctcatatgaagggaattacaggagcgttgtaccgggcacgttgtgatgctttgacagtcacagacgtgtgctggttgccttacagtgaccatcgagggctgagatggggtcctatggtgctcacagttcgaccggagagggtgctacgccagtttgggtacattcagagcatccctccaccgnctgatagcgcttcgttgtcatatgatgatatagatgaccggtggatgcctttctcagaccacgtagtagttgtgagtgacctttgtgtagtgcttgggcag

SEQ ID NO: 79175 - DNA, 510 bp, Glycine max
  Peptide Sequence Number=SeqID_170860
atgaaggaaagtcattttgcaataaagacaaacattaaagaaacttcccctcttagacaacctccacatcttctactttgtaaaaagacacctgttggcactgccatgcctcttgggcttgagattattcctaaagtaaaggagttgttggatgagggtttggttcgtaagagcttaaatccttgtgctttgttggtgcccaaaataggtattatgaggcaccaaatccctatgatagttggtatgatgaatgtgtttagtggtgcaacccttttttgtaaaatcacccatgtatccaacatcttcatgattcacatacatagggactcattaggtaggagtaatcaacatgaaaatattaaaaaggtcattccagagtggcccactccaccaagtataagggaattttggggcttctatgacttatcaaacttttacaaaaggattgtcccatatttttctatacttgtagcaccactcattgagttggtgtcgaggaaagaagcctaa

SEQ ID NO: 79176 - DNA, 620 bp, Glycine max
  Peptide Sequence Number=SeqID_170861
catgttgcatttagtggagaaacaccgagacttttcagtctcacaagttatccagaactacgtaggtctgagtacctcatggaggatacgtaggagcaagagtctcgcttttgtcgaccacaccgcctttgtcgccatgactcaagagctggtagcccgcggagataccttacggttatccgcacccttttgtcatccagaggcggcgggcccgatgacaagcagagaccaagtttggtcattctgcacccttgtatcatccagaggcggcgggcccgatgatacgcagagataccttacggttatccgcacccttttgtcatccagaggcggcgggcccgatgacaagcagagaccaaagaccaagtttggtcattctgcacccttgtatcatccagaggcggcgggcccgatgatacgcggagataccttacggttatccacacccttttgtcatccagaggcggcgggcccgatgacaagcagagaccaagtttggtcattctgcacccttgtatcatccagaggcggcgggcccgatgatacgcggagataccttacggttattcgcacccttttgtcatccagaggcggcgggcctgatgacaagcagagaccaa

SEQ ID NO: 79177 - DNA, 754 bp, Glycine max
  Peptide Sequence Number=SeqID_170862
atgccggcgatcaccggcactttaccgtcggcggcgtctctcgccacttcgatcaccgccagcttttcctgcaccgtcattgaggccggagacgccgtcgcgcaccaggtttttgatcaccgtatgagtggcgtcgagatccagagagaaatcgttgcggaactgggtcgtcaccgccgggaatacgccgctccagcttatggctttatggctcatcgtggaggcttgacgcttttcgccgattgccgcgacgaaattggcacaatgccggcggaacgcgggcgtgaaaaatctgggcgccggcgcaccttgaaaagagggggcgcgttaagcggaaagcgtcaggcggaaatcgcgcggcgtggagccggtcatcgctttgaactgacggctgaaggcgctgtgatcggtgtagccgcactgcagcgcgatgtcggtgatcggcagatcgccggccagcagttccgtggccttttccagccgcactttatggatcatctggcgcggggtgaggtggaagatacgtttgcagtagcgttcgatctgcgccaccgacaacccggtcagcgccgtcagctcctcaagcgcgatcggccgggcatagtggcggcggatgtgtacgtcgatcgccgccagccgttggtaggccgggtgattggccctggcctcctgcagatcgtgagaaatacccgccataccgatgatttttccctgcgcatcatacagcgccagcttttgcgtcaggcaccagccg

SEQ ID NO: 79178 - DNA, 273 bp, Glycine max
  Peptide Sequence Number=SeqID_170863
atgtggcggaaattgaaaagaggtgtttttgcacaatcccaatctggcccacttaggccttccagatccttcctccagaaggctgttgcttctggaggaagcaagcttgctcgtctgggcgagctaggtggcaagctcctcccctattttgccataaatagggggaggagtgaagaagaaaagggttcagcctttttggcacttctctctctctcgaaattgctgaggaaaattatttctgtgaagaaaatccaagccgaggcgcttccgtaa

SEQ ID NO: 79179 - DNA, 223 bp, Glycine max
  Peptide Sequence Number=SeqID_170864
atgataattgtcgcaacctacccttcggcgggagggcgacgcggggctcacgggtgtgtcttccaagaaaggaaaatgcacggagtcgccaccaacatttatttgaggaaaatgtcggaaaaaccgaaaaaggtgtggtctatgaaatttaagtgtgaaaggttcgggagtttttttacgcacagggaagctattagcaccccacgcatccgtcacaagggac

SEQ ID NO: 79180 - DNA, 510 bp, Glycine max
  Peptide Sequence Number=SeqID_170865
atggtagccataacccctgctagggttcctcaacctccatttttccgaggatacgactcgaacgcaacatgtgaatattatggaggagttttgggacattccattgagcactttatgaccttaaagcgactacacgtcctcgccttcagcggactacacgtcctcaccttaagagggctacacaccctcccctttagaggactacacgtcctcgccttcaagggactacacgtcctcaccttcagagggctacacaccctcgccatcagaagactacacatcctcgccatcagacggcttcacgtcctcaccttcagagggctacacgccctcaccttcaaaggactacacgtcctcggattcagaggactacacgtcctcaccttcagagggctacacgccctcacctttagaggactacacgtcctcgcaatcacgcgggccgcacgacctcaccttcagagggctatatgccctcaccttcagagagctacacgccctcacctttag

SEQ ID NO: 79181 - DNA, 228 bp, Glycine max
  Peptide Sequence Number=SeqID_170866
atggagtctccaactgtcgcaacctacccttcagtaggaggacgacgcggggctcacgggtgcatcttccaaaggaggataatgcgcggagtcgccaccaatgtttattcgaggaaaacgtcggaaaaatcggaaaggagaaaagagggaggtggttgccgcctagctcgcccaggcaagctgggttgctttcaccagaaggcaccaccttctgttggaaccccctag

SEQ ID NO: 79182 - DNA, 597 bp, Glycine max
  Peptide Sequence Number=SeqID_170867
atggacatgaacatcggagcccttatctcaggtcagatttcttctattgctcagagtaactccgctaggctcggatctctagccttgatcactgccctatgcagagctagaggagttacctctaacagtctaacttatgagagcctaagcccggccattaacttggcctacataaagaaaaactgttggaatatggatgatctaacagttaactttagaggggcgaggaaggcaagggtgagaccagctgatgttccttcttcttctactctaccagctccttccacttctgctactcctacaccagctcctctaggctcatctactcaggactctcagcgctttgaagccatgcttcagagtattcatcagggacaaattttattactgcagagcttacaggtgatagctcctctagggtcaattttgtcaatagagcagttcattgagaaggtatcctggcctggaaccttgccttctgttgtgagagaaggtgagggtcctagtgctcaagtacctcaacagggcacaggtaaggcaggaggctgctactctagagagattgatcgaacccagcaagtgcaccagatcgcgcaa

SEQ ID NO: 79183 - DNA, 552 bp, Glycine max
  Peptide Sequence Number=SeqID_170868
atggcatctaagaaaaggaaggcaccttctacacctacccaggccaaatttgatagatccaggttcacatcccaagaggcttgggagaggtatacagacattgtggtgcctcgaaagctactactagagaggaatgtggtagtctattacacaaagtttgacgagttcaaggaggaactcgagagaagacattgggatgagaagttgattgattttgatgacagtagcatagacattgctattgtgaaggaattctacgcgaacctctatgaccccaaggataaatcacctaagcaggagttggctgctaagctctgtatcccagggaggggattcgagctaaatgctgatgggcaaccattgaagatattgaggaagaacatgaccaccttagctcagacatggagtgttctttccttttctaacctaattcctacctcccacacatctgatgtgaccttggacagagccaaactgatttatggcatcatgatgaagatggatatgaatgtggggtacctcatctcccataagatctctctgattgcatag

SEQ ID NO: 79184 - DNA, 444 bp, Glycine max
  Peptide Sequence Number=SeqID_170869
atggagagaagccataacttcaacaatgggaagagatcccaagaagtttctccaacacttaaatgctataagtgtaatcaacccggtcacataaaggcaaactgcccctcaaatgagtcatggtccgagaagaatgagaagaaaaactataaagaaagaagatccaagaaggcgtatattgcttgggatgacaatgactcatccgatggttcggagaaggagatcaaccttctatccaaggactatgaaagtgatgagaacatctctcaagaattttatagagggtacatctcttgtggatcagttcaagtggagggtacatccacttggttgttcaaagagaacaagggaaggtacatctcttgtggatctttggcttgtaaaggattttacaaggttgaaagaaatctcaagaaccgttggttgcttggggactggatgtag

SEQ ID NO: 79185 - DNA, 542 bp, Glycine max
  Peptide Sequence Number=SeqID_170870
atgactagaggcaatccatctgacttacaaccctttgattctgagatagataggacatttcatagattagttaggcatcattttataccttttgattatcctgagcattccattactggtgaatctgtgcattctgttattggtgattttcatcatccagattttgagcattataattttgagcattctgattctgagcattctgattttgaacattctgagaacatggcacaacctccaccccatgagaggactctaagggaaatggctgcacctgatttcacctacgaaagtttgtgcatccaataccctgatgaggatgtcccatatgttcttaaaactggactgattcatttgcttccaaagtttcatggccttgcagagggggtggcaaaggactggttgtattaccttgctccacggtccatcacgagctgggatgaccttaagagagtattcttagaaaaaaatttccctgcttctaggaccacagccatcacgaacgatatatcccgtattagacaactcagtggagagagcct

SEQ ID NO: 79186 - DNA, 309 bp, Glycine max
  Peptide Sequence Number=SeqID_170871
atggccaaaatacaaggcccaaaagaagaaaaaacttattctaatatttacaaagaagagaggacccaaccttggtccatgggctcagaaatctaccctggggttcatgagaatcccaaggccttctttagcagctctagcccaatcctcttggagtcttctatccaatacccttggggggtaggattgcatcatcccctccaccttggaatggatttgacctcaaatcctgagagtaaggtaaggtctgaaaacccctttcatggacatcttcccatgagggaacattgttcctcaccaactcaatga

SEQ ID NO: 79187 - DNA, 183 bp, Glycine max
  Peptide Sequence Number=SeqID_170872
atgagcccacccttatggctctcttttacaagacttggaggacctatgacaagggctagagcaaggaaagccaaggaacctcttcaacaagtgttgtccatactatttgaatacaagcccaagtttcaaggagaaaagtccaaggttgtgagttgtatcatggcccaaatggaggaggactaa

SEQ ID NO: 79188 - DNA, 402 bp, Glycine max
  Peptide Sequence Number=SeqID_170873
atgcctaagtttcatggcaacatatcagtcttgagaagtgtactttctttctcgatgacatatctcgtaggaaaatcatggctctcaagcaacttctcggctttaagattgggagtcttcccttctcttatttgggagtgcctatcttcttgggttccaattggtcaactcagtgataagtggcatgttactttactccttccacatcaattcttcactgaagaagtttttgaagttagtggactcttggctgcgaaactttgtgtgggcggttgctttgtcagtttttggaacgactgttggtgtctccaacaactgatcgctaaagcccccagcctccccctttccatttgccaacaactatcctctatggttaagaacttttggcaagataactcttag

SEQ ID NO: 79189 - DNA, 534 bp, Glycine max
  Peptide Sequence Number=SeqID_170874
atgtcaaagacatgggagaagacttgctccaccaaagggaaaactagttattcttgtccagatgtctcacccaggaccaaggaaggggcagaggaggaagctaccaaggaatttgaagggccatccgcaggagaattcgctgagcgcaaccttcagtggctaagcgcgaggaagaatccagaagaagatgagttgtcaagttcgctaagcgcaccactccagatttgcaaaggggagtttggcacttttcttgagaagctctgcatacacgaaggttctagagagataaaggtccaagttccagagagttctgagagattttgttgtgtgaagatctgcagagacgcgagttcaaagcagaagccgtttggagagcttgagatgagtttgaggtttccggactatagaaagctaaatcctctgttggatcttccctataggtacctgattggaaattggtctgattctaaagtccttgatagtacgggactaagttgttgtgctatcacgaggaatcggggtacaagaacttag

SEQ ID NO: 79190 - DNA, 1098 bp, Glycine max
  Peptide Sequence Number=SeqID_170875
atggatgacttcgcctatagaccattcgtaaagcaggtcggaccgggaggtagggatgtgccaccatctacggttgttgctgttgttgaaaaagagggtcaacctgctagcgaggttggccatattgttgttgatgttgaggtcacccccaacggttcttcctctgtcttggcaaaaaggaagagggctccatcggccgttgaggctactgctactgctacttctgctcctgctccttctccttcttctattattgttgttcaagaggttaccattgttgctattgaagttttcataccagctactttggctagttctcttgcggcgttgccgtccaccgtcataagttttggtgtggtgaccactagtgctcctacagtgcttccttattcctctaatccttcggtggcttctgcctctactattttggcggctgtagcgtcgccttcttcgttctctcaccctcgtgtctcccttgatcacttttataagtcgaaacaaaagacctcggttggctttgtgtcagccttcgacaagaaccttattaggtcagctggggtggagaatgctactgactctgccaaagtctttctccaaagaagtttggcaattttggagaagagtgaacaacgacatcaagaggctgtgcagaaggtggcgtccttggaggcggaggtcgccaaatggaggactactactcgtactctttggcgagtggagcgccctaaggtggccaatgctactgttgcttttgctaaggcagtggagaaaaaggacctgtgcggcaaggtggagagcgtggcggctgaaagggaaaggctagtcaagatatttttcgatttagaggcccaacttaaggaatcggagtccaggttggaggagtccgagctacaagctgccaaggaaagggaagccaggtttttggaggccgtcaagcaagctgatttctttgtgaaggaccttaacttgggtctcttcaatcccttcaaggatgtgaaggatggtatcatgctagatgaggaaggcattattgcggacgacgaggctattgatgaagggcagggtgttgtgaagcaaggtgatgatgcttgtgtctag

SEQ ID NO: 79191 - DNA, 165 bp, Glycine max
  Peptide Sequence Number=SeqID_170876
atgggaagcacgacgacattgaggttaggacaaagaaggaagtttaggctcatggaaggagagaagggaagagaaaagaagaaggaggagggctcatggaaggttggtggcgaagaagaggcaggggttgttgatgcaatcctaccctgcaagggaattggatag

SEQ ID NO: 79192 - DNA, 402 bp, Glycine max
  Peptide Sequence Number=SeqID_170877
atggctcgcaccaagaaaactagccaaatgacgtctgaggcagcaaaggaaattgctgacaagattgattccatgaaggagcaggcctcacagggttcctttgtcgcccatggacgtcaggatgtactgattgctgccattgggcgaccagaacaccctggtcatgtgtgtgttgctggagccagtgtcacgatcaaacaatactttggactggctccaaggacctcctgcacgtcttcgtccatggctctcgaagacctagagcagctaacgcaaaaaattagggaagctggaggagtcgatcacaaaaaaagtgacttgacaactaatgttgtccttcagctagatgcaatcccagtttcaatcgcaaataaaatcacatggactcgcactgcctcctga

SEQ ID NO: 79193 - DNA, 330 bp, Glycine max
  Peptide Sequence Number=SeqID_170878
atgaagctcaagccctataaaaatgacgtatttttgcaagctaaccctgtattgagacatgattggttcaagttaaagcaaactgccattgtcaatggcgagtttgctgtgcgaagccacgtggcatggaaaacgccacttgtagtggcgagttgcctacaggtggaagttgccaccatgactagcgagttagggcaggcttctgcaggcttttggaaaccgctagtcaaactggcgggttggctggtgcaggcttttgcagtgtttgcaggttgcttttgtaggcggtgtaggcctaaaggggagttgcaactgccactggcgatttga

SEQ ID NO: 79194 - DNA, 339 bp, Glycine max
  Peptide Sequence Number=SeqID_170879
atggtaggagatggtgatggtggtggtgaatatcatcaattggatggaactcagcgtctgttattggacataatgactacacagatgcaacgattgttgaaccgtaacaatgaagagctctatggacaaatagaaggtccggagaaccaactgaatcagaatactggaaggcattttggtgggaacagagtgggcaatgttggacccaggcaaaacaaaatggagggagtaaaactcaatgtaccccctttcgaaggcaagagtgacccagacgcctaccttgattgggagatgaagattgagcatgtattctcctacaatgattatactgaagaatag

SEQ ID NO: 79195 - DNA, 678 bp, Glycine max
  Peptide Sequence Number=SeqID_170880
atggtttggcagtctccaaatcaaaaatcaatcttttccaaactcgaattcgattccttggtcacaatatatatcaaggcatttaaaactgtcgaaactgatgcttcagacataggttatggtggcatcctcaaacaaagagtccatggccaagatcataaaacatcaagggcacctcaaattcattacctgactaccttacccgtgaattcttacagaaaagtggtaatgcctcctaaggcatcgggaatctccctaagaggaggaagaagtacaggcaaaggagccagactggctcttccagagccaacaattaagaaatcatcaacctcttctgggtcaccaacccaggctgggtcatctacccagaaaaccaatttagaagggtcatcaacccagattacctcaatcaaacctgagccatccactcaggaatctcccaaatcggcaaccgccaaacaaacatcggccgactatgcatggccaattgaaacccttcaggcccttcaagacatgggtataaccaaatttccaaaaataatcaaaaaatcttgggcagacattgcctcagaatctgatgatgaatctgaatcaaatttacaaacagtgatccaaaatgcatcaatgaccaaaacagctaccaatcctaaagggaaactacctttagccaaagcttaa

SEQ ID NO: 79196 - DNA, 1085 bp, Glycine max
  Peptide Sequence Number=SeqID_170881
gggtggcttgttttggttttggcgcatttcatgtaacaggattgtatggtcctggaatatgggtgtccgatccttatggactaactggaaggatacaatccgtaaatcccgcgtggggcgtggaaggttttgatccttttgttccggggggggtagcttctcatcatattgcagcaggaacgttgggcatattagcaggtcttttccatcttagtgtgcgtccaccccaacgtctatataaaggattacggatgggaaatattgaaactgtcctttccagcagtattgctgctgtcttttttgcagcttttgtcgttgctggaactatgtggtatggttcagcaacaacccctattgaattattcggtcctactcgttatcaatgggatcagggatactttcagcaagaaatatatcgaagagttggtgctggactagccgaaaatcaaagtttatcagaagcttggtctaaaattcccgaaaaattagctttttatgattatatcggaaataatccagcaaaaggggggttatttagagcaggttcaatggacaatggagatggaatagccgtcggttggttaggacatcctgtctttagagataaagaggggcatgaactttttgtacgtcgtatgcctacttttttgaacatttccggttgtttggtagatggggatggaattgttagggccgatgttccttttcgaagggcagaatctaaatatagtgtggaacaagtaggtgtaattgttgagttctatggtggcgagcttaatggagtcagttatagcgatcccgctactgtgaaaaaatatgctagacgtgctcaattgggtgaaatttttgaattagatcgtgctactttgaaatcagatggtgtttttcgtagcagtccgaggggttggtttacttttggacatgcttcttttgctctgctattctttttcgggcacatttggcatggtgctagaactttattcagagatgtttttgctggtatcgacccagatttagacgctcaagtagaatttggagcattccaaaaacttggagatccaactacaaaaaaacaggtagtctaa

SEQ ID NO: 79197 - DNA, 634 bp, Glycine max
  Peptide Sequence Number=SeqID_170882
cgggctacacgcccttgctttcagaggactacacatcctcaccttcagagggctacacgccctcgcctttagaggactacacgtcctcgcctccaaagggctacacgccctcaccttcagaggactacacatcctcgctttcagagggctgcatgccttcgccttcagagagctgcacgccctcactatcaaagggctacacgccctcacctttagaggactacacgtcctcacctttagaggactacacgacctcaccttcagagggcttcacgccctcacttttagagggctacacgtcctcgccttcagagggctacatgacctcaccttcagagtgctacacgtcctcgccttcagagggctacatgccctcgccttcagaaggctacatgtcctcggcttcagaggactacacgtcctcaccttcagaggactacacgccctcgccttcagagggctacacaccctcgccttcagagggctgcacatcctcgccatcagaggactacacaacttcgccttcaaagggcgtcacgtcctcgatttcaaagggctgcacaccctcaccattggatggctacgtgtcctcactttcagtgggctgcatatccacaccttaagagaattttag

SEQ ID NO: 79198 - DNA, 103 bp, Glycine max
  Peptide Sequence Number=SeqID_170883
gaaatgggtttatgatcccaacatggggaaaatgcaagggttacacatgagcaaacatgaaaacaaaaagtatgttgaacgcatatacgtgatgatgcaatga

SEQ ID NO: 79199 - DNA, 1058 bp, Glycine max
  Peptide Sequence Number=SeqID_170884
atgctcagtcaaatacaacgttttggcggtgccatgtttaccccggtattgctgtttccgtttgccgggatcgtggtgggaatcgccattatgcttcgcaacccgctgtttgtcggcgaagccttaacggcccctgataatcttttcgcgcagatcgttcacattattgaagagggcggctgggcggtatttcgcaatatgccgctgattttcgccgtcggtttaccgattggcctggcaaagcaagcgcagggccgcgcctgtctggcggtgctgattagcttcctgacctggaactacttcatcaacgcgatggggatgacctggggtcacttcttcggcgtcgatttctccgccgaacccacggcgggaagcgggctggcgatgattgccgggatcaaaacgctcgataccagcatcatcggtgccattgtgatttctggcatcgtgaccgctatccacaaccgctatttcgacaagccgctgccggttttcctggggattttccagggcagttcgtttgtcgttatcctcgcgtttttcgtcatgatcccctgcgcctggctgacattgctgggctggccgaaagtgcagatgggcattgagtccctacaggcgttcctgcgctcagccggtgcgctgggcgtgtgggtgtacaccttcctggaacgcattctgattccaaccggactgcaccacttcgtctatggcccgttcatcttcggcccggcggcggtggaaggcggtattcaggtctactgggcgcagcatctgcaggaattcagccagagtaccctgccgctgaaaaccctcttccccgaaggcgggttcgcgctccacggcaattcaaaagtgtttggctcggtcgggattgcgctggcgatctggtacaccgcctcagcggaaaaccgcgtcaaagtggcggggctgctggtcccggccacgctcactgccgtgctggtgggcattactgaaccgctcgaatttaccttcctgtttatctcgccgctgctgtttgccgttcacgccgtgctggcggccaccatggcaacggtgat

SEQ ID NO: 79200 - DNA, 198 bp, Glycine max
  Peptide Sequence Number=SeqID_170885
atgtgcttcagtgaaacagtagcccgagcattcgctaagtgcaaccttcagtggctaagcgcgaggaagaatccaaaagaagatgagttgtcaagttcgctaagcgcaccgctccaggtcatcaagcacaccgcttcagctcatccgctaagcgaaacaagcgcgctaagccaaaatccacttatgcgtactaagtga

SEQ ID NO: 79201 - DNA, 349 bp, Glycine max
  Peptide Sequence Number=SeqID_170886
atgccaactaagctgattatgcagaagcagaattttctgcaacatccgctaagcggccccacatgttgctatgcggtagggagaaacatcttgtcagagaggaaggtggagctctaccatactgagtttgatgattttaagactgagttggagaggcgtaatctccataaacgcctcaccaatttggttgatgggagcataaatgtggctttagtgaaagagttctatgcaaacctatacaactctgagggcccttcaccaaagcaagccagggccagaggccatctagtgaagatcgatgctgacaacctcaacacattcctagagacacctgtggtgttggcagagg

SEQ ID NO: 79202 - DNA, 367 bp, Glycine max
  Peptide Sequence Number=SeqID_170887
atggcttacgaacggggcggagatttcctggaagatgccaggaagatacttaacagggaagcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccgtcatgcgccggttaaggctaaactgaaaggacaagttttggtgactgcgctcctccaagccagttacctcggttcaagagttggtagctcagagacttcgaaaaccgccctgcaaggcg

SEQ ID NO: 79203 - DNA, 940 bp, Glycine max
  Peptide Sequence Number=SeqID_170888
gaaggcaaggaaggagttcttttctcgtgtggggactatcctaatgttccactgatagggactaggggttgtattaattataatcccgcactcgccataagacagctaggatatcccatgaggggagcaccgaccgaagaaagtctctcgcctttccttatgagagatctaggcgcgcaaggtctcaaggttatacaaagaatccacaaggcgtggaggagtccgttgaggaaagacaaggagcttagaggcatccgaaacggcgtcatcggaggttatcatggatggctaagaattcacacgcggggcttagattggctctccaaattgaaagttatcaatgaggagaacttcgaagctccggaggaagatgaagaagtccgagctctaaagttagagctagggaaagcgagactcgccaaggagaagttcaaatcagctgctacacacatccggaagagtgcaccgagttacaagaggaaaacgcagccactgcaaaatcccttgaacaagaaaccaaaagggcccgcaaggaggaatatggccgaaagaaattccgaggagcattgtggggtagcaacaatgagctcaagctccgaagagaagagagagatcggtcacgggtccaaaaggaatttggctcaacacttggaagccaccgagcaaagcatgctagccatcatagggcaatacaaggaagaattgaaccagtccacggcccatgaacaaaagttagtggaggactatgcacaagtgtatgccgaaaaggaggcaagagggagggtgattgatgcgctgcatcaagaagcgactatgtggatggataggttcgccttcaccttgaatgggagtcaagacctcccgcgtctgttagccaaagcaaaagccatggccgaagtgtgtactgcccccgaggagattcatgggctaatcaattact

SEQ ID NO: 79204 - DNA, 765 bp, Glycine max
  Peptide Sequence Number=SeqID_170889
atgcgtgctagagctagagtaatgggtgaaatagaggaggtgcaagagcggataaaggccgacatggaggccatggaagagcaaatggccacaatgatggaggccatgatgagcatgaagaatataatggaggtcaatgcggttgcagttgccgttaccaacacccttgctgagggagacaaagagttgggaagtactggcggcccccattttgtgcaagttcagaacaagcatgccttcccactatatggcttgcctcccaactatacaccacccaatgttgcacacacttccgatgagaatatcaataactccactcacatactcattgagagccaacaacctcaatctgataatgcacatgtctctcaacccatgggggagacacatgaagtaccacaccacaatctagctgactttgaacctcacctcggatatgccactgaggggcaagcagttggtggtgtacccctgccagacactttggggggccctcaatttcgccaacaaccacaaccctcacattttgcggtgggaagagtccctcctgctatggtggaaaggggaaaacttgatcatatagaggaaaggctaagggccatcaaatgggccggaaattatgcctttgcagacatggcagagttatgcctagtactcgagaaccacctgaagaagtactgtaggaaaatgggagcatatgcgaaagatgaaaaattattgatgcatttcttccaggaaagtcttactggggtagtcgtcacctag

SEQ ID NO: 79205 - DNA, 294 bp, Glycine max
  Peptide Sequence Number=SeqID_170890
atggaaaagagcggaggcaaacagaataattttgggtcaatgaaagaaagggaatggaaaatcttcagaccagataaattctcggcaagattgccattctcgactggcgatatcccaccccacatgaacaaagaggaaaagaccgaaacacccagcttcctctccaaaaacactaccctcgagaaaatcctattggtccgtgatcgaattaatgaaacattgggattaatccggattttggttgtggacttgaagagggcaaataaagcagcgcttaccttagttaatttctaa

SEQ ID NO: 79206 - DNA, 408 bp, Glycine max
  Peptide Sequence Number=SeqID_170891
atgggtagagcagaagaggtgcaagagaaggcgaaggcctacatggaggccatgaaagaaaaaatggccacaatgatggaggccatgatgagcatgaagaagataatggaagccaatgtggttacaattgccgctaccagcattgttgctaaggtgaacccgatgcccccatctggcctcaaccaaatgaatcatccaaccttagacatggtaggcaaagatttgggaagtagggacgacccccatgatgtgcaaaatcaaaacaagcacgccttcccgccatatggcctgcctcccaactatacaccacccaatgtggcatacactcccaatgaggatgtcaataactccactcttatacccattgagagccaacaaccccaaactgatcatgcacatgtctcttaa

SEQ ID NO: 79207 - DNA, 180 bp, Glycine max
  Peptide Sequence Number=SeqID_170892
atgatgttgatgtcggcaggaataaagatgaactgggtattgtcagcagccaaagttgccaaaaagatgaagctaaaatttactaaagaatggattgcatatcttagattgcctcttccaattgatgtttacaaagagctgaagcattatattctgaaacatggtgcgaatgccatgtaa

SEQ ID NO: 79208 - DNA, 249 bp, Glycine max
  Peptide Sequence Number=SeqID_170893
atgaaacggttacagagggcggggttgaggagctctcgcggtgttgggttggggcataacattaaatgtcggtccctcggtggtgaatgtgggatatgggtcgaagtcaccttgagcatgctctcaaggttcttcacgggcgccccctacaggctggggttgctgacccacaacagtaaggggaacgacatgattaatgttctcattgggcatgtgcatggtgggcggcatataattgaggggtggtaa

SEQ ID NO: 79209 - DNA, 120 bp, Glycine max
  Peptide Sequence Number=SeqID_170894
atggaccgatcttggattacagcacctcgcataagcgaagcttatcaacatgggcaacatgtccacctcatcccggttgagctacaaagcggagatctcatgggaagacatgatacgtga

SEQ ID NO: 79210 - DNA, 730 bp, Glycine max
  misc_feature (697)..(697): n is a, c, g, or t
  Peptide Sequence Number=SeqID_170895
atgccggaagtcgaaagggagcattgtcgcgcaatccataaagttctgcaacattccagaggtcaaaaaagggattattgcataatccgtaaggggtgtgcaaatagcaaccaggcccacttgggccttctaggaggttccaacagaaggcggtgccttctagtggaagcaacccagctcgcctggaactcaacaaaaccccggctagagtctctggtgtcagtcaaatgcatggaccacgtcatggccaaagtactcatcgataacggctccagtttgaacgtgatgcccaaaagcacgttggagaaatttccgtacctgccaagtgaggaagatgtcttggtaagttgcccttcctctatgccatatgtggaagccgcggaggagtcattggaaatggctttccaatcttttgaggtagtaagcattgcctccgtagattgcctctctgggcagccttgcctgtctgatatggcaatgatggtggccccggtgatattggggtacggctacgagcccggaatgggtttgggcaagaacaacggcggcaggaccagcctggtaagcaccagaggaaaccgcgggaagtttgggttaggctatagacctacgcaagctaacataaggaaaagtatctcggaaaggaagaacaaaggccaaagcccgcggttgggacaacaagccgaaggggccccgncctgccacatcagtagaagctttataagtgcgg

SEQ ID NO: 79211 - DNA, 861 bp, Glycine max
  Peptide Sequence Number=SeqID_170896
atggggtgtagcaagattgcatcagagtggttgtcacaacaagtgttcaactttcctagtcttctaaaagcagaaggactatcaaagctggtgcagaagaaaataactttttatccagagctagtcaaggaagtagccgatctggacattggtggagtccacaagtttgatgaagcgcctgatgggtacaacaagatgcagacctatatgggaatgcttcttgacccggttaggaacttgaggaatcgcttaggagttggtggactgactgaaaaggaaaaaatgttagtatacctcattacctacattctcacacctaggtcaagcaatcatgctcaggcaacggatgatgatttacagatagtttatggtctgaaatcaggtatcaagatgaattgggtattgttgattgaagatattatgttgaagtgtcatcttcttttggattatgaatttccttatgttgtgcttgcctcaagattcattgactatttcaaggttgatatctcttatgagattgtgaactttactaaagccttcagtgagattaccgaaaggcatctcaagaagcttggaatgaggtttattgatcatgaatggataatggttggagagcctgaagctggaaacattgacgagatggaagaagatgttgaagttaaagctccacaaaagcatgtacatcaatggagtccttttgagtttcttatgattccaaagatggatgctatgcttcccctccatcaagagcactcagctaaatttcatagttctgcagacaatataattacccgactggaaaactttgagactaggctgacccttagcaaccttcttaatcctaataaggatgaaacttaa

SEQ ID NO: 79212 - DNA, 957 bp, Glycine max
  Peptide Sequence Number=SeqID_170897
atggatgacgaagagctaccttcgcctgtgaattctgacattgtcaagcgggctgcaatggatggctctaggcctatccttgattttattgcaatgtctccaaagaagcttctcactaaaagggcaaggaaggacaccgcaggggagggatctagttcagccccacatgcggaagttgagcttgacggacaccgtgtccgaagcgaggagcatcagcgccgctttgaagcgatcaagggttggtctttcctcaaagagagacgggtccaactgagagcaagggaatacacagaattccaagaggaggagtcatggataagcgctcctgggtgtgaggccaatggatcccctatgatgaagaggctatcaaccagttcctggggaggccataggccagctactgtgctccccaggacaggaatttgcgtgaagcgtgatgggaaggcggctcgacttatctcagatgccatttaccagtttgcaggtatcacgcctctaagacacccagtggacccagaaaagtccaacaaagcactgggatttccagccttgatcacaggtcactgccagttctatggggtgccagttacacccacaaagctcatctgcccacccattaataggtcgttcattgagaagtactacatgccaaggcaggcacagcaaccgaggcaggaccagcagcagcagtcggccttagacgcaccaccacaacctctacagcagccaccatctctagagtccatctcggctcacatgcagagaatggagctctacatgcagcatttggctaaccaacaggcggccaaccataggggtcaggaccccaacccttacccatggcctactccagagcagtttgaggccactgttgcttggactagggacaggcataattttcaggcgggggcaggcctcacaaaggcccaggggatgaggacgaagcttaggaagagg

SEQ ID NO: 79213 - DNA, 570 bp, Glycine max
  Peptide Sequence Number=SeqID_170898
atggggacgaggggttgtatcaattataatcccatccttgccataagacaacttgactaccctatgagaggagcttcgtcggaagaaagtaccatgcccttcatcgcatggggtttcagtgaccccaatgcaagaatatttcaaagggtccgaaaggcatggagtgtggtgcaaaggaaggataaggaacttaggggaagcaacaatgggatcttagattggctctcgaagttcaaggtctcaagtgaggaagaggttgaaaccctggaggagagtgaggaggtacaagccttaaaggtggaacttgaaaaggcgcaagtagtcaaggaaaggttcaagacaatgaccatcaaggtccgaaaagagtgtgatgaactgagagacgtcaatatggccacaaccgaagcattggaaggggaaacaaagagggcccgaaaggaagaatgggtccaaaacaagttccgaggggcgttgtggggtagcaacgacgagcttaagcttcgaagggccaaaagagaccagtcgagagttgaaggcatgatattggaaggcaagttaaaggcttgttga

SEQ ID NO: 79214 - DNA, 501 bp, Glycine max
  Peptide Sequence Number=SeqID_170899
atggaatccagaaggaaacgccttgactgtggccttgaagggatttttgtcccaataccctgggtttttaaatcaatttcagattcatcatctgattctaaggctatgtcagcccatgttttctcggggagctttgttaggccaatttcttggagggccaaaaattttgagggtgaaatcttttttgagcatggctctggtagagccaacttgaatccttttcctgaactccttcctcctcgtaaggaggtgatggatgccttaggtggcatgacaacttttctgttaattaggcaaattggcaaaagtgtagttttcaccttctcgctaagccaatctactggcttaaattcagaagaagatgagctgtcaagttcgctaagcgcaccgccccaggtcatcaagcgcgctgcttcagctcatccgctaagcaaaacaagcgcgctaagccaaaatccacttatgcgagctaagcgatccagatctgcactaagcgcatga

SEQ ID NO: 79215 - DNA, 747 bp, Glycine max
  Peptide Sequence Number=SeqID_170900
atggaattcatgcaaatttcaatgttcatgaaaggaatcaccaacaattgtaggaggatggtcaatgcatcgactggaggaaactacctcaataaaaccaccactcaagtgaagaccataattaaagatttggtggctagtgagagaaccatagaaatgcggaggaggccatcaaacatcaaaatgtatcgaggtaccaaccgaggaggtttccaaaatatacatagaagctacaaccaagtgggagacaacaaaccacaacaaagaccaaatttgtgggaccgcatcttaaagttggaagaagacttgaccaaactcatcgaagtggtcatcaccaaccacaaaaacatccaagccgcaatcaaaagcatggaaactcaaatagggaaattggccaaacaattgcaaacctcttcaattggcttttccgcaacaattaaggataacccaaaggtccattgcaaggctattatctccatcatagagtgtgacgtgggaggtaaagaagaagaagagatagaagaaagcaccatgctagaggaagagatgaaagcacaagccaacccttcaacccaaggtatgcaatcctcacttaatcctccattgtttaattttagcaagctaagcatccataagcaagaaaacaatgagaggatcgccaaattcaagaaatacatagaaatgctacaaggaagaaggaggaaccacctattgaaaaaatcacatgggacatgttacatcaagtaa

SEQ ID NO: 79216 - DNA, 399 bp, Glycine max
  Peptide Sequence Number=SeqID_170901
atggctcttgggtcaaaaagggcactcaacccgctgatgaagaaggcaacctcccagatgaagataattccactcttcttcaaaggcttatggacaagtttggacttcagacttttgttggtgacaagtttgatgccatggaattgcaagtcgacatgcggttcgatgccatggaatcaaggatcaccaaagttgaagaagatgtctccttcatccgtacttgctttgatccaccaccaccgcctccatcatcatcttagcttaaggattgtcatcataaaagggggagattgtagacaaagaatcaagccgcgccgatgttttgatgatgccaaaagatcacatgcgtctcaaagatttattcaagacaaagcaatgaaagatatacaagataaatga

SEQ ID NO: 79217 - DNA, 927 bp, Glycine max
  Peptide Sequence Number=SeqID_170902
atggctgtggctgctgttgtgcacctttatgtcttcccagcagaaccttacaaaatgggagagagatgtattcgtaacgtagcagtgatggacgactatgcatcgctaggatcgcctctggaccctgaggaagttcaagacagtcagcgctcaacaagaacgtggctgggagcacataataatcagagagaaaaaaatcctatgaaatttacccagagtgttcgtgatgtggttgttggaagcggtgaaattattgttgatgacatgaagtttacagtttcacatgtggtggagcctgttgaaaggggcattgcaaagataaacaaaaccttccatcagatatcagaaaatgtgaaacgccacgagcagcggacgcgaaataccaaggatgattgttaccttgttcccttgcgaacgcaaatgtcagaattttctgacgttcacgatactatgggtgaaggaagtgtcagtgatagtggtatgtccagggtcccaaatatttcaaaaattttgtctgaggtccctgccgttagtccgaatccgttatctacttacgtggtcgttaattgggcacttagggcttcacacagtccagagaagagtacgacatccatgggagcttcttgttcatcatttgggtccgcttttgttcgttgttggtgcaacaaggcgacgattcaactaacatctcaaaccaagaagcatcctgacaagatattttggcgatgtgctaagtggaatgttctacaagttctttggaggttgtcaaaccctaatttcgtccgggaaccatccgttgttgggatgcgaccctcgtttgaccacttcgaggatgttcctccagaaggcggttgcttctggaggaagcaacctagctcgcctgggcgagctgggtggcaagcatctccttccttttcctataaatag

SEQ ID NO: 79218 - DNA, 129 bp, Glycine max
  Peptide Sequence Number=SeqID_170903
atgggaagagatactcacttgcaccttcgaggacttgagctctcaacaattgaggaagagaataagagaaaaacaatgggttcccctttctctctcttggctggcagaaatagaaagggggaattttag

SEQ ID NO: 79219 - DNA, 180 bp, Glycine max
  Peptide Sequence Number=SeqID_170904
atggggaggggggatgaccataggcttattgtcgcaacctacccttcggcgggagggcgacgcgagactcgcgggatgcgtgttccacgaaaggaatacgcgcggagtcgccaccaacgtttatttgaggaaaacgtcggaaaaaccggaaaagacgcgatctacgaacttttaagttga

SEQ ID NO: 79220 - DNA, 540 bp, Glycine max
  Peptide Sequence Number=SeqID_170905
atgagggcttctggtaatcgattaccaagggggtgtaatcgattaccaggcttagaaaggggactggaacattgtggaggcctctggaatgggtcactggtaatcgattaccagatcatgatggcggcgcagctaatccatgatcgagtggagatggagtgcctagagggagcttgggagaccctcgaaggcaacacgaggtgccgatttcggggcaccattcgattcacggctacttctttggtgcatccagatgaacctgcacggacgcttcagcgcatggtggagtggatactacccacgcctacaccatatcatctagtggagcccatccaagtgatcgaggtaacgtcatccgaggaagaccctgaggatgctcttgactttctagagggtgatgaggacccacttcctgaggtggattctcccgaggaagtcatgtcggcatctgaggcagactctacggaggatagtggcccgggggggggggatggcgatcagcggaggctcttcatcatagtgggcagttccatggactag

SEQ ID NO: 79221 - DNA, 360 bp, Glycine max
  Peptide Sequence Number=SeqID_170906
atgggaaatcaacagcgacaagggtatactcaaggaggattttcaggcttccagcagggtccctataatcaacaaggacagtggaggacacaccctggtaaccagttcaacaaagaccagagtgggccttcaaacaggccaatccaacaaggacctaacatattccagaggactactaagctggaggagaccttgactcagtttatgcaggtaacaatgtcaaaccataaaagcactgagtcagcactgaagaaccttgaggtccaggtgggacaactggccaagcagatagctgacaagtcatccaacagttttgtggcaaatacagaggtgaaaggtactgattgcaagaaaaaatga

SEQ ID NO: 79222 - DNA, 387 bp, Glycine max
  Peptide Sequence Number=SeqID_170907
atggagttatcttcaatgatcctgtatatgcatacagcatatgcaggatcagatacagcatgtgaagttgtaagttatgatttcaaggaaaaaagatttgcacatctacaccgatctgctatcggctttccagaatcaaggttcttctataccggcactcctgctacatcaaatgcaaaagcaactgctctaaaaggtgaggaattggtcagaactcaattccaaagagatccatttggatgtcgaggttcactttatcacaagaaactaaagcgtgacccttttcatcggtcaattccttatcccaatgggtgtcctgaaattgaaggattattcaaatattgtggaccaactccttatcctggtgcactcccgtgggcacagtaa

SEQ ID NO: 79223 - DNA, 201 bp, Glycine max
  Peptide Sequence Number=SeqID_170908
atgggaaaattccttttaatagggaaagaaaggaaagcacagacaggtaaggaagaaagtgtgaaatggagagcacttacagaggagcatgcacgagacagctttgaaaaccttctatttagtgtttgtcgattccgggagcttactggcacctatccccaaaatataactgtatgtaagccttacttatctgagttgtga

SEQ ID NO: 79224 - DNA, 417 bp, Glycine max
  Peptide Sequence Number=SeqID_170909
atggcggttcctgattctaagtcgaattcggtttttgggtatgcgggaaaggacttgggggcttgggatccaaaaggcactctgcgtggaaaggtcttgggagttacgagatggagagcgtttgatagcaaagggaacatgaggcccaaatggaagatccagccacccaagatacctggattcgttccgttcacacatccttccacattcgacacaatcactatggaactagattacacaagcaaaatcaaattcgatctcgaatcgttcctaagagtgaagcagtactaccactgcctcagttgcatcaggaaacgatgcctcctcctctacagtcccttcgacatcgaaaaatcgagcttcgccaccgccatgaccaatttcctctactacgacatctatgacattgacctctag

SEQ ID NO: 79225 - DNA, 519 bp, Glycine max
  Peptide Sequence Number=SeqID_170910
atgttacccaggtacagcctcacggtacaaggttttgttcttcgcgaccccacggtacagggttttcttcttcttgttgttcctgttgttatttgtttgtttgtttgtttgtttcttctccttttcttcttctttgtaactgcatgttacccatgtggtcactgcaaggaggttcgtgcttgcaagttgcaaggtgctcaaggtggtgactttcagtccgttggtgttcgcaaggtgcttcgtgctcccaaggctatttttttccctcttttggttgccactggtgatgttcctctcaatagggagttgtggactgatgggtacttctcaattattgttgagattgttggaggagtgtggttgaggtggtggcttcaagttgctgctgcaatgtcaaacatggaaatgtttgttgctgaaatgagcagtgactcattccagcttctagggatggcagagaggggcatgttacttgagttcttcggcaagaggtcatgttacgaaaccccatatacatga

SEQ ID NO: 79226 - DNA, 399 bp, Glycine max
  Peptide Sequence Number=SeqID_170911
atggaggccatgaaagagcaaatgaccacaatgatggaagccatgatgagtatgagaaaaatgatggaggtcaacatggctacagtcattgctgcaagtaccgccactgaggtggacccgactcacccatctggcctcaatcaagtaaattgtccagtctcgaatatggtaggtcagaaaggaggcagagcattgggaagtatgggcgatgagaatatggcttcccaccatatggcttgcctcccaactatacaccacccaatattacacatgctcccgacgagaatgtcgataactctgctcccatacccattgagagccaacaatcccaatctggtcatgcacaggtccctcaacccatggggaagacacatgaagtaccccgagaccacactctag

SEQ ID NO: 79227 - DNA, 252 bp, Glycine max
  Peptide Sequence Number=SeqID_170912
atgttaggattcacaagaagttctcctcaaatttcagccagcccgcatcaattagactttgcaccttacgcttcaaggtcatacattgctcaatggaatgccccggggctcctccatgataagcacacgttgcgttcgagttgtatcctcggagaaatggaggttgatgaactttggctggggttttggctaccattgaattatcaagtagatataggagcaagtcagcataggacaccagaattggggtga

SEQ ID NO: 79228 - DNA, 459 bp, Glycine max
  Peptide Sequence Number=SeqID_170913
cgggtgctatccgagaacaattggccgatctggatttgagaattcttatggattcttcgttgatagaatggaaagaattaggggaagagggatccccggacaatgaaaacgaatgggaagatcgaaaagttggaagaagaaagaattttttggttcgacgcatagaattagctaagcattttctccgaacaaatatagaaccagaatggatggttttatgtcttttaccagttcttcctcccgaattgagaccgattattcaaatcgatgggggagaattagtaatgtgtcaggagaaattggtacaagaagccgtggatacacttcttgataatggaatccgcggacaaccgatgagggacggtcataataaggtttacaaatcattttctgatataattgagggcaaagagggaagatttcgcgagactctacttgggaaacgggttgattattcgg

SEQ ID NO: 79229 - DNA, 798 bp, Glycine max
  Peptide Sequence Number=SeqID_170914
atgggaccgcacggcgcgttctacaaagatgaaccgattcgcgaactggacgcggcgctgaagctgcagggtttccagaccgtttatcccaacaatgccagtgacctgctgaaactgatcgaacacaacccgcgggtctgcggagtgatatttgactgggacgactacagcctggcgctatgcagcgacatcaatcagctcaacgaatcgctgccgctgtatgccttcatcaacacccattcgcagatggatgtcagcattaatgaaatgcgcatggcgctgcacttcttcgaatacgccctcaacgccgctgacgatatcgcactgcatatccggcagtacaccgatgagtacatcgacaaaattatgccgccgctgaccaaagcgctgttcacctacgtcaaagaggggaaatacaccttctgcacgccgggccacatgggcggcacggcgtttcagaaaagcccggtcggcagcctgttctatgatttcttcggcgccaacacgctgaaagcggatgtttcgatctcggtcaccgaactgggctcgctgctcgatcacaccggtccgcacctcgaagcagaagagtatgtggcgcgcacctttggcgctgaacagagctatatggtcaccaacggcacgtcgacctcgaataaaatcgtcggaatgtacgccgcaccggccggcagcacggtgctgattgaccgcaactgccacaaatcgctgacccatctgctgatgatgagcgacatcatccccatctggctcaaccaacgcgcaacgcgctgggcattttgg

SEQ ID NO: 79230 - DNA, 105 bp, Glycine max
  Peptide Sequence Number=SeqID_170915
atggttcagcctaaacaaaaatatatgaataagaaggttaagtggtggcaggacagaaatatagaaatggcaataactgaagctacagggctccaaatgaggtga

SEQ ID NO: 79231 - DNA, 535 bp, Glycine max
  Peptide Sequence Number=SeqID_170916
ggcgatcggtgcgggcctcttcgctattacgccagctggcgaaagggggatgtgctgcaaggcgattaaggcgaattggagctccaccgcggtggcggccgctctagaactagtggatcccccgggctgcaggaattcgatcgcgcgcgccgaccccgttgaccgggccatcgccgtacgtgcaaagcgttcgcgcagctgcggcacgcatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcagagaaaaaaggctgcaccggtgcgtcagcagaatatgtgatacaggatatattccgcttcctcgctcactga

SEQ ID NO: 79232 - DNA, 93 bp, Glycine max
  Peptide Sequence Number=SeqID_170917
atgccttgcaaatgtgagatagctccgagaaagctccctgccaagaggaccaggaaagacacagctggagagggttccagtgcggccccatag

SEQ ID NO: 79233 - DNA, 885 bp, Glycine max
  Peptide Sequence Number=SeqID_170918
atgttcacgtttggggactttacgttagtaccatacgtggaggagtttgaagagatcttgggatgcctgctaggaggaagaaagccatatcttttttctaggttctatccctccttggcaagaatagccaaggtagtcaaaatctcagcacaagaattggaccgagtaaagcaaaatagaaatggggtggtcagaataccgaggaagcacttggaggagaaggcgaaggctttggcggatcaaggtgaatgggcttcattcattgatgtcttggccctattgcaaagaaagcctggtcgttgcacacctgctctttatgtatggttggtcttgcacttctttggtcatgaaagtagacccgtctgtcccctgcaaggtcaccgcacatgcactaagaaagtgaaggccaattgggagcaactcttggctagtatggtgaggacatctgttaattggttcccccgatggaagaaaggaagagccggagttttgtcctcatgcgaggggttctcaaacatccccttgatgggaacgaggggttctatcaattataatgttgtccttgccataagacaacttggctaccccatgagaggggcgccgtcagaagaaagtaccacgcctttcatcgcacggggtttcagtgaccccaatgcaatgatattccaaagcgttcaaaaggcatggagcgttgtgcaaagaaaggataacgaacttaggggaagcagcaatgggatcatcagcggatatcacaagtggttgaaggctcggacgcaagagctagattggctctcgaagctaaaggcctcaagtgaggaagaggctgaaaccctggagaagagtgatgaggtgcaagccttaaagacgaaacttgaaaaggcttaa

SEQ ID NO: 79234 - DNA, 618 bp, Glycine max
  Peptide Sequence Number=SeqID_170919
atggttttgaaagaggagttagttgcctgctcaaggtccaaaagaagcttgtctcagcgtttatgcgagacggagaccaacatgctagctatcatcgccaagtaccgagaagagttaggtctagccacggcccacgagcataggattgcggacgaatatgcccaagtatacgcggaaaaagaggctagaggaagggtgatcgactctttacaccaagaggcaaccatgtggatggatcggtttgctcttaccttgaacgggagtcaagaacttccccgattgttagccaaggccaaggcgatgacagacacctactccgcccccgaagagattcatgggtttctcggctattggaaaaacaccataactaaacgcgccgcaaggtatccctatcgcaccagatccaaatctagaacgatgggtgatcaagaggagacacaggaacagatgaaagccgacatgtcggctatgaaagaacaaatggcctccatgatggaggccatgttaagtatgaagcagctcatagagaattacgcggccagcgccgccgctgtcagttcggctgccgaagcagacccgactctcttggcaactgttaaacctcctccgtcaaacata

SEQ ID NO: 79235 - DNA, 465 bp, Glycine max
  Peptide Sequence Number=SeqID_170920
atgtccaccaaactactcctaaccctaatcctcatctcttacaccctctccaatgtcataggagaagaaacgggctttgtaggcacactacaccccaaatccttaggtcttcacaagaaacaaaccctaagccacttcaaattctactggcatgacatagtgagcagtggagccaactccacctcagccacaatcatcccaccactccccaaatacaacacaaccacttccttcggcatggtcaacgtcatggacaaccccttgactctgggccccgagctgggctccaagctcgtgggccgggccgaggggttctatgccctaacctcacagtcccagatcaacttgcttatggtcatgaactttgggtaccgagctcgaattcgtaatcatggtcatagctgtttcctgtgtgaaattgttatccgctcacaattccacacaacatacgagccggaagcataa

SEQ ID NO: 79236 - DNA, 534 bp, Glycine max
  Peptide Sequence Number=SeqID_170921
atggcttctaggaaacgcaagagtatcggttcaagacccacaacacaatatgatacaagaagatttcactccttagatgcttggaactgggttagaggccacctagtgaagatcgacgctaacagcctcaacacattcttagagacacctgtggtgttggcagagggtgacactttacccagatactccagatactgcaggttgcccacagattacagagagattgaggctgccttatgcataccaggccgagggttcatcttgaacgctgagggccatccatggaggattctcaggaaagatttgactactttagcccaagtgtggagttttgtctcatactccaacctggcccccacatcacatacctctgatctgatagtggacagagctaggctgatctttggcctagtctctcgcatggacatgaacataggagctcttatttctggccagatgacttctatagcccagtctaacatttctagattgggctatagaaggttgattgacaaagaaaagtttgaaccataa

SEQ ID NO: 79237 - DNA, 933 bp, Glycine max
  Peptide Sequence Number=SeqID_170922
atggccaagtttgatctggatatagttctcgagttttatgccaatgcttggcctacagaggagggagtacgggacctccggtcatgggagtgcgaatacggtcagaggaggaaccgggccgatggatttgatgaggaggtcatcgctcagctgctatgcataccaggtcaggattttgcccggaccgctgccgggagaagggtgcaaatcatgcgcaccaacatgactaccttgacccagacatggatgacgttgctgctcagcaacatcctgcccagcgatcataattccgacctccctctgccgaagtgtcagctggtgtatgccatcctgacacggatgagcattcatgtggctcagatgatcactgatgccatttatttatttgcaagtataccacctaccaggcaccctctagacctagataagtctaacagggtcctgggttttctagcattgatgacgggtctctgccagtcgtttggggttcctatcacacctagtaaggtgattcgactgtcgatcacctgggctttcatagagaagtattgcacgcctaggcaggcgcagtgtggcgacctgcaggcccctgacgcaccgccgccacctcatcaggcagatccagctgggtcatttgacacagagcggtatttacggcatttggttcgccagcaggcggccaaccatagggcgcacgtgcagacccatgactgtctctaccagctcagcctcagcctgcagagccagggttttgctttttttccatgccctactccggatcagttcagggcagaggtcgcatggcccggagattggcctgaggcccaggcaggggaggcacccgcagaggctctcggcgatgcagataaggcccgcatggacgaggagatgatagatttacttgatttcttgggagggagcggagccacatga

SEQ ID NO: 79238 - DNA, 171 bp, Glycine max
  Peptide Sequence Number=SeqID_170923
atgagtccgcttagcacatgtgaagacggtgcgcttagagggttggccttcgctcagcgcctctatgcagctcatccttattctggaatggtccatgcgcttagccttcaggtggggcgcttagcagatgatgcgcttagccagaagataagtggcttagcgagttcatga

SEQ ID NO: 79239 - DNA, 48 bp, Glycine max
  Peptide Sequence Number=SeqID_170924
atggagaattgcactaagcaatcactacacatggctccaaactcaaag

SEQ ID NO: 79240 - DNA, 177 bp, Glycine max
  Peptide Sequence Number=SeqID_170925
atgtggtaccatggagaccagttagggtcacagtgttttgcgagaatgctccaaccatatgggatcaacataggcttaaaggagcactcaaaccgtgtgacccccaaggcctacactccgaagagtccgtcagggcctctccctcctgattcaggtccaacccagaaaatattttag

SEQ ID NO: 79241 - DNA, 126 bp, Glycine max
  Peptide Sequence Number=SeqID_170926
atggaggttgaggaaccttggttggggttatggctaccattgaattatggagtggatatgggagcaagtcatcataggagaccggaattagggtggtgggtagtgagaagggctgataatggctga

SEQ ID NO: 79242 - DNA, 189 bp, Glycine max
  Peptide Sequence Number=SeqID_170927
atggggggggttgctcgcgggcgagctcagctcgcccaggggaaacataaccatggccccctctctttacaggatactgggttgccttgcagtgacgttctctgcttgttcagcacagggaagggacgacgatcggtcagtcatgaccctatcctccatttgcgtccgttcctaagtacctataagtag

SEQ ID NO: 79243 - DNA, 768 bp, Glycine max
  Peptide Sequence Number=SeqID_170928
atgtacgaccagctgaacgatgcatctatgagccacagtcgacagcttggcagttacatcacactgctgcagatttacgagcactttccctcggtcgcggagtccaccgctgatcaggactacgacgaggcttcctcgcgtgcgtgcaggtggattgcgacgaagaagaccgtgaagagcattcgcacgccggcgtacaaggagcacctagaccgactctggattccggatgtctgttggatcccttatggggagcatcgggagtttggctacacacagaccattcctgctcctcctgtcgattcatgggtctcgtatgatgatatacacgacaggtggatgcactacgaggatcatatcgttccagcaggtgaggtgtgcgttgtgctaggggtgtgttccagtgactacatggactggttcttctgcatctcccatcctcttatgacaccaggccacgcatcagatcctctgcctcatggtcacgccccgcagccccgagtcgtccatcaggccccacagacggatatccctcacgtgccggagccaggagcatcgtcgacatctgtggaggagcctagacatgcagtggaaatttgtgatgacattgctaagaggttggagcgccatctgagtctaggggtggtcacgcctggctcatcgacacatgaggtgatcgaagaatgcctcaggttggccaggagtgtgacacaggaccatctagtatatgttaggtctagacgcaggcggcgcacaaatcaggcgtag

SEQ ID NO: 79244 - DNA, 231 bp, Glycine max
  Peptide Sequence Number=SeqID_170929
gattgtcatcatcaaaaagggggagattgtggaagcaatgccttccaagattattttgatgatgctaaagaatcaagagtaaagcaaattccaaagtttcaagatacaagattcaagaatcaagtttcaagaatcaagattgaagatcaagattcaagactcaagattcaagaatcaagagaagactcaatcaagataagtactaaaaaagtttttcaaaacattgagtag

SEQ ID NO: 79245 - DNA, 861 bp, Glycine max
  Peptide Sequence Number=SeqID_170930
gttgtcagaacatacatgcctcacgctgaggtccctattcctacatcagaggttcattatcttgagcaggccgttggcacattcgtcgcatggccgacccatcttgttagggaagtaactaatgaggtggtcgtaggacccgataagcctccatcaaggtctgttggagagccgaacaggttaacatctgtggccacagatgacccactgggagaattggttaagaagtcatatgtggtttacacaaagccaatggagttggcatgggacggggcgaaatttgggttacctaatgcctcaaatgtgtacggtttccttgagccccagtctatacgctgcataaaggacacgcgtgaagaatgtcaaaagtacatagaaacgtgggtcaaggagtcacatcgagaaatctacttaggaccttacttcaatcaggcacattggcaacttcttgtgttgtgtccacgagagaacattatagtatggttctgttctgtacgaagaaagcctgatgttcacattaagtttgcagtgaacaatgcaatgaagaaaatatgcagtaatctccaaggcaaggacaatgcacctccacctccacctcaatggattgaggctaagagccatgtacaacaaggagcatatgagtgtggatattatgtgatgcattggatgtggtgcatcgttagtgccgatggaacaacattagacactgacaccatgacgacaatacgcaagaaatgggcagcctattttctagaagttggaaaatggatgtcagcgtttgacatgttcctgcttgggtcgttcagtccgccgcaaccttctcatacattggtccaagaaatcatcggaaaagctcctcag

SEQ ID NO: 79246 - DNA, 213 bp, Glycine max
  Peptide Sequence Number=SeqID_170931
atgaagcagctcagaagaaatggtggcgacaacccaatgatacgattcgtgagatcttcaaactccgaaagcctatcagagttgattttggatcttgaggattctgccatgaaacaagacaatgagagcaccaatttgttaaggccaagggatgaaaaattggctttgagggctagagacctcctcagaaaaagaaaagaaacttgtagataa

SEQ ID NO: 79247 - DNA, 225 bp, Glycine max
  Peptide Sequence Number=SeqID_170932
atggaggaggagggtccaagtggtctcaatgagatgcctgatcttgcactcagccaccccattttgttgaggacttcaaaatctagcaaaggaaatataattaatccttgcattcctagagggtatgagtatcctcagatctccaatgcaagtgatgtaaaacacccactcttccaaccagatgggaatttctcagcatgcaggaaaaagaaagatcttgggtag

SEQ ID NO: 79248 - DNA, 540 bp, Glycine max
  Peptide Sequence Number=SeqID_170933
atgtcaccttacgaaattacttttggcaagaaacccttcaatattctgcaatatcttgcgaaaacatcggccgtagctgccgttgatgacatgttgacgaacagggaagttgtgcttgcagaagttcgaaggaagctcatgaaggctcaagctatcatgaaacaacatgctgacaagaaaagaagggatgtccattttaaggaagggtacatctacttgggtttgactgagaacaagagagggtacatctcttgtggatcagttctagtggagggtacatccactaggttcaaagagaacaagggagggtacatcccttgtggatctttgcttgccactcgatccaacaagtggaagggcttatctcctgatgacaccacttgggaagactgggaccaattgaagtcagcatacaaccttgaggacaaggtacttttcgatgctggcgggaatgataggaaaattgcagaacaaccagcgttaagggagaaatccacaaggaagatgaccacacctagatatttgatggactacatctaa

SEQ ID NO: 79249 - DNA, 345 bp, Glycine max
  Peptide Sequence Number=SeqID_170934
atgtgtacggataacccttgggtgtctccgcatgtcattgaacttgatcatctctggttagcagagacgagtcttgcgcgcatcgaacttgaatgtctctggatgacaaaggaagggtgcgagcgaccatatgttgtcttcgtgcgtcatcggacttgtcgtctctggatgatgaaaggtgcggataaccataaggtgtgtccgcgtgctactagacccttaggtcacgatagcaaaattgagacttttttgcggtctcagccggaagacgctggcatcttcgggaagggtgcagatgaccacattggtctctgcgtgccaacagactcgcttgcctctagctga

SEQ ID NO: 79250 - DNA, 147 bp, Glycine max
  Peptide Sequence Number=SeqID_170935
atgagcaggttgaagagagctctaacaggccttggaggaccgaacccacagcgtatgatgtcgatggcccgaggtagagcactcaatgggctagggtggccccatttcgccttaccaaccccagggaaactccgaatacaggcctag

SEQ ID NO: 79251 - DNA, 147 bp, Glycine max
  Peptide Sequence Number=SeqID_170936
atgacgcatagtcagattagagttatgatcactcggaagaacattactcaggaggaaggtcatccagatttgagtaagagctgtcatacttgtgcgcattattcacaactgcttccttgccatgctatatacaaaatcacgccttag

SEQ ID NO: 79252 - DNA, 672 bp, Glycine max
  Peptide Sequence Number=SeqID_170937
atggctccgagaaagctccccaccaagaggtttaggaaagacacaactagagagggttccagtgcggccccacaggccgatgtggacttcaatagacacagggacgaagagtttgctaagttccaagaggagatagcccggaggcattgggctccgctcgtatcacccatggctaagttcgatcctgaaatagtcatgttgttttatgctaatgcctggcctacggaagaaggggtccgggacatgcgctcttgggcctcaggctttgatgaggaggttattggccaattgctatgcgtgccgaggcaggactttgcccggaccgcagcaaggagacgggtgagtgtacatgtggctcagctgatctctgatgctatttacccagagaagtccaacagggccttgggatttcctgctctgattacaggcctttgtcagttctatggagtgccaatcacccccagaccaggcaccacagcagccagaggagggccaatagcaggcagctatagacgcaccaccgccacctccagagtccacctctactcacctgcagaggttgaaactctatatacgacatggctcgcagggacctctggagatggagacagagctcaggaagacgatgacatggtcgatgtgatggactttttccttggaagaggcgaagtc

SEQ ID NO: 79253 - DNA, 303 bp, Glycine max
  Peptide Sequence Number=SeqID_170938
atgtctcctccacctctaagaatctcacaatcactcaaaaactcacaaatcttcctaaaagatcaaaacttggctccttttgctttattctttgcctatgtggatttcactcttcaagctctgacagctattcagcgctctcttccagacctctcttcattcttcgcaaaagagacaaccatctcgcttagcgagctgcatacgcgttgggcgcgaattgaggataagcctgaagagagttcttcagccttatcctcagttgctaagccactgccgtctcgcttagcggtttggtctcgctaa

SEQ ID NO: 79254 - DNA, 135 bp, Glycine max
  Peptide Sequence Number=SeqID_170939
atgacaacggaatggagaaggaggaaaggtgattggagatgccacttcaatgagaagatgagtcaagaacaagctcaccaccataggaagccatgggtaagagcttggagacttaatatgcagaaaaagaagtaa

SEQ ID NO: 79255 - DNA, 330 bp, Glycine max
  Peptide Sequence Number=SeqID_170940
atggtagcctggcctgggacccaaccttttctctacggggaagatgaaggtcccacatcccaagtaccacagcatgtggaggatgagtcatctgaggccaccattccaaagccattcgttgtaggggaggaggtaggcgagacacaggtgagacaagtagttgctgctactcctgagagatctcttgaggccacttcagagtctcctgcaccagtagtggacctaccctcatctcagcataaagcagacccctccactcctatcctagagatacctgaggacccgaccacaccagtcctgactctagacacttctcctccaactactcca

SEQ ID NO: 79256 - DNA, 192 bp, Glycine max
  Peptide Sequence Number=SeqID_170941
atggttggagcaggtcgtggtggtgacgattatcatcagttggacggagctcagcgtctgttactggacgcgatgaatgcacagatgcaacatttgctggaccgtaacaatgaggaggtctttggacgactagaatttttggagaaccaagccaatcagaatgctagacgaaatataggtggggaacagaag

SEQ ID NO: 79257 - DNA, 231 bp, Glycine max
  Peptide Sequence Number=SeqID_170942
atgtctgaagaagttgatatgaatgttgaaaatgaggaagatgttggtgtgaaagtagaacacgtcgattgctctcataccttatacttctcagttttacattgggctcgatcagtggctcatgacattggatttgttgtcgtgataatgaggtcatacaccaatactggtgtcgcaacctacccttcggcgggaaggcaaggcgaaataaaaaagtgcatcttctcatga

SEQ ID NO: 79258 - DNA, 477 bp, Glycine max
  Peptide Sequence Number=SeqID_170943
atgaccatgaaagctgctgtgcttactgcctttggccgtccgctggacgttaagaatgtgcctgcaccggtgatgggaaccggggaagtcattgtcgatgtggttgcggcgcccgttctctcctacacgaatgaagtactgagtggggaaagaaaatatcttttacctgtgccggtcatcccgggctgtggtgccatcggaaaggttcgccagaccggccctgactcagcctggctgaaaccaggagactgggtattttgcgatcccacggtgcgttcccgtgacaacgcgctgtcgccagaaattgtccttcagggatggagtgcccgtggtgaaggaggacaaaaaatccagcaatatcacctgaatggcagtcttgctgaacaaatacgcattccgactgaaaacgcagtgcccattggcgacatatcgctgcagatgcggggcgatggtgtgccatcaatacgctgcttatag

SEQ ID NO: 79259 - DNA, 681 bp, Glycine max
  Peptide Sequence Number=SeqID_170944
atgggtaagactacccaagccatacctctttccagatttaacggcgaattgccagcaacattggcaggggttactataccccatacacgcttcactgatggggctactgagcttgttgcttcatgctcatcagctccccttttcaatcatgttgtaagaacatatttattcgcagcttctattggaaaaaaacttggtaaagcttttgatgaagaaatgctttatttaggttgtataatgcacgacctggggcttaccgaaaagttcatcaaagatgccagattcgaactggatggagctgatgcggcacggcagtacttagtcgataacaaattccctgaggaaaaagcagaagttatctgggatgcaatcgctttacatgcaacaatggaattgccggaacgaaaaaggccagagattgcgcttgtccatttaggtgcttttatggatggggggatgaatgcaaatattttccccttgtcattctttgaagaagtatttgaggaatttccgcaaaatggaaacaaaacgcactttatcgaactcgttgctaatgttttgagaaaaaaacctcatactgcctatctttcctttgaaaaagatattggagtaaaaatggtagaaggcttcccaacagttaactattgcgatattaaaccaaactatccttttaatagataa

SEQ ID NO: 79260 - DNA, 192 bp, Glycine max
  Peptide Sequence Number=SeqID_170945
agccagggtttcactccttttgcgtgccctactccagatcagttcagggcagaggtcgcatggcccggagattggcctaaggcccaggcaagggaggcgcccgcagaggctcctggcgatggagaggaggcccgcatggatgaggagatgacggatttgcttgatttcttgagaggaagcggagccacgtga

SEQ ID NO: 79261 - DNA, 546 bp, Glycine max
  Peptide Sequence Number=SeqID_170946
atgatttcctacatctcgtgtccaatcttgttggatgaccggccctctcgatgggccgacctcttgttttctcataaaggtggacccttgggtactagtacctatcttcttcagagggctacatgtcctcgccatcagaggactacacgtcctcgccttcagagggtcgcacgccctcgccttcagaggactacacgtcttcaacttcagagactacaagtcctcgtcgtcaaagggtcatgtaccttcacctttgtagggctacacgccctcaccttcagaggactacacatcctcgcctttagaggactacacgtcctcgccatcagggactacatgtcccccattttcaaagggcgacacgccctcacctttagaggactgcacatcctcgccatcataggactacactccctcgccttcaaaaggcggcatgtcctgaacttcagagggctgcacgccctcgcctttagagggtcacgcgtcctcattttcagtgtgctccatacccacaccttagaagaatataaggtcctttgcccttag

SEQ ID NO: 79262 - DNA, 111 bp, Glycine max
  Peptide Sequence Number=SeqID_170947
cacttatactctaaaccctgggactggtacttcaattggatgggctggaccaagagaagagggaagcaacttccatcgatcgagtttcagttgctttttctgttgatccag

SEQ ID NO: 79263 - DNA, 639 bp, Glycine max
  Peptide Sequence Number=SeqID_170948
atggggatgaggggttgcattaattataaccctgtgttggccataagacatttaggatatcctatgagaggtgcgccatcggaggaaatcatcatgcctttcatcacacgagggttcaacaaagctaatacgaagatacttcagaagatacataaggcatggaataaagtgggaagaaaagataaagagcttagaggaagaagcaatggtgtcataggcggctatcacaaatggctgaaacctagaagacaagggatagcttggctcaaaaagctaaagggtctgaatggggaagaggcagaagtgctcgaggagagtgaagaggtgcaagccttgaaaattgagctcgaaaagacaaaagtagcgaaggagaagctaaaggtggtagtcactagagttaggaaaaaatgtgattggctgaaggatatcaacatgtccctggttgaagggctagagcaggaaacgaagaaagccagaaaggaagagtggagtagaaataagtttcaaggggctttgttaggtagcagtaatgagctcaaacttagaaaggttgagagagacaaatcaaggatggagaacgtgatgttaaaggataagttaaggaattgtcaatggtcaaagggaagtttgaaagagtag

SEQ ID NO: 79264 - DNA, 471 bp, Glycine max
  Peptide Sequence Number=SeqID_170949
atggccttgagaaagcttcccacaaagaggtccagaaggacaccaccggagagggctccaacgctaccctgcaagctaacatggacttcgaccagcaccggttccggagcgcagaacatcagtagcattttaagaccatcaagggatgatgccctcagtcagttcctagggcacccactgatcttggcagaggaccagcagtgcgagtacagccagaggagaagacaagtctctggctttgatgaagaggctattgcccaactgctatgcataccggggcaagactttgcccggaccgccacagggagacgggtgcggatcatgcacaccagcatgaccacccttacacaaatatggatgacgttgcaacttagcaacattctgcccagcaaccacaactctgacctccccctgccgacgtgtcagttggtttatgccattctgacgcgagtgtgcatgtggcttagctga

SEQ ID NO: 79265 - DNA, 297 bp, Glycine max
  Peptide Sequence Number=SeqID_170950
gcatcaaatgcggtggatgcgccaaaaggctatcttgcagtctatgtcggggagaaaatgaagcggtttgtgattcccgtatcatacatgaaccaaccttcattccaggacttgttgactcaagctgaggaagagtttggatatgatcatcccatgggtggcctcacaattccttgcagtgaagaggaagggggaaggaccattagaatgacagattcatatttcatggagcatgtctctgtgtgtttaagcaacacgctgtatcattgtagtgactaccaatacatatttttatag

SEQ ID NO: 79266 - DNA, 342 bp, Glycine max
  Peptide Sequence Number=SeqID_170951
atgtatcgagttacatcgctgcttcgtctacttccaaacacatttaggattgttgatgtccttgttacttccagtttcaccttgacaaagatgtcattgaccagaaaagaacacgctttacggcacccttaccgaactcgtgctagagctagagtaatgggtgaagcagaggaggtgcaagagcagatgaaggccgacatggaggccatgaaagagcaaatggccacaatgagggaagccatgaaagagcaaatggtcacaatgagggaagccatgatgagcatgaagaagataatggaagccaatgcggttgcagttgccgctaccagcgttgttgctaag

SEQ ID NO: 79267 - DNA, 189 bp, Glycine max
  Peptide Sequence Number=SeqID_170952
atgtcatttaggacttgtgggaaggcttgggctgagcaaatgagaaaaatgagtgacaaagaaaatgcttgtgcattgctggttatgggaaaggtagtacatattggggtctggagtttggcctctggaaatcgattaccaagggtgtgtaatcgattacaaggcttaaaaatgaagacagaaagttaa

SEQ ID NO: 79268 - DNA, 944 bp, Glycine max
  Peptide Sequence Number=SeqID_170953
atgtctgaaacaagttccgttcattctcttcccatgcgctatgcggacttccccactttagtggacgcgttggattacgcggcactgggcaatacgggaatgaatttttacgaccgtcgcaatcaactcgtgaccgttctcgaatatcgcacgctgcagcaaaaagcgatctcgggcgcgcggcgtttattgtccctgaaactcaagaaaggcgatcgcgtggcgcttatcgccgaaaccagcgcgggattcggcgaagcctttttcgcttgccaggacgccggcctggtggcggtgccgctggcgatcccgatgggcgtgggccagcgcgactcctacaccgccaagctgaaggggctgatcgccagctgcaaccccgcggcgatcgtcagcagcgaagagtggacgccgctgatcgcctcagccacggaaaacacctcggcgctgcacatcctcagcgatgcggattttaacgccttgccggagccggagatcgccttgccggcgccttcgcccgacgatatcgcctatctccaatacacctcgggcagcacccgctttccgcgcggcgtgatcattacccagcgggcggcgatggcgaacctgaacgcgatcagtcgcgacgggatcaagctgcgcgcgggcgaccgctgcgtttcgtggctgcccttctatcacgatatgggcctggtcggtttcctgctgacgccggtggcgacccagctgtccgtcgattacctgcgcacgcaagatttcgccatgcgcccgatgcagtggctgaaactgatcgccaaaaatcgcggcacggtgtccgtcgccccgccgttcggctacgatctgtacctgcgccgcagcaacgccaaagagctggccgatctggatctttccagctggcgggtcgcgggcgtgggcgccgagccgatcccggccgagctgctcggcca

SEQ ID NO: 79269 - DNA, 642 bp, Glycine max
  Peptide Sequence Number=SeqID_170954
atggcgccaatggggcgcatcagaaaaccggcgccggatcccgcgaaggtcatcatcagcgaggcgaactcgctgctggccggggaaaaaggtgtgtgcgatgtaggtggcgtaaaagccgaacagaaagaagtcgaactgttccagaaagttgccggaggtgacgcgcagaatcgcgccggctttggcccgggtggtcatgggggcggcggggaaacgccccgtgcctctgaccgattgtccgttaccgctcgtaaaaaggtgaatgtctcgcactgcgtttgcaaaatgtccggatgtacgttcagccttgcaggaggtcccgtgtgggaaattaaaacaacggatgcgtttgataactggtttagctcactccacgatgccgatcgggctggcgtgcttgccgcattgatggtcctgcgggaaaaggggccggggctgcccagaccctatgccgatacggttaaaggttcgcgttacagcaatatgaaagagctgcgcattcagagccgtggcgaaccgttgcgggcattcttcgccttcgatccgtaccgtatcgcattgtgctttgcgcgggcaataaagccggctgccgatcgggaattcacgaactggctgaacacattaaacgagaaggagtga

SEQ ID NO: 79270 - DNA, 612 bp, Glycine max
  Peptide Sequence Number=SeqID_170955
atggcgacttccaaacccacaaccatgccgccgcgcggcccgcttccgacacgctccggcggcataggccgcattcttcgtccgctgctcatgatcctggtgctgctgctggtggccgccgccagcgccggcgcgacctggttcatcgcgcagcgcatgcagccgcaaggcggtggcgcgccggtgcaactgggcgtgggccagaccggcaaccagccgggccagcccggcgccgccggcccgcaggccacgccgaccacgttcgtcgccccgcccacgacgccggccgccgtgccggcgccgatcttcgtgccgatcgaggccttcacggtcacgttgcagaacgccgacaccgaacgcatcatgcacgtcggcctgaccctgcgcgtgagcgacgaacagactcgcatccgcctggaaaagtacatgcctgaagtgcgcagccgcatcctgatggtgctgtcttcgcaatcgcccatcgcggtgcagacgcaacagggcaagaccgacatggccaacgccatcaagcaagccgtcaaccgcccgttcgcgcccctgccggacggccagtatgtcaccgacgtactgtatacggcgttcgtggtgcaataa

SEQ ID NO: 79271 - DNA, 282 bp, Glycine max
  Peptide Sequence Number=SeqID_170956
atgggtaagcttaactcatccaaacacggcaaaaacctagcaaaactacccatcatatctcccaaaacccaatacccacgaaaatcaagtgagaaagaagtctacccaaacctgaaatttcgaggtcccacacgtagagatgcgcttcacgacttcgaaaatgccttcctttcacgatttggagcagaaatgggcacaaaaggttggagctttaatggagtttcaatggaggatgaagaagaagagaatggcaacgtgagagagagaaaagagcttttctga

SEQ ID NO: 79272 - DNA, 867 bp, Glycine max
  Peptide Sequence Number=SeqID_170957
atgattcctggttcagcccctgttcctgagaaactggtccctaaaagacaacagggaatgaagatttctgaaaaccctagccttgcaacaagtcctagggaagtagacacggacatggacaagaagattcgcagtattgtgagtagcattctgaaaaatgcttctgtccctgatgctgatacagatgttccaacatcttccaccccaaatgtttctgtccctgatgctgataaagatgttccaacatcttccaccccaaatgtttctgtccctgatgctgacaaagatgaatcaacagaggaagaggatcaagtcacagaggagacccctgcaccaagggcaccagaacctgctccaggtgacctcattgatctagaagaggtagaatctgatgaggaacccattgccaacaagttggcacctggcattgcagaaaggctacaaagcagaaaagggaaaacccccattactaggtctggacgaatcaaaactatggcacagaagaagagcacaccaatcactcccaccacatccagatggagcaaagttgcaatcccgtccaagaagaggaaagaaatctcctcatctgattctgatgatgatgtcgaactagatgttctcgacatcaagcgggccaagaaatcagggaaaaaggtgcctggaaatgtccctgatgctccattggacaacatttcattccactccattggcaatgttgaaaggtggaaatttgtatatcaacgcagacttgctgttgaaagagaactgggaagagatgccttggattgcaaggagatcatggacctcatcaaggctgctggactgctgaaaactgtcaccaagttgggagattgctatgaaagtcta

SEQ ID NO: 79273 - DNA, 354 bp, Glycine max
  Peptide Sequence Number=SeqID_170958
cgattctcctcaaatttcagccagcccgcatcaattagactttgcaccttacgcttcagggccctacaatgctcaatggaatgccccggggcttctccatgacaagcacacgttgcattcgagtcgtatcctcggagaaatggaggttgaggaaccttggttggagttatggctaccattgaattatcgagtagatataggagcaagtcagcataggacaccagaatgggggtggtgtttagcattggttgtgtggaaggtgggttttgtggttgatttagggatggcctttgtggataactgggtggtgggtaaggagaagggttgttattggttgagtaatgacattgttgg

SEQ ID NO: 79274 - DNA, 168 bp, Glycine max
  Peptide Sequence Number=SeqID_170959
atggagaaatggcgaacagcgcgaggcaatctaattctccgggctcctgactcgaagggactccagtctcgaaggtggaggacacatgaaccagcgctaggcaatgaattcatggggctccgaataaaagtggagaatgtagaactggcgaacttcgctaggcaatga

SEQ ID NO: 79275 - DNA, 309 bp, Glycine max
  Peptide Sequence Number=SeqID_170960
atggaaaaatccgacaagatgaatttcaaagagaagaaagaaaagaaaggatacatcacttgggaagataatgtcataaattattcaagtgattcagagaagaaaatcataagtctgggtatcttgatgaaagactatgaaaatggagaagagcaaaacaacaaacaaagctcacatttctccccaagaaaagtgaatctcaagaaaagtaaatatgtgatctatggagacaaagaacaaaggccacttgatcaacaagcccaacaagtgatattgaatgataccaacaggtcacttgtctttgattga

SEQ ID NO: 79276 - DNA, 423 bp, Glycine max
  Peptide Sequence Number=SeqID_170961
atgtcaacatcttctagccaagaatcttttggtctcacaacatctgctgatcctgacacatgcatcaggtggcacgcggatatacccaagtggcaggcggaaatacccaaagtggttatccgtacaaacacaattatgttaccccgacctgtgagaggtccggtagcatgtggagacaccttatggctcaatgtttatcgaccgagaccgccaaaaggtctcgccttagttatccgagggcattcaaagtccgatagcgcgcggaggcaacatacggttgtccgtatccctcaactagagacaagcgagcccgttgacaagcagagaccaatgtggtcatctgcacccttcccagagatgtcagtgtcttccagccgagaccgtgaaaaagtctcacttctactatcgcgactcgagggtctg

SEQ ID NO: 79277 - DNA, 366 bp, Glycine max
  Peptide Sequence Number=SeqID_170962
atgaggcaccaaatccctatgataggtggtatgatgaatgtgttgagtggtgcagccctcttttgtaaaatcagtcatgcacccaacatcttcatgatttgtgtacatagggactcattaggtaggaataatcaacatgaaaataaagaaaaaggtatgttttattccattactttccttgactttttaaatagtgatcaagggcttcccatggaccctaagagaataaaggtcattcctgagtggcctactccaccatttgttgaggaaagaatccctgagtttcaagaaacaatggatttgaggttaaatccttttcaagggggagggaatgatgcaatcccaccccccaagggcattggatag

SEQ ID NO: 79278 - DNA, 929 bp, Glycine max
  Peptide Sequence Number=SeqID_170963
atgaaaaatctcaggagggctgtagctgctattggggatgtcatcgagtcagacgatgacacagaggatcgccgacgattggaccgggctcgagtattggtgcggacaccgcttccgccgttgataaggtcagaggtcatcgtccgtgtgggggagcttgagtatcgggtatggattgtggaagagacagggttcgaaggtgggtcgaaccggaaaggaagctcgtcgtccgatgggtggtcggagatgataacatcggacgacggtggggaggttggcgatgttcttgacgacactaataccaatttctccttctcgtcggagctgcccaaccagaaattgtctccgtctcgtacccaacgggcagaaggagggaccgatgtgcgttgctgtgatcttagacccctaggtaatatccaggcagacgttacacccaaagaaaagtcaaaaggcactgtagaaggtatgctaggctctagctttggtaagctcaacctagggtacagcttcgcaggaacagaagaggaagctgctaacaccaaagaggtaacctgctataataccctacaggatgatcaaaggcacaggaatcacatagagggaaagtatttgaatggtggagcgaaagtagctgctgaccagacctttattggggaagaagagggacatgtcacgcagtctctctctccttctttatcggggcagattcaacaaggaatttggccaggttgcattaagggcccaatttcgactccaggagggtgtaataaagaagacatccacccagttgagcttttgggggtgcaagctgtgcagaatcaaaaagagggtgggctaagtaatgatttaggcccaattttaaaaacggacgggtgccataaggaggaatccctacctttaatccaatccataaaagagaatccagacaa

SEQ ID NO: 79279 - DNA, 401 bp, Glycine max
  Peptide Sequence Number=SeqID_170964
aattcgctaagcgcgacactcagtggctaagcgcaaggaagaaaccagaagatgatgagttgtcaggttcgctgagcgcaccgctccaggtcatcaagcacaccgcttcagctcattcgctaagcgaaagaaaagcaaagcttcatgatgaatcaagattgattcaaagatgttttgatgataacaaagatgatgacaaaggtgatgacaaaaagggcaaaggtcaatcaaagaatgagttcaagatgttcaagatagaatcaagaacacttcaagattcaagaggaaagttgaagaacacttcaagattcaagaggaaagttgatttcaagaatcaagattcaaggatcaagctttcaagaatcaagatcaagattcaagactcaagattcaagaattaa

SEQ ID NO: 79280 - DNA, 207 bp, Glycine max
  Peptide Sequence Number=SeqID_170965
atgtcacgaaactttacggattacgcaaccatcccctcttcggcttctggaatgttacgaaactttatggattgcccaataatatttcctttcgactcccgacatgtcgcggaacttcacggattgcttaacgatgggtgtcaagttcctcgaagcggtcaagcaaaggttgcatgccatcaaacaatggtccccggacgaaattag

SEQ ID NO: 79281 - DNA, 315 bp, Glycine max
  Peptide Sequence Number=SeqID_170966
atgaaggttgaaggcatagggtgcgtgaggatgaaactccatgatggtattaatcaaactttctcaaatgtgaggtttgtaccttttgttgttgtcaatatcatttctatgggggagatgacatcacaagggtacaagtatggtggttcaaaatggaaatgcaagaaaaataaaagtaaccttggttatttggatggacaagccttgaagaggaaccatgacaataaagtgaagaagaaagtgaagttttctaatgttgtagaagtgttgggagatacttctgttggagggagagtttgctcactttcaaattga

SEQ ID NO: 79282 - DNA, 216 bp, Glycine max
  Peptide Sequence Number=SeqID_170967
atgcaaaatgcaaaggttgtgattatgggtgatattgaggtccccccaaagtgtttggcaggggtatgccaccaaatgcttgctcctcaatggcatatccaaggtgaggctcgaagtcagctagagtgtggtctcggggtacttcatgtgcctcccccatgggttgagggacctatgcatgaccagattggggttgttggctctcaatgggtatga

SEQ ID NO: 79283 - DNA, 387 bp, Glycine max
  Peptide Sequence Number=SeqID_170968
atgtataaagtatcagatggtacttacttgtgtgagatgaaagaaatgcgaaaaaatgaaagcaaaagtgcacaattgaagcttggggctgttgccaagggtggctcctataagcttgttagagaccctaatttcgtttggggaggatcatttgctaaagttttgattcttgccagccgaattgagctacttaactccagttcccgcgcaatccgtaaggtgaagggggctgaaggaatgggtttagactttcaaacattgaaagatttagtgaaattaaggagaagaaggaaaaacgaggctgaagcgcttttgaatcgcatccgtgaccgattcctacattgttcttcgttcgtaaaccgattagtttttattttgaagttttga

SEQ ID NO: 79284 - DNA, 579 bp, Glycine max
  Peptide Sequence Number=SeqID_170969
atggggagctgtgctgaagttgctgcaaaagcttctattgaagagccttctgttgtggatgtggccactatgggcttgtacatagttggtgaccaattttatgacacttatgccccggtcccttttccaacttcaaaaattcagtatgtgagggaggccattaacacattcgttggttggccgacacattttgtaaaacctatatctgatgaagagtcacacaatcatctgcctaaaccagttggagttgttcaaaggtgcaatacaattgaaatagagaaaccattgagagaattaattaagagtttgtttgatgtttaccagaaaccagttgagttgccatgggatgggccaaaatttgggattcctaatgtacacgtatcccttttcatcacacatgtagatgtaacagaaattatatcagctgattgtcaacttgagaattttgcatgtcctgttgacaacgataatgaaaaagacaaatatgaggttggagaaaatgttagatttcaatgggagggtcaaacgcaggaacaaggaagtgtcgaccaggatgatacattgaatgaatattgttaa

SEQ ID NO: 79285 - DNA, 940 bp, Glycine max
  Peptide Sequence Number=SeqID_170970
acctgtctgtcctcttcaaggtcaccgcatgtgtgccgaaaaagggaaagcaaattgggagcaactcttggctggtatggttggggcatctgttaattggttcccccgatggaaggaaggagggaccagagttttgttctcatgtaaagggttccaaaatatccccttgatgggaatgaggggtttcagtgatcccaatgcaagaatgcttcaaagagttcgaaaagcatggattgtggtgcaaagaaaggataaggatcttagaggaagcaacaacagtgttattggaggatatcatcaatggttgaaggctcaaacgcaagggataacttggctcccaaagctaaagagttcaagtggggaagaggctgaagtccctaaggagagcgaagaagtgcaagccttgaaagcggaacttgaaagaatgcgagtagtcaaggaaaagttcaagacgaaagccatcagggttaggaaagagtgtgacaagctgagggacgtcaacggtagtaacagcgaactcaagcttcggagagatgaaagggacgagtcgagggtggaaattatgatattagaggacaagttgaaggcttgtcaaaggtcgaagaggagcttgaccgaacagttgagtaggatggaagagaacatgtgggcaatcattgaccaatataaagagaagctaaatctagctgccaaccatgatcaaagactagagggcgagcatgcaaaagtatcggctctacaagcgaaaagggaagcaagagagagagtgataaattcattacatggagaagttatgacgtggatggataggttcgctttcactttgaatggaagtcaagagcttccaagactgttagccaaagccaaggcaatggcggacgtgtactcagctccagaggaagttcatgggcttttcgattattgtcagcatatgatctag

SEQ ID NO: 79286 - DNA, 696 bp, Glycine max
  Peptide Sequence Number=SeqID_170971
atggctccaaagaagctttcggctaagagggaaaggaaagatgctgctggaaatggttccagggtggccccacaggtggatgtggagttttacgaacttcggttctggagtgaggaacaccagtgccgatttgaggcaattaagggttggttgttcctcaaggagaggcgggtccagttaagggaaggagagtatgccgaattccaggagcaaattgccaggaggcaatggactcaacttgaggcacccatggctaagtatgacccagaaatagtcatggagttctacgccaacgcatggcccacggaggagggagactttgctcgaagcgtggcagggaaacgggtgcagatcatgcgcaccagcatgaccaccctgacacagaatttggatgaccctttgccaattctatggggtgccggtcactcccgccaagcttatctgggccctcatcaacagggttttcatagagaaatattgcatgtccaagtaggcacagtagcaggaggaaggccagcagtagctagccgcagatacaccgccaccacctctacggcagccgccatccctggagtctatctctgctcacctgcgaaggatagagcttcagatgcacacgactcgcaagcccccagagacaaggatggagctcaggaggatgatgatatggctgatgtcctggactacttcctttga

SEQ ID NO: 79287 - DNA, 228 bp, Glycine max
  Peptide Sequence Number=SeqID_170972
atgcaaaaagatagccttgtctacaacaatataagctggtaccaagaggtgtcaaagctaaaggcaaagtatgattctcttcaaaggacccagaggcatttgcttggggaagatcttggaccattgaacataaaggagctgcagaatcttaagaaacagcttgaaagggctttaacacaagcaaggcaaaggaaggttgtaaagcatgtgcctatatacaagaactga

SEQ ID NO: 79288 - DNA, 510 bp, Glycine max
  Peptide Sequence Number=SeqID_170973
atggacgggcatattgatgtggccctggtcaaggagttctactcaaacctgtatgacacagaagataaatctccaaaacagatggatatggatgtgggcttcctcatatcacatcaaatttctcagatggcccagtccaactcctcgcggctcggcttcccagccttgatcacagcattatgcgtcacccgaggagttatctcatactccctcactttcgagtccctcaaccctgccattaatttggcatacataaagaagaattgttggaacctggacgatcccacgatcgtatttctagggacccgcaaggcacaagctcaaggatctgagggcccatcttcgtctgctcctgctcctgcttctacttctgctcctgcctctagtgatccagctccctctacttctcttccaccaccatcagttccagcacccttcggcacctccactcagagcttagacctcacagtgcagatgctgcagagcctccaccatggcttagcctggtga

SEQ ID NO: 79289 - DNA, 421 bp, Glycine max
  Peptide Sequence Number=SeqID_170974
atggcagaaccattaaagaagcgaaagggttcttcgagtcaaagccaacgacattccgagactcaggaaatgcagattccttcctccatttcctcttcctcattgttctcatccgaagaacaacggatacggtacacaaatcttttctctttcggttccattattgatccaaaattcattgacatggatttcttttccaatgagatttttgaatgcattcaggcatttgaaaactccaatctcattcctttcatgtctttaaaattgcctgtttacactgaattagttaaagccttctattctaacttagaaatccaagaaggcactttaatttctgaagtctatgggataaaaatggtcattgaccaatccctattctatgacttgacccaactatccagtgaaggtgtaccatttgaag

SEQ ID NO: 79290 - DNA, 93 bp, Glycine max
  Peptide Sequence Number=SeqID_170975
gactcaatgtcctttgctttatctttcataggactcaaagtcctcgctttcatctttcataggactcaaagtcctcacctttatctttcatag

SEQ ID NO: 79291 - DNA, 225 bp, Glycine max
  Peptide Sequence Number=SeqID_170976
atggggaaatttgcatgttgttgcttcgtcaaaataacaaatctcaaagggagggtggagtcatgtctacccatttctaaattcagcaagtgcatcaatattggaaataggtacatgtcttgcattactgcttctttattccaagttcaactggtcgttgggaaagttcttcctgagctaaataggaaactcactgggatggcattttgtgtaccgatggaatga

SEQ ID NO: 79292 - DNA, 186 bp, Glycine max
  Peptide Sequence Number=SeqID_170977
atggtcagagatggcggtggcaatgctgttctagcgcggcacgtggtgtgcgaatggacctccatggcaattgcgtcccagtccttgaagccatggcagttcacggtgcatgctaccaacaactcctcccatgtgccccatgcttcgttatggtgttgctgttgttggtggtttttctctatgtaa

SEQ ID NO: 79293 - DNA, 599 bp, Glycine max
  Peptide Sequence Number=SeqID_170978
atggaggagaagaaaaaaaaattggaggaagctactcaatttggaagcactaacactgtgattgatcctcatctcccatcagacggcacgcctctgggttcctttgtcgcccatggacgtcaggatgtactgactgttgccattgggcaaccagaacaccctggttgtgtgcgtgctgttggagctgacctggagcagctaacgcaacaaatcagggaccagctgaaggagtcgatcacagaaaaagtgactcaacaactaatgttatccttcaaccagatgcagtcccagtttcaatcgcagatgcaatcacagggactcatactaccttctaagcctgaggttggtccttcaattgctcatgtcagcacaaaggagagttatgttgatccctcagggaacgatcgagacacgggtgactcagacaaatgcgggttgtacgtcgaagaaagtcctcctcgcctggttgccctaggaagactttgtgaggggtccacaaccgttcacaacattcctttgctccatgaccaagtcaaggttggtgttgaggaggttagagatgtagatgctcccattcctgtacccaatgaagaggctaa

SEQ ID NO: 79294 - DNA, 186 bp, Glycine max
  Peptide Sequence Number=SeqID_170979
atgggctcatggattggtactgaggaagcaatggagcagtggtggtttgttgttgactatagtaaccttgttgctgctcctgccatggagaacaacaacaccaccactaacaaccatccccaccatcagttctcatctgttttcgatggcagccgcttgcaactctactatggtcattctaactag

SEQ ID NO: 79295 - DNA, 801 bp, Glycine max
  Peptide Sequence Number=SeqID_170980
atgggaaggaacatgggtttgaatttgatagggtactccaccgttgcaatggttttcataattgttttcagctggagcggagagcattcattgggacttaggacagacgctatttattacaagaattgtagcaccggcttagaaggtggtctcacatacatatttgattataggaggacaatggcgttgctctccatcgactggctcgtggtcgtcgttgtcatcgtccttatcgtctcaccatctttgtcgcatggtctagtcatcattttcaccgtcgtgttcctttgccctcgccctcaccctcaccattgtgtttgggaatcccttgccaccattttcaaacctgaacatgaatgtctcagagttttaatttcgttgaacttgaagcaagaaccatgtttggatctctgtgccagtggtggcaaagatggagtgactcttttgtgggatttggctcaggaatgggaaggaaatgactggaaacacccttacaatgtgttggagatgcagattttgattatcaaggcgagatgcatccgctttgcaaggcatccaactcgcttagttgattgggaaaccctagaagatgataagtcagagatgtgcttgtccagcgtgaagccagcctgcccaacgagcatgttgtctcttctcgcgctcagcgcgcccactctcgctaagcgaaaattcactaactctcgcttagcgagccatgctcgctcagcgagctttcggaagctgaagagtccaagagcctttaaaacactgaggttggcggagtttcaaggagaaagatga

SEQ ID NO: 79296 - DNA, 273 bp, Glycine max
  Peptide Sequence Number=SeqID_170981
atgcagtcccagtttcaatcacagatgcaatcacagggactcgcactgcctcctcagcctgaggttggtccttcagctgctcgtgtcagcacaaaggagacttgtgttgatccctcagggaacgatctagacacgggtgactcagacagatgcaggttgtatatcgaagaaaatcctccccacttagttgccctaggaagactttatgagggatccataaccgttcacaacattcctttgctgcatgatcaagtcaaggttggtgttgaggag

SEQ ID NO: 79297 - DNA, 387 bp, Glycine max
  Peptide Sequence Number=SeqID_170982
atgaggtcacatgaatgtcctgtcgcaacctacccttttgcgggcgagcgagacgaggcgtggctcacgggtgcgctttccaaaggaggaaaatgcgcggagttgccaccaacgtttatttgtggaaaacgtcggaaaaaccgaaggaaaccggtcataaagaatattccaagttcgggagttctatttacgtttgaggaaggtattagcacctctcacgtcaacaaaagcggggctcttgctcctacgtaccctccatcgaagaggaaatcagacctacgtagttcctttttaagggtgaatcaagcgattctttctacctggaaggtgatcattttaaggcgttggaccttaaaaatgatccatttacttggtaagaaaaactga

SEQ ID NO: 79298 - DNA, 483 bp, Glycine max
  Peptide Sequence Number=SeqID_170983
atggggacaaatcaaaacggcaaaaggttttatcaagtcaaggttaaaagtctagatgtcactagcctcaaggaattgggacgattgatgggacctctccaaaggcaagccttccgcaaagtgtacgggaagattctagatttggccgcagcggaggtatttatggaagttgtcgtatccctcgcccaatactataaccagccgttgaggtgtttcacgtttggggacttccaaatggtcccaactattgaagagtttgaggaaatattaggatgccctcttggggggaggaaaccgtatcttttctccggctttcttccttccttgagcaagattgcagctgtgattggagattcagcaaaagagttggatcgcatgaaacaaactcgcaatggaatagtgggcctgccacggaaatacttggaaggcaaggcaagggatatggcgagccaagagaagtggagcccatttgcgatattttag

SEQ ID NO: 79299 - DNA, 487 bp, Glycine max
  Peptide Sequence Number=SeqID_170984
atgaagggtctttacgactgtcgcaacgtgcccttcgcgggcgagcgagggcgaggctcacgggtgcgctttccaaaggaggaaagatgcgcggagtcgccaccaacgtttatttatggaaaacgtcggaaaaaccgaaggaaaccggtcaaaatgagaattctaagttcaggagttgtatttacgtttgaggaaggtattagcacctcttacgtcgacaaaagcggggcttttgctcctacataccctccatcgaagaggaaatcagacctacgggaggagcttgccacccagctcgcccaggcgagctcagctcgcccaggcgagcaaggttgcttcctccagaagcaacagccttctggaggaaggatctggaaggcccaatcctcaaatcagatgattcaggaatatcaaattcaacatgcttttctagtcttcttcgacgcagacggtgaagaaggtgttgctggctcaggagaaggaggag

SEQ ID NO: 79300 - DNA, 372 bp, Glycine max
  Peptide Sequence Number=SeqID_170985
agacaggcccagggggatgctccgcaggccgcagacgtgccgccacctcatcaggctggtccagccggatcgtttgatacgaagcagtatttgtggcatttggtttgccagcaggcggccaaccaccgggctcatgtacagacccatgattgtctttaccagatgagtctcagcctgcagagccagggttttacttcttttccgagccctactccggaccagttcagggcagaggtcgcatggcctggagattggcctgaggcccggccaggagaggcgccagcagaggctcttgacgaggcagatgaggcccgcgaggacgaggaaatgaccgatttacttgatttcttaggagggagcggggccacatga

SEQ ID NO: 79301 - DNA, 595 bp, Glycine max
  Peptide Sequence Number=SeqID_170986
gttatgttctgaatttcgagcgtcttggatatattacgggactcaatcggacaaccgagtcaaaagttattgtcatttgaatttgctcagagcttctgttttcaattacgagcgtcttgataaattacgggacacaatcggacatccaaagattcagttttcaatttcgagcgtctcgatatactacgggacacaatcggacatccgagtcaaaattttttgtcgtttgaatttgctcagagcttttgttttcaattacgagcgtctcgaaatattactggactcaatcggacatccgagaacaagttattgtcgtttgatttttctcagagcttcggttttcaattttgagcgtctcgatatactacgggacacaatcagacatccgagacaaaagttattgtcgtttgaatttgctcagagcttctgttttcaatttcgagcgtctcgatatactacgggactcagaatcagacatccgagtcaaaagttattatcgtttgaatttgctcagagcttctgttttcaatttcgagcgtctcgatatactacgggacacaatcggacatccgagttaaaagtgattgtcgtttga

SEQ ID NO: 79302 - DNA, 222 bp, Glycine max
  Peptide Sequence Number=SeqID_170987
atgaccggccctctcaatgagtcaatctcttgctttctcataagagtggacccttgggtacaagtaccctcaccttcggaaggctacacgccctcgccttcattgggctacatgtcctcgccttcagagggctgcacgccattgccttcagagggctacacgtcctcgccttcagaggactacatgtcctcgccatcagagggctgcacgccctggccttaa

SEQ ID NO: 79303 - DNA, 441 bp, Glycine max
  Peptide Sequence Number=SeqID_170988
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcaagatgcacttttcaatcttggacttcccagcctccagaagtgtgagccaataaatctctga

SEQ ID NO: 79304 - DNA, 681 bp, Glycine max
  Peptide Sequence Number=SeqID_170989
atggcaaaagataacaattggtacctcaaaggcttacactgggcaatgaggggcatcgtgcatgagccccaagtgaacataggggcagatcaaaaatttcctacatctaatgtccaatcttgtgaatttgggataaccggcaatcttgatgagtcgatctcttgctttcccaaaagggtggacccttgggtactagtacctatctcctttagagggctgcacgccctcaccttcagaggactacacgtcctcatcatcagagggtggcacgccctcacctttagaggactacacgtcctcgccatcagaggactgcacgccctcaccttcagaagactacacgtcctcaccattaaagggctgcacaccctcacctttagaggactacacatcctcaccttcaaagggctgcacgccctcaccttcaaagggctacacgccctcaccttcagaggactacacgtcctcatcttaagagggctccacacactcgcattaagagggatgctcgccctcgcctttagaggactacacgtcatcgccttcaaagtactggacgtcctcacctttagaggactgcacatactcaccttcagaggactacacatccttcgccatcagagggctgcacaccctcaccttttagaggactacacgtccctcgcaatcagaggactgcat

SEQ ID NO: 79305 - DNA, 495 bp, Glycine max
  Peptide Sequence Number=SeqID_170990
atggctgccattcctacatggccaaacttcccaccagcccaacaatgtcatcgctcagccaatatcgacctttctcattacccaccacccagtcatccacaaagtttgttggccgcacatccaatgtcaagcgcaaaccaaaacaccaaccaagaaatgaattttgcagcgaaaaagcctgtggaattcactccaattccggtgtcctatgctgacttgctcccatatctacttgataattcaatggtagccataacctcagccaaggttcatctacctccatttctccgagaatacgactcgaatgcaacgtgtgcttgtcatggagaagccccggggcgttcaattgagcattgtagggccctgaagcttaaggtgcaatgtctaattgatgcgggctggctgaaatttgaggagaattgtgtgttagtcttgacattgacaagagatgccacacatggggcaattttgaaagctgttgttagatgtctctaa

SEQ ID NO: 79306 - DNA, 376 bp, Glycine max
  Peptide Sequence Number=SeqID_170991
atggccggaacaaattccgaggggctctgtggggcagatgagttgaggatttgcctaaggtccaagagaagcttgtctcaacagttgagcgagaccgagaccaacatgttagccatcatcagcaagtaccaaaaagaattaaatctagccatgacccacgagcacaaagtggcggacgagtatgcccgagtgtacgcggaaaaggaggctagaggaagggtgattgactcgttacatcaagaggcaacaatgtggatggaccgatttgctcttactttgaacgggagtcaagaacttccccgattgttggccaaggtcaaagcaatggtggacgcctactccacccccgaggagatccacaaacttctcagctatt

SEQ ID NO: 79307 - DNA, 216 bp, Glycine max
  Peptide Sequence Number=SeqID_170992
atcttccagcccactgattttgttggatttctctctaacatcaccaagaaaacatgcggcatcaaaatgttgcacaatcttgtcatacaatgctttggcaagttcggtcatatatgcccaacatgcatacagttttatcaccaggcttcatgtctaaaagtggcattgcctcctctacgcgggacaaagtcgaataaggttcagatcaatatgtaa

SEQ ID NO: 79308 - DNA, 306 bp, Glycine max
  Peptide Sequence Number=SeqID_170993
atggttcttggagcgagtagtccccttgtacttgtcaaagtccagcaccttgaacttgggaatgaccatgggctcttcccaccgcaaaatgcaatggttatggttgtgggcgaaactgagggctctccaaagtgttttcaaagggtataccaccaactgcttgcccttcagtggcatatccgagccaaggctcgaagtcagctagattgtggtggggaatttcatgtgtctcccccatggtttgagagatatgtgcctgatgagttgggaggcaagccatatgatgggaaggcgtgctcgttttga

SEQ ID NO: 79309 - DNA, 474 bp, Glycine max
  Peptide Sequence Number=SeqID_170994
atggctgcacctgatttcacctacgaaagcttgtgcatccaataccctgatgaggatgtcccatatgttcttaaaactggactgatccatttgcttccatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 79310 - DNA, 336 bp, Glycine max
  Peptide Sequence Number=SeqID_170995
atggaacttgaccttagatgggaagcgttaaatggcaatttctccaaagtgcttttgggcatcacgttcaggcttgagctgttgtcgatgagtactttggccataacgtgttccaggcatttgactgacacatgtaaagcccggttatgtcctctcccctcggtggggatttcctcttcagcgaagaggaactccccggcctccttgagtgatacctctctcttgccacaaccctctcttccctcgaaatatcctcgtctggctagggggtgcgaacacgcgacccctgtgggttatgccgctcagcccgatgatattggtcactttggccgatag

SEQ ID NO: 79311 - DNA, 278 bp, Glycine max
  Peptide Sequence Number=SeqID_170996
atgggtgatcctgaggcacagtatgcattgggttgtcatctaagagttgagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcacgagaaaaaaggctgcaccg

SEQ ID NO: 79312 - DNA, 171 bp, Glycine max
  Peptide Sequence Number=SeqID_170997
atggaggttgaggaaccttggttggggttatggctaccattgaattatcaagtagatatgggagcaagctttctcgctgcaaaattcacttcttggttggtgtttttggtttgtgctaaaggtggtgttcgtcattggaagtgcggtagacagactttgtggttgatttag

SEQ ID NO: 79313 - DNA, 207 bp, Glycine max
  Peptide Sequence Number=SeqID_170998
atgggggttcgagggaacctagcaggggttatggctaccattgcgttatcaagtagatatgggagcaagttagcatatgacaccggaatttggggtgaatcctacaggcttttcgctgcaaaattcatttcttggttggtgggttttgttgtcgatttagggatggcctttgtggataactgggcggtgggtaaggagaagggttga

SEQ ID NO: 79314 - DNA, 510 bp, Glycine max
  Peptide Sequence Number=SeqID_170999
atggcttcaaactcccagcaatttagtgccagaagtgatgctattgtcattagaggagtgcatgaagtagccacgaattcatcttcatcaaccgagactaagaagcttgaaggtaaactagatgccttggttaacctggaaacccaactggccatgaataaaaaatctgcacctgtcgccagactctgtggtttatgctcctctgccgaccaccacacagacctttgcccttctgtacaacaatctgaagcaattgaacaatctaaagcttatgctgcaaacatctacaacagacctcctcaacctcagcagcaaaatcagccacaacagaacaattatgacctctccagcagtaggtacaatcccaggtggaggaatcatcccaaccttagatggtcgaatccttcacaacagcagcaacaacaacaacaaccttattttcagaatgctgctggcccaagcagaccatacgttcctccaccaatccaacaacaacagcagcagccctag

SEQ ID NO: 79315 - DNA, 180 bp, Glycine max
  Peptide Sequence Number=SeqID_171000
atgatgcaatcctaccccgcaaaggcattggatagaagactccaagtagattgggccagagatccaacggaaggccctaggacaaaggatcaagctgaatgttttgatgatgccaaaggatcacatgtttctcaaagctttattcaagacaaagaaattaaagatattcaagatggatga

SEQ ID NO: 79316 - DNA, 138 bp, Glycine max
  Peptide Sequence Number=SeqID_171001
atggagtcatttgcctcacaagttcttcaagggaaggttgcggaggagcctcaactgtttgctgtttctggggctgttgctgttgttattgttgctgctggattggtggaggaacgtatggtctgcttgggccagtag

SEQ ID NO: 79317 - DNA, 216 bp, Glycine max
  Peptide Sequence Number=SeqID_171002
gaagccattgaaatctgtccttacatccctactatggttgcagaaaatgcaactatagaaaaacctagggaacaatgggaagcagaagaaaggaaaatggaatacgaaatggaactcatgagactaaatcaacatgaggaaaatgacaagaaaaagaaaggaatcgcacttaaagcttcatcttcaattcaagaaggaagtgataagaagatttga

SEQ ID NO: 79318 - DNA, 783 bp, Glycine max
  Peptide Sequence Number=SeqID_171003
atggtagaatttcggaatgaagttaggcttgctaaagctgcaaaagaggaacatgctagggacctacctctcatgaatggcataaaagaagtcataaaatctgttggggttttggactctagcaaccttgattaccatgaggctttgtacaacctttcttctcaagtcaagtcattgcaggataagcataatccacacctggagcttacacttagtactcgaaagaagatatcatcaattttagagcatctaaaccgtaaatggggtaattcaagcatagcagctgcagaagtaatgttttttccttatggtattcaaagggaaaacttggttaattgtccgagatggacccaggaatctactcttagtgcagcagatatatatgcaatgattggaagtccacccatcttttgtttaagggtgacctccaatcctgatgatattgtgattataattgggaatgttaagaatagaatttcctcactcttcccttttaaattcagttgtatctcacattttgtggtttggcaaataagccacaagaattggatgatgcagttcttaggagttaggagacagaaatcacagatagcccttctgcaatgttcatacaaagacagaaatcctgtcactgcaggcagattatgggagaccagccagagtcatgttgttttacaagaatgctccaatcatgtgggatggcacaggcttaaaggagaactcaaaccgggtgacccccaaggcctacactccaaagagtccgttagggcctctccctcctaa

SEQ ID NO: 79319 - DNA, 704 bp, Glycine max
  Peptide Sequence Number=SeqID_171004
atggatcaacaagactttcgggaaactgtttttggtgggaaattcggctttggcatgaaagagacggggcacaaagatttggttggtaaccaagaaagggagcttcatgtgtttcaaatcatgggtaagggtaaaaattcctatcctgggtcaaggtttatggtcgaagggttgaggttttggctcaaaaaggctcgcggaaggcaagacatgacgtatgtcagggaggaagtccaacatgtcggccatgtcctcatccttctgggcgctgtctccctctccggaggccaatctccggaggtgctctggagtcctggccctgctgacgtagagtgtattgataaaaactatcgttcagtcgcacctgacccctgtggttggccgcctgctggtcagccacatgtcatatacaacgttccaacctccgcaggtgagcagaggtggactccgaaggtggcggtggtgcgtcctcacctgcctgctgctggtcgtccccaggctgttgtggtgcctggccttgttgcgcctgcggggggggtgcagtatttctcgatgaagtcccttcgcgctaagcggaccctgtgggctcagctcgcatccattgctaagcgcagcttcagcccgcttagcatgacacgggcatctggaagagcacaagaatcaaggccatgcgctaagcacgagatcagctcgctaagtgagac

SEQ ID NO: 79320 - DNA, 270 bp, Glycine max
  Peptide Sequence Number=SeqID_171005
atggccccaagaaagctcctcgcgaagaggtccaggaaggacaccaccggagagggctccagcactgccccgcaagctgacatggacttcgacaggcaccggttccggagcgtagaacatcagcagcgttttgagaccattaagggatggtcattcctcagagaaagacgagtccaactgagggacgatgagtttcctgactttcagggagagatagcccgcaggcactgggcaccgcttcctaaagtactaaacctcgatccctcataa

SEQ ID NO: 79321 - DNA, 372 bp, Glycine max
  Peptide Sequence Number=SeqID_171006
atggaggaaaacataatgttcacgagcgcacaatttattgaggtcatagaaatgcttaaacaacagaaaacaatgttggaagaacatcaaaaattgatcgcggatctgcaaacagaaaaggatgatgcacaaaaggaacattcgaatgcaatggaagcgttaaagtggcttcattctctcctatcaatatctatcgattcatggctagacttgagggagaagtttaagtccacctttgcaatgaaagaacaaagatggaggtcgataaaaaacttattcgacaaggacctaaggaactgcttacatgatacatctcacaattcaacaaggaagcaagggctatggacaatcaatagtcaggagtcgtgttaa

SEQ ID NO: 79322 - DNA, 882 bp, Glycine max
  Peptide Sequence Number=SeqID_171007
atggccccgagaagaatgagaagaaaagctataaagaaagaagatccaagaaggcgtatattgcctgggatgacaatgactcatccgatggttcggagaaggagatcaaacttctatccaaggactatgaaaatgatgagaacatctctcaagaagtttaatctctggaacatgaagccacggaacatcgaaggcgcagacatctcaaattcctccctccatatcatctcctacgttgttttcctcagaagaacaacgcatccggtacaattctcttttctctttcttgttcccattatcgaccctaatttatctcccatgaaacttcccttttaccctgaattggttaaagccttttattctaaacttggagatttcaagaagattcccttgatttccgaagtttatgggattaagatggtcatagaccagtcccttttctttgatctcactcaattatcaagtgacggtgtaccatttgagggttcacttgatgatgagtggaagtttgatttttttgtgtttgatgcccgccggatggttggcaccaaccaagcggatatggctggaaggcttcttgccagttcattggcattcgaatgttgcatcatgcactacttgattgtgccatcctactctttagatcttccaaccttgcaaagggatggctcttgggtaaagaaggatgctctagtacaggtcgttgaagaccgctctccatcaccacattctcagagagatgactcttcatctcttatgcacaacattctagaaaggtttgatggacttcaaacctatgttgatgagaggatcacaaaggttgaagaagatgtcaccatcattcgcgactgccttgatttacctccaccaccatcagtttag

SEQ ID NO: 79323 - DNA, 450 bp, Glycine max
  Peptide Sequence Number=SeqID_171008
atggaaggatatgattttggagtcaaggagggaatctttgaaacatttttggatccaacagtcttccgggtcgttggcaagggaaaattagccgaagaaagtctcatgacttcattctcggacatcgttggagacgtcaagcgtggagggtgtgacagagtagaggaggaggacccacacgtgtttcttccacacgtgcttggccttgttgccgtggttgtggagctgctggtggtgctggggcttgagcgaaacagcgtcgtcggagacggttgtttctcttcaagccctgaggaggagagggttgtcgtgaagcgcgttttggaagatggtgtggaattggggtgggattggaaggagagaggggacaaagtggtgattgttgttgttggtggtgcattggaactcgaaggagtgggtgagaggagcaggttttggaggaaagagtag

SEQ ID NO: 79324 - DNA, 963 bp, Glycine max
  Peptide Sequence Number=SeqID_171009
atggcgatggctgcagctctgcgtcgcgaaggaaggcgtttgacccaaccaatcaacgccctccactcttctctcaattcctccctcatctctcagtcacattatgtgatagagatagaaggttggcttagtgtgaggaaccgaatgaagagtgtgaggaatatccagaagatcaccaaggccatgaagatggttgccgcgtccaagctgcgggccgttcagaccagaactgaaaattcccgcggcctctggcaaccgttcaccgctcttctcggtgacgatcccagtgttgacgttaagaaaaacgttgtcgttaccatctcttcggacaaaggtctttgtggtggaatcaattccacgtctgtcaagataagcagggttttgaacaaattgaattctgggcctgataaagagacaaaatatgtcatattgggagagaaggctaaggctcaattgttgcgtgactcaaagaaacaaattgcgctcagccttactgaattgcagaaaaatcccctgaactacactcaggtgtctgtcttggcagatgacattctaaagaatgtggagtatgacgcattaaggattgttttcaacaaatttcattctgttgtacaatttttgccaacagttgcaactgtactgtctcctgaggttattgagagagaggctgaatcaggaggaaagcttggggaattggattcatatgagattgaaggtggcgagacaaaagctgaaattcttcagaatctggctgagttccagttttcttgtgtcatgtacaatgctgtgttggagaatgcttgtagtgagcaaggagcaagaatgtctgcaatggacagctctagcaggaatgctggggatatgcttgatcgtctcaccctcacctataacagaactcgtcaagcatcaatcaccactgaattgatagagattatctctggagcttccgcactggaaggttaa

SEQ ID NO: 79325 - DNA, 243 bp, Glycine max
  Peptide Sequence Number=SeqID_171010
atggcggctcgcggtggccaccggtggttgtgggtgatggagaagaagcttgggggcgttggggagggtttaggggaagagaagaaggaagaagtggctgttttcagctgttgcaccctaagtgtctatccacttaattcaagcattgttgtttatgaaagccaagagtggcttgatgttaaacaatacttggatgttcttagattcagggggagtctaaggggtatgccaaaagtggcctag

SEQ ID NO: 79326 - DNA, 808 bp, Glycine max
  Peptide Sequence Number=SeqID_171011
ggatgagtcaaggatggaaagcatggtgttagaagataagttgaaggcttttcaaagggcgaagagaggtttgacggaacagctgagcataacgaaagagaatatgttgacaataatcgatcaatataaggaaaaagtgaacctagttgctagtcatgggcagaggctagaggatgagcatgcgaaggtatcagctttgcaaattgaaagggaagcaagagagaaggtgatagaatcattgcacggggaagctatgaaatggatggataggttcgctttcactctgaatggaagtcaagagcttccaaggttgttagctagagccaaggcaatggccgtcacgtactcggctcctgatgaagttcatggtcttttcaattactaccaacacatggaacagatgaaggccgacatggaggccatgaaagaccaaatggccgccatgatggaggccattttgagcatgaagaaaataatggaggtccacacggctgcagttgccactacaagtgctgccactgagatagacccgtctcgcccatctagtatgaatcaaaattctttcccaccatacagcttgcctcccaactatgcaccacccaatgttgtacatgtgcctgatgagaacaccgaccactctgctcctaacctcgagaccacgctctggctgacttcgagccttaccccgtatatgccactgagggaccatcatttggtggcatgccctaacctaacacctcaacggtccctcatcatcgcccgctacaacctttacatttcttggtgggaagactgccacctgccatga

SEQ ID NO: 79327 - DNA, 144 bp, Glycine max
  Peptide Sequence Number=SeqID_171012
atgaccacaaatcgacatccacttcctatgtctcacacagatccaggagtcctcagtggagtctccatctatcgcaacctacccttcagcgggagggcaaggcgaaatgccaaaggtgcgtcttccaaaaaggaaagtgcgtag

SEQ ID NO: 79328 - DNA, 789 bp, Glycine max
  Peptide Sequence Number=SeqID_171013
atggttttctcttcacttcgcgggtactttagtatgaggcaacaaagctccaaggttcaggctttgtatgaccattgcaaaaccatcttatcaccctctggctctggaacagcccctccttcgtcccaagctctgatgaagctttcttcgattctggacactattcaaccggctgatgttggccttaaggaagaaactgcagatgatgatcgagggcttggattttttggtgctaatgcacttagtagagtaactcgttgggctcaaccaataacatatgtggacattcatgaatgtgacagttttacgactgcctctgcactgcactgcactgctgcagggtttcatgtctatgtcagtatgtgtatattttgtttccctacttcttcagttattcctctccatgatcatcctgggatgactgtatttagcaaacttctctatggctctttgcatgtgaaaggttatgactgggttgagcctccctgcatcatagaaagcaaaggacctggatatggtcaagtacgactagcaaagttagcagttgataaggtcttgaatgcactgtgtgatacatcagttttatatcccaaacacggaaatctgcactgttttgcagcagtgacaccttgtgccatgctagacattctcacacctccttacagagaagaggaaggaaggagttgtacttattatcatgattatccttattcagcattcttaggccgtgattgtgcattgcatcacccaaaattggcctgtaataacaacaacttagtagaactataa

SEQ ID NO: 79329 - DNA, 1467 bp, Glycine max
  Peptide Sequence Number=SeqID_171014
atggctttgaatttgactcatcaaccagccattaaagcaccgtcttcctcctctttcgccgcctctcgccctttgcgggccccgcaaagcgtccccttgaggagcccgcagcgctcacttgccgtgcgcgccgccgccacggagtctccggcgccggcggttacggcggtgagggagtgtaaggtgaagtcagtgaaggcgcggcagatcgtggacagccgcgggaacccgacggtggaggtggacctggtggcgaacgggcttttccgatcggcggtgccgagcggcgcgtcgacggggatttacgaggcgttggagctgagggacggggacaagagcgtttacggcgggaagggagttcttaacgccgttaggaacatcaacgaggtcttggctcccaaactcgttggcgtcgacgttaggaatcaagctgatgtggatgctattatgctggaaattgatggaactcctaacaaatcaaaactaggggctaatgcaatattgggagtttcactgagtgtatgtagagctggtgcaggggcaaagggagttcccttgtacaagcacatccaggagatttcaggaacaaaggaacttgttatgccagttccagctttcaatgttataaatgggggaagtcatgctgggaataatctggctatgcaagaatttatgatactaccagttggagccacttcatttgctgaggcattccgcatgggcagtgaagtttatcatgtattaaagggaataatcaaggcaaaatatggacaagatgcatgtaatgttggagatgaaggaggatttgctcccaatgttcaagataacagggaggggcttgtcttactcatggatgctattgagaaagctggttatactggcaagattaaaataggcatggatgttgcagcttcagagttttacactaaggatgggaagtatgatttgaacttcaagaaacaaccaaatgatggagctcatgttcactctgcccagagtcttggtcaactatataaagattttgtgaaagaatttcccattgtgtcaattgaggatccatttgatcaagatgattggggttcatgggcttcacttctctcttcagttgatattcaacttgtaggagatgatttgttagttacaaatcccaagagaatagctgaggccatccaaaagaaggcttgcaatggtttgcttctaaaggttaaccaaattggtacagtgactgaatctattcaggctgcacttgactcaaaggctgcaggttggggtgtcatggttagtcatcggagtggtgaaactgaggataacttcattgctgatctctctgttggcttggccagtggacagataaagactggtgctccttgccgaagtgagcgattggcaaagtataatcagcttcttcggattgaagaggaacttggaagtgtgcaatatgccggtgaagctttcagatcaccttag

SEQ ID NO: 79330 - DNA, 429 bp, Glycine max
  Peptide Sequence Number=SeqID_171015
atgtctgaagaagttgatatgaatgttaaaaatgagaaagatgctgtggctcaagaaattggatttgttgtcgtgataatcaggtcagacataaatgctggtgttagaggaagggtctcatttctgttaatagcttgcaaaaggagcggtcgaatgactaaagatgagaagattgttgttgctgatatgacaaaagggagtaacaccgaaatgcaacaactgatgatgctgcttgaccgagatcaatatattcactggcataggatgaaggatgtaaatgttgtatgtgacttgttctggagtaatcctgatgcaggaatgacattctttgctgcttttgcttatttggaaggagaacgtcttaataatgttgtttgggccctacggcggtttcggggtcttttcatgaaagttgatgcactccctaag

SEQ ID NO: 79331 - DNA, 213 bp, Glycine max
  Peptide Sequence Number=SeqID_171016
atggcattttggggagaaacaagcagtcaaaccattgtcaactctagtagaatgcacaatacccttcaactaaccgacgatcaatatttggatgaaatttactaccggcagccattcgcagatgcaggtcattttgagtattcagaaaaagttatcaaatttgaaattattgagctgaaaactgacgatgatgtgttgaaggtcttagtatag

SEQ ID NO: 79332 - DNA, 1062 bp, Glycine max
  Peptide Sequence Number=SeqID_171017
atgagacgtcgttgtaggcctccggccagtctacgacggtctccttccaccattttagaaacacacgattcctgcgacggggatgactggaggcccgtagttgcaggttcgccttcgaagacgttgccagcacgaggaacgacgttgaaaggtaagcttttaaggtcgggctatggcagcaccgatgtagtgtataacaatcaatgcttgaaaggtaaggtctactacgtcgttgaccggcaacgactgccattgaatggttggtcaactacgtcgttgctgttgaaagcaacgacgtcgaaaggaaccttgctacgtcgtttccaggggaggaacgtcgttgaatgcatggccttgacgtcgtgtctgggagaggaacgtcgtggaatgcatggctactacgccgtttcgcgaaggagaccgccgttgactgcatgggaaaagctacgtcgttgttgtcatataattagatttaacaggtatgatgatacaaatcctgaagcagaaaagaaagagtatattgatcacattgaagaaagtgttcagtggatgggttggaaaccattcaagattacttacacaagtgattacttccaagaattgtacgaattagcagtggagctcataaaaaagggtcatgcttatgttgatcatcaggtgtctacaatcaagtcattaataaaggatgttatggtgaggaggaagatcaattttatgtgcctacaagaaactaagtggacaggtgaaaatgcgaaagaattagacaactcgggatttaagttgtggtatacgggaaaaatcagatcaagaaatggggtagggattattgtggacaaggagtggaagaaggatgtcgtggatgtaagaagagtaggagatcgtatcatagtcttaaaattggtagtgggacaggacacctttaatgttattagtgggtacgcacctcaggttgggttagcagaacactttaaggtaaaattttgggaggatctagaaggggtacttcaggatataccccaaggagagaaagttttcctaagagggatctcaatggacatgtag

SEQ ID NO: 79333 - DNA, 309 bp, Glycine max
  Peptide Sequence Number=SeqID_171018
atggaagccagaccaaggccttgcaaaccacctccaccaccacaaaggaggagtgaccctgaaaatggaccatggacggggataaagaagaaatatccagaagaccctttttggaaggaaaaaaggatggcagaaattctaggttggaatcatccatctctgaagattcctgaagcacctataccttgcaagatgttttcttccacatcctatgatcaagagtttccatctcttaacagaaaaacagacccagtgacaatatcaaccaagccctacataattcctacggaagtagggccagaaggatag

SEQ ID NO: 79334 - DNA, 519 bp, Glycine max
  Peptide Sequence Number=SeqID_171019
atggttagaactaggggtcttggtcgaactttaggccaagcaataggaaaagtcctgggaaggagagaggctaatgacgatgataatgatgtccctagcgatgaaggcctaccacatctgcccgaacgtcctgaactgaagctatatcttcccatggaaggaagatggctaagttcgggaggcctactccagagattgagggccttgtggctgtcagcgaataagtcatttgatcacatgttccctagatatgggagatcgaggactaattttccaattcccgtcagagaggtcactatcaccttcgatgaagtcgcgtcattgttacattttcttatcgtaggggtgttccacagcttcgagcaacttcatgtcgacgacgttgtcgatatgttggtggaattactcgaggtcagctttgtagaggcaagagctgagacaattcaatgtcatggctcttatgttcgactatcatgcctacgagacgtgtatcaaacgaaaatcgaggcatgtcactag

SEQ ID NO: 79335 - DNA, 657 bp, Glycine max
  Peptide Sequence Number=SeqID_171020
atggaggagaaacaaaagaaacgattgaaggaagcagcccaatctgggagcactgacactattgttgatcctccatctcccattagacaacacgatgtactgactactgccattgggcgactagagcacccaggtcctatccatgctgctggagcctgtatcaccatcaaaaactactttggaccgacttcaaggggctcttccacctctttgtccatgtcgcaaatgcaatcacagggactcgcactatctcctgaggttaaggttggtccttttgctactcgtgtcagcacaaaggaaagttgtgccaatccctcagggcaggacccagaaactggagactcggacaaatgtggcttgtatgggtccatgactgtcaacaacattcctttgggcaatgatcaagtgaaggttggtgttgagcaagttcgagatgctgatgctcacgttcctatacccactcaagaggttcagttagtgaggcaaacacttaacatcttccttactttgtcgacacatcttgtaaagccttttttggaacatgataaacaggtagctaaaggatcggcgaaacctgtacatatgccggatcctgacgaagatcccctctacctaatgacattgaccatcctatatcttttcctcaagttgttgtag

SEQ ID NO: 79336 - DNA, 456 bp, Glycine max
  Peptide Sequence Number=SeqID_171021
atgatgaacaaaaagctcaagagaatcaaagaacatccatctcaagaaaatctagaacaagtcaaagagttgaagaatcaagaagaattcaagactcaagaagaaagcctacaaacaagaatcaagattcaagatctcaagaatcaagatcaagattcaagaatgaagaaaagactcaatcaagataaaggatacatctacttgggtttgactgagaacaagagagggtacatctcttgtggatcagttctagtggaggacacatccactaggttcaaagagaacaagggagggtacatcccttgtggatctttgcttgtaaaaggcctaggatcttcttcatcaatggattcctttacttcttggaagatgaatggcagcggaatggagaaggaagagagaaaggagacgccacttcaaggagaagatgagtctagaagaagctcaccaccatag

SEQ ID NO: 79337 - DNA, 222 bp, Glycine max
  Peptide Sequence Number=SeqID_171022
atgaatcgaaggcttgaggaggaccacaggcaatgcctaaaggaaattggtgttagcagtattttggtgcaaatgtttgaagaagaatttctaaattttcaaaacctcaaagaatatgcatcctctgacaatgatgagaagaaaggtcaatattctaagttctggaatgagtttggtaaatccattaaacttggtatcattgaggatgccaccaacagataa

SEQ ID NO: 79338 - DNA, 678 bp, Glycine max
  Peptide Sequence Number=SeqID_171023
atggacacgtgggtgtatttggacttgaagatcccaatggctttgttacccagggtgatatactttgttcacttgcttgaaaaatactattgtctgtcattcttgatcagtgtttctaagttgatttctctttcaggtagtgatgagcatcttgaaaggaagattctagatcctgagcgcttgagtagggagaagctagaggggtcatacaacagtggtggcaatcatgtttctaacagatttctaaacaacttttggtacttagatcaacttggaatagcatcctgctacaacactaaagtctattgcaggcagactttaattggagggaattatggccttctcaatgccaccacctttgctcccaatcctgactactacagtgcagttttgtggcatcggttaatgggaaagaaggttcttgcggtctcaagtgatgttcatattaaagacttttacctacagttagaaaatttaaaaagaaataatagtctattacctgggggatcaaagacagtggaagcttttgaaagtctttgtagagaggcccaaatatttctgcccgtgtcacattcaacccattttctcggaaagttctcatcacctctgctaaaagtccttgtcggtcttcgatgcataactcctccagcaatagctccaaaatttaagctaacatga

SEQ ID NO: 79339 - DNA, 423 bp, Glycine max
  Peptide Sequence Number=SeqID_171024
atgagcataaatggtcgtcccaagatcaaaggcacatctggatcttcttctatatccatgatgacaaaatccaccggaaatgtgaaatgccagaattttacaaaaacatctttgtcataccctaatttcgtctggggattattacttgatgacatgcaacctttgattggccgcttcaaaatacttggcaccctttgttgcacgatatctaagtcccgagacacgccggaaatcaaagggaagcaggtaaagggggtgcatttagtaaaaaggggggtacaaatagaaatcaggcccacttgggccttccagattcttcctccagaaggccgttgcttcgggaggaagcaaccttgctcgcctgggcgagctgagctcgcttgggtgagctgggtggcaagctcctcccctaatttgctataa

SEQ ID NO: 79340 - DNA, 318 bp, Glycine max
  Peptide Sequence Number=SeqID_171025
atgattggcgaaaggattcgcccttacattcgggctgtcctcttgaaatgtcaaccacctcgcatcaatccaactctggaccttgtgtttgaaggccacgcattgctctattggatgccctgggacacccccgtgataggcgcaagttgcattgaggttgtaccatcaagggaagggagattggtagatcttctcgggtttcaccaccaccatttggttgatgatcaaggatggattctttgctggaaaattccttcccgaattggtgcttgtgttagggttggcgttgccggcgggacgagattgggtgggaaataa

SEQ ID NO: 79341 - DNA, 339 bp, Glycine max
  Peptide Sequence Number=SeqID_171026
atggatgcggtttatggttggttagaatgcaaatattatggacaaatattatgtgctatagcagaaatttcaaacatccacaaccttaccttcaaaacacagccgtgttacgacaactctgaaaaggggtactcactggcttgcgcggtgccgccacaagacgagacgtcggatgaggtcacgggggtgcgggcaaatgccacaggtcacagcgagttcacggcgaggtcacagtacacagaaatttcagacaaacagggaagcgggagctcgagcgcgagtgttcatgaattagcgcgaacaacattatatacatcaatgttaacgatggtggcttaa

SEQ ID NO: 79342 - DNA, 348 bp, Glycine max
  Peptide Sequence Number=SeqID_171027
atgggtgcaaaggattcatcattcttgaacagggatcatcctgaggtatggagggggcatcctgggctggcaaagatgtatttggtgctggagtgggccagggatcctaggagctctgtgctgctgccatgtctacaacataatttgtatctgcagtgccgtctccctcctcaggtgcctgagatggtgtggcagcaggggcataagccatggtggaggctctacagcattggcactatctggtctgagctctgcatggaagtgtcgaagggtgctggagtaggtgttggtggtggtggagcgggagcagagagagcagaagaagaagtatcaggtcctcaatcctga

SEQ ID NO: 79343 - DNA, 264 bp, Glycine max
  Peptide Sequence Number=SeqID_171028
atgcctctgatgttgaataagcttgggctaagcgagtcaatcttgctaagcctaagatggcctctaggaagaggaaatcaaccgcctccagaccccaggagccctatgatacgaacagattcatctctgagggtgcttgggagagatacgagcagaacgttcactcctggaacatccttccgaagaggaatgctaacttattcattatggagtacgacgagttctgtagggagcttgaaaggaggcagtggcataaagccttga

SEQ ID NO: 79344 - DNA, 390 bp, Glycine max
  Peptide Sequence Number=SeqID_171029
atggctctcggcgacgatgcgcagcaccactctccctcgttcctcgatgcccttctctgcgaagagcgagaaaccttcgaggaagactttgatgaaaatggttatgagcgtgagaccgaaaacaacgaaccctctgtgataaagttgcaatctttgcccttggttttgcacaataatgacctattctgggaaggcaaagagcttgtgtcgttaactgcgaaagagggagagatccatttgtgttttcatggtgtcgttgctaatggggccttagaagggcctcgtgttgaggctgtgaactggatttcgaaagtttgtgggcactatggagttgttgcagaatctaacaggcatggatatcacattccaagggttatgggattgggttag

SEQ ID NO: 79345 - DNA, 741 bp, Glycine max
  Peptide Sequence Number=SeqID_171030
atgaggtcggacacaaatactggtgttagaggaaagacctcatttatgttaatagcttgcgaaaggagtggtgagtataggcctaagaagaaggatttgttaatttgtgggactcacaatcatgaaatgacaaagtcatttgttggacatccatatgtgagtcgactaactaaagatgagaagattgttgttgctgatatgacgaagttcatggctctacaacggtttccgaatcttttcatgaaagttgatgcattccttggggttattgttaccgacagagatttggctttgatgaatgcaatggaaactgtattcccggatgctacgaacatgttgtgtcggtttcaaattgacaagaatgtgaaggcaaagtgcaaaaccctgagttattttgatgagtaccttaagaactttgaaatggcttgctcttgtggcctatgtttgtcgattatgtgtgccaaacatgggtacactttaaatgaaattgctgctgagtgtgagtatgtagcttatacaggcaaaaacccttcacgctgtggatgtgtcatgaggactacccatggtcttccatgtgcatatcaaggattatgtgaggttgaggtgaccataattggggagatgaaaaccatatcgaaacgatttgagcagctcgatgtttgtggcaaagtacatttgaagataaagctttgggaaattacttatcttgatttgaactatatgggtcttcctctagaaaag

SEQ ID NO: 79346 - DNA, 447 bp, Glycine max
  Peptide Sequence Number=SeqID_171031
atggagatccttatactcatcttgcaacatccattgagatttgcaacacaatcaagcttgtgggagtgtcgaatgatgctaagcattggctcttttcattcaaaggaaatagcttgcatacttgggatgaggccacgtaccaatcaaatacttgatgattttgcgggcataaagatcgaattgaagactccagaggaagccacaaagcttattgaaaatatggcggctagtgatcatgtcataattcagaataggactcatggatgggtaactaagtggaaagtgttgtggtatcctcaacaaggcaagtttggcaagggttggtatggtttttgtagatggctagggctaaaggaaggtgatgaggtgatcttccacaagttccatggtgtgagcatggtctttatgttagtcaaaccaattgacatgttgtcaactatggagtga

SEQ ID NO: 79347 - DNA, 561 bp, Glycine max
  Peptide Sequence Number=SeqID_171032
atggaagaagtagagactaggacgaacctaaaaggtcttaaaaatggaaaaaaggaaagactaagagccaattggatgttgcaacacgcgaagctttgggatttcgagtggactcttggacttcgtacgctggctttgagaaaggtctttgttaagaggataggaggggagacctgcaaaacaaaggactctgacactcaagtatatgagttaggaaataaagcatgtatatgcataagtgtaagctcgagtgagcgtttgagggataatcagtgcgcaggcgtgtttgctcatatgttcgtgtgtgtgggatgtattgagggtttgatagaacttggtatttgtaggagggaagtggagctacaggagggtgacaagtttgtcaagccctcaagcatagacaagtgtttgtctgatgtcgggtgtggtaaccttggcaggctaagtctgatgtgtcaggtgagggaagtctttagatttgacaattctgcccttttttggccgttggagggtgcactgaagatagactttatgttctcttgcataggtgtcactcgttga

SEQ ID NO: 79348 - DNA, 2727 bp, Glycine max
  Peptide Sequence Number=SeqID_171033
atgtcttcatttttgtctgactccgccatcgacttgggtgacagtgattctgagggttcgattcaacaacccttgatggaccaagagatcatttccattagtggttcctccttggagaatactcgtcacggtgcctccaacaatgagtcctcctcctcggagaaggtagtggaaatgaagatgtcagggcatctccctacgtgtgatgtagctgggtcgccattgttcctacttgttgttgctggctatgagttgctagcaagccctgaggactcttgcaagatagtccttcaggcttgcaaaagtgataacttccctttcttaaaggcgatgtcgggtagtctgcccttcttctttatgcataagtgcttgtttgaggaccgtttcttcaaggtcctagacacaagtgtcgtggttgatggtttgcccctgatgctcaacaaggatagggagcctagcttcccattctactggcaggctgatcccaccaagtttaagtctcttgatgaagatctgttgaccctcatggagagggcccttttttcttttcacttagtgagcgatcccctcgctgccttggacagtattatgaatgactttgcttggaggccattcatgaaacaggttagacctacaagtgggactatgcctccgtctgttgctactttcgctgaagggggtcaacctgttgttgaggttggtcttgttgttgttggtattgctgagattgtccctagtgctccttcctctatattggctaagaggaagcgggacgatagtgttgggttgtttggccgcaaaaagtcgatggctccttcgagccttcgtcccctaaggcaacctacagggttgaggcctggtgtgggtcgcctttcagttgtgcaagatatgcctccgactccaccagttgtcgaggctcctactgctaatgtcgttgttgttgttgtcgctcttattgcttctaaagtgagtgcaccaactgctctggctggttctactatggcaccctcgtccaccgtcgttgcacttttattgagtgtcgatgtggtgaccaccagttcccctgtggcacctcctccttcctcttcggctctaatagtcccttcctccacctcctctcagccccgtgtttcactggatcacatctacacttccaatgatgttgatttcttgttaggcatgggggtgactgcttgcactgtctggagagtggagcgtcctaaggtagttggtgccactattgcttttgttaaggctgtgaggtcgaaccaccaactatcttttaaagttggtagtgtgttggccaagttgttgcacactaggttggatgaattgttcaaacgttgcaaggacttgcaggaagagaaaaataacttggctggtagggtagaggatgttgtagcagagaaaggtaagcttgctaagaaggtggcggatcttgaggcccgggcgaaggagtcagagtccatgctaaaggagaccgagctacaggctactgcagagagggaggctatcaagaagcttgaagatgagttgctaattttcaagagggaggccatggagcaccatgaaaagggcttcaacaaggtcgaccttgacttgggtctctttgaccctttcaaggacgtgaaggatggtgttttgcttgacgaatacgatattgccgctgaaaaggaggccgacaaggaggagcagggtattatggggcaaggccatattgaggataaatgtggaatctttaacagtgtaggaagtcttgtcacccatctagtggggcttccttctgctttgcggagcttctcccctgatgcttgtgaggagtatgtcttgtcactcaatctaatgatgggtggttttgacctgcaaagcctctcctctgatggtaatgaggaccttggaatggggacatatcctcccctgcgttttgaaatgcctgtagagctgtgtcgaggcttaccaagggtgggccttggattttgtgaacttgtgaggatcaccaagtgcagagcttgggacagaccaagcgtgaaccttgggttttatgagccctttggaggatcgactagggaattgtctaacttgggttttaggcgccgtgctcttgcatacatgtcactcatcgtggatggcatgtactggagacttaatggcgtgctcttgcatacatgtcactcgctgtgggtggcatgtattggagacttagtggcttgttgtgaccctgaatgggccttcccagttgggctttcccactcagagatcttttctgatttcacctcagactcgccatacaagcagtctccttgtggatggtttctcgactttaatagggatcatggcatctatgtcgtaagtgagtcgggccctgaggatgactctattacctgcctcttcctaacagttggtctaaggatgttcaatagaggcgtatgggaggccgtacctgcatataaggtgtttctagggcctttggcagtggtcctagtatgtccattccccacatggaagggagctcagactgtggagtttgtcaggaggggtgcatggaatgtctgcaaactcttggcattacctgcatctctttgtgaagtcaagggtgtttgccctaagtgttggccagtattagccagcgcacaccacctttgttgcaagggagcgtcctcttgtgtggagaccacaaattccttcatggagttctctcatgacataatctatttattggttgtttag

SEQ ID NO: 79349 - DNA, 234 bp, Glycine max
  Peptide Sequence Number=SeqID_171034
atgccagctggtctacaccatcttgacccagggatcacgcctccaagacacccagtggacccggaaaagtccaacagagcattgggatttcagaccttgatcacaggtctttgctatggaagcaaagctttccaagtttattttgatgatgccaaagacttaagtcaagaatcaagagtcaaacaagtttcaagaatcaaagagtcattcaaacaagaatcaagattcaagtaa

SEQ ID NO: 79350 - DNA, 192 bp, Glycine max
  Peptide Sequence Number=SeqID_171035
atggaactatacccgcagcatgtggctaaccagcaggcggccaatcataggggccatttaggggccacaattgcatggcctggagatagacccagttttcaggcaggggcaagacccacatgggtcccaggagatgaagatggagctcaggaagatgatgacatggccgatgtgatggacttcttcctttga

SEQ ID NO: 79351 - DNA, 432 bp, Glycine max
  Peptide Sequence Number=SeqID_171036
atggatgtgaagaaaattgtggttgctgtcgaagatgtggatgcagctagaactgctctacaatgggctcttagaaacatcattcgctatggtgacataatcacccttctccatgtctatcatcactccacaagatcaaaaagcaaagcacgtcttctacgcctaaatggcttcaaattagccctctcctttcaagacatgtgcaacaactaccccaacacaaaggttgaaattattgtcacggaaggggaccaagaaggagccaagatcgcagccacggtgcgagagattggagcttccatgcttgtggttggactccatgatagtagttttctatacaatacttattacatagttgtgagttgtgatggatggatgatgacataccttaataatgttatatgggtcctccctctcagtccctctccatag

SEQ ID NO: 79352 - DNA, 1920 bp, Glycine max
  Peptide Sequence Number=SeqID_171037
caacatttccacactgttatcacagccatccccacccgccttcctcccatggacgggcgacgcgcctcgcgggcctctgcggccgaccccaaagtgaggcgcatcggcttcttcgccccgcagtccgaacccgacccgacgccgccgcctccaaacttcgtctcggttcctccgctgcgtcatctctccgctgccgtgcccgtccccgacaccgggattcggcgccagttgtccggcgacctcgtgccaattggaagctacaaccccgccgagtcgctgctcgggacctcgccggcggcgtcttcgctctcttcaagcatagttggcgtcggcgacaaggagttctccgaagactcttccgccgccggctggtaccgtcgcggcgactcggattttaccggcgtagggtttgacttgccggtagtgaagcctcctggaaattcgccggcggtgaatgcgaaaaacgttgccggagtatggaactacgcttgtagtcgcgatattgtggtttctagggtttctgcacattgcgatttagttaaccattgttgtgatgctatgatgcgtatattgtctgtgtttatgcttttagttgtcctacatccagctgatggaaacacaacagttgctgaaactaggagggcagcccccagtaaaagaatgtggcagtcttcacaaaagaaagatggtcctcttgttatgtcaccagtggctactgacaagaaatcaggagatcgtcctttggagaaagagaggaaaaaagatgctcctcctccacgaatgcaatttgatgataaaaacagagtggaaaaggccaaaaggcgtgctgtagttgatcagaatgaagctagaaacagagttgaattatttcgccatttgcctcaatatgaacgttggactcagcttcctaaacttgaatcaaagtttttccaactggattcagtgcatcctgctgtgttcaaggttggaatgcgttatttggcaggagatatatctgggagtaatgcccgatgtattgaaatgcttagagcatttcaggaagccattatagactactccacaccgcctgggaaagtccttgtcagggatttaactgcaaaaatcagtagttatgtttcattttttagtgaatgcagaccactttctattagcatgggaaatgcaattaggtttgtaaagagttgtgttgccaagttgcctttaagtcatactgaatctgaagcaaaagcagctctttgttcagatattaatcaattcatcaacgaaaaaataattcttgctgataaggtgattgttggacatgctgcttcgaaagttagggatggagacgttcttcttacatatggatcatcatgtgttgttgagatgattcttttatatgcccatgatcttgggaaacagttccgtgttgtggtggtagactcacgaccaaagtttgaaagccgggccttacttcgtagactggtggctaggggcctgagttgtacatatacccatataaatgctgtttcttatgtcatgcatgaggtcacacgagtttttcttggagcatcttccattctgtgtaatggaactgcatatgcaaaggttgggactgcatgtgttgcaatggtagctcatacatttcgtgttcctgtattgatctgttgtgaagcttataagtttcatgaaagggtgcaacttgattcaatatgttctaatgaactaggtgacccagatgctgttgccgtggttcctggaagaatggatgtcaattatctggacaattggactaatcaagacaatttgcagcttctgaatttgttctatgatgctactccttcagattatgtatcggccattgttacagaccatggaatgatccctcctacaagtgtggccgtaattgtgcgcgagtatggacgagagcacttgatctag

SEQ ID NO: 79353 - DNA, 2052 bp, Glycine max
  Peptide Sequence Number=SeqID_171038
atggcgagtgcctctttttctaggcaacattgcgagatatttttgttcttcttggaatcaaacataaaatcaaggtctcagaaccacatgataatcaaagtgagcttcattgttgcagcttcgattgctgcactcaagatttcgcagacaaaaaccagctcttccaccaagagaaatggaagtgatgggtcacacttggaacaagagtttgaagagagggaaaatagcactgttaatgctaatcatgtgatacaggtaaatgaagagaaggagattaaatttgaaatgccacagaatctgccaacaggagaatttaaggacttggagctgttaatagatagtgagaaaatgcacaatgctactaaaaaggaggtattgcagaatttggtacaaaattacaagcagagagaagtaaaccttgaaaggaagcttcttaaattgaatagtctgagggaagagcaatcagccattgctcaaatgcaaaaacaattagaggaaaagacagagactgtggagattcttaaaaagaccattggttccttgcagtcagagagtgaagtttttcgagaaaaaataagagaggatctaatgttaaaaaagcagctagatattgcaaagaaaatgatgaatgagatgcataggaaaaaggatgttaatgcaagccctgtgagggagcagatattgatgctccaacagcaagtagctgaatttcggaagtttaatagttcaggtggaaatgctatgggaaataagaaacttaaagatgtccaagacatgatggttaaagttttggaactaaagaggaggaacaaagagcttgaattggaaaagagggagcttgtaattaagttggctactgcacaagcaagaatcagaacagagctgaatggttctttgagggcaagtcctggcacaacagtaaagttgtgccttggtaaccgattagtcgtgggttcgaattcagaaacagcctctttgcatatgcaaggcaaggctgcttacaatgacctttccccatacctttgcatagaggaaatagggccccggataaaacaagaaattactggcttaaggcatgtgcatgaagaactttcagagcaagttgaaagattgcagagaaacagatttgacatggtccaggaagttgtgtaccaacggtggctttacacattgttgaaatttgaagtgcatgatcatcaaaaacaaagtagaaaggcctcaagaagagatagcattaggagccagaattcaagcaaagaactgtgtgggaaaaagcatgcatcaatatctgatcttgagcttgaaagcgtctcttccaattccacatcgaacgaaaacgatgaaattgaaactaatacctttgaaagctcttccagtagccaaagtagcagtggcagcacgaaactgaagagatggaggacaaccaaagactactctaacaaaatttggtcaaagggtagaaatttttttatccaacctggtccgatacaaagattttctatgtcaatggttgaatcagatgtttctaagttagaaagcccaataacgccaaaaattaaaagagtttctttcagcgattctgtcaaactctctacttatgaagatatgccagagacaactactgaggatgcaattgatgacaaaggaacaaagtctgagcagatcatggagctgacttcaagtgttgtgaactctatcaacattgattgcattgaaaaaaatgaaggtgccaagaataaaattggtcatttgggtgaagtgtattcaagtgttgtgagctccaccaacattgattccattgaaaagaatgaaggttccaagaataaaattggtcattcgggtgaagtgtattccagtggtgtgagctccaccaacattgattccattgaaaagaatgaaggtgccaagaataaaattggtcattcagatgaagtgtattcaaggaatggaaccatttctagaaaggatgacaggatcaaaactatactagtgcagctgcacttcactcctcaattcagtgtttggattatatttaggaactcagcgatttag

SEQ ID NO: 79354 - DNA, 357 bp, Glycine max
  Peptide Sequence Number=SeqID_171039
atggggttgcacgtgcaagatggtgtggtaagggtgagtgtggaaaaagtttatgatggtgacgctcaagtcctgttgttggcgtcaaaggattcacagattcatccaaagaaactcgttgaacctgttgaaaggtcgaatatcattgttggagatgatcccttgggtgatttgattatgaacctgttcatggatgagtggagtacaaggttaggtcatggttcggtgtatggattccttaagcctcagtccatacacaatgcaaaggatagacatgttgaatgccaacattacattgaaacatgggtcaaggaatcacaacaagaggtctacctaggagcttacttgaatcaataa

SEQ ID NO: 79355 - DNA, 1530 bp, Glycine max
  Peptide Sequence Number=SeqID_171040
atgtatagtgctgctacagctgctacagttgatgttcagctgactggaaaagagggagaagaaaagatatatgatgtggttaggtacagaatacatcgcatgaaaaagctgctgaaagatgaattggacaacaagaacacaattgaggaatatatctgtacaaaatgtggaaaaagatataatgctctggatgcattgcgattagtatcttttgaagatgatgacttccattgtgaaagttgtaatggaaaacttgaggtagaaaatgacaaatttgttgctcaagaagggggtgatggagatgaaaatgcaagaagacggcgccatgaaaagttaaaagacatgcttcagaagatggagtcatggttatcactgccatttgctagaactgagaaatttgtgtcattactcatttgggcttataggggacctaggtattatgggatgctcgatggagtatttaagtacttgggcaacctgaggaagattttgaccgatggaggggcagtgctatgtttgggacctaggtattatgggatgcctaagtctcttgtcgagttgggatgcttgatggagtattatggggtgcctaagtcccacatcgagttgggatgctcgatggagtatttaagtgcttggccacttgtgtttatcatgatccaggcgagtagccttgagcacgaggggggggagtgttggaaagccaccttaattgcggcacagctgaagcctttgatggaccaactcagccgggtgaaagatttgcctgttccagaatttggcagtcttctagcgtgggaagctcgagctagtgctatggggcgtgcagccaacggagatatgtctggtgattctaaaatgtctcagcttggatataatggagcaccaatgccttatagtggagatactaaggttgtggtggacttcaatgggactgaagacataaaggatgttaagtctgaaactggaagtgcatctctaaaggttttgccaccatggatgattaaatcagggatggttcttacaaaggaacaacgtggagaggcgaaggaggaaataaagatggatgggacttcaacttcctcatcagcacagtacttggacgacaagaaatcaacagatgagtatattaaagcttattatgctgctttgcttaaacaacaacatgaattggaagctgctagtaaacaagaattgccaaatacactcactgcaaatgatccttctagcagtgcttctaatcgtcaagttggcatgaaatcaaaacttgaggaagatgatgatggtactgaatgggaggaggctccagttgcagttatcaaagtgacattgccagttgcaacattggcatggtgtaatggcaatgatggctatggtggcaagacagttgtagtggtagctacggatgatgattgcagtagagttgacaacaactgtattggaaatgaaaattacaaggtcgatttgaatgttgaagctgatgatactccagctgatgacgatgaagaagtggactgggaggaaggttga

SEQ ID NO: 79356 - DNA, 456 bp, Glycine max
  Peptide Sequence Number=SeqID_171041
gatcttcttcatcaatggattcctttgtttcttggaagatgtatggcagcggaatggagaaggaagagagagaggagatgccacttcaaggagaagatgagtctagaagaagttcaccaccatatgaggccatggataagagcttggaggaagaaggagatgaatgaagggagagggagagaagagcacaaaattttgtgctctaaaagagctctgaaatctgaagttaatattcaaatgatcaaagttcttctatccaatgcccttggggggactaaccgcctaagaattctttgtcccaacacattcgagggtacatcctttgtgggtacatccacttggtttttcaaagagaacaagggagggtacatcccttgtggatctttggcttgtaaaggattttacaaggttgaaagaaatctcaagaaccgcaggttgcttggggactggatgtag

SEQ ID NO: 79357 - DNA, 747 bp, Glycine max
  Peptide Sequence Number=SeqID_171042
atggagaaggatgaaggcccagaggcagagacactaccaagactattaattacttatcaaggtaattcttgtggcgtctaccctgacttatcttccttcactggaagtggcgtcatccaaatctccatagcctgtatcaaacgatccgctcctactcaggttcacatcacattagggtgtgacatgtttaactccgttcctgaatttggacatttcttccatctagatgcagcctttggctcgtttgcgcaactcgtccatgctactgggggggttttgtacagactgttcgtgaacttgtcgggtcatagggcgaggagcatggaatgcaatgctacctctggaggtcatgcgatgagacctgctggttacgtactatgcactgaagcattcgacgagggtttcgaagctgtctatggatcttggtgggagttcattgtactaggtcaatgcctcccccttatgggcattgggaagacacgacatatgatcccatcatcattgcctaaggatatgatagcttccatgatgtggttgacaaagagaagtcgacgagtagtccgacctgcaatgtgtgagcatatagctcgttgccctggggacgtctggcatgagccttcaaccgatcatggtgagcctttagctttctcagctcctcctcatgacgttgcttcatctccgcaatggttaaagcctttgaaatggggtttcgcgtctgaggccagaccaagtgctaaccatggatga

SEQ ID NO: 79358 - DNA, 423 bp, Glycine max
  Peptide Sequence Number=SeqID_171043
atggaggtactcatcaggctagccccgacgaagcctcccaggctggggttagccaagaccaaatacttccagtaccgtcacggtattggtcataacatagaaaactattggaccctaaaggacaagattgaagagcttatacaagatgggtacttagcccaatttgtcaaaaggttgaacagccaccaagcagaagcaagacctgaaggacaacaagagaagaagacacttaacgagcttggagccatagtctccataccgtatttgaaaatgaaattccctaacctgattagggagattgtaaccgtcaagggagaccaaaagcaagcacgacaaagctatgtaaagagcctaaatgtagcaccctatcctttcaccagggagcttgccaagcatcaccccacagtgattgaaggtacttaa

SEQ ID NO: 79359 - DNA, 345 bp, Glycine max
  Peptide Sequence Number=SeqID_171044
gcggaatttgatatcctagaggcttctgacagtaggacaaaaaggaagttactacagaccgtgggggagagatggaggcagtttaaatcaggcctcacaaggaaatgggcccttgcagccgatcaggacggtgtcgaggacattgtctgtgagaaatacgacatcagcaaggaaaagtgggcccagttttgccagactcgtagagacccttcttgggagcatgaaggcacaagccatccagaagtagaatactgcccccacgttttgtctcgtgggggttatgattatttggagcagaagctcctggctgggaagacgaagaataagctggaggaagctgcatag

SEQ ID NO: 79360 - DNA, 1170 bp, Glycine max
  Peptide Sequence Number=SeqID_171045
atgatgatgatgctgttgttcaatagtaggtggagggtgaagggaagaagtgcattttactactacaatagcagaccctttttcattgactctgaaagcaacccaacatcaaaacaagaaaacaataacaacaactgtgaccttgttccttctcctcctcctcctttgtcctttttccactttccttctccaacctttgaagatactcaaaatcaaattttcctcgaacaacgccacgattttctccttcagttttaccatcaacctctgcctcaagaccccgagcctcaacctgttattaccaccatggatctttctgttaaaaagagtgatcagatccaaagaaaaagagtacctggcaagagagataggcacagcaagatcaacactgcaagagggttgagagatcggagaatgagactttcccttgaagttgcaaagaggttttttggccttcaagatatgctgaactttgacaaagcaagcaagactgtggagtggttactgaaccaagcaaaagttgaaatcaatcgactagtgaaagagaaacagaagcagcagcagcagaagaagaaggaggagaatgatcatcattattatcaaagttgtagcagtgctagttcggaatgtgatcaagaaggtgtgtcttgtcttgatgaggttgtggtgagtggagatcaagaacaacaacaagagagggtcgaaaaagttgtgaagagaaaggtcaaaaactctagaaaaatcagtgcatttgaccctcttgcaaaagagtgtagggaaagggcaagagaaagggcaagagagagaacaagagaaaagatgagaaatcgtggagtgctagctgaagaatcaaagcaatgtggagaggaaacaaatcaggatctgatccaattgggttcttggaacccctttgaaacaggagatcaagaatctgcaggtgccaagagaactactactcacagtgttgctgagcatccttcttccttggacgtgattactattgaggctaaagaacaaagctaccacgcagcaaaggagcatgatgatgatgatgacgattctttggttgttttgagcaaatggagcccctccttgattttcaataactatggattctctcaagataaatttaacggagtaaggtaccttccagttctacgaatctggtaa

SEQ ID NO: 79361 - DNA, 1500 bp, Glycine max
  Peptide Sequence Number=SeqID_171046
atggttagaactagaggtttaggtcatgcattaggtagggttataggcagagccttgggtagacatgatgatcatcatgcagatgatgttccccaacggcgtaggcctaccgcatccgcacgtaggcaacaggtagttgcccctgttgctgaggatgttcctgagatgactgaggatgttcctgagatgagtacggacgtacctgcacctggtgcagagggcttagctagtgatggtgttgagggatcagctgatgatgatgctgagggattcccaggtgggccacgtgacccatcaatgctaacttcatttgctgagcatgttgcatatagcatatggagtagagaggaatttcctgaattgaagttggtctcccacggaaggaaggttgagaaatttgggaggccagtgcctgagattgaagggtcagtcgctgccataggattaactactttgatcgcgagttcagtagtcatcagcgatccgggagttatatatgcttttgtcgagaggtggcacaaggagactagcagcttccatcttccagtaggagagcaaaccatcacactggatgatgtggcgtcactcctcaatctgccgatcacaagcgccttccacagctttgagcctctacttgtggacgaggcggtcatcatgttggtggagttgcttgaggtgtcgggtgaggaggctagagctaagaatgtatggtgtcatggggcatatgtacgtctgtcgtggctacaggatatccatcaaacgagatgcgagacccaacagtggatttttgtagctcgtgcttatctgctacacttgtgttggatatatgagcactttcccagtgtgcataattgcgtcactgatgatggcttcgatgagatgtccccacgtgcctgccgatggcttactacgaaggcttatatgaagggactaatagcatcgccgtatcggacacgtatagatgctttgtcgatcactgacatgtgcttgatgccttatggtgaccaccgaggagttagggcatttaacctcatttcatgcttccagggtcagcttagatggggtcctattgtgaccatccctccactgcctattagtgccaccttgtcatatgatgatatcgacgacagatggatgcactactcggaccatctagcagtttcgggtcagatttgtcttgtgcctgagcaggtttcaggagattacatggagtggttcttccggatatctcatccgttcatgacacccacacaagtaggtgatcagccaagacatccacctgtcccacaacatgaggcatatgtggagctagatatcccggaggatgcttgtgaagggatcacagaaaggttggagtgtgtgctcaacctaaggatagtcactgaaggcacagagttacatgagatcatgaaagactgcctcaggatcattaggggtgtcacctcagatggaaatgtgtatgttagggcgcgacaaagacggtgcatagatcattcatag

SEQ ID NO: 79362 - DNA, 267 bp, Glycine max
  Peptide Sequence Number=SeqID_171047
atggcgttagggttgttaatacggaagaacttcttccgtatgaagattgattcaaggtgttttggtgataacaaagatgatgacaaaaagcccatgagaatgatttcaagattgagtcaagaacaattcaagaatcaagagaaagattcaagagaagtttcaagttttcaagaatcaagaatcaagaacaatcaagatcaagattcaagaatcaagaaaaggctcaatcaagataagtacaaaaaagtttttcaaaacattgagtag

SEQ ID NO: 79363 - DNA, 1785 bp, Glycine max
  Peptide Sequence Number=SeqID_171048
atgagtaggtctccttcgttttcagtgagaacagaagtgagtccgagtgttgattcagaatcattgcaacaatgggttgttgccttttgtgctataaggtttgatcttgaacagggccagcttgtggaagagtgttatccacatgggtgtttttcccatgatgaggagcttgaaattgcttatagttcctttcctgattccgtttcgcagcaccaaaaccagaaccgatccagcattcatgattgtatcttctttttccgaattctcaggcaccttaagaagtccttagatgaaaagggtgttgctgatagtagcaatgcttctaaattcttgtatggttatgtgtttaataggcagagacatgacgagcggttaaagcgtggtggggagcagaagtccgtggtcattttgtcttatagtccttattcaagtgtgtttagacctttgctgcaaattgtaggtcctttgttttttgacattggtaagaaagcattggagcatattgctgcttatgtttcaaaatggcctgctcctgttcctggtaaggtgatggatcttcctattggaaatgcaacccttaaagtgaatttgccaccagctcacagttttcctgtagaaggtggagtgtcttttgaagagggtgcttcttctgtggcaccttttctgcctaatagtcagcctgtcccacaaggtctttttcatgattcagatatttttggttcgttccgagggattctattgcagctttggcttttgtgggagttgttactcattggtgaaccaatgctcatcattgcccccacacctccccaatgttgtgaggccgtggctagtcttgtgagtttggtcgctccattgctttgcagtgttgatttccgtccttattttaccattcatgacccagtgtttgcacgtttaaactcagtgcaagaaggcgaagctttccccccgatgattttaggggtgacaaacgtgttcttcctcaaagcactgcgtaacatcccgcacattgtctcagttggaagtccttctcctaattcaaacaggcttgcccttacaactaggtcttctactggcagagtttctggccgaccagaaggtattgggtttcaacaactaaagaagttctctccttcaagtttattgagtgcggttaggatgcggagagatggtcctctttgtctgatgacagaacataaggaagctatatggagtacatattctgcgacaactaagccagatacttctatcttaaataggcttatagatgctggggtgtcaccaagagttgaggagtcaatgtctgttgtgaacaatgagatattacggagacacttcttggagctcatgacaaactttttggctccttttagcccatactttaggacttcaacaccatcagaaggatcttctccttatgtagatcctccttctctacctccattcaatgccgatgaatttctttcaagtttatcagcaagaggtccaggaaagtttatattaaagcgaatgaaatctaactggcttgacttatacaggcgattcctgaatggacccaactttatgccatggtttcagagaaggcgtgctgttgctgaacaagaacaagatagattatggagactagcaagaatgaaaaccgacatacaacagcttatttctagactgcctgaattggaaattgtggattccttcagtgtcatagaaagacttctcctcagagaaatacagactgttccttttgctgagagaaactgtaacattattgtatctgtggaaccatga

SEQ ID NO: 79364 - DNA, 846 bp, Glycine max
  Peptide Sequence Number=SeqID_171049
atggttcataagtattgctttgaagcattagataaaacactgaatgacatcatgcgtatgtctaattccgacaatgctccatttggtggcaaagttgttgtatttggaggcaatttaaggaaaattcttcctatcatacctagaggaagtagatcagacataatgcatgctactaaaaatgcctcatatttgtgggactattgcacagttttaaaactgacaaaaaatgttggtgatgggaaacaaggcaaaggtcatgatgggtgttatgggatagaacttccatctgattttttaataacaaacttcactgattctattaaagcaattgtcagccatacctacccagatatccagaagaagtataaagatgagaaatttctcaaatccaaagctatactagctgcaacaaatgagttcatagaccacattaatgactatatattaaacattatcccaggtgaagagaaagaatatttcaattgtgattcaattgacataacagatgttgcagcaactgaatgttatgaagcagttacaccagagtttctacattcattgaagatatctagaatacctaatcatataattaggttgaaaacaaacacacatattatgttgattcagaatttagatcaagctgaaggcctatgcaacgagacaagactaattatctctagaatgaccaaccatgttattgaggcacgaataatttttgaaaaaaaatataggaagtttggtttatattccacaaatgccattatcaccatctcaatctccttggcctttcaagatgacgagaagacaattcctatttatagtgtcatatgccatgataatcaataa

SEQ ID NO: 79365 - DNA, 366 bp, Glycine max
  Peptide Sequence Number=SeqID_171050
atggggaatgaagatttggctatgctggagaatttgtcgtgggatgctacacaaaagactcaaaaggaccatgatgggatcgtgattcctattagtgatgaaaacccatggaaaaacaggttgctagtcaaggtgctaggtgcatgggtgaatttccgcataattgaggcaaaacttcaacgaagctggacaaagaatgacaccattcagattattgatgtgcaagatgggtactaccaggtgatctttactagtgcagatgactacaaatttgcatttccaaagatggaggccgttcttcttaatgcaagcggaggagacaaagaaggtagctgtatggattcgtatacccaggctaccaattga

SEQ ID NO: 79366 - DNA, 339 bp, Glycine max
  Peptide Sequence Number=SeqID_171051
atggtggcccctggcataaaagttggtcattcaactttcatgcaatatgtctggagaagaaagaagatgatcaaagtggtgcagtacgtggtaaaggagaatgttcattggaaaagcaaaagtgcaagaaaacagaaaaagaaggataactcttcaaaggaccagaaagaatcacaagaccagtctgatagcatggatgttggaagtaggacttttgaaactgttggcatagagaaggcagaggatgtgtctgccattgatgttaaagagcagcttaagaaagtcgcttctatgaagaagaaaggagatggatgctgctgcacgagcagctatgaatga

SEQ ID NO: 79367 - DNA, 1386 bp, Glycine max
  Peptide Sequence Number=SeqID_171052
atggctcctccatgggttcaagagctccatctcaatcacctgagcattcctataaccattgctaaaatgatttctgtcatgccatcaaggcctattcctgttaaaccaggtgacactttatacctttccaacctcgatgacatgatcggagctcgtgtttttacgcctacggtgtacttctatcaatctgataacacaagtttctccgaaaaacctgtcacgaaaacactgcagtgtgctctggccgatgttctggtgccttattaccctctctcaggcaggctcagagagaccaagaatggtaaactagaagtgtttttcggaccagatcaaggagcactcatcgtcgaggcgcggtctgatatcgccttggctgaattaggagacctcacagctccaaacccagattgggagccgttgatcttcaagtttcccgacgaagaacaatacaaagtccttgaaatgccactggtcattgctcaggttacccttttccgctgtggtggatttagccttggtttgaggctgtgtcattgcatctgtgatggcatgggagctatgcagttcctaggtgcatgggctgccactgcaagaacaggaacactagtaacagatcctgagccatgttgggatagggaaatttttaagcctcgtgaccctcctgaggtgaaatttccccacatggagtttatgacaattgaagagggatccaacctgaccatgtcactatggcaaaccaagcctgttcaaaagtgttacaggatcaagcgcgagttccagaaccgcgtgaaggatcttgctcagccatatgatgctgcaggctgcaccacttttgatgccatggcagctcatatttggagatcctgggtgaaagctcttgatgtaaggccactagactaccaacttaggctaacattttcggtcaatgctcggcagaagcttcaaaaccctccactgagagaagggttttatggaaatgtggtgtgtgttgcttgcacagcaagcagtgtctcagagcttgtgcatggaaagctcccacagactacccttttggtccgcaaggcgagacagagtgtctcggaggagtatttgagatccacagtggattttgttgaagtagataggccaaggcagcttgagtttggtggtaaactaaccataactcaatggactaggttctcaatttacaagtgtgctgattttgggtggggtaagccactctatgctggtcccatagatttaacaccaacacctcaagtttgtgtgtttctacctgaaggggaagctgattgtacttgtggttctatgattgtgtgcatatgcttgcctgagtctgctgcacagaagttcacacaagccttgcagttgctcgattcggtttcttga

SEQ ID NO: 79368 - DNA, 921 bp, Glycine max
  Peptide Sequence Number=SeqID_171053
atgtgtgctcaacgcgagaagtccaacctggaggaacacatgccaaacatctggtcatttctcaagccatttgagcctccatgtgcgctcaacgcacacatgcaagctcttgttttaatcattgggaaatgttttaacgctaaaaacttgaaggaacttctaagtaacccatatctagggatgaaatggtgttggtcagccttatttatgcatttttctaagggattaggagtgaaatcaagtgagttaggctctttcacacgagggatcatgctcaaaacaagattcttgctaaacaacttaaaccctcatggtcacactcaacaagcatccacgaccattgcattcctttcagccaactcaatcttccactatgcttatgaatggttcaagatgaggcatctatggaggtcaattacatggcaaaccaaaaccgtcaagactatcatcaaggaggcaatcatcaaggtggtaacttttctcaaaatcaaaggtcaagggtgcaaatctctttcgaggaacaaattcaacaaagatcaaggggttccatcctatcgacctcccaaccaaggcctaaatttatatgagagaactactaagcttgaggacaccttgacacaatttatgcaagtctccatctcaaaccacaaaagcaccgaatcggcaatcaaaaaacttgaaatgcaagtgggccaactttcaaagcaacccgcagagaagtccaatgggaaatttgtagctaacacagagcaaaaccccaaagagcaatgtaaagaggtgcttacaagaagcaagaggatgaagggccttgtttctgatgagttagtggagggtatagtagaagatgtgagtgatgatgatgaagttgaggagagagagagaaaaagggctgagaataaagagaaaaaaaataagtcttga

SEQ ID NO: 79369 - DNA, 336 bp, Glycine max
  Peptide Sequence Number=SeqID_171054
atggctccaaagaagctcctatctaagagagcaaggaaagatgccgctggagaaggatccagtgcggccccgcaagtggatatgaaatttgatggacaccggttccaaagtgaggaacaccaacaccattttgaagcaatcaagggtttgtctttcctcaaggagagacgggtccagttgagggaagaagaatttgttgagttccaggaggaaattgacaagaggcagtggactcaacttgcagtgcccatggctaagtatgatccagaaatattcatggagttctacgtcaatacatggcccatggaggagggagtcagggacaagtgctactag

SEQ ID NO: 79370 - DNA, 336 bp, Glycine max
  Peptide Sequence Number=SeqID_171055
atgtggtatattgtgagagattttaatgatgttaaatgtgaggatgaaagaaagggtggtttggagcattcaagacaagaggagatccaggcgtttgaagagttaatggaggaagctaaagctatgaattcatctattgttggaatgaggttcacttgttatcgggatgatggatcgacaagaggaagagacattcatgactcaagtgttagcgccttagcaaccttagcacttgagggattgtggatcgttctccctcacagggaggccaacttagtacacaaggacagacaagagaaggatgcacgaagcgacattaccttaagggcaacctaa

SEQ ID NO: 79371 - DNA, 372 bp, Glycine max
  Peptide Sequence Number=SeqID_171056
atggtgcaaaataggaattctttcccatacggcttaccccctaactatacaccacccaatgtagtgcacgtgcccaacgagaatgccaaccactccgttctcattccccttgatggccagcaaccccagttggggcatgcaccctttgctcagcctgtgggggaagcccgtgaagagcctcgagatcatgctctgggtgagtttgaaccataccctacgtatgccgctgagggaccaacgtttagtgaaatggagaagttggatctcataaaggagatgttgagggccatcgaagggatcggtgattatccatttaccaacatggcggagctatgcttagtgcctgacgtcattatccctccaaagttcaag

SEQ ID NO: 79372 - DNA, 240 bp, Glycine max
  Peptide Sequence Number=SeqID_171057
atgaatgagaccttggatgttagcatttcgtttctaaacgaccatttagaggaaacactgggtccaacaaaaatagaagaaaatcactcaaagtgtatcaatctcacacaggtttatggtaagttgggattttggctcaaggcttgtagaacggctggacatgatatatgtcagggtttggccagcggtttggggataaaggggatgttccacattatttccatgatacacatgcaataa

SEQ ID NO: 79373 - DNA, 462 bp, Glycine max
  Peptide Sequence Number=SeqID_171058
atggtgttggacgtgcaacaacgacgacatcatggcgtggtgtttatggtgatcgctaaccaccagagaaagaacaacaagagaaagggaaggcgagaaagaaatctattggaatcaaggtggtggggccataacatcgaaacagtggtggtggagatattgagaagaggggctatgcagatcttactcataactcacagatctttcattggaacgccactcgccgatgcaaaacaaccagcgaacgagaataccaagagtgaacttgttggggtggcatcctttttggtgcattttatcaaacaattcaagtgtgtggttgaaggcgtgagatttgcaaagggaattgatgaggagggccttgtcgatgtgaccctgttgggagaggacttagacatgaaagtgatggagttcatggtgcatgttggcgctggcgagcatgcaggttgtgatggtgactag

SEQ ID NO: 79374 - DNA, 399 bp, Glycine max
  Peptide Sequence Number=SeqID_171059
atggagaaccttcgaaaggagaatgccaccttcaaggagcagtacctaaagcttcaggaagaccaaaacgcaaatttggattacgaaggcacaactcccacatggatgaaagacgttaaccatgcattgatcgttacgatggactcttggacccaaacgaacacggtgttggtatactcgtttgccgagaaactcaatagactcattggtgacgcttatcgcgcattttggagcctagttctcgttagtcttagtccaaatctgagacttgagctcaaaggacgtgcttactacaatgattatggctctaaagtcaggatgcttctcgaacaacctatcatgtatgtagaacaacaagaaattggcgtcattgtcgggtacttgcgtctcaatatttag

SEQ ID NO: 79375 - DNA, 531 bp, Glycine max
  Peptide Sequence Number=SeqID_171060
atggtattctcaaaggcaacaaacttgctgtgtcggttccacattgacaagaatgtgaaggcaaagtgcaaaaccctagttgctcaaaagaatgcatgggattatgtgatggaggcttgggggagtttggttgaatgtccatgtgagagttcttttgatgaggttgagagtgctcattggtcactaaagagactcctacaaaactctgatgatgacatatgcagtgtttgggaagaaatgaataatatgatgacacttcaacacacccagattaaagcatctttgagacaagcacgcacgtggttgggcatgtgtttaaatttttcagatcaagggttatgtgagacacaggagaccataactgaggagatggaaaccatattgaaatgctttaagcagcttgatgtttgtggtaaagtacatttgaagtcaaagttgcaagaaattacttatcctgatatgaactctatgtgtcctcctccagaaaaggtgaagaccaagggtgctccaaaaaaaccgctgaccaaataa

SEQ ID NO: 79376 - DNA, 291 bp, Glycine max
  Peptide Sequence Number=SeqID_171061
atgaaaaagtggggtgcacttagcaaacttgggcaaatactagtaatagcacaaatgggtgctgttttttacgtagcagcagtggaatatttcatgcaaatcgctagcatgaacaacgccacactcaggcacgcgacacgtggctgtgtcgcctctaccactggcgacaacagtgatgtcgccacctgcaatggcgctttggccatgcagggtggagtcgctggtcaaaccagcgcttccctacgcgtagcaacagcttttgcaggtgcagcagtgaaggtgcagcactga

SEQ ID NO: 79377 - DNA, 423 bp, Glycine max
  Peptide Sequence Number=SeqID_171062
atgtatatcaaggtagaaggtgtcacaagcagtgcatttgtcagggttgacttctattccccaatgtgtgatcataaatcccaagaacttgcctccgccaaccccaaaagtacatttttccgggttgaggcgcatgtcatatttacagagctcttcgaagacctcttcttgtctgccatgtgttgggctatgctgagacttgatgactatgttgtcgacatagacctcgacgtttcgtccgatctactgcttgaaaatttggtccatcaatctctgatagctacacccgaggcttgtcaaggaaatgatgatattggctcgatcccctttacatctaatgccctagataatgatcaaggattgtctttggacaggaatgatttagtccgacccatagttgatggaaaaccggtggtaccttaa

SEQ ID NO: 79378 - DNA, 213 bp, Glycine max
  Peptide Sequence Number=SeqID_171063
atgcagaggaagccaacagagtcatcctcagggccctgcgcacgagactcgataagtctaagggcctatggaaagaagaactccctaacaaagtctaagaaatggacaaatcaaggaaaaagctgccatgcttcgagcaacaaggagatacaacacaaaggttcaaccatgagcctttcaactcgacaacctcgtatggctagtctgaggtga

SEQ ID NO: 79379 - DNA, 549 bp, Glycine max
  Peptide Sequence Number=SeqID_171064
atgagttgtttgatgatcaatgatattgatgttggccttggtagatttgagcttttatacacaattgtatgtctatattcccactacaataaccgctacaataaccattacaataaccgctataataaccactacaataaccgctataataaccgctacaataatcgcacctccactacaataaccgctactagaatgataactacccctatgacaggtggagtagacagaaaagagttgttccatttgtatcttgtttggatacaagataaatgtctatctttgttggagtcgtgcaaattagataaggacttcatcatattccctttgatgcatagcatggtgaacttcttggaatttggatatgacccctgtttcatggttctttgcattggatacttgcatgtacacagggaaaaaacttcaaaaatggagctttttataatttctggtgctgcttgcttgcctcatccctctaacgtaccttccatacttcaatatcatgactcattcggctcagttaataggaatgagaatgaagcatgttaa

SEQ ID NO: 79380 - DNA, 279 bp, Glycine max
  Peptide Sequence Number=SeqID_171065
atggaaggagtgaaagtgaaagcccttctccatcgagagatgcaaatgtattctttacacatagacggtattattctgcttcccacttcttttctgagacataggagggagagaagagaatatagacagggaaagatattttttccgaatccacttggctgtagaaaattggattttctcttcctatttttaatcatccttccatttttgaatgagtcaacccgtgcttacctctctaatgagctgagaaatatgttaatgcaacaactgaaaacttga

SEQ ID NO: 79381 - DNA, 942 bp, Glycine max
  Peptide Sequence Number=SeqID_171066
atggcgaaagaaaggtgtcgtaggagggtggtgcctgcaaagtgcagagagacgaagcacaagtgtactgtaaccgtagacgatgtgaaccaacctctctctccactgattaccacagaaaccttcaagggagttgttgtgttgaaggattccttctttgatccttggtttcaatggaggtgttacaatgagaaagagtacaagtccaagaaaatagaccttactctaaagctttcaccttgtggtgagaatgcagaagagaaagagagggggttgagaaggtcatcatcatcatcattagtagtagttggtgttgcaaatggggcccagtggggcacatctcttggcagatcttgctcattgccagcagagaggcagaggagggtggctgcactctcacctcaagtgcttgcttgggtggctgcttcttctgctgtcaatgtcaacaacacatcgtcatcacttcacaaaccaaacccactcccaagttcttctcaggattcagggcttcagggtaatcaatttctttcgctcatgtcttcttcctctgccaaaggagttgctttgaacatccaaacatcaaccaaggaggaaaacgattccaaggcttcccacaaaacaattgccaaggcaatttcacctaggcctgctgacagtaagccggagaatccggctaaaaaacataaacttgggaactactgcagtcttaaaggcgatgtaatggagatcctgagacagatgccgagtgtgactactactggagatggccccaatgggaagagaatagaagggtttctgtacaagtataggtctggtcaagtgtgtattgtttgtgtctgccatggtaactttctcaccccagctgagtttgtcatgcatgctgggggcaaggaagtggccaatccaatgaagcatatcactgttttatctaactcattttag

SEQ ID NO: 79382 - DNA, 1548 bp, Glycine max
  Peptide Sequence Number=SeqID_171067
atggcccgcacaaagcaatatggccagatgacctctaaagccgccaaagaaatatctgacaaaattagcacacatggtagctttgtgccttcaagacgcgatgatattttcaacatcgctattagaagacccgagcattcaggtcaagtacatgtggcggggacaagtgtgacaattagccagtactttggtccagcatcacatgggtctacaacttcatctaactcaatcactccacaccagttggctgaaatcattggaaaaaaatgcactatggacacaattaaagaagaactaaaacaagaaatcaagttggagttatcacaaattgcatcacaacactcaccctcacttcaagcacatgatatacaagtattagcagcaagtgtaagctccaaggggagctgtgcagcaccgaagacaaatgcaataggtaaaaaagcctctgatatgcatggtgatagcgtggggctgcatgtaattgccgagaagtctacaaaattagtagcattgggcaaactgtacgacacttttggcaccatacacaatgtgccttatgcagatgatgtggttcgagtgagtgttgtgaaagtttacgatggtgatgcgcaggtccctttccccacatcagaaattaagtttgtcagagtagctgttgggactttcgtgggatggccaacacatttggttaaacccatatcgaatgaggatctagagaagcccgtgaccacaccgtttaagattgttgcggaggacaaagcattggtgccagttgatcccttgggagagttggtaaagaacttgtttgaaatttaccaaaaaccaattgagttgtcgtgggatggtgctaaatttgggatcgataatgtcaaagatggctttttcatcacacacgctaatgtcagtgagataattttaggtgacaagtgtttgaacatctccctactacagttgtggctgacggcccattggcagctgcttgttatgtgcccaagggacaatctagtggtttggttttgttctttgcgtaagaagcctgatgctgccatcaaggctgcagtgaacagtgtcatgaaaacattaagcaaaagtacagaaggaaacccatatcaacctgtgcctcagtggattgaaccaaagacagaaaatgaagcattcaaagtacggatgaatgcccttatagccaaagctcagaagatgccagaggaaggttggacaatgcaggctggaactcgagtgtttttaggtcatattggggggctggatacagatggaaatgagctgcctagacttgtttatgtttctcgtgcccgtcttagaatccaatgcattctaggacagtcgcatagccatgaccatcgtagactgcgttgcattctaagatgggtctgtccaggcgggcatgtccacatgcccgatgtaaaattctgcgctttctacgatggtcctttccaaccgtcgttgatatggtcacaacttttcactacgtcggagacgacgacgatcgttaaccaacgtaaaatgccttcaataaccgatgttgaatga

SEQ ID NO: 79383 - DNA, 228 bp, Glycine max
  Peptide Sequence Number=SeqID_171068
atgagtttgcggatctgcaattctgccccacgtgcagagtttcacgctacaaggccaacgatggggaatgcagtgaaggtgcagccaccatcagtagtcatccaacaaaggtttaagctattgtttgccaatgaacaggatgcaaaaaacttaaggtggcatgtagatgaaagaagaatcgggactggtcagacatcctgcaaattgtacacaatggaagacatttga

SEQ ID NO: 79384 - DNA, 423 bp, Glycine max
  Peptide Sequence Number=SeqID_171069
atgactatcaccctcgatgatgtggcatcgttgcttcatctgcccatcataggtgccttccatagcttcaagcctcttcatatttccgaagtcgtgttgttgttagttgaattgcttaaagttaataaagctgaagcaagagctaaaacaatctacgagcattttccttctattgcttcgtgtattgttgctgaagattttgatgagaggaaatcgcgtgcctaccgttggaagtctgggaaggcattaccagtatcgatgtattgtcagatatgtgttgcgcttatacaatatgcagcagactacataaagtggttctacatgatttctcatcccttcatgagtccggcacagcctagggatccacccagacatccacctatcatgcgcgatgacacatttattgaaccagatattccttag

SEQ ID NO: 79385 - DNA, 2235 bp, Glycine max
  Peptide Sequence Number=SeqID_171070
atggatgttgtaaatgatttgcatatggggcctccagcaacaaccaatttgggaggttccactagtacagatgatgtaaattcatcgcagaagcagaaaatagtgagaaagaagacacaaggtaaatctgttgagtgtgaaggtcctgatttttcactggataagtcttcaccgaagacagatgctactataaagcacccattacatgagtcccctgctttacctaatttcttaagttgccaaataattgtagaatattcaacagagaatgaaaagagcaaacggcagaagacaacacataatgctattgaaggcaatgttaatggttgcggcactcctgagggtattttttcaccaaaagcttccacacctgcattggatatgccttcagaacatcccattcaatgtttttccaatgatctaataacaagtcaatcttgtgtggaagtgggtatttgtcagggacataatgaagaaaagaagcaaaatatgatcaatacaactgcagaaaatagcaattcacagcaaggcattccagaagaaagctgcaatcacatttcatttgcagcaagtcatgagccttttgcaaaagagtgtgtttcagaagttgtaaaattgaacacagagcatggtataaatgataacattcccaaccgtgaggataagaatgattttgaaaagaatacaagtctggtgaagaaaaatgttgatgactcactggattatggcttgtgtgataaaaatctgtgtgttaaaacgtatgcaaggagaaaaatggttaattccagttgctggagaaacagtggttccccaagtcctgaaaattgtaacaaggaaccaactattcaggatcatcaaaaggatgattcacacaaattttctgatggaccattgagagtgtgcttgatggatggagaaacaaaactttcaattgatcaagttacctcacaaagtggagctgcagctgaggaaataaagttgagcactgacaacattaacgagcaaagatttatgactacatcttctgcagtagacattccttcagagcatctcaaaacagatggcagaccactagatcatactgagattacaagaaatgatctgtgttgtgcagatgaggaaatagagttgagcactgacaacattaaggagcaaagatttatggctacctcttctgccgtagacattcctgttgagcaactcaaaacaagttgtagaaagctagataatacggagattacaagaaatgatctgtgttgtgcaggtgatgtttctgatttaagcttagacacagtaagagacggtcatttaaagatttcacaattctcactagacagaaattttgctggcaaccaaaagaacaaacttctcatccttgatctgaatggactgcttgctgattttgtcagtatcagtgacactgacactcctttccgaagatatagacgagaaccagagccagattttgtgcttagagggaagaaaggtgacatggtcaaatgtcttgtttcctcattccagatttcatatcttgctctagctcaaatttggctgatatgctactctttccttttgcagtctacaagaggcccttttgtgacgattttctacagttttgctttgacacatttcatgtgggagtatggtcgtctagatccaagagcaatgttgatgcatcaatcaaatttcttatggggaaatctgcaaccaaactgctcttttgttggatataaggttggcctagtggttgggaagggggggcttaagggtgaagggagagaggggagggggaggtcacggaatcagtcccactgtactaaaacaaagtttagtactgttgagaatatagacaagccacttgtgttgaaggaaataaggaagttgtgggaaaaggcagaacctgatctaccatgggagaagggagagtttaatgagtcaaacacattgttattggatgactcgccttacaaggcactaatgaatcctaggcattcagcaatatttccttattcttaccggtactaccacaccagagactcagaattaggacgagaaggtgatcttcgggtttatctaaaagggctggctaaggccgagaatgtgcaaaactatgtgtcagaaaatccgtttggccaacggcccataagagaagcaaatccatcttggggttactatcgtagagttatagaatcacttcaaagaagccaaaatgatgggccctcattacccaggtag

SEQ ID NO: 79386 - DNA, 1143 bp, Glycine max
  Peptide Sequence Number=SeqID_171071
atgcagcacgtatgcatggggacatgccgtgcttgcttatttatacagagagatgtgcagcgccaccgattacaaaataaaatcaatcggaggtggctgcgacgtggaaaccaacatattgacaatgatgatctaatagttttccgtcacaaattgggtatcatgaaacggcatgagtttctgtgggaaccttacacaacaactgttatgtcgatgttgtctcccatttgtttggttggtagtgtggtgtggtgcgcagtggtgccactcatttgtttccatgttgtagagtggcaccaacccgatagagtgttgcggcaatttggaatgcaacaacctattccggagtctccttcgcaaccacagaatatccatgggctaatgctgaaaggcaaacaagatgaaaattggttccagctgttggccgcaatgatcagtcagtggaataatcgagctgagtttaggggtgaagttgcggagacattgcagtatatggtgtcaccaaaagggcggaacacatggacagttaatgatcccatgccttatgtggagaagataacgattttatccgaagagcaagagaggatcactgagcctatggcacatggtccaacatcagagcgtcgatttcccccacaacagtttcacatgcttcagtcaagtgttgaaactcgaggttttgacagacgaagggagattgttcaagcggaagatttttcccaacaaatgcagcagcgtggccatggaatgtattacacgccactaacattttctcagtatccttcgcagatgtatcagtatcctttcgaaggtcatgacactgatatgtctgcaagcgaacattcgtttggtggtgttgcggaaacacatcctcatttttcatggccgaccatgaccccttcgcagcaacatgatgccccaatggcaacacctaatgccccattagctccgcaatgggatgtactcggagcaatacctgatatgggtgacttattaggtgttgatttgcgtcacgagttttctgcagaggctgagcaacaagggcggagacagtgcgcaagaagaaatccaaatcgccaagcccgaaggtgggatcgaccatatggcacatcctcacaccatcacggacaccataatgactga

SEQ ID NO: 79387 - DNA, 93 bp, Glycine max
  Peptide Sequence Number=SeqID_171072
atggctcacaaattttgttttgaagcacttgatcaaagtctaagagatattattaaggccaagtccagtcctggtaaaatctttggagattag

SEQ ID NO: 79388 - DNA, 1110 bp, Glycine max
  Peptide Sequence Number=SeqID_171073
gtggcaactacacctaatggtccttctgctagattttctgtagctggtgactgtttagacccatatatgagtggtgttcttgtgtttgttggtggttgtaatagaaatctggaggccctggatgatatgtattacctatacacagggattgcacgggaaaatgaacagcgaccagagaagttatccttaaagaagcaattgaagcggaaatgtctagaacaaaatcccaatcttgtccgaaacccagttatgtgtggatatggagtgggtgctgccagtaaccagcctatggaaatcttgaactgtagccaaccaagcagactaaatatcccagtaaatcagtccctgcttcctggaaagaaaatgtttcaagcccaagttaaggaaaaaaactcagcaggatatactattgaaaccgttattgatggaaagcctcttcatggagttctgtttaaaaaccagcctaacactcttattccagttcctaatacttccagtagtcctgcttcaaatggtatacattcacaaaatgtaacggcttataaagtgctcgggcaggacagaatgcaagataaacgggaattacggggagagagttcagaatctcatgaatgccataaggatgctgatactattgttgtatcaagtaacccgacaactgttgctgagtcctttaaggatatttgtactaaggtttttcctttgtttccggagatggtgggagtgaataaaagatcacctccagttgctttgcatgaatctaatcccaagtttgagttattgagtcctagttggtgtctggtttctgtcaacccagaaccagaagctgtttctttgaatcgaaatggtgatgaaaaaaatgacacaccaaaatccttaattgagagcttgaaaaacgatggatccaatgatgtgacaagttccaaaggtgaaattcaaattggtgttcaaataaatgtgccagtttccaactatgaaattccaactcaaatgagtgatgcaccaaactgtaatgctgatgtcctgaaacctgcagcagctgagattattgtgtgtctgccaaatgaagcatattgcaacatttccagctgtgattttttagacggttaa

SEQ ID NO: 79389 - DNA, 598 bp, Glycine max
  Peptide Sequence Number=SeqID_171074
atgaggtgggaaaaggtggagggaataggaagagaagaaggaccagggaagaggtggggccacacgtgtaacgccgttaaagatggcagacttctttatctcttcggcggttacggcaaatttaacttgaagcagagttggagtgaaccagcaattaaggggcccccacctactcctagagacagccatagttgcaccgttattggtgataatctgtttgtgtttgggggtactgatgggaccaagctactgaatgatttgcagatactagatacttcttcaaatacatgggtttttccaactgtgagaggggaggcaccggatgcacgagagggtcatgatgcagcacttgttggcaaacgactatttgtgtttggtggttgtgggaaatctgctgataatattaatgaggtgtactacaatgacctttacatattgaatacagaattgttcgtttggaaccgtgctacaacatcaggcactcctccatctcctcgtgatggccatacttgctcatcttggagaaacaaaattattgtgataggtggtgaagatgaaaatgattcttatctgtctgatgtccacatcctagatactg

SEQ ID NO: 79390 - DNA, 342 bp, Glycine max
  Peptide Sequence Number=SeqID_171075
atggtgacacaaactccagcaacacggacacatccagggtgctttggtcacccagtggtagtacaacaattgcagggaagactcattgaggcagaggtagaaggtgaggccgtgaaggcgacctcgacggtgttgtgcaagaacgacctgacattggtgtggcaagatgacacagcagcaacaacgggggtagagatagaatgtgaggttgtgagggcagacgacacagactcattggactcagagagactaaggcaccgcgagattgcaagaggaaagagactcaagagaggccaacactcaagagggtttctaaaatggcttgaaacaatgtcgttttga

SEQ ID NO: 79391 - DNA, 297 bp, Glycine max
  Peptide Sequence Number=SeqID_171076
atggttaggtggatgactttaaagaacctcgtgctagaggacattgggacacaacactttgatagaaagtgtcacaaaggtggtattgttggtgacagtggtgataatgacagtggaggtgacactaatggtggtgggggtggtgccagttatggcgatgacaacaatcatgatggtgatggtggctgtggtgtggtggtattgatgatggtgacgatgatggcggtggtggtggaagtagtggtgatgttggtgacaacaaaaattatcattgtcaaatgtgtgtttttaaattaa

SEQ ID NO: 79392 - DNA, 738 bp, Glycine max
  Peptide Sequence Number=SeqID_171077
atgatgattccgatgatgttttgcagcgtcgatggcctacgaaatccgcacgcaggcaacgagtacctgtcactgctacggacgatgagccagtggtcctgcgatagaggacactgggcagacgctcctgcagacacaggcgcacaggctgctgaggatgaacctgagggatttttgggtggtccgagggacccatccgtgctaatcgagtatgcggatcacgttgcaggcatcgtatggataggagaggagcgtcctaagttgaagttatcctctcatgagaggaaggtgcatagtttaggcaggcctgtccctgccattgaggggctagttgctgggacaggactaagtcctctgatcgcgtgttcgatatacactggcgatcgaggacttttgtcgtcgtttatcgagcggtcgcatcaggagacttctagtttccatctccctgtgggagaggtgacgatcacactggacgatgtcgcgtatcttcttcattttcccgtggttggcgacttccatgcctttcagcccgtgcacgtggatgatgctgtacagatgctggtggagttactgatagtccctgcagaggctgccagggttgagacagcacagtgtcgtggacctcaggctgggaggtatgcatggggagtagttgtgctggtgcatatgtacgatcacctgaatgatgcttctatcagcaccagccgacagcttggtggttacatcacgctgttgcag

SEQ ID NO: 79393 - DNA, 387 bp, Glycine max
  Peptide Sequence Number=SeqID_171078
atgttgggtgcacctagcaacactccttctaggcttaggttttataatctttatgtgaagctgtacctagagtgtgagaagatatatgggaggttgaaggggtgtggtggtgaagttaggaggaagcacccggtggggctgtggaaactgtttaaatcggagaagtttctgaaagagagtgatctgaacacaaaggaagggttgtccttgtgtggttcagagattgtaaaaggattttacaagacagtggaaatctcaagcggattgcttgaggacgggatgatcgagcttgagtccatggctctgttaaaattgagtcctggccagactcatgaacactttggtatcgatgttaatactctggaattgaacattaagattctttga

SEQ ID NO: 79394 - DNA, 834 bp, Glycine max
  Peptide Sequence Number=SeqID_171079
atgcctcaggctatagtgaacttcgtagtgcaaagtcttggtgatttgctcattcaagaaggaatattcctatataggctggaagacaaagtgttgcaactgcaaactgatttgaggatgatgaggtcttacgtgcaagttgcagatagaaagcaagatggtaatgaaagcctaaggaattggatttcagaaatcaaagaaactgcttatgattctaatgatgtcattgagtcatatgccctcagaggagcttcaagaagaaatttgactggtgttttaagcctcatcaaaaggtatgctttaaacatcaacaaattcatagaaacccacaaagtgggatctcatgttgataatgtcatagctaggatttctagccttacaaggagtttggaaacttatggcataaggcctgaggaaggagaagcctcaaattccatgcatgggaagcaaagatctttgagctcctactcacatgttattgaagaggacataattggtgttcaagatgatgttaggattttggagttatgtttggttgaccccaacaaaggctatagagtagtagccatttgtggaatgagggcaatcaacaatggaagcaatggaagaaggaaccttacctcgatgaagaacggaagaatggagctcgcggaagaagaagagacacttgcaggaagacagaggaagaagaaatggctcgcgggagagcaccaacaacagcctcgtgagggagaagaagaaccagcagcagctcgtgcggaagaagggagaagaacagtgctcgcggaagaaggaaatgaagaaggaagcggaatgcaccccttatggatataa

SEQ ID NO: 79395 - DNA, 1106 bp, Glycine max
  Peptide Sequence Number=SeqID_171080
atggcagcgttccgatggaagagctttgaggagaacgaggatcaccctgaactttcatcaaatacttacactaagacatttattgggattgatggagctggaaagcgattagctgatgaagtgagtcccgagacatgcaaatttatgtatctcaatgcctatgatttgattggagaaggtgaaagagatagaagccaggaggaatgttttgtgaagctttggaggttaaaggttcctgctagaacccatcaagaggacgcatcccatctcttcttccattgcagcaaagttcaacccatatggtgggaaaccatgtcttggctgcaactcaagggtgcttttcctttaaacccaaagcagcactttcttcatcacttgggtcttcaacctgctggtgtgagaaatagtagatggcattgttggtggttagctttgacctcgtccatttggaaagttagaaatagcataatcttctctaacgcgacttttgatgctaacaagctgtttgatgaggccatattccttctctggtcttggcttaggggttatgagaaggactttacagtgcatttcaatcaatgggaacaagctttcaagagaagggatgattgctgggttggagccaatgaattttataactttagcaacgccacatcttggcgtgagaggaaagaagcggagagtgtttttgtggaggttgagccaattctaagatctgcaatggacgggcacaatgatggtacaaatgaggagccaagaattgttccgcgtgcacttgaagagttctttcgtcaagcctctttggataattcatcttcttttacttttacaatgagcatatctacctcttggactaatgtgaatgaggcatcaagcaggtcacacagcttgacgaggataaacatatttcggcatggggatgcattggaagccaaaagtgaagtaagtaaattgtggatgattgatcttgaaggctgcaaacagttgcttaaaactggagccaaaggactaacacttgatgagggcagagccattaatctttccctttcagctttaggtgatgttgttgctgctttgaagagaaagaggtgtcatgtgccttacag

SEQ ID NO: 79396 - DNA, 288 bp, Glycine max
  Peptide Sequence Number=SeqID_171081
atgatgagtctcaaagctatggaaggcgcttgtgatgggcagatgaagcaaagaggccacatcatcgaggctcttgtgccgaagaagaacggggctaagggatctgccgaagctgtgggatgtaaaaaagaagaatcggtagggaagcgttccgccttagagggaaggacccgcacgagcagtgctggacgaagcgaaagcaagaatgtcgacttgaataacgcaagcgttggtgagaatccaatacctcgaaaacccaaggttcctccgcaaggttcgtccacatag

SEQ ID NO: 79397 - DNA, 333 bp, Glycine max
  Peptide Sequence Number=SeqID_171082
atgacatttttaggagagactagcagtcagacgattgtcaactcaatgttgggtttcatttttccaaatggatcgattattcacaatgatagtggggtttacttccaaacttccactccggtgcccattcgagtaccaaacaactgtgattttgcaaggctaaaaaccataatacacactacccttcagctaatcgacaaacaatttttggatgaaattcactaccgacaaccattcacagatacaggatgtaccatcgatgaattgaaggatttgataaagcaagttgcacttgaagggattccccctcatggaattcatgcatcacaaacg

SEQ ID NO: 79398 - DNA, 360 bp, Glycine max
  Peptide Sequence Number=SeqID_171083
atgacaacgggacgggatagggacgagtattgctttcccattccccgactccccaacgtatactcatatccgatactcgacgggttaaaattttttatctcattcccatacccgtcaggtattccccatcaaaatcgggatggatttgggcggatatccacgagtacgggtttcattgctatgcctagttgtggcattcagatgttggactatgggattcgtcaggcatcatggggagaaattgacacagcaggagttctagaagatgttgaagaattggggcagcgcgctcagcgcgacagcacccgctcaacacgaggagtcaatctagaggccaattgtatcgtgcaggcgtgctaa

SEQ ID NO: 79399 - DNA, 744 bp, Glycine max
  Peptide Sequence Number=SeqID_171084
atgggcattaaatgctttcacaacggcttccatagttgcaattgttatagagggggttatggagaaactgatgtatcttctgaagggagtgaaattggcttcgacattcagtcggaggaagctcaggtggacgatgaaagtccagaaacaactctgacagggatgctgacggtgatgaacaagccagaaacgttgggaagtagtttttggccattgggtgcacccattattcatcgcttcttctgtgagtgcttcttttcttctcccgtcttccgtgcctgctcctcttttgttgtccttcttctccgtgcctgggctgccattttcgttcattttgggagcttcgtttctgcgttttcgtcgtcaagatgtgtagtgattagggttgagtgtatcatggttagaaccagaggtttagggcgtaccttatctagggttataggcaaaggcttggttagagaggatgagcatcatgcagatgatgtttccctgcgtcgtaggcctaccgcatctacccgtaggcgaagagtagatgttgcaattgttgaggatgttcctcatatggacgaggatattcctgagaggactgcggacgtagatgttgcggatgtagagggcataactgttgatggtgctgaggggtcacctgctgatcatgctgagggattccctggtgggccacgtgacccatcgatccttacttcgtttgcggaccatgtggcacatagcatctggagtggatag

SEQ ID NO: 79400 - DNA, 390 bp, Glycine max
  Peptide Sequence Number=SeqID_171085
atggctcgcccgatggttattccaagcagccatagccattacagcatgaatcaggtttctgaaaagatgatgggaataagttctcaggcttcaaataaagtgtttgataggtttccacctgaattcaatcctgtagatggacgtcatcttagacccatattgatatcagacaataatgaaattttcaattttgaaatggcagatgggatcttccaagggtcggattttgtgaatgtgaaagatcatctttcctgtgaagacggcctcacctttgactcgtttcaactatcatctccactgcagcgcactccaatgccggtcattcaattccttaacaatgtagggcacagtggggagaagcttaagatggtgattggtatctgctgctaa

SEQ ID NO: 79401 - DNA, 249 bp, Glycine max
  Peptide Sequence Number=SeqID_171086
atgtacaacaaagaagaagaagaagaagaagaagaagaagaagaagaagaagaagaagaagttgaagggagagctcaagccagaggactcactgtgtgtttggatacgcagcacggtgaagcaaaatcaattttcttttccacggtcacactgaagcaaccctttgttgcttctgattttttcacggtcacacacaccatgattttagctgtcagaatcgattctgaaggttatcgaaacatgcactga

SEQ ID NO: 79402 - DNA, 240 bp, Glycine max
  Peptide Sequence Number=SeqID_171087
atgctacaatgcgaagggttttcctctaaactcagatatgattttgaaattctcaacggtgagagtgttcggaattgggttgcgaacatgatactcaaatttcacgacgatccaacggtgaacaggttcgagatcgtcgtttttctgagacagatttggtgggctgcgggaaaaagaaagggttttgagaggagaagaggaaaaacgaaaatgaagtcaaaaaggagacagctgacttaa

SEQ ID NO: 79403 - DNA, 766 bp, Glycine max
  Peptide Sequence Number=SeqID_171088
atgatagatggagaagatgtgatgcaatcctacctcccaaggatattggatagaagactacaagaggattgggctagagctactaaagaagatcctagggttctcatgaagggagtttctacgtgcacccaacaaaattgctgggacacccagcaaacagtgaatgggcaattatgcccctccgtgaaggctatttccggaagaccattcttccggaagaccctttctccgaaaaagttccggaagacacttcttccggaagaagaaggtggacttccggaagaactccagaaaacgttccggaagaagtgtcttccggaaaaagggtctttcggaatacttccttcttcttccggaagaagttgtttagagaagatgaacagtaaaaaactatttccggaattactttttattgcaggaggaagtagtttcggaatgagaatgttgaatttccggaagaagttctttcggaagttactattctcaattccgaaagaagtggttccggaacaacttcttccggaagtagacataatggacgaagatcaatggaggtatgactatgcgatgtcacaagaagttcatatggattatgattatgataatgaagaagaatgtggggtgaatgaatcacatgtcgattgttcaaatgcttttaatacgtctcaggtattcggtactcgagatgatgttttgcaatgggctcgaacagttgcctatgaaaatggatttgttgcagtgattatgaggtctgacacagatactg

SEQ ID NO: 79404 - DNA, 177 bp, Glycine max
  Peptide Sequence Number=SeqID_171089
atgaagaagaaagaaagcaaacggaggaagcaagctgtagaagaaggcacgtggagcaaccaacagaggttgaagtctcacatggaaatgcccaaaaaaccaacaaatgagctacatgtcaagctctcaggtatgggcacaacagaaatttccatggccttctcttttattagatag

SEQ ID NO: 79405 - DNA, 417 bp, Glycine max
  Peptide Sequence Number=SeqID_171090
atggcccgcaccaagaaaactaagcaaatgacgtctgaggcaacaaaggaaattgctgacaagattgcctcacagggttcctttgtcgcccatagacataaggatgtattgactgttgccattgggcgaccaaaacaccttggtcatgtgtgtgctgctggagtcggtgtcatgatcaagcaatactttggaccggctccaagtacctcccgcacccagatgcagtcccagtttcaatcgcagatgcaatcagagggactcacaatgcctcctaagcctgaggtttgtccttcaactgctcgtgttagcacaaaggagagttgtgttgatccctcagggaacaatccagacacggtcaaggttggtgttaagaaagttacaaatgcatatgctcacattcctgtacccactgaagag

SEQ ID NO: 79406 - DNA, 339 bp, Glycine max
  Peptide Sequence Number=SeqID_171091
atgaagatcccattatacgatttcacgaaacatggatattttagtgagcatgaggatcaagagttgtctcatcacaacaatgaccaaagcgatgacgagggtgttgtcgtaccaacatcacctctgttgcaatatcaccaacctaggctcgaaagacctgtctcccccgacccatcgtctcctccttaccgtgccactcaacttgtcactaaggtgtgtgtgactgttgcaaaccgctcaacctacaattgtgctgctccacgagtttgggtttgtcactgccgcgatttagacacagtcttggctcctggttcttgggttcatgagttagtaggaagg

SEQ ID NO: 79407 - DNA, 652 bp, Glycine max
  Peptide Sequence Number=SeqID_171092
atgccactcaccgtcagtggcacacactggagacgtagtgatatgctccagcatataagtcactcaccgtgggtggcatatactggagttatagcagtgttggtgtgctcttgtatacgagcctcttacaaagtgactcatactagagacatggtggcatactcgtgcgcacatgctactcatcgtgggtggcacatgtcactcgtcgtgggtgacatatactggagtcatggtggtgatacgctcttgcgtgtatgtcactcactgtgggtggcatatactagagtcatgatgggtgctcgtgtgcacatgccgtgggtgacatgtattagagacacaatgatatgctcttacatacgagcctcttacaaagtgacgtatacaggagattcagttctagaagaagggctcaccaaggggaccttcccaattggggcaaagctttcttgcttggggatcttttttggcttcatcacggacacgccatatgaggttatcagtattctccttgtcgacggttccccgacttcaatggggatcattgcatctatgtcatatgtgagtcgacttgtcaagtctagtatgcagggccctaaggatgactctgttagctgcctctacctgtttgttagtttgaggatgttcgataaag

SEQ ID NO: 79408 - DNA, 1095 bp, Glycine max
  Peptide Sequence Number=SeqID_171093
atggcttctaggaaaagaaaggcaccatctacacccacccaagatagatttgacagatcaagatttacttcccaagaggcttgggaaagatatacagacattattgtgcctaggaagcttctaccagagaggaacgtggtggtctattatactgagtttgatgagttcaaggaggaactcgaaagacgctgctgggacaaggagttgactgactttggggatggcaatattgatgttgccattgtgaaggaattctacgccaacctctatgaccccgaggacaaatcacctaagcaggtgaaggtgaaaggtcatctgattaaatttgatgaggatacgcttaatacattcttgaagacccctattattgtggaagaaggggaatcactctgtgcttattccatattttcactcctaaggcctgatcctcaggagttggctactaagctctatatcccggggaggggattcgagcttaatagtgttctttccttctctaacttgattcccacctcccacacttctgatgtcactcttgacagggcgagactcattaatggcattattatgaagatggatatgaatatgggatacctcatttcccaccagatcttcctcactgctcagcatgatacatctagacttggattcccgaccttgattacagctttatgtaaggctaggggagttcagtctgactctagatccttggagagcctaagtcctgccattaatttggcttatattaagaagaactattggaatcttgatgatccaataatagctttcagaggacccaggaaggccaaagggaagagatctgaggccccttccacttcaacatcagaggcaccaataccctcttcttctacacttcctccttcttcctccacagatattccagtgattcctccaacgccttcacagataccactaccagctcctctttctgcaggtccagcagattttattttcactcttcagatgcttcactccatgctccagagcatccacagagggcagtacatcatcatgcagatccttcagggcttgggcttgacctccattatgagcacggaggagtttgacgcatag

SEQ ID NO: 79409 - DNA, 198 bp, Glycine max
  Peptide Sequence Number=SeqID_171094
atgacggttgtgactccgtcgaagactactagccgcactttctccctcgacctctctcgaagttccccggcctctgtcaaccactctaccctccctcgtgccctcaatcactctgctccagcatgcgtcgctaatattatagattggatgtgctatttcatgtctgtttctctcgcacaggccaaaaatcatcgataa

SEQ ID NO: 79410 - DNA, 891 bp, Glycine max
  Peptide Sequence Number=SeqID_171095
atgggacgagccccatgctgcaacaaggtaggtttaaagaaaggaccatggactcctgagcaagatcaaaagctcctagcttatattcaagaacatggccatggaagctggcgtgcctttttaccaaaagctggcaattcttcttctcttttgaaagaagaaggcgagcaagagtggaaaggtagttatggtagttccatcactagttttagttctagtctgcatgatgagttcacaatgaacatggaaggcacgtgggcctctgagttccttaggcctagtggctcacatgatgatcacattgttgaagaaggcttcaccaatcttttgcttaaaacaaactttgacgacccaactttgttgtcggagggagttaagcgatcaagtgaagaaattttaagggacatgaatccggacgaggatgttcgctcggttgcaacaatcccatctgtgaaggaactccacaaagctgggattgggtttcaacctgcgaaattaggaggaatctcaggcattgaatacgatgaaggaacgtacgttgaaataatgagagctattattgacacttgtgaggatgtgaagttgttggtacaaagggaaatcattcagcagactgagctgagtgaccaagtcgtggaggatcttttcaatgggatgagaaaatcgattaggcctaccaacactctagacctggaaaaagagattaagaaagtcaacgccaagtacgatgattcccagaaggttaatagggccatggtcaagtacgtgtattctgcagggaaattctacacggataaatggatgggtatctttgcagaagaaggggatcatgtttttaagacccaaaacatttccccttacactctcattctttcacgcatccaaccatag

SEQ ID NO: 79411 - DNA, 195 bp, Glycine max
  Peptide Sequence Number=SeqID_171096
atgtcgttgttgcctgaaaatcacaaatctcaatcggaagcatttatagggaaacaaaaaggtattgaaggttactggaaaggttacctccctcaggactgtatacttaggaaagaatgtactggtgcgacggaggccaacaggacacttgaaggtcatcccaaaatgatggcagtggtggaggccaacaagtga

SEQ ID NO: 79412 - DNA, 426 bp, Glycine max
  Peptide Sequence Number=SeqID_171097
atggattcttcaagtggacagggaatgaagaatgctctcctagaacctaaatgttcgagttatgagaaaaaccatgattccttgttagtccagccaagttacaagcctgataaagtccgtagtgatccatattttgccggcacatacgccaatgagctttgtgccatgttagcaacaggcaaaggtgaaacaatactgtgtgcaactgttgcaagagatgttgctgtcttgatggaattcaaaggtgtttttctcaaggaagctgctaactgtgttgtgcatgaacgcacatcaaaaggccttgttggtttggttgatgtgtctgctgcaggagaagttgctatgccttataacacattgggcatgttccgagcatgtgctactgaagatggatattcagagattgcaatttggccttcttcctag

SEQ ID NO: 79413 - DNA, 1170 bp, Glycine max
  Peptide Sequence Number=SeqID_171098
atggaggaagcgcaaatttgggctaagaaggtggagcaggctgaaaaattctttgaggtacaagaaattcctttgttccataagctgcaatatgcatccatgagcatggagggtgctacgacacattggttctacatttggagccaaagcaacctagattcagattgggagtcattttccacagcttttatcaaaagattcggagatcgctatggtagccacgtcttcaaaagattgagtatcttgaagcaagaaaagcaaactgagacagaaacccacatcaaaaaatgggagacttccatagagttcttgaaagagaggaccaatatttcagagttgaaacacatgttgcgcaagatattgaatgaagaagttgattctcatgcctctcaacaagaaaaaaatagcatggagggaagagggtcagaattcagtgaagcaaaggctagtttttgggtaagaaaggtggaactacccagttttgatagaagcatagacgggggaactgatttgaagggtagcagttttgagtgtgacagcgacccgttgcagttcttgaaattagaaaacagaagtaaagaaggttcagtaatcaagaaccacaccctttgtggtggagaagaaaccaaaaatgatgaagcaaaattagcaagagaaaaaaagattgaaaaggttatggatgaagaagttgatccatcaataaagagggagaagcacaaggaaaatggagtgacgaatgtgggctgcgaagacgattttcttgataacccaattacagatttgatcaagaaggaagtcgaagctggtgattcaaccaagccacattgttttcaagattcagatttccataaaaagattgttatggtgaaacaaaaatcattcatgaaggtggttggaacaacaatggtgctggaatcttggaatgtcaacttgttgggtgagcctttagcattaaattttgttgcatctatggctgacaacttagccatggaactaaggcagaaggaatgtactgagccagtcaagctgattaaagttatatggagtccaacccttatccctcccaccactgaagccaccagacttcagtttgcaagcaagggcagtgggtctttcccagttaagctacaaggggtgcagttgtcttccagcaatcagacaaaactgtag

SEQ ID NO: 79414 - DNA, 198 bp, Glycine max
  Peptide Sequence Number=SeqID_171099
atgctggtagcaaagataggaatctgtggagaatctttcgttttctatccagtgaaagactatcttaaaaaattttattcccccaacttctacgaggtccagttgctttgggtcaatttggttactgctgacggattgcctgccactgttattggccacaataaacaagactctgatgtgatgacggctaagacgtga

SEQ ID NO: 79415 - DNA, 1326 bp, Glycine max
  Peptide Sequence Number=SeqID_171100
atgatgattgaaaacccaccactcattgaggacccccaatctcccattaaaagacatgtcaagtggaagatgacacgcactaaccaatatgggcatatgacatctcaggcggcacaacaaatagctgataaaattgactcgttggaagaacaaatgagacacgatgagtttgtcccccagggtcgtgaagacatacttaacacggccgtagggagaccagatcatagaggtcgtgttcgtgcagccgggtctggggtgacaattagtcaatactatgggaggacatcacgtgcctcaagaacccttagggaacaagtcaggaatgagattgaagaagaaaacaagcgaagtctagaggctaggaaaaaggagctgaaggacgccatcgttattgagatgtcgcaaaagggagataacgtctcagcactggctcattttgatttaaatgtgttaggtgcacgcggttgtatgtccaatgtcaaaattgtacaaagctggtggcgttgggaaaatatatatgatgaaccctctaccatacattgcatggcgtatgtagatgatgtcataagggttctcaacactttcattacatggccaacacctttggtaaaagtggtatcagatgaggatttagccatcactctaaataaagttgccaaagctgccgaattaaacaatgatgttgctgaacaggaccccttgcgtgagttgattaagaccctcattgacatttacaacaaacctgttaagtttgtgtgggatgttagtcaatttgggattccaaatgtagattcatcgttgttcttaacatatactgatgtcagagaaataacatcaggcgacaaatgcttgaacatagccatacttcaattgtggaccatgtatatgaatgagtggagtaatagcttgggtcaacagttggtgtatggattccttgagcctcaatctatacacaatgcaaaggatagacgtggacaatgtgaagaatatattcaaaaatggcttaaggaattgcaacgacaactgtacttaggagcttatttgaatcatgcatttaagaaattaaacacgactgctgatgggaaagatcctcaaactgcaccccagtggattgaactaaagactaatgttcaacgcagaggctataagtgtgggtattatgtgatgcattggatgtggaacataattggcgcggagttgaagagtgattggtctatgtggttcgataatggcacgtcactagacacagaggcgatcacaacattacataagaaatgggcagcttattttttaaaacttagaaccatccaatgtacaaagcagtaa

SEQ ID NO: 79416 - DNA, 87 bp, Glycine max
  Peptide Sequence Number=SeqID_171101
atggctaagagactacaagaagattgggtcatagatgtaggagaagaccatagggttcttatgagccttaggggctccatagtgtag

SEQ ID NO: 79417 - DNA, 345 bp, Glycine max
  Peptide Sequence Number=SeqID_171102
atgagggacactggacactggaccttctgtgggaacattcagttcctattcatgctagttcttgaggcatcgtgtgtttctccgatcccagtagagcttgttgggattcttaccaaaccctggctctcgggtatactggatgttcctttatctccaccttcttcatcttctaggtcgtctcttcctgatgccgacatggagtttatcggatgcatgactcatcttcctcaaagaacgtccttcctttattggttggatgccataggtgtcaagctagaggacaatgaggaggaggatctatctaaggattcaggattttggtggttaggaataacccaacaataa

SEQ ID NO: 79418 - DNA, 957 bp, Glycine max
  Peptide Sequence Number=SeqID_171103
atggcagaaccctcaaagaagagaaagggttcatccttcaccaccaccgctgcaggccaacgtcatcacggcacatccggtgacccaccagcaccaccccctccttctttttcttctccaaggtcattgactctattttcttctgatgaccagcgtcaaaggtactattccctattctctaatcgtgtcattctcgatcctaagtatctagatgtagaattctttgatggggaaacctttgattgctataaagtgtttcaaaattctgaattagttgagtttatgtctctaaaattgtcgtattatcctgaattagttcgagtcttttacaataatctgaaaattcaggatggtgtcattttttctgaggtgcatcacatacccattgttgttgatcaatctctattttattctatgacaaaactgagcagtcagggtgttccttttgagggcactctagttgatgattggaagcatgtctattctagtcataatgcccataaaatggtcggtaatgaccatgctgatatgaccggaaaattacttgctggctcattcacctttgagtgtcgcattatgcattatatcctttgtcgagttatgcttccacgttccaccagtcttgctcaggcctctgaggaggatttaatcttgctatgggctcttcaaactggtcgccaaattgaccgggcccatcttgtcaggtaccatatgcataaggcattacgagtcaatgcacttcttccatatcctcatcttgtcactatgtttcttcagtatttcaatgttcctttagaggatgaaccttttcttaaggttaaaatatcatttgctattggtgttggtgctgttacctccttcggatactgtaaggatatggatggccaatgggtgcgtaaacaagacctgccacctcccattcctgatgaatgcacaccctctccaccaccccaatag

SEQ ID NO: 79419 - DNA, 291 bp, Glycine max
  Peptide Sequence Number=SeqID_171104
atggtgtatggtcagctcaatgcgcttagcgagtatcatccgctaagcgaggcatcaacacgcttagtggataagaggaatctggaagggaatctgtcacgcaggcacgtgctcagcgcatcatcagctcgctcagtgagtcatttgtcatcttctaggcttagcgtgagtttggcgctgagcgaaaattcacttacttgcgctaagcgcgagaatgacgctaagcacgacgtcgaggagcttccttgctatggaaggataaatcctcatttggggattcttgttgagtaa

SEQ ID NO: 79420 - DNA, 1995 bp, Glycine max
  Peptide Sequence Number=SeqID_171105
atgtcggcgtgggcgagacgagacgagggtgccaaacgaaatcactcaccctcttctgggaaagccctcaatgaagggtcaccacgtatcccagccgaacatctggcctatcaatcgccgacgctgtccaatccactcgctctccggcgcattcagttgcattcaaaacgcgaggatctcgccgtttcgggtaatgcgcctcgaaattctggaatcgggagcctcgcggcgggtttggatctggaattgggggagggggaattgaatccaattgaaccgttagggtttggggcgcgggtgaggggggttgcatttatgaaggaagcggtgttgttaggagataagaagagcgagaggaaaagaggaggagggagggtggtttgggaagggttgatgatgatggggttgaagggacaaagtaataataataacaacagtaagttaaagaattcggttgtagtttcttcggcgaggtcttcgaggatgaaactgtggatgatacgcgccaccacatcggtgttactgtggacctgcgtcgttcagttaacggcgttgggggatatgtggggcccgcgtgtcctcaaagggtggccgtcgtgtttcacgcacggcgaatccgccgtgctcattgagttgccgtctgccaccacgcctagagtgctcccacccaagagggtttataagaataacggttacttgatggtgtcgtgcaatggaggactcaaccaaatgagggctgcgatatgtgacatggtggcgattgcaaggtatttaaacgtgacgcttatagtgccggaattggataaagcgtccttttgggctgaccccagtgagttccaagatatctttgatgtggaccattttattacatccttgagggatgaggtgcggatattgaaagagttgcctcctagactcaagacgagagtggaaaatggtttcctttacagcatgccaccgattagttggtctgacatatcatactataagaaccagattctacctttgatacaaaagtacaaagttgttcatttaaatcgaacagatgcccggctggccaataatgaccaacctttggagattcagcggctgcgttgcagagtcaattttagtgctcttagatttacttctcagattgaggagttaggcaaaagggtgatcaagcttctgaggcaaaatggcccatttttggtacttcatctgaggtatgagatggacatgctggcattttctggctgtacacaaggttgcaacaatgatgaagtggaagaattgacaaggatgagatatgcttatccttggtggaaagaaaaaataattaattcagatttgaaaagaaaagatggtttgtgtcctttaacaccggaggagactgccctcacacttagggcccttgacattgatcaaaacattcaaatctacattgcagctggggaaatctacggtggggataggagaatggcaagtcttgcgaagaactatccaaaattggtcagaaaggaaacactgttggaaccatctgaccttcagttcttccaaaatcattcctctcagatggcagcgttggattaccttgtctcattagagagtgatatctttgttcctacatatgatggaaatatggccaaagtagttgagggtcatcgcagatatcttgggttcaagaagacgattttattgaacagaaagctcctagttgatttgatagatcaataccatgatggaatattgaactggaacgaattctcttcagctgtgaaggaagttcatgctgatcgcatgggtggtgcaactaagagattggtgatgcctgacaggcccaaagaagaggattatttctatgccaatccagaggaatgtttagaactatcagatgatatgttgaggagtacatgtttaagatgggtctctacgcagtttagcgaagaggatgacagctatttgtatcacagaggcagtcatatagtgactgttagaatggggaggggggaatag

SEQ ID NO: 79421 - DNA, 495 bp, Glycine max
  Peptide Sequence Number=SeqID_171106
atggagaaatctgaaaagaaaaattttagtgaaaagaagatgaagaaggcctacatcacatgggatgacaatgatatggaattatctgaggattcagaaaatgaagaaataaacctatgtctaatggcttatgaaagcgatgaagagtctaatgttatttctccaagaaaggatattttagatgatattgtagaatctttagaacaaatgcatattcatggaaaagattctaaaggaaaaggagaaggaagcaatgaagatcctccagtagaagtcaaagcaaataatgatcttccaagagagtggaaagcttcaagagatcatccccttgacaacattattggtgatatctcaaaatggggagattgtgtgctagaatttgttgatacaaagaatcagcttgctgatatctttacaaaacctctccccaaagaaacattctttgccattagaagagaattaggcctcttagatgttagtgatttggataaataa

SEQ ID NO: 79422 - DNA, 186 bp, Glycine max
  Peptide Sequence Number=SeqID_171107
atggatacttgtatgacgcagcttgaagaggatgaattaaattgtcatcatcaaaaaatgggagattgtagaagcaaagactttgactttgatgttttgatgatgccatgtgatcatgcacttctcaagtttaattcaaggcaaaaatccaagaaattcaagatacatcatcaagaaaatctctag

SEQ ID NO: 79423 - DNA, 360 bp, Glycine max
  Peptide Sequence Number=SeqID_171108
atggggtcccgttgtggtcacacagtgaccagagagggtggtgcgacaatttggatatgttcagaccattcctccacagactacgggttccagcatgacacatatgtggagccagatatccctaaggtcccagtggcaccagaagcagcaccttttgatgtggagcagcctagacatgtagtggatgcttgccaagcgatcgcaaaaaggttggagtgtctgctcaacctaaggatagtcactgtaggcacaaaaatacatgaggtcatggaagactgcataaagatcgctaggggtgtcacaacagatggcaatgtttatgtcagctcacgacgaagggggcgcatggatcagccatag

SEQ ID NO: 79424 - DNA, 225 bp, Glycine max
  Peptide Sequence Number=SeqID_171109
atggacgaaaatcaatggatgtatgacagtataatgtttgaagaagttgatatggatgataaaaatgaacaagaatgtgatatgaatgaacaacatgttgattgttcggatgctttcaatacttctcaggtgtttggtacccgagatgatgatttgcggtgggctcgatcagttgctcatgaaaacggacagattcgaggaattaaagaggtccctacttgttga

SEQ ID NO: 79425 - DNA, 129 bp, Glycine max
  Peptide Sequence Number=SeqID_171110
atggaagtggagcttgtattaaagtttggcatgagccttgggttcgctcgagttcaggtggataacaaggcatgggatgcaaacattgtagcctcttactctgtgaatatgattctgaagctgtgttaa

SEQ ID NO: 79426 - DNA, 1134 bp, Glycine max
  Peptide Sequence Number=SeqID_171111
atgtctcgaaaagaaaatcttatatctgaattgcatccgaggaaagagacatggaagatagctgtgcatataaccgatatgtgggatgttaagaagcacaatgagagacaagcgattgacatggtcttaatagaccaaatggaggttgcaagacctgaaattcctactaatgtacacatgataactgaaattgttgatattatttctggcattgcactgcggcatactttagttgatgttgtgggtgttgttgttgaagttattgaacgaaaaacagtgaatcctgcatacaggatcctcatgacactgtgggaggattatgctcttcagctagatgatgctattgaaaaaaaccattttgttagggagccgttggtgcttatgttaacattggctaagatcaaagatgccaaagtatcccttgagtgtccaaaatataaaaatggttccaagttgtatgtgaactccgatgatattgccaagataaggaaattctgtgatagtttatgtgttccattttatgttggtggactaacagaagaagggagtggttcgcaatcccagtataccattaattcacaaagaagcgattgggataagtttttgcataatgctcagatggtgagcttaggtgacataagcagactgagagagtggatgcctgccattcgtgccagaaccaagttagtcatacggttcccagttatgaaaatggaacacaatggggagaaagctaactttcatttttgggatgcaacgtgtatcaaaatgttcggtaagacagtcgaggaatgtagacaggaattgattgcgggtggtgatgagatcaaagtgttccctgagtgtgtggatgatttggttggtaagacattggcgctcaggttcaagtaccgtgtaaacatgcgccagtcatctgtgatggatgttagccaagaggaacatcatatccacacactgactttgaaaattggtttacagccttcattgtcccagtcaactgactatgaccctaggaacactgccttcatcacccctgccaaaagattgagtggtcaacaagccacaaatgaatttgattctgaggatactactccgtatgagctatccacaaataaacatattaaagctgagtaa

SEQ ID NO: 79427 - DNA, 1485 bp, Glycine max
  Peptide Sequence Number=SeqID_171112
atgaggatgatgttttcctccgctaaaggctcacaatcttacaaagatattagaataatagacaatgtcgtctaccatacttttagagaagcatgctttgcaaaaggtttcctaggaagtgatcaagaatttgttggtgttttacgagaggctaacacttggggaactccacacttccttcgaaagttatttgtcaacctgctatttatgaatacaatggagagaccagaatatgtgtgggaacaaacttggcggtggatggcagatgatattgtatttaatcatagaagtcaaggcattcaactcactgacaaagaaacaatgcatctttgtttgactcaaattgaaaacatgctacaagccaataggaaaagtctacgagattttccttcaatgccatacccaataggctatgctgccaacccacaccaaaataagctcatctacaatgaaatggcttataacaaggaagttttggctaccgaatttaacagatgctatcactcaatgacagttgcaagtcaattagggagagtttattttctctatggatatggtgggaccggcaagacatttatgtggaaaaatttatcatctgttgtatggtccaatggaggcattgttttaattgttgcttccagtaggattgcttcattattattgcccggaggtagaacaacacattctaagtttgtcatacctgtgcctacaacacaaaattcaacatgcaatattcatcaggggagtgactttgctgaattgttgcagaggacaaaattaataatttgggacgaagctccaatgtgtcacaaatttagttttgaggcacttgacaaaagcttaaaagatatcatgcacaacaacaaactttttgggggaaaggttattgttttttgtggtgattttcgaaaaatactacttgttgttccaagaggtaatcgctctgatattgcccatgcatctctaaatgcatcatacatttgggatcattgtcaaattctaaaattgacaaaaaatatgcgcttgcaatccaatccttctaaccatagcagcactgatgaactcaaacagttttctgattggttactagacataggtgatggcaaacttgggcaacctaacgatggacattgcgaaatcaccatcccaggtgagtttcttataatggattttgaggatcctatccaagcaattgttgatgcaacatatccagatttattacaaaactacaacaacgcaaatttcttgcaaaagagagctatcctagcctctacaaaagatgttgttgacaaaataaatgactatgtcctgtctttgattcccggtgacgagaaaatactaacacctgagtttcttaacaccttgaaaacatcagggatacctaatcacaagctaagaatcaagattggtattcccatcatactactccgaaatttggaccaagcaagtggtttatgcaatggaactcggctaattgtcacctaa

SEQ ID NO: 79428 - DNA, 50 bp, Glycine max
  Peptide Sequence Number=SeqID_171113
atgggaactagaggacaagatgatggaattatatctgcatgtgttccaag

SEQ ID NO: 79429 - DNA, 171 bp, Glycine max
  Peptide Sequence Number=SeqID_171114
atggcaggttttatgttgcctcccagtgatggtattggtgttgttgttgatgcttctgtgtttcacgagtcgtttcttgatggcggtattgcaaagctgcttcttggtaacgttctcaaggaaggaactgcaatttctatcaaccctcttgtgatttcatcaatgccataa

SEQ ID NO: 79430 - DNA, 810 bp, Glycine max
  Peptide Sequence Number=SeqID_171115
atggtgagcaacccctctagagctcagaagaaagccaagacttccaagaggaagcaaggtgaatggtctcaagatgctctcaacaggttggatacatggttcaccgatgaaagcaagaagaatgactataagatgatttatgctatgaagaatgtgagaatatccaagtatctggacttggaatggttctctcaacaaggtttcaacttctctaatctgttggaagctcaaggtttgtccaaactagtgcagatgaaaggaatattttatccgaaactagtgaaagtcttttacacttgcgcacacgctgacctagaaggtaatctcttttctattgtcaatggagtagaaatggttattgacactgaagtatggaaggaagtagccggactggacatgggtggagtctgtgaattcgaagaaacaactaatgggtacaacaagatgcagaccaatgggggaatgcttcttgacccaacaaggaatttgaggaatcacctaggagtaggtggtatgtcaacagaggaaaaaatgcttgtgtacctcattacctacattcttagtctgaggtcaagtaatcatgctcagatggatgaagaagttgaagctgaagctccgcaagagcctgcccatcaatggagtccgtttaagtctcttatgattcagaaaaagggcgctatgtttcacctggatcaagagcactcagctaaagttcacagttcactgaagaacatcactacttggctagaaaacatagaaactaggttgacccttaacaacctccttaaccccgatgatgatgaagcttag

SEQ ID NO: 79431 - DNA, 171 bp, Glycine max
  Peptide Sequence Number=SeqID_171116
atgtctgttgttgtttacaaggattgggttttcactgatcaagcattccccaatgatcttgtcaagagtcttgtgctccatgatcatcatggctatgctgcttctctgctgaagaagaaaagcaagcaggaattccaattgagtctcgcatcattcttggtgataaagtga

SEQ ID NO: 79432 - DNA, 516 bp, Glycine max
  Peptide Sequence Number=SeqID_171117
atgacattgaccatcccagatcttttcttgaaacctttccaggttaactgggatgctactgtgttcgaggtatttaatccagacttcccactgtacataaagcacgaagatctctctgaaatcacacacggtggtcaatgtctcaatatatttgtcttacaattatggattttgcatctgactgaaacaagtatgcgagcgaggaatttcgatgtgtatggattcctcaagccacagtctattcagagatctgggcaatcacagtttgacactgaaagttacatcaagagttggatgcagagttcaaaacgcgatgtctaccttggagcctacttaaatggcagacactggcaaatggtggtcattctccccaaggaaaaccttgttgtctggttttgttccttgcataacaggccagacaactaccttaagggaataactaacagtacattgaaaggacttgatgacactccacagcctaaatccaaggctgctgctaggtggattgttgttaag

SEQ ID NO: 79433 - DNA, 240 bp, Glycine max
  Peptide Sequence Number=SeqID_171118
atgggggctaagttcaccataaagacccccttaccactgaaattcaattcacacaaaaatgatgagaggatctcgcttggcgagctcgtctggctaagtgggaatccacttttggcgctaagcgtgacctttcgggctgagcgcaattcctcttgggttggaactgcgctaagcgtgcttcttgtgctaagagagatatccaaaagtgttattgtgcaaatcccaacgatcaaaatgtga

SEQ ID NO: 79434 - DNA, 1101 bp, Glycine max
  Peptide Sequence Number=SeqID_171119
atgtcgccggagcccggagcacacgctcctctcctcccgggatccaaggatgttcctccggcaactgtgtccggtgccgtgttcaatgtcgccaccagtataatcggcgccggaataatgtctcttccggcgattctcaaggtcctcggcgtgattccggcgttggtgctgattctcgtgattgcgtttcttgccgaactatcggtggagttcctcatgaggttcacgcgtgccggccaaacgacgacgtatgccggcgtcatgagagaagcctttggtcccttgggagctgtggcagctcaagtcgctgttgtaatcaccaatctcggttctgcagtatcaactcttcttgctgtggcatttgttacaatatgtaccgtgttggcaatagtggctattgtagaaggaagaacacaatcccctagactggttcctcgtttggaccaacatacctctttctttgatctgtttactgcagttccagtcatagtaacagcctacacatttcatttcaatgtacatccaattgggtttgagcttgccaagccatcagaaatggcaacagcagttcgaatagcattgctgctttgtggtgtcatttacttttcaataggcctatctgggtacctcttgtttggggattcaacacagtctgacattctggtcaattttgaccagaatgctggttctgcacttggttcattgctcaatgttttagtccgtttaagctatgcttttcatgttatgttgactttccctctcctgaatttctccttgagaaccaacgtagatgagttcttcttccccaagaagcctctacttgccacagatagcaagagatttgtgagcctcactctagtgctgcttgtcttaagctacattgctgctattgtagtcccagatatttggtacatatttcagttcatgggatcaacatctgctgtgtgccttgcctttatcttccccggtgctattgttctaagggattcttacggtatatcaacaagaagggacaaaattattgcactgtttatggttatactagctgcgataacaagtgtgattgctatctccaccaacatatacaaagcctttcagtag

SEQ ID NO: 79435 - DNA, 357 bp, Glycine max
  Peptide Sequence Number=SeqID_171120
atggccgagtcgtccccgccggaaacgccggaactgacaaccgagttcggtgccggatccgggtcgggtcaaaactggggagtaaggagagtgggtttgagagctgaaattgatacttcgccgccgtttgggtctgtcaaggaagcggtgacccgttttgaaaaaaccggaccttggataccccttttcaattttggagaggcttataaatatttttgcataagagctgcaaaaatgcttccttttctgagcctctcagactctccttgcattcagttcaaacatagtgtagctcttgatttgtggaattatgcccctgtggtgatttactctctgatgttggagattgtttgttaa

SEQ ID NO: 79436 - DNA, 63 bp, Glycine max
  Peptide Sequence Number=SeqID_171121
atggaaaataagatgaagggtactacaatcgcctcaggaattcaggttgtcaagcaaaagtag

SEQ ID NO: 79437 - DNA, 309 bp, Glycine max
  Peptide Sequence Number=SeqID_171122
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccatatcttcctgttgacattgttgcttataaccaatccaagatacactag

SEQ ID NO: 79438 - DNA, 927 bp, Glycine max
  Peptide Sequence Number=SeqID_171123
atgactttttctccacaccagcaccagagtcagagtcatcaacagtggtgttggacggttgttgggtggaggtggagcacggtggtgttgggtgaaggaggttcggcccatgcgcatctcacattaggaaggttatttttggacatttacctttacatcctaacacctccctcgcgcttttcctcgttcccaaacccgaaaggcccagccacagagtctccattgcccatcgctctctctattagttcacgcgcggcaattggagattcacgcgccaccatggcctctccatcgagcctccctatatcctcccaatcaagcgcttccgccgccggcgcctcgcagtcccagcctccgatcgcgacgccggcgttccgcgccttcatctcccgcatctcctcgtcgctccgccacgccttcgcgcagcgccgcccgtggacggagctcatcgaccggagctccatgtcccgacccgacaccctcgccgaagcatactctcggatccgtaagaacttcgcctacttccgcgtcaattacctaaccctaatcgtgttggcgctcgcggtctcgctcatctcgcatccgttctcgctattcgtcctcttcggtctcctcgcgtcgtggtcgttcctttatctctttcgcccttcggatcagcctgtcgtcctcttcggacgcacattcgctgatcgcgaaaccctagggatcctcgttgtgctcaccgtgttcgtcattttcctcaccagcgttggatccttgttgatctctgcactcatggttggattggcgatcgtgtgcgcgcacggcgctttccgcgttcccgaggatctgtttctcgacgatcaggagcctaacagctccggattcctctcgttcctcggcggcgcagccgcttctgccgccgcgccggcagtcgcgcgcgtgtga

SEQ ID NO: 79439 - DNA, 906 bp, Glycine max
  Peptide Sequence Number=SeqID_171124
atgggtgatcatttggcgagggccgaggattttgagaacaaggcagagaagaagctcagcggttggggcttgtttggctccaaattcgaggacgctgctgatcttttcgacaaatccgccaattcttataagctcgctaaatcatgggacaaagcaggatccacctacatcaaattagcgaattgcaatttaaagttggaaagcaagcatgaagctgcacaagcttatgttgacgctgcgcattgctataaaaaaactaatataaatgagtctgtatcttgcttagacaatgctgtaaatatcttctgtgagattggaagactctctatggctgctagatatttgaaggaaattgctgagttgtatgagtctgaacagaatatcgagcaggccgttgtttactatgaaaaatcagctgatttttatgaaaatgaagaagtgaacacttctgcaaaccagtgcaagcaaaaagttgctcaattctctgcccagctagaacaatatcagaggtcaattgagatttatgaagatattgctcgccagtctctcagcaataatttgctgaagtatggggttaaaggacatcttcttaatgctggcatttgccaactttgtaaagatgatgttattgctattaccaatgcattggagcgatatcaggtccaatatttttcaagaatttacatcttgagaccggacttggatccaacattttctggaacacgtgaatatagacttctggcagatattgctgctgcaattgatgaagaagatgttggaaagtttactgaagttatcaaggaatttgatagcatgacccctttggattcttggaagacaacacttcttttgagggtgaaggaaaaactgaaagccaaagaacttgaggaggatgatcttacttga

SEQ ID NO: 79440 - DNA, 246 bp, Glycine max
  Peptide Sequence Number=SeqID_171125
atggggtcatcatcactctatttgtctcagaacatggtaactgtttgtcacctcctcagatgcagcttcaccatcctgttaagaaacaatctaaggtcacacctttttttccgtggaacctcgtcggaatcagacaaaggtcacacctttttcctccaaagcaatttaaaaatcaaaggggaaaaaaatcgaacaaagaatgcccttgcatgggcaaagcgtcgtgaccttcaacaccgccgttag

SEQ ID NO: 79441 - DNA, 705 bp, Glycine max
  Peptide Sequence Number=SeqID_171126
atggctgaagtaaatgaggtgcaagagctgatgaaggccgacatggaggccatgaaagaacaaatggtcacaatgatggaggccatgatgagcatgaagaagataatggaggtcaatgcggctgcacgattgcacgccctcgactttagaggactgcacgtcctcaccttcagagggctacacgccctcgcctttagagggctacacgccctcgccttcagaggactacacgtcctcgccttcagaggactacatgtcctcgccttcagaggactgcacgtcctcacctacagagggctacacgcccttgccttcagaaggctccgcgccctcgacttcaaaggactacacgtcctcgccttcagagggctgcacgccctttccttcaaagggatacatgtcctgaccttcagagaggattgcgccttcaaaggactacacgtcctcgcctttagagggctacaggtccttaccttcagaggactacaagtccttgccttcagagggctccatgtcctcgccttcagaggactacacgtccttgccttcagaggactacacgtcctcgccttgggaggactgcatgtcctcaccttgggaggactacacgtcctcacctttagaggactacacgtcctcgccttcagtggactacacgtcctcgccttcagaggactacacgtcctcgccttcagaggactgcat

SEQ ID NO: 79442 - DNA, 470 bp, Glycine max
  Peptide Sequence Number=SeqID_171127
gccactcgatccaacagtaccctccactagaattgatccacaagagatgtaccctctcttgttctcagtcaacaacccaagtagatgtaccctctacatataccacaaaggatgtaccctccaatgtgttaagacagagatctcaggcggttaaacctttgatactttgtgaatggggaaacaaaagaattctcaggcgggagaagggagacacaaaagaattcaagcggttagtccttcgttcttttggaaaagggagaagagagacacaaaaagaattcaagcggttagtccttggtgaattcttttttgcaaagggagaagagatgaaaagaatgaatagcacaagttttcaaggtttagaaaatcagaaaactttggaaagcttttggcacaaagaagaagaagaagttcaaagagattcaaggcttgtaaaggattgtataagattgattggaaaagtgtattga

SEQ ID NO: 79443 - DNA, 522 bp, Glycine max
  Peptide Sequence Number=SeqID_171128
atgaacatcttgacaacacacgatcaaaggtgggagcaggagttaattctttacaatcaatatgaagaagaaagaactcctaatcttgaaagtgtgtttgaagaattcatggcttaccatgctagctcaaaagctaatcaaaattcaatgaaaaatcatgaaattcattttggtaagaactactcaatagaaaactttcaaaggggacaagagttacaaccttactatcaaaatgaagcagaaagaggttccaatatggataaactattgatgcaattcatggaaacaactaaatcaactcaacaagcactccaaaatgtagaaatccaggttggtgaactggcagaagcagtaactcaatttatgtccagacgagaaaaatcctttgtagagactgaagctcaagagaaaaagatgagcagaaagataaggaacaaatacaacaacaatgggagaagtattcaacagcagaagaccaacagggaaatattctccatagcaataaccttcctcatcaactga

SEQ ID NO: 79444 - DNA, 477 bp, Glycine max
  Peptide Sequence Number=SeqID_171129
atgggatttatgttggtaaacctaaagaaacttggttaccacaatgaccctttcatcatggcagaacaagctagacaagtattttatgtgcaagacccttgtgatgaaaggtggatcatggcttctccaccttcctcgcctcctcctcctcctcctcctccttcctacgcatcagcttcgccgtctatcgtgaagtgcacacggaaagcctcacatctacgatcattgtctactagaccacctggtgctgagagaccagtggtccatgttgatcctgctaccgacaaggctgacggtccccacaagaagaaattaagaacatatttggggattgtggtgcatgataagatggacgtgatgtatgagaactggaaggaggtccctactgctcaaaaggacttgatttgggaggatattcaggcggaatttgaaatcccagaggcttctaacagtaggaggaaaaagaagttactttag

SEQ ID NO: 79445 - DNA, 291 bp, Glycine max
  Peptide Sequence Number=SeqID_171130
atgtcgtcacacacgcattgtatgttggtctcatcttttgtcatgggaagccggaaggtccatatcaccttcttaaactgcacacatggggcattgcgcccccaaatgcgcaagaaagaacacgctttacggcacccttaccaaacctgtgctagagccaaagcaatgggtgaagtagaggaggtgcaagagcagatgaaggacgacatggaggccatgatgagcatgaagaagataatgaaagccgatgttggatcaagtgacctcggaataataagaagggggggttga

SEQ ID NO: 79446 - DNA, 273 bp, Glycine max
  Peptide Sequence Number=SeqID_171131
atgggagaacctcgaaacccctcagcacaaccaatattcttttccgcagacgggccacccccggcagttgaagaaaagaggaagctcgatctcaacgaagagagattgaaggttattgaaggctttggcgactatccgtttacagacatgactgatctttgcttagtaccagacgtcatcattcccccaaaatttaagctacagaacatggttaagagggaaagcgagtcccttaaggagtacgctcagcgttggagggatctggcagcgtaa

SEQ ID NO: 79447 - DNA, 209 bp, Glycine max
  Peptide Sequence Number=SeqID_171132
atgtcgcgaaaccttacggattgcgcaacaattccttctttgacttctggaatgttgtggaactttacggattgcgcaacaatgtttcctttcgacttctggcatctcgcgaaacttctcagattgcctaacgatgggtgtcaagttcctcgaagcggtcatgcgaaggtcgcatcccaacaaacagatggtccccggacgaaattagg

SEQ ID NO: 79448 - DNA, 405 bp, Glycine max
  Peptide Sequence Number=SeqID_171133
atgttgtcggtgctctgcgtgaatgtggacaaattcactattatcatgtgggaatatatagctggcaatgaatcaaaagttcaaagatttgcaataaatttagatgacgattctaacgatgatgattacatgatatctaattcatatgttgaggactcgttggatgaggaggaagatatcgatgatatatctgacatagatgaagaaggtggaagtgagactgcattttgggaatctgcttctagttatagtaacattaaatggagtcatccgaatgaagaagacatttgtggtttcgatatgagatcaaccttcaatattgtccaagaattatttgttggcatggaatttgaaagcaaaaatgcattaaaaaatgcactgcaaaagtatgttatgaagggatga

SEQ ID NO: 79449 - DNA, 123 bp, Glycine max
  Peptide Sequence Number=SeqID_171134
atgcgtcctccgttatcaagttcggagactccggtgagtgcaaaatacgggaaagaaggagagatgggagtcacttatttcaaatcgttttgggttggaactattgtgattgagatcaattaa

SEQ ID NO: 79450 - DNA, 339 bp, Glycine max
  Peptide Sequence Number=SeqID_171135
atgggtagtgggagatcgaggcgacggttaccagtaaatgtgccatcatgtcgccgtttcaggaaaactgaaagaagagtttatggaaagggattcacaggttcaaggaagtatttacaaagtataaggctaagacaagaaagagggcttcgaaccattgggcgaatcgagctggcatatggtcgaatcgaagtcaaggcagcaagatttctggacttagcgcaatttctgacaaaacttcacaaaatcagttcgacttcgagcgatatggataaccgttctaaggagcagttatgtgcatgcaaggtgtatgtagcaggacacttggcattaggatag

SEQ ID NO: 79451 - DNA, 195 bp, Glycine max
  Peptide Sequence Number=SeqID_171136
atggctgagtctcctcaggagcaggtgcagatggtggagatggctgtggggtcttatctggagtgtcataggctcctaggctgtagaggccccaccccctccagaggaagaaggctggtctcttggtcaggccacctatgcatcaaactcctccatgcttataatgtgttagacaagtggcctcagatatcttaa

SEQ ID NO: 79452 - DNA, 763 bp, Glycine max
  Peptide Sequence Number=SeqID_171137
tgcgcgccagcacggcgctggcatcgccgggttcaggcgtggtctcgaacagggcgcgttgcacgtcgatcacgatcagggcggacgtcatggttctctcggaaaaagtgggtcgcggcccggcaaggccgggcccacgggaacggaaaggcgggctaaccgcattcggcgccgaccagcgcgggcggccagatgcgcgcgtacatccagaaatggcgcggctcgccgcgcacctgccggtaatggtgcagcagcccttcgcggtggaaatggcagcgttccagcacgccggccgaggcggtattggtgtccagcaccgtggcctgcacccgcgccaggcccagcgtctgcagggcccacgcggtcatggcctcgcaggcccgcgacgcgatgccgcggcgccagtgcgaaggcgcgaggtcgtaggcgatttcggcgcgacgcgcgcccggcgcgatctcgtgaacccgatcgtgccgatcaggcggtcgtcggcctcgacgatggccaggcgcacgcagtggctggcggcagggtcggcatagccgcggatcaatggcgccagcgcgtccgggccgtccagctgccaactgataggcataccactgtgtcgcgtcggtgtcgcgcaagggacgcaggcgcaggccggcgatacccaggtcaggcgcgcgttgcggccagtcggcaagaggcaggagcatggggaagccacgtcgcaaagatagtgccggcgcgccttcgcgccggccatgggacagcttaa

SEQ ID NO: 79453 - DNA, 396 bp, Glycine max
  Peptide Sequence Number=SeqID_171138
atggcagtgcagttgatccatgatcgcgttgtgatggagtgcctagagggtgtttgggagaccctcaaaggcaatgagaggtgccgatttcgtgccacaattcgactcactgctacttcgctacctgtggagtggatactacctacacctactccatatcgactagttgagcctgttcaattgatagaggtgtcatcatctgaagaggatcttgaagaggacccaaaggagctacctcctgaacttgctatggatgcccctgacttaccagaggatgatgaggacccgctttctgatgttgattctccagaggatattatgtcagcgtctgaggcagactctacagaggagagtggccctgaagggacagcgaatagtgatgactcttcatcatag

SEQ ID NO: 79454 - DNA, 402 bp, Glycine max
  Peptide Sequence Number=SeqID_171139
atgaggggccaagacatttatagtagccaagataaggctactactttaccttcctctagtgaatgtgaagaagcaaaaggggcagaatctagtgaagaaatctacccccaagaagaaggactaccattagtggttaaagagaagtgtaaggaggcactgagcgaaatccaacttgctaagcgcaccgtcttcaccttcaggctgagcgacttttttggctgtggagagactgagaaagagctgagcttgacgaggaagccatcttgtggagcttttgatgagattttgagaggttgtgaggaagcttccctgctatggagagctaaatcctcagttggttcttcctacggggtacttgatggtcactcaatattgggaaatggtttgatccttagaacctga

SEQ ID NO: 79455 - DNA, 219 bp, Glycine max
  Peptide Sequence Number=SeqID_171140
atgaattggattcatgcatcctccacgatcgagtctggagccccacgaattgccttgccttgcactattcatctatcctccaccctcaaatcttatccggaggcccatgaattgattgtcattcatgcatcctccaccatcgagtctggagccccacgaattgattgcctagcgctgttcgtctatcctccaccctcaaatcttatcggaggcccatga

SEQ ID NO: 79456 - DNA, 433 bp, Glycine max
  Peptide Sequence Number=SeqID_171141
ggatcacacccacaagacacccagtggacccggagaaatccaacagggccctgaggtttccagctttggttacgggcctctgtcagtcctacaggatgctcgtcccccctagcaagcctgcaagacacccagtggacccggagaaatccaacagggtcctggggtttccagctctgattacgggcctctgtcagttctacggagtgcctgtcacccccagcaaggtcatcaggcctcctactaaccgagctttcatcaagaagtgtgcccccaggcaggcacagggcgagacaccacaacagtctggggatggccgacagcgggcaatagacgcaccgccgccacctccagagcccctcagctcatctaaaaaggttggagcgtggcctacgacccgtggccgaccaacaggtgaccaagtccaaagccaaag

SEQ ID NO: 79457 - DNA, 297 bp, Glycine max
  Peptide Sequence Number=SeqID_171142
atgccaatctccccctgcagatgtatcagttgggatcgcgcccataagacgcccagtggacccgaagaagtccaacagggccctggggtttccagctctggttacgggcctctgtcagtcctacagggtgcccgtcccccagcgaggtcatgccatcgtgacatagggatcgcgcccacaaagacacccagtggacccggagaagtccaacagggccctggggtttccagctctggttacgggcctctgtcagtcctacagggtgcccgtccccccggcaaggtcgcatcatcatga

SEQ ID NO: 79458 - DNA, 369 bp, Glycine max
  Peptide Sequence Number=SeqID_171143
gttggttttgaggaagttaaagatgcagatgctcccattcctgtacccactgatgagggagctgtgtctctagcaaaaccttcagataggtcgcatcctgaggtcgatgatcccctatatctgatgacattgaccatcccgcaactttttttgaagtcgttgcaggttatgtgggatgcttccctgttcaggctgtttaattcagacttccccttgtacataaagcatgaagatctgtctgaaatagcacatggtggtcaatggcttagcatctctattatacagttgtggattttgcatatgattgagacaaatatgcgattggggaatttcgatgtgtatggattccttgagtcacagtccatctag

SEQ ID NO: 79459 - DNA, 117 bp, Glycine max
  Peptide Sequence Number=SeqID_171144
gcaggagaggcaccagcaggggcactagcagaggctcccgacgaggcagatgaggcccgtgaggacgaagagatgactgatttacttgatttcttaggagggagcggggccacatga

SEQ ID NO: 79460 - DNA, 1149 bp, Glycine max
  Peptide Sequence Number=SeqID_171145
cgcagatctgcaattgctgcaacagttacagcgcgagctgggcctcactatctgtttatcacccacgatttggccaccgtacgacgactggcacacagcgttaccgtgctgcgcgccggcgaagtggttgaacaaggtgacaccgtcacactgttcaatgcgccgcagcatccctacacccgcgcgttgattgacgccattccgcgctaccggctggcgacggaacagattcagcatgctgaacgctgcggatttgacagtgcctggatcgcgcagcaccactttcatgaaaaggaaggcgggctgccctcaccgctggtgtttcttgctcacgtggccgcgcacacacgtcatatccgcctcggcaccggcatcatcaccctgccgctggaaaatgccctgcgcgtggccgaagacgcggcggtgctggatctgctgagcgacggacgcctggaagtggggctcggctccggcggcacgccaacctcatttttgccgtttggcctgaccagcgaacagcgcgccggcgtgtttgccgaccagttgcatacgctgctcagcgcgtggcgcggcgacacgctggcccatccggacaatcatctctatccgccggctcccacgctggcgcagcgcgtgtggatcgccaccttttccgttgcaggcgcgacgcgtgccggccaggccggtcacgggctgatgttatcgcgcacccagccgcggccggcgggtcagcctgacctgtcgctgcagcagctgcaaaacccgatgatcgatgcttatctcgcggcgctgccgtcgggcgttgcgccccgcatcctcgcttcacgcaccgcgtttgttgccgactcgaacgactacgcgcgccgccttgccgcgcccggtctgcagcgtcaggcggagcagtttcgcaaggcgggccacgacatcaccggcagcacgctggagagccacgcgcgccagctcgatgcgcatatcggcgatgccgacgcggtgctggcttcgctgctggccgacagcacgctgacgcgcgccaccgacatcaccttccaggtgcactctatcgatccgccgcacgccgatacgctgcgttcggtggcgttaattgctgaacatattgcccccacgctgcgtgcgctgggtaccgcttaa

SEQ ID NO: 79461 - DNA, 270 bp, Glycine max
  Peptide Sequence Number=SeqID_171146
atgacattcatggggatccgagaaaaagtggaaaatggagaattggcaaacagcgctaggcaaagacatccgtggggctccagactcgaagatggaggacacatgaagagcgctaggcaaagacattcatggggctccgaaaaaagtggagaatggaggattgcactagagggtccacacttaggcaatcatgaagcatatctccaaactcgaaggtggaggacacatgaacagcacttggcaatgacattcgcggggctccagacttga

SEQ ID NO: 79462 - DNA, 672 bp, Glycine max
  Peptide Sequence Number=SeqID_171147
gctgaatttgatattcctgaagcatctgatttaaggacaaaaaagaaaatacttcagactgtgggggagcggtggagacagtttaagtctgatttgacgtcgaaatgggcacttgcagctgacaaggatagtgttgatgacactgtatgcaaaatgtacggcattagcaaggagaaatggacccaattttgccagagccgtagagacccttcatgggagaatgttcgaaaaaaagcacaagctgtccaaaaacaaaacactgcccctcacgtgatgtctcgtgggggttatgaatatttagaaaaaaagttgatggatgagaagagaaagaaaaaactagagaaagcaactcaatccggaagcactgacaccgtcattgatcctccatctcccatcaaacgacacgtgaagtggaagctagcccgcaccaagaaaactggtgacatgacatctgaagcagcaaaggaaattgctgacaagattgagccgtataaccatcaaacaatactttggatcagcttcaaggacctcctccattgctcccgaatacctgcaacagttgacgcaacaaatcaaggaccaactagaggattcaatcacagaaaaagtcactcgacggctaatgttatccctcagccaaatgcaatcacagggactcgcactgcctcctga

SEQ ID NO: 79463 - DNA, 411 bp, Glycine max
  Peptide Sequence Number=SeqID_171148
atgcagtatttcactaatgttagaccattggaaccagagagattgaaggcgcttcgcatccagtgggcaaagtactatttgaaagagaagttccttcggtatcgaacaagcttagcaaacgtttgcagatgctctcaaaatcaatcccaagggattgagctgaatgtacaaaaggatgaggggtttgtgacaaggaatgggatgagtgctacggaaatggttgctggtggttggctgtgtggaaaggatggcaagggaaggggtggttcaacggatgtggaagttggtatggtagccatggaagacaaccatgagctctcaatgaaagcaccaaatgctacaaacgcaggaacaatggggaagaataacctagcttcgagggctaggaacctccataagagagaaaaataa

SEQ ID NO: 79464 - DNA, 492 bp, Glycine max
  Peptide Sequence Number=SeqID_171149
atggaaactacaaccaacttttccgcagccatcgaggagaacccaaagggccattgcaaggctattatctctaccatagagtgtgatgcgggaagtgaaaaagaagaaaaggtacaagaaagcaccatgctagaggaagagatgaaagcacaagccaacccttcaacccaaggtatgcaatcctcacttaatcctccattgtttgattttatcatgccaagcattcataagcaaagagacgatgaaaggatggtcaaattcaagaaatatatggagatgctacaagggaagagggaggaaccacctattgaaaaaactcacatgggatgtgccacatcaagcacaagttgcaacctcatgcctcattctttcttagaaaatattggtcaccttaacctaaagcttgccaacatgactctgcaatttgccgatggttctgaaaacaaagcactatggaaatcaaggagaactaccaaattccaatcattctag

SEQ ID NO: 79465 - DNA, 690 bp, Glycine max
  Peptide Sequence Number=SeqID_171150
atgtatggtgttgacaagaaggaattgttaaaggctaacatctcaagagggtatttgcttatgaaaaggaattcatctgtttacatcttctacatgtcagctaaggctgagacatacttaactgtccaaggtaccccttcggacatgcatcttcagctcgctcaaatctccatggaagtccctttgatattggaggaggaatatatgggtttcttcctcgacagcttacatgaggatatccgaatggaggatggtgggccaaccctgtctgcaactggttctagcatgccaacggataaagggcccagatacaattcagaccaatccaccaatttgaactctcgaggacatacttgggatgacccaattgacgaaattcaacctgtctctgatgacccaccaacatttgacgaccatgaaatggaatgcctcactctgaactatcgtgctttggatccaagagagttgacatgttacatcaccatcaaactcgagggagatttgcttgtggtagctgatgttcatcccagggggttgccaagctttacaaatcaaaattggtgggtacaccatcgtggtgaatgcatatgttctagatttgtggagagtcaacttggttttggatggctcgctacttgtggtctcactactatggattggacgaagaagatggtgagttttgacgatgag

SEQ ID NO: 79466 - DNA, 2661 bp, Glycine max
  Peptide Sequence Number=SeqID_171151
atggacatcctcttcgcccagatccaagccgacctccgctccaacgacgccctccgccagtccggcgccctactccaggccctccagcagtctgccgcgggtcgcgacatcgccgtcatcgccaagaccgccgtcgaggagatcgtcgccgctcccgcctccgccgtctgcaagaagctcgccttcgacctcatccgctccacccgcctcactcccgatctctgggacaccgtctgcggcggcatccgcaccgacctccacttccccgaccccgacgtcgctgccgccgccgtctccatccttgccgccatcccctcctaccgcctctccaagctcatctccgactgcaacaaggaaatctccgactgcttcgactcccccagcgactccctccgcttctcggccaccgaaaccctaggctgcgtcctcgcccgcgacgatctcgttaccctctgcgaaaacaacgtcaacctcctcgaccgcgtctctgcctggtgggcccgcgtcggctccaacatgctcgaccgctccgacgccgtctccaaggtcgcattcgaatccgtggggcgcctcttccaggaattcagctccaaacgcatgagcaagcttgccggcgataagctcgtcgattccgaaaactccctcgcgatccgctccaactgggtctcctccatggtggacttcgtgtggcggaagcgccgcgccctcatggcgcgctccttgatcctccccgtcgagaatttccgcgccaccgtgttccccgtcgtatactccgtcaaggccgtggcctccggtggcgtcgaggtcattagaaaactctccaaggcttcctctacctctgcatccaatgcggatgctgaggttgattcccacgcggagaagctggtgggggtttctgatgtgctcactcacctggctccgttccttgtttcgtcgttggagccggcgttgatctacgaggttgggatcaatatgttgtatctggctgatgtgcctggagggaagcctgaatgggcctcacaatcgatcattgctattctgacgctgtgggataggcaggagtttgcttctgccagggagagcattgttagggctgttgtcaccaatttgcatctccttgatcttcacatgcaggtatcactgttcaagaggttacttttaatggtgaaaaacctaagagcagaatcagatcgaatgtatgctctagcatgtatatgtagaacggctctttgtgtacatctatttgccaaggaaagtgtacgaagagggcaaaaacctcttcccggaacggatatagcttccctttttgaggatgccagagtgaatgatgatcttaatagcattacaagtaaaagtatatttagggaggagttagttgcgtcgctggtggaaagttgctttcagctgtctcttccattgcctgaacaaaaaaacacgggcatggagagcagggtcattggagctttggcatatggaactggttatggtgcattaaactggactgaacctgctttggaagtagtggaagtttgtcggccttgtgttaaatgggattgtgacggccgcacctacgcaattgactgctacttgaagttgcttgttaggctatgttacatatatgatacccggggtggtgtaaaaagagtcaaagatggagcttctcaggaccaaattttgaatgaaacaagattgcaaaacttgcaacgtgaacttgtgaaggacttacgcgaggtcaatacaccaaggatattggcccgccttatttgggctattgcagagcacatagatatagaaggattggatccgctcctagcagacgacccagatgatcctcttaatgtcattatatcaaatattcacaaggttcttttcaatatcgattcaactgcagaaacaacaaatagagttcaagatgtacaggcagttcttatatctgctcaacggctgggatcacgccaccctagggctggtcagttacttaccaaagagcttgaagagtttaggaacaatcctttggctgattctgtcagcaagcatcaatgtcgtttgatattgcaaagaatcaaatatgctacaagtcatcaagacagtagacctcctattagaaaaggaatgactacagggaatattttgttatcacagaattggagagaaggttgtataaagatggagagagtcaatgaggggtgggcaggggttacagaagctagaggggattacccatttagccaccacaaattaactgttcagttttatgaagcatctgctgctcaggatagaaagttggaaggattggttcacaaggctattctagagttatggagacctgaccccagtgaactaacccttttactcacaaaaggagttgattctactttactgaaggttcctccaaatgcaattactttgactggaagcagtgatccctgctatgttgaaggttatcatttagctgattcaagtgatgggaggatcactctgcatttaaaggtcttaaacttaactgagcttgaattaaatcgggtggatgtgcgtgtgggattatcaggtgcattatattatatggatggttcttcacaagcagtgcggcagttgcgtggtcttgtttcacaggcaggtgtcaaggaatgcctgatcagctgggcctattttgacacttaa

SEQ ID NO: 79467 - DNA, 342 bp, Glycine max
  Peptide Sequence Number=SeqID_171152
atgaccatctcttggaatcctttcttcaattgcttgaatctcttgaggattacaatagtggaggcaaatcttgttggagcaatggatagcaatttcaatgaattgaatgaattgaaaattgatagtctcatagagtgtgtttcaaaagttaaagaagcgcaatgtcgtgtccggtgctccatcgccttgtccgagccgtgtccctaccgtgtcggagccatgtcagagccaaaaagaatgggtttttcaattaggacaccggtagggcatgtccaatgcgcgttgtacgggcattgtaccagcatcgatgtcgggttcgtgtcagacacccggacacggtaa

SEQ ID NO: 79468 - DNA, 285 bp, Glycine max
  Peptide Sequence Number=SeqID_171153
atgaggctaaactgtctgcaagctgttaatttgggcaaatgctcagttattaaggcagaattgtgggctattcacctcactactacccgggccaagtcacgtggtttccttctggtggagattgatactgactctcagctaaaagtgaatatgattcagaagggtgtgtcgttgtatcatccttgtcatgctattgttagtgaaattctggaggtcttgattgcttttcagaattatggtattaggcatatttatagggaagccaacttccctgctgtctgctga

SEQ ID NO: 79469 - DNA, 207 bp, Glycine max
  Peptide Sequence Number=SeqID_171154
atggcaaatttgctacacatcaattacaacaccaaaggtaagagaaagacatacctcgtcatcaatgctaacactgatacctcatcgccgagaagaatggccatcgagagcgagaacacgactggcagcgagtgcgagtggggcacgagcttcatacgagcgagtgcgagtgtgggcgagaagagggaagagttggagtgccgttga

SEQ ID NO: 79470 - DNA, 267 bp, Glycine max
  Peptide Sequence Number=SeqID_171155
atgggtggaggagaaggagaagtaaatgctaggttgatgatgaaggctattcaagaacaattcaaggcttcaaatacaaaattggatgatctacaatctatgtttagatttagaagtccaagggaaaacacttatgaagaaagggaagaaaattttttggaggaggagaagattgaactagcaatttctaagttcattgattatgctagtatttggtgggatcaatttttgagtagtaggcatagatgtggagagaaaaagagttga

SEQ ID NO: 79471 - DNA, 267 bp, Glycine max
  Peptide Sequence Number=SeqID_171156
atggctatggtgatgggtcccctccttgggaggattgcatcaacaagagaagggcttagaagtcaatattacctcaaagaagctatgaaatggaggattgggggaattttctccaccaaatccttgaggaggattctgaggatttcgctccaattaaagtgttcctcttggtgtgtgggtttggcggcaagcaacgacagcttgcggcggccaccggtggtcgtgggtggtggagaaggaggtgttagggtctgggtggcgttttag

SEQ ID NO: 79472 - DNA, 192 bp, Glycine max
  Peptide Sequence Number=SeqID_171157
atgattcaaaggactaactgcctgggaattctttgtcccaacacattggaggttcaagtggagggtacatccacttggtttttcaaagagaacaagggagggtacatcccttgtggatctttggctagtaaagaattttacaaggttgaaagaaatctcaagaaccgcaggttgcttggggactggatgtag

SEQ ID NO: 79473 - DNA, 240 bp, Glycine max
  Peptide Sequence Number=SeqID_171158
atggcgtctgggcttagagaaattgggtttcagagaaggaggacgaggacaaggaggaaaaaggatggaattggtaatgagttaaacccacataaggggaaaaacgatgatctcggactcattcactgttggatcgtcgtgaaatttgagtaccatgttcgcaacccaattttgggcattctcactgttgggaattgcaaaaacatgacagagctaagagaaatacccttcgcaccgtaa

SEQ ID NO: 79474 - DNA, 339 bp, Glycine max
  Peptide Sequence Number=SeqID_171159
atggcttttgaagcaaccattagtgctatttgcacctccgttcgcctcatagggacgactataatagggactatagggaactctattgttgatttctctgttcttaaaaaactctatgtttctactagcattggcattgagagtgctttcattgcaaagattattgcatccatcctcgcaattgaaaaggtcatacttggtggaattcaccaccttctttcatttcttaggagcttagtagatacacagatgagcttccttttcaaaggttcatttagtcttgcttcattgggtatggtttggccctcccaagtgttttgttcatcttttcatcaataa

SEQ ID NO: 79475 - DNA, 1332 bp, Glycine max
  Peptide Sequence Number=SeqID_171160
atggcggaaccatcaaagaagcggaaaggatcctcgagtcagagtcaacgacattccgggtcacaggaaacaccaattcctccctccattccctctggatcattgttttcatcagaggaacagcgtatacagtacacaaacctcttttcatcttgttccattgtagacccaaaattcatagatatggagttcttttcaaatgagaattttgaatgcttccaagcatttgaaaactccaatcttattccattcatgtctctgaaattacctgtctattctgaattagtcaaagctttctattctaatttagaaatccatgaaggtatcctaatgtctgaaatctatgggattaagatggtcattgaccaatccctattttatgatttaacaaaattgcctagtgaaggtgtgccttttgagggtgcactgattgatgattggaaattcaatttttctgtgcatgatgcccgccgattggtctgcaccaaccaagcggatatgaccggaaggcttcttggcggttcattggcttttgagagccgcatcctccattaccttattgttcgcatcttactccctagatcttcaaaccttgctcaggtttctgaagaagatctcattgtcatgtgggcctttcataaaggtttacaaattgattgggcacaccttgagcatgatggctcttgggtgaagaagggtgctagaaatgttggtgaagaaggacatgaaggagaggattcatctcttctttcgacgattatggacaggtttgatggtcttcaaacctttgttggtgagaggtttgacactttggaattgcaagtggatatgcgcttcaatgaaatggagtcaagaaccacaaaggttgaagaagatgatggtctgcggtactctgttgcctacactaagcatattaagaggaagacaggtaccgttgtggctgttgttgccgctctcaagaggcaacgtaaggtggagagggctggccatggtgtggcatgttgcggcatgagtgcggggcgtggcggcagagttggcatggacgtgggtgttatgcgcgtgagtgacgggggtggcttaatcggcggaggcaacgacggagtcagcggtggaggcaacggcgtggtcagtattggggcggcgactgtagagggaaggaaaatggagaggagtgtggtgagtggtgttgttgttgttgttgagtggtttgcagaggtgcttcagccatggtgggaggattcaatgaaagcaccaaattgttataagcagaatttctactctaaggcactagccaaggatgctactacggaaacaaaaggtgctagaatgtga

SEQ ID NO: 79476 - DNA, 258 bp, Glycine max
  Peptide Sequence Number=SeqID_171161
atggaagcaaggaagaagaagggtttcggaagcgaggaagaagaaaggctaagacaagaaagagggcttcgaatcattgggcgattcgaactggtgtatactcgagtcgaagtcgaggcagccagatttctggacttagcgcaatttctgacaaaacttcacaaaatcagttcgacttcgagcaatgtggataaccgttctaaggagcagttatgtgcatgcaaggtgtacgtggcaggacacttggcattaggatag

SEQ ID NO: 79477 - DNA, 75 bp, Glycine max
  Peptide Sequence Number=SeqID_171162
atggcaccaaaaacttgttcgaacccggcaagtgcaccggatcacgcaagttgtataaaacagtatgtaaactaa

SEQ ID NO: 79478 - DNA, 1207 bp, Glycine max
  Peptide Sequence Number=SeqID_171163
gatcccaccgttgggcatcaaacctgacgagatcatggcgctgggcgaccaggaaaacgacatcgcgatgattgaattcgcaggcatgggcgtggcgatggataacgccattccgtcggtgaaagaggtggctaactttgttaccaaatccaacctcgaagacggtgtggcctacgcgattgagaaatttgtactgtcccgagcacaaggactctccatgacgctgaacaaaaccgatcgcattgtcatcacgctgggcactcagattgtgggtggcaaatacgttcccggttcgccgctgccagcagaggctgaactgtgcgaggagtttgaaacttcacgcaacattatccgggaagtgttccgctcgctgatggcgaagcggttgattgaaatgaaacgctatcgcggcgcgtttgttgccccgcgtaaccagtggaactacctcgataccgatgtcctgcagtgggtgctggaaaatgactacgacccgcggcttatcggtgcgatgagtgaagtacgaaacctggtcgaacccgccatcgcccgctgggcagcagagcgcgcaacgtcaggcgatctggcgcagattgagtcggcgctcaacgacatgatcgccaataaccagaaccgggaagcgttcaacgaggcggatattcgctatcacgaggcggtattgcagtcggtgcataacccggtgttacagcagcttagcgtggcgatcagctcgctacagcgagcagtatttgaacgtacctggatgggcgatgaggccaacatgccgaaaacgcttcaggaacataaagcgctagcaggcagcactcaccatgattgccagctcgacacgaaggctgaaggaaatcacatgacatcacgctacatcgcaattgactggggatcgaccaatctgcgcgcctggctataccagggcgagcagtgcctggagagcaggcaatcagaagcaggcgttacgcgtctgaacgggaaatcccccgaggcggtgttagctgaggtgacacaaaactggcgcgatggcgcgacgccagtggtgatggcgggaatggtcggcagtaacgtgggctggaaggttgcgccttatctgcctgttcctgtccatttctctgctattggcgagcagttaacgtccgttggcgacaatatctggattattcccggtttgagcgtctcgcgtgacgataaccacaac

SEQ ID NO: 79479 - DNA, 350 bp, Glycine max
  Peptide Sequence Number=SeqID_171164
ggcatgttgcgacaactacggtcgaagcattagaccaggaaacaaaaagggcccaaaaggaagaatggagcagtaacaagtcccgaggggctctatggggcagcaacaacgagctcaaacttagaatggccgaaagggatgagtcaagggtggaaagcatgggcaagcatgtgaaggtatcggctctacaaatggaaagggaagcaagagagagggtgatagaatcattgcatgggaaagctgtgaaatggatgggtagattcgctctcactctgaatgggagtcaagagcttccaaggttgttagccagagccaaggcaatggtggatgtatactcggctcccgatgaa

SEQ ID NO: 79480 - DNA, 252 bp, Glycine max
  Peptide Sequence Number=SeqID_171165
atggcagtaggatacgatgtacgcatgattcatgatcttgagggggagttacagggggagcaggagcagaaagctgatgtcacgattcacgatgtcggatacaatgtccaggacatcctgcccaaaaatactggaattgctaaaagcattgaagctgcaggattcacgatgtcggatacaatgtccaggacatcctgcccgaaaatactggaggtgctgcacaatgcacaagggcagataaaagtcaaatga

SEQ ID NO: 79481 - DNA, 375 bp, Glycine max
  Peptide Sequence Number=SeqID_171166
atgaacaacatgatcacgctgcaacatactgaaattaaagcatcctttgaaacaagtacacatgtggttggacatgtttttaaagttgccttatacaagaggcttcttgccatggtttcaaggagactaagttttttagaccaagggttatctgagccccaagtgaccataaaggaagagatgaaaatcatatctaagcgatttgaggaacttgatgtttgtggtaaagtaactctaaagagtaaacttcaggaaattgcataccatgatcaaaaatctatgtgtcctcctccagaaaaggtcaacactaaaggtgcacaaaagaaacccatgaatagaaaccaaagatcaacaaaacgcgattcgtcttactag

SEQ ID NO: 79482 - DNA, 345 bp, Glycine max
  Peptide Sequence Number=SeqID_171167
atgcaaatgaaaccccttgaagatataaaaccccaaatcaaaccaccaaaacaatgcaaacgaaatgaacgcaaaaaaaccaccaacctaacaaaaagcgcgaaccctcacaatcacgagaatgcaggggagggaagagcaaaccacaaacagttaaaaaaccctacaaataggtacatcctttgtggtacaagtagagggtacatctacttgggtttgactgagaacaagagaggatacatctcttgtggatcagttctagtggagggtacatccactaggttcaaagagaacaagggagggtacatcacttgtggatctttgcttgtaaatgaatttttataa

SEQ ID NO: 79483 - DNA, 537 bp, Glycine max
  Peptide Sequence Number=SeqID_171168
atgttcggggtctttaatccagacttcccgctctacataaagcacgaagacctctccgaaatcgcacacggtggtcaatgtcttagcatatcagtgttacggttgtggattttgcatctgattgaaacaagtatgcaagcggggaattctgatatctatggatttctcgagccacaattcattcagagcggacactggcagatggtggtcatcgtgcccaaggaacacctagttgtctggttttgttcattgcataacaggccagacaactaccttaaggggataattaacagtgttttaaaaggtcttcatgatgctccacagcctaaatcaaaggctcctgctaggtggattgtcttcaagtgtaatagacaaagaggaagtactgagtgcgactattatgtcatgcactgcatgtccaccatcattttaggaagtttcaagaataactgggaagcgtattttaacgatcctagaccattggagctagagagattaaaggcgctacggattcagtggccacaatattatctctga

SEQ ID NO: 79484 - DNA, 594 bp, Glycine max
  Peptide Sequence Number=SeqID_171169
atggctgaagtagacgaggtgcaagagcggatgaaggctaacatagaggccatgaaagaacaaatggccacaatgatggaggccatgatgagcatgaagaagataatggaggttaatgcggctgcagttgccactgtcatcactttttctgggaacaagcaggttttcccaccatatggtttgcctccgaactatactccacccaatgagaatgtcaataactctagtcctatactcattgagagccaacaacttcaatatgatcatgcacatgtctctcaacccatgggggagacacatgaaatgccccaccacaatctagctgacttcaagccttgcctcggatatgccactgaagggaaagcagttggtggtatacccctgcaaaacactttggagggccctcaatatcacccacaaccacacctcttgcattccgcagcgggtaaaaaccctcatgctatggtagaaatgggaaagttggatcatctagaggaaaggctcagggacattgaaggaggcaaacattatgcctttgctaacctagaagagttgttcctagtacccaatatcatcacccctcccaagttcaag

SEQ ID NO: 79485 - DNA, 219 bp, Glycine max
  Peptide Sequence Number=SeqID_171170
atggcatccaagaaaaggaaagctccttctacacctacccaggccagatttgataaatccaggttcacatcccaagaggcttgggagaggtatacagacattgtggtgcctcgaaagctactaccagagagaaatgtggtagtctattacacagagtttgacgagttcaaggaggaactcgagagaaggaattgggatgatccagatttgcactcttga

SEQ ID NO: 79486 - DNA, 881 bp, Glycine max
  Peptide Sequence Number=SeqID_171171
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatccaggcgatagacggtgattgcgtacccagtattgaattcagggttttcagggttcccttccagagccttttcaaagcaggtcttggcccgttcataattctttccaccacacttcgccaaggatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 79487 - DNA, 195 bp, Glycine max
  Peptide Sequence Number=SeqID_171172
atgctcagactcaccaataatagaatgctcaggatgctcaaaagatcagcaaaagtggtcgctaaatccgtcgcaaagcactattcacagcaaaacacaaaaactgaaatagggaaagcgctaaacagaaaagctaaaacaaaacaacacactaaacaaaataacaagacactaaacgacactaaacaacactaa

SEQ ID NO: 79488 - DNA, 204 bp, Glycine max
  Peptide Sequence Number=SeqID_171173
atgtatgttgggttttcttcgagccaggacaatgtgggttctgtgggggggttctgcgggttccagcaaggacaatgtgggttttccggcagtgtagggggttctgtgggttccaacgaggacaatgtgggtgtcgagggagcaatttccggcagatttcaggcgggaggagaaagagaacagcgatttcaggcaggaggatga

SEQ ID NO: 79489 - DNA, 884 bp, Glycine max
  Peptide Sequence Number=SeqID_171174
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcagattaaagaattgcaggcaaagcttgaacgtgctagacaaaatgttcgtactgagcgacaaagtgcacaacgtcgcgtggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 79490 - DNA, 399 bp, Glycine max
  Peptide Sequence Number=SeqID_171175
gaagaaacaaaggccaaggccccgcggtcgggacaaacaagcccaaagaggttccaccgtgcccacattagtagaagcttcgtgagtacgggtttaagacacaaaggacaagccgccgcgatatgcgatgaggactccccgaggaggtcaaatttggtacagccatgccctcccggcttccaactagggaataggcaagtggaggaatgcccggaggtttacacgacaagcataatatcaaacaatgagtcccgtgaaggtactaataccggggacccggccgtcgatttcgagcaagaagcaagtcagacgaaggatgaagaaaacgaagatgtaggacttcccccagagctagagagcataattgctcaggaggatcgagagataaagccgcattaa

SEQ ID NO: 79491 - DNA, 857 bp, Glycine max
  Peptide Sequence Number=SeqID_171176
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccaggcgaattggagctccaccgcggtggcggccgctctagaactagtggatcccccgggctgcaggaattcgatgaagagagtccgcaggtcaaggggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 79492 - DNA, 571 bp, Glycine max
  Peptide Sequence Number=SeqID_171177
atacaatccagattggagaaatcatccaaatctgagatgggcaagtcctccacaacaacaacagcctgtccctcctttccagaatgctgctggtccaagcaagccatatgttcctcctccaaaacattggcagcagtcacaacaaagacaacaagcaactgaggctcctcctcaaccttccttagaagagttagtgaggcaaatcaccatccagaatatgcaatttcagcaagaaataagagcctccattcagagtctgacgaatcagatggggcagatggatactcagttaaaccaagctcagtcccataattatgacaaattgccttcacaaactgtgcagaatccgaaaaatgtgagtgccatcaccttgaggtctggcaaccaaattcaagtgcctccaccagtagcagcacctgtatctgaacctgtcaagcttcattctacacctgaaaaagaggatgagatagttgcacaaaagagaaagcttcctaaaaaaaatttcatgcaggtggaccttcttctagtaattctgacttaccgtagccatccctcttccattcccacctag

SEQ ID NO: 79493 - DNA, 95 bp, Glycine max
  Peptide Sequence Number=SeqID_171178
atgcatatgacacagatgcaatttacgaaatacgggaagcccgagaaaattgtttccttcttggatacaacgtttgggcagcgatggcacccaac

SEQ ID NO: 79494 - DNA, 297 bp, Glycine max
  Peptide Sequence Number=SeqID_171179
atggctgatacattccttccaagaaagtcttacgggggtagctgttacctgtgtcagtataatgtcttcggatatgatgcaactacagaacatgtgcaaaaagggggcatgatctttcaaagaatacgcccaaaggtggagagacctggcagctcaagtggcacctcaatgacggggaaaaaaatgatgacaacagacacattaccggtattctattatgaaaagatggtgagctacacaccttcaagctttgatgatatggtcttcatcgacgaaaggatcgatgtgggtctgtaa

SEQ ID NO: 79495 - DNA, 286 bp, Glycine max
  Peptide Sequence Number=SeqID_171180
atgggacccctccaaaggcaagccttccgcaaagtgtacggaaagattttagatttgaccacagcggaggtatttacggaagccgttgtatccctcgcccaatactatgatcagtcgttgagatgcttcacatttggggacttccaaatggtaccggctgttgaagaatttgaggagatattaggatgccctcttgggggaagaaagctgtatcttttctccgggtttctcccctccttgagcaagattgcagctgtgatcggagattcggcgagagagttggatc

SEQ ID NO: 79496 - DNA, 521 bp, Glycine max
  Peptide Sequence Number=SeqID_171181
gtatgccacccaccaggcaccctctagacccggataagtctaacagggccctggggtttccagagttgatcacgggcctctgccagttattcggggttcccgtcacacctagtaaggtgatccggccgccgatcacccgagccttcattgagaagtattgcacgcctaggcaggtgcagggtgatgcaccacaggccgcagatgcaccgccgccacctcatcaggctgatcccgctgggtcattaggcatggagtggtatctacagcacttggttcgccaacaggcggccaaccaccgggggcaggtgcaaatacatgaatgtctctaccagctcagcctcagtcagcagggctgccctactctagatcagtttagggctgaggtcgcatggcccggagattggcctgaggaccagacggaggaggcacctacaggagctcccgacgatgcagaggacgcccgcatggatgaggagatgacagaattgcttggcttcttgggaggaagcggagccacgtga

SEQ ID NO: 79497 - DNA, 261 bp, Glycine max
  Peptide Sequence Number=SeqID_171182
atgggggaaccaattattggatgcccctaccacgctagccaagagttgctccctgtttgcctttctgatgaggacatgaccaagagcaagggcaaggatccacttgaaggacttggaggaccaatgataagggctagagcaaggaaagccaaggaagctcttcaacaagtattgtccatactatttgaatacaagcccaagtttcaaggagaaaagtccaaggttgtgagttgtatcatggcccaaatgggggaggactaa

SEQ ID NO: 79498 - DNA, 345 bp, Glycine max
  Peptide Sequence Number=SeqID_171183
atggttatgggggatcccatcagcagactctccttccctgcatgtttgcattttagtggagaaaacaccgagactttttcaagtctcacaagttatccagaactacgtaggtctgagttcctcattggaggatacgtaggagcaagagcctcgcttttgtcgaccacaccgccttttgttgccataactcaagagccggtagcccgcggagatacctttacggttatccgcacccctttgctaggcagacacagttgtgtccgatggcacgcagagaccaagtttggtcattctgcacacatgatacgcggagacaccttacggttatccgcacccctttgctag

SEQ ID NO: 79499 - DNA, 411 bp, Glycine max
  Peptide Sequence Number=SeqID_171184
atgttgagtcagcatcccaatatgttaaactacactgactctgtgatgaagagagaatctcctctatccctgcattacaaactgtttgaagggacacatgtcccagacattgtctcgacatctgtctcgacatcagggaaagctgctgcttcaggtgctgtgtccaaggatgctctgattgctgaactcaaggacacatgcaaggtgctggaagcaaccatcaaagccaccacagagaagaagatggagctagaactgctgatcaaaaggctctcagagagtggcattgatgatgaagaagcagctgaggaagaaggagaagcagctgaagaagaagaagaagctgctgaggaagaggaagatgcagcagaagaaacagaatccgatgatgattctgaagccaccccatga

SEQ ID NO: 79500 - DNA, 591 bp, Glycine max
  Peptide Sequence Number=SeqID_171185
ggagctgcgacactagtgcacatgtatgaccagctaaatgaagcttgccagacccctacacgacagatgactaggtacttgactttatcacagtgctggatatatgagcactttcctagtgtgtatcagtgcgtcactgatgatgcgtatgctgagacgaccccatgtgcctcctggtggctgactacgaaggctcacatgaggggggtcacaggagcgtcgtaccgggcacgtttagatgctctgacgatcacaaacgtgtgctggatgccttacgctggccaccgaggagttaggggctttgacctgattttctgcttccagggtcagctgagatgggtcctattgtggtctttgttcgaccagagagggtggtacgacaattcggcacctgcgggtgagatttgtgttgtccctggacaggtatcagcagactacatggattggtttttccagatatctcatccattcgtcacactgacccaggcaggtgatcagcccagacatccacctaccccacatgatgaggaatacgtcgagccacatatcccggaggttctagtggcatttgatctccctagacattcagtg

SEQ ID NO: 79501 - DNA, 726 bp, Glycine max
  Peptide Sequence Number=SeqID_171186
atggtggaggaagaagaaggagaaaagcaacgtgagggagagggagagagagagctgtctgaaattgggctgaccacaaaaagtgagaaaaatctaacctttgaaacgctaaaatcttgcctcggtttgcgtgccatttctctgattccagttcctcgcgtttctctgcgtccatcggggccagttttcgaaagatgtcacagctcacatactaaacatcactccaaaagaagagaaaatgaaagaaagcctcaagaggttaacattaaactcccatacttccataggaaggacaatgtagaggcttacttagattgggaaataagggtagagcaaaaacttaaaagaaagcctactttaaaatcttatggctatcattcttttccaaagaaagaccaaggtctaggcatcttaggggcagcaccttctaagcccaatgatgataaggggaagacaatagaaaagcaaccccctaaggctagtatgcaagaaaagactagctccataaagtgctttaaatgtcttggaagaggacacattacttctcaatgctccaccaagaaaaccatgattatgaggagccaagacatttatagtagccaagatgaggctactacttcaccttcctctagtgaaagtgaagaagcaaaaggggaagaatctaatgaagaaatctacccccaagaagaaggaaaacctttaatggttaaggaggagtgtaaggag

SEQ ID NO: 79502 - DNA, 90 bp, Glycine max
  Peptide Sequence Number=SeqID_171187
atgacacaggaaaacattaatataggtggtacttacattgatattggagatcctgtatgggaatgcccacattgtaaagctatgatgtag

SEQ ID NO: 79503 - DNA, 450 bp, Glycine max
  Peptide Sequence Number=SeqID_171188
atggcagcggagggcatgatttgcgacattggctggaaggtcctacgtgttgccgacaacaacaaagttagcggcgagaggatagtgcggaggcctctcgccatccacaaacacaacgttttggagtggcccagcgtcggctgcgacgatctcggtgattggtatcttccaccgaccccaagagggtcctccaaaacaccagattcgggttcaggtcaagttttccagttcaagaaagagtattacgcgttctacgacatggaatgtttgaggatcatggagcacgtgtacctggggagtgacacagtggcgaagagcgtcgagcttttgcggcggtgccgacgacctttctctttctctttctctttttcgatttcgcttaaaaatccattttttattttctgtgcatggctttttctgaaattaatttatacgcagatgaataattga

SEQ ID NO: 79504 - DNA, 411 bp, Glycine max
  Peptide Sequence Number=SeqID_171189
atggcggaaaggatagtggtgcttacctcgacgaccgacgctgacaatgctccctcgacagtggacgctggttcgtggttcgtggctcctcttcacggcaacacggctcctcttcacggtggttcgtggttcgtggctgctcgtgcttcgtcgttcatggccgaggaagaagaagaagaatcaaacggagaagaagaagaaggtagcgcgaggaagaagaagaatggctctggggaagaaggtagcgcgaggaagaagaagaatgactctgtgcgaggaagaagaaaagaactgttgggtgaaaggagagagagagtagcgggagagagagagggcataaaagacttttcatctaaagtgctgggtacaccagcaaaaatgctgggtgcacctagcagcactctaatctaa

SEQ ID NO: 79505 - DNA, 410 bp, Glycine max
  Peptide Sequence Number=SeqID_171190
tccaagtgattaaggtgacgtcatctgaggaagaccccgaggagctacctcctgaacctgttgtggatgctcttgactttctagggggtgatgaggacccactccctgaggtggattctcccgaggacgtcatgtcggcatctgaggcagactctacggaagagagcggtcccggagggatagcgactagtggaggcgactcgctgaaggaagtcctctggcgtcatgagtggagggtccatggcaaggagaaagatggagaaggctggctagtggtgtcaggtggaactgatggtggtgtaccttctggtggaggaactggaggtgcatctgatgcttctttggctcgaatcctcctcggtcctggaaagataatggaaagatctgctgggttccaacagttctcctga

SEQ ID NO: 79506 - DNA, 564 bp, Glycine max
  Peptide Sequence Number=SeqID_171191
atgaactcgctaagcgagcatgttgtgctaaccgagttcattggtacttattgtatagaggcgttctctgaagaactcactaagcgcgcctatcgcgctaagcgagttcatcctttgaggatgaatactcatcctcttgctgaactacctgtggctaagcgagcgcgatttgttgcggcatccgctgagctaagtgagcttctctcgctaagctcccaatacttagtgaaatttttggaagagttggtgccactaagtgcagcctttaaggagcttagtgcatatccttacggaagatgccagctaagcggaccatgtctcgctaaacggccagtaaagatatatcactctgagctagatgagtttaaggctgaattggagaggcgtaatttccataaacgcctcaccaatttagtcgatgggagcatagacctagctttggtgaaagaattctatgtaaatttatacagttctgaggaccatccaccaaagcagtccagagtcagaggtcatttggtgaagattgatgttgacagtctcaacacattcttggagacacctatg

SEQ ID NO: 79507 - DNA, 198 bp, Glycine max
  Peptide Sequence Number=SeqID_171192
atgctcaatggtgttcttaatcgagttgagaaaggtgaaatagctaaggccgttatggctttgaaaaatgcagaaattgatgaaggttacacaattgatgttgttgcagctcgtcaggtactttggagccttataacccctacaggtcgaaaagcaaaagctgagtataccactgtttcaagatataatacattgtaa

SEQ ID NO: 79508 - DNA, 1653 bp, Glycine max
  Peptide Sequence Number=SeqID_171193
atggtgggaagacatgttgagggagctggtgccggagcaagcaaaaagtcattcctcaattacatgccacaaaacttcctgtattgttcaaattcaggttgtggatcaggacttagcggtgagacaatctcggagaatggacaccattggattgggcttgatattttagcatcaatgcttaatgttgcggtggagcgagagattgagggtgaccttttacttggtgacatgggtcagggtctaggaatttgtcctgaagttatggatggggccatcaatatatctgttgttcaggctcttcaaactgttggaaattctcttaacttcaatccaagcaaggggaggataaccaacaagagggaagatgggtatcatgatttggcatccctttttcatgtgataagtctaggtgacataattaagttctctttgtcaccttcaaaaaccaaggatagcctgtcaaccaacgtgtctggggtgccccttgatgatagaaatttgattcatcttgataaatgggtgcctactggggcagggcttggcggtggaagtagcaatgctgcaactgcactatgggcagcaaatcaatttagtggttgtcctgcctctgagaaagaactccaagaatggtcaagtgagattggatcagatattcccttctttttctctcagggagcagcctattacactggtcgaggagaggttgttcagaatattcctccaccagtatctctagatgttccaatggttctcataaagcccccagaagcatttgtgcttatagttttggtcattgctctgtatccagccaagggaagtaaagcagttgctgaatctggacgagccaccccaggttactgctctcccattttggccactgcaatgtctgatttaatccctgcttttaccttcatacttgccatcgtcttcaggatcaaaaaattggattggaaaactaacagtacttgggccaagtccattggcacattggtatcaatcgctggagccttaataattactctgtacaaaggccaagcagtcataaagaatcatccatcaaataaattgttccccaaaaaacatgtttcatctgaacaatttgactgggtattaggggcagtgttgcttgcgggtcatagctttgttctctcattgttgttcatagttcagacatggataatcagaaattaccctacagagcttgtgatagtgctcactcgcagtacattagttgctatgctatctatcccaccttcactgatttcggtaacagatccaaaagctttgagattaggatttgatgtgaatttgatagctattgcattccaagcaatttttggtgtatcccttcgaagtattgttcatatatgggtcatgagcaagaagggccctctctatgttgcaatggttaagtcaattggaatcatctttgcggtcatcatgggaattgcatttcttggtgactctatctatcttggaaggcatacgtttctttcatgtcttaatcatatgaaaaattggagtgtgcttggagcagccattatttgggggaaaagccaagagcaagcaaaggaagagtgtgaagtctatgatgactcggaatcatactcacccgttgtccctcttttgaagaacaagagaatggaggaatag

SEQ ID NO: 79509 - DNA, 342 bp, Glycine max
  Peptide Sequence Number=SeqID_171194
atgtcacaaaactttacggattacccaaccatcccctctttggctttcggaatgttacgaaactttagggattgcacaataatgtttcctttcgactcccgacatgtcgcggaacttaacaaattgcttaacgatgggtgtcaagttcctcgaagcggtcaagcgaaggtcgcatcccaacaaacagatggtcctcggacgaaattagggaaccgattgggaaaacaacaaaaattgtattttcccctcactgggggctccgtacttgataatggaggacgcacgaacaacgctaggcaatcaattcgcggggctctggacttgatggtggaggatgcatga

SEQ ID NO: 79510 - DNA, 234 bp, Glycine max
  Peptide Sequence Number=SeqID_171195
atggtgggtttggaaaggtttacaagggtgttattgataatgggttcaaagtggctatcaaaagatcgaatccgcaatcaagttcatgttagtacacccttgaaaggtagctttggatacttggatcctgaatatttcaggaggcatcaattgaccaagaaatcagatgtgtactcatttggggttgttttatctgaggcactttatttgaggaaggtagctttggatacttga

SEQ ID NO: 79511 - DNA, 639 bp, Glycine max
  Peptide Sequence Number=SeqID_171196
atgggaatctttattcaatcaattgatcctggtgcatggaatgctattgttaaaggaccatttgtaccaactaaagaagttaatggtgaattggttcctaaagaatgggatgagatgaaagatgacgagacaagaaaagtgcaagatgatgaaaaggctaaaaacatttttacttgtggtttatcctctgatgaatttttccatactccaaggtgtaaaagtgaaaaggagatatggaaaatgcttgaagtcagttgtgaaggcactacggatgtgagaagagaaagaaagcacactcttgtattcaaatatgaagctttccgaatgaagaatgggaagcaaggccacgtcaaatcagattgtcctatctaccttagaaaacaacttgttgaaaagaaaggaaataaggatagaaaatcgaaaagggcctacatatcttgggaagacaatgtgtcaacatcctctgattcttctagtgaagaagaagttgcaaatgtgtgcttaatggatgattcaaaggatgactcctcaaccattgaagaaactgaggtaaattctgaatttgaagaagttttggaagtctttaatgaaatgcatgaggaagcgcaaaggcttatcgtgtcaaaaaataaaagctaa

SEQ ID NO: 79512 - DNA, 345 bp, Glycine max
  Peptide Sequence Number=SeqID_171197
atggaattgaaagggttggtggcagcgagggcagagatgatacggttgaaggtggagtcggtagggttagtgttaaatgatgacatttcggtgatgcagaggggtttggaggaagagttggtgggccacggggagggagaggtgagtgctatagaggcagaggaggatggaggagacaaaggggttgcggaggaaggaggacttggtggcatgggcgttgagggaggtggcgaggagggggaggttgaggacagtgcaggacttgttgagggtaagggagaagaggtaaggatcgagggggaggagggtggagtgcacgtggcagaagacgaaaagggcttttga

SEQ ID NO: 79513 - DNA, 129 bp, Glycine max
  Peptide Sequence Number=SeqID_171198
atgggtggtggtggttcaaagtgggtgatggtggactggtgcttcgttcatggttgtttcgccattgccattgcagtgggtggtgtcgtctcgctgctgtgggaaaaagagaaacgacatcatttttaa

SEQ ID NO: 79514 - DNA, 306 bp, Glycine max
  Peptide Sequence Number=SeqID_171199
atgcacaactcatccttcttccatattcttcctcgcgctcagcccaggagggttctgctcagcggatggctcggtaagccagaagattggcttagcgagaagtctgatcccaccaagttcaagttgtatgacgaggatctgttgacccttgtggagagggtcaacaaagcaatattagagcagttgtcggcctcactagaaatgtggaccatcttttctcttccgtcagtgagcgatcctctcgttgccttaaatgggaaaactgccaggaagctacattttaaacagaacctcgaagagagttga

SEQ ID NO: 79515 - DNA, 186 bp, Glycine max
  Peptide Sequence Number=SeqID_171200
atgtttgcttaccgtcctttcgctaagcgcaagactcgcgctaagtgcatctttggtcatgcactaagccgagagtctctggcgcttagcactcaacccttgcatctcaggctgacttggtccactaagctacccaaggctgagctaagcccatctcaattcggtttgaattgggctaagcgatga

SEQ ID NO: 79516 - DNA, 486 bp, Glycine max
  Peptide Sequence Number=SeqID_171201
atggtcaaaagaaaagtgattcacacaaggagacctaatcaattagcattgttatgcttacttggcaatttctattacctaaccaatacagaacatgcctacactaatccgttaaagaatttgagaatagctagacatgggaaatttggagaaaattctgctaggtcatcagtacttgcatgggtatacagaccaactaaaccaaggccaaatgattttggtaggaaacccatagaattggtacaacctagccggccaaattcaattcaggcaagattgattccactagtgcagccgaattcagtcagttcaaccgaattcgggtcagttatttcagctgaaggcagttcagctaatacagccgaattcagtgcaagcaggaccttcttggatggttcagccaatatgattcaagcaagccaggctttgcaagtccaaccaaatttcactcaacatgtaccgtatagccattcttggcccaatcag

SEQ ID NO: 79517 - DNA, 117 bp, Glycine max
  Peptide Sequence Number=SeqID_171202
atgtcagctagcaggaagctgaacacaggaaaaaaaactgtgctttcgtggatgattgaaactggaacaatactacaacatgagaaggaggattatgaagatggagatgaattgtga

SEQ ID NO: 79518 - DNA, 195 bp, Glycine max
  Peptide Sequence Number=SeqID_171203
atgaccaaagtgaacaaagatccatttctagggcttgggaggattgatggggacccggtgttgagagaaacgatgatatgggctacgtgggagtacgtgagctcagttggaggtgggcaacaggggatggtgggtttatgcgcgatttatggatgtggaaaacttgttgtgcaccatcgcccgaccgccatctag

SEQ ID NO: 79519 - DNA, 159 bp, Glycine max
  Peptide Sequence Number=SeqID_171204
atgagggaggggaacgttttctgcactcaaaactttcccccctcattcaaaagagcaaggcttacgggactcacggtttttgctcccccaagccacctttggttgcattttgctatcatttttggtactcctactcactccaacaagggatggccttag

SEQ ID NO: 79520 - DNA, 684 bp, Glycine max
  Peptide Sequence Number=SeqID_171205
cgacatgttcttgtcgatggcaaagttaggactgacaagacttaccctgctggtttcatggttcaagctctgcaagaactgacagatattgagacccagagaaaacaggaagcaaatgaattttcattcaaattggaaagcacaatgagaaagtggaaggaggccattgaagagattgatgagtcaaaggagcttgaaatgaaattggctatgagaatatcagatgttgatttcttgcagaatgagttaaagtcagttaaggaaatggataaaagggttcaaggagatgggagtgcaaagcaattggaaggaagattcaaaaaaggggaggaatcagaagactctatagtgttacaaactataacagaagaatcgaaggcagctaggaaagaattagctttggttagagaagaaggtttgcagtttatggcctctttggatgtcataagaaatgagttgaagcatgtcactgctgagacagataagttgaagaagaaggaagggaaagtagagtcaacagttcaaaatctcaatttcaagattttgagagcaaagtctaaattacaagttgtgtttgctgctgaggaaaaggacagatccatagtcatgagtttgtctcatactcttgaaaagctgaagacagaaacaaaagaagcaaaaaaggaaaatgaggatgtaagctag

SEQ ID NO: 79521 - DNA, 468 bp, Glycine max
  Peptide Sequence Number=SeqID_171206
atggcttctccaccagcctcgcctcctcctccttccgacacttcagcttcgcagtctggcatgaagcagacacaaaaagcctcacgtctacgctccttgtctactagaccagctagtgctgagagactagtggtccacgttgatcttgttactggcaagaccgacggtccccacaagaagaaattaagaacatatttggggattgtggtgcgtgataaggtggacgtgacgtttgagaactggaaggaggcggattttgaaatcctagaggcttctgacagtaggacgaaaaaaaagttacttaagactgttggcgagagatggaggcagtttaaatcagacctcacgaggaaatgggccattgcagccgatcaggacggtgtagatgacactgtctgtgaaaaatatggcataagcaaggaaaaatgggtccaattctgccagactcgcagagacccttcttgggag

SEQ ID NO: 79522 - DNA, 798 bp, Glycine max
  Peptide Sequence Number=SeqID_171207
atgctagctgacctatatgacaccttcgaccgaagatgtgagaagcgcagtaagaggattctctactgtactcccgctctttatgtatggttggtttcacacctttttcgccaagaggtgaggcatgcctgcccgttagaaagccaccgttcatgcacagagaaaggaagggcgaattgggaccaactcttagcaaacagagaaggagcatctgtcaactggttccctcgatggaaagaaggaagaaccggagtttttatctcgtgtggaggatttccgaatgttcccttgatggggacaaggggttgcatcaattacaatcccattcttgcgataaggcaacttggctacccgaagagaaaggcaccactagaggaagatctcgcacctgtcatttcacgagggttcagtaagaccaacgtggagacgcttcggaaggtccgaaaagcatgggaagtggtacaaaagaaggataaagagctcagaggcagtaacaatgggcccattggtggctaccgtgagtggttgaaagcccacgtgcaaggtttggattggctcccaagtctgagaaccgctaaaagggaggaagttaaggcatcagaggaagaggaagaggtgcaggctcttaggacagaactcgagcaagctcaaacagtcaaagaaaggttcaaatcagtggctcttagaatccgaaaggagaatgccgaactgagggatgaatatgtagctaccaccaaggccttggaacaagagaccaagaggcctcgtagggaagagcatggccgaaacaagttatga

SEQ ID NO: 79523 - DNA, 288 bp, Glycine max
  Peptide Sequence Number=SeqID_171208
atgttcttcgtattcaacactgctttggaaggacttgatgatactccacaacctaaatccaaggctggtgctaggtggattgttgttaagtgtaatagacaaaaaggaagcactgagtgcagctattacgccatgcactggatgtccacgataatcttaggaactttcaggaataattgggaagcgaaaatttatttgaacgatgttagaccattggaagcagagagattgaaggcgcttcgcacccaatgggctaaattttatctcgtagttagaaatgaaagttag

SEQ ID NO: 79524 - DNA, 941 bp, Glycine max
  Peptide Sequence Number=SeqID_171209
cggcgaagcactgcagggtgccgaaggttttggtatcgacgcgagcgtgcttgaccgtatggcgcaagaggtgaaagagctggttgagctgggcattcaggtgggtgtggtaattggtggcggtaacctgttccgtggcgcgggtctggcgcaggcaggtatgaaccgcgtggtcggcgaccacatggggatgctggcgaccgtgatgaacggcctggcaatgcgtgacgcactgcatcgtgcgtacgttaacgcgcgcctgatgtcggcgattccgctgaacggcgtgtgtgataactacagctgggcagaagccatcagcctgctgcgcaataaccgcgtggtgatcttctctgccggtaccggcaacccgttctttaccaccgactcagcggcctgcctgcgcggcatcgaaatcgaagcggacgtggtactgaaagccaccaaggtcgacggcgtctactcagccgacccggtgaaaaatccggatgccacgctgtacgaacagctgacctacggtgaagtgctggaaaaagagctgaaagtgatggatctggccgcctttacgctggcgcgcgaccatcaactgccgatccgcgtcttcaatatgaacaagcctggcgcgctgcgtcgcgtggatgatcgatgtttatcgataccgtttccgttccgctgcgtccggaagtggccaggtcaaaccgaatccaagggtttcaacgtgattaacgatattaaaaaagatgctgaaacgcgcatggacaaatgcgtggaagcattcaaaaacaccatcagcaaagtgcgcaccggtcgtgcttcgccttcactgctcgacggcatcgttgtggaatattacggtacgccaacgccgctgcgtcagctggccagcgtcaccgttgaagattcacgcacgctgaaaatcaacgtgttcgatcgctcaatgg

SEQ ID NO: 79525 - DNA, 774 bp, Glycine max
  Peptide Sequence Number=SeqID_171210
atggagcttacatcggtgtgttcagctcatccttcttccagattcttcctcgggctcagccgtaagagtggtgcgctcggcagatggctcgctaagccggcttgtagtgagtgtcatactctaatttcgtccagggaccatttgtttggtgggatgcaaccttcgcttgatcgctttgagtcgaaaggaagcattgttgtgcaatccgtaaagctccataacattccagaagtcaaagaggggatggttgcaggtgtgcaaatagcaaccaagcccacttggaccttccagggtgttccaacagaaggcgacgtctccgtgagcgatttcgtgaagattttccaccgttcttcattcgttcttcttcgttcttcggtcttcttctccgtgagcgatttggtgcgcatgaagcgcactcatctctttgcagcggcacgggtgaaatcttgccccgttggccctcctccaatatcagggggtggcccaggaaccattaaaaggaaactactggtgtggatgtggagcacactgaaaatgaggacacgtagccctctaaaggtgaggacgtgtagtcctctcaaggtgagggcgtgcagccctctgttggcgaggacgtgtagtcctttcaaggtgagggcttgcagccctctattggcgaggacgtgtagtcctttcaaggtgagggcgtgcagccctctgttggcgaggatgtgtagtcctctaaaggtgagggcgtgcagccctctgatggcgaggacgtgtagtcctctcaag

SEQ ID NO: 79526 - DNA, 549 bp, Glycine max
  Peptide Sequence Number=SeqID_171211
atgcacccggtttcggatgaaggccggatgcgccgctacggcggcgcgtccaccccgaaaccagcgatcgagctaaccatgaatatcaatttcacccttcttgcgcaggcgctggccttcgctggtctgatctggatcatcgcgaccaagatctggccgccgctgatgaacgcgatcgaagagcgccagcagaagattgctgaaggcctcgctgctgccgaccgcagccagaaagatctggcccaggcgcaggagaaggtcaacgaagcgctgaaggaagcacgcaccaaggccaacgagatcatcgatcaggcccacgcacgtgccaaccagatcgttgatgctgcccgtaacgaagcgatcaccgaagccacccgtcagaaggaactggcccaggctgaaatcgacgccgccgccaaccgtgcccgtgaagatctgcgcaagcaggtgtccgcgctggccgtgaccggtgccgaaaagctgctcaagcgcgaaatcgacgccgacgcccacaaggcgctgctcgacgagctggcctcggagatctaa

SEQ ID NO: 79527 - DNA, 282 bp, Glycine max
  Peptide Sequence Number=SeqID_171212
atgggtcagatacattatatttcagcacaactacaagacaatgacgatctcagaggcgcgatggaaacaattctccagaatccacaattgaattttgtcgaattctatgatgttactgaccttattcctcaaccacaaccatcatcaccacaaccctcatgtccacaacaacaactaccgcctccacaacaattaccgtataacaacatagacctcaataatccagtatcttcatacaacaacctagaaacacaagacccctttgacatttatacttcataa

SEQ ID NO: 79528 - DNA, 96 bp, Glycine max
  Peptide Sequence Number=SeqID_171213
atgggggtgcaaatagcacccaggcccatttgggccctccagaagattcctccagaaggcggggaggaaggcaagaaggaaggggttcagccctga

SEQ ID NO: 79529 - DNA, 260 bp, Glycine max
  Peptide Sequence Number=SeqID_171214
atgtcggctattgagttttcttttcaatcccttaatgaaatatgcatgatgtcggtaaggaaatgtgatgaggacatgaccaagagcaagggcaaggatccacttgaaggacttggaggacctattgatgaggacatgaccaagagcaagggcaaggatccacttgaaggacttggaggacctatgacaagggctagagcaaggaaagccaaggaagctcttcaacaagtgctgtccatactatttgaatacaagcccaa

SEQ ID NO: 79530 - DNA, 390 bp, Glycine max
  Peptide Sequence Number=SeqID_171215
atggcaggaggcagtctttccatcgcaaaatgccccccaaagtgtttggcaagggtatgccaccaaacgcttgcccctcagtggaatatccgaggtgaggctcggagtcggctaaagggtggtcttggggtacttcatgtgtctcccccatgggttaagggacctgtgcctgaccagattggggtgttggctctcaatgagtatgggagcccaaagtgtttggcaagggtatgccaccaaacgcatgcccctcagtggaatatccgaggtgaggctcggagtcggctagagggtggtcttggggtacttcatgtgtctcccccatgggttgagggagcagagttatcgacattctcatcaggagcatgtgcaacattgggtggtgtatag

SEQ ID NO: 79531 - DNA, 552 bp, Glycine max
  Peptide Sequence Number=SeqID_171216
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccaggcgtttccccctggcggctccctcgtgcgctctcctttcgctccaagctggactgtatgcacgaaccccccgttcagtccgaccgctgcgccttatccggtaactatcgtcttgagtccaacccggaaagacatgcaaaagcaccactggcagcagccactggtacctcggttcaaagagttggtagctcagagaaccttcgaaaaaccgccctgcaaggcg

SEQ ID NO: 79532 - DNA, 630 bp, Glycine max
  Peptide Sequence Number=SeqID_171217
atgttcggctcgagcgccacggcgcgtctcgccgcggagaacgcgctgcgctacccggagcgctcctcgcgcatggcgatcggcgtggtgatgggcgtgacgctcgtgacgatgttcgccgtggcgctcgaatcggcgaagcgcctgatgatgagccaggtcaccggcgaggtcccggaggagttcttcgccccgatggacgctttcgcgggcgtgatgatggtgctcgtggcggtgtccgcggtgatcgccgcggtcgggctcgtcaacctgctcacgatcggcgtcgtgcagcgcaggcgggagctcgggctgctccggtcgatcggactgtccaaccggcaggtgcggcggatggtcctcctcgaggccacgcacatcaccgtcgcggcgacgctgacgggactcgtgctcggcgtggtctacggctggatcgccgcgcagtcgctgctcggttccgttccgacgctgcccgacttcgtccccgcagggctcgtcgccccgcagatcccgtgggtgccggtggcgatcatcgtcgtcgcgacgggcatcctcaccctggtggctgcggcgacgccgacgcggttggccacgcgcgtggccccggtcgaggcgctcgcggcggactga

SEQ ID NO: 79533 - DNA, 1215 bp, Glycine max
  Peptide Sequence Number=SeqID_171218
atggcgcgcacgccttccgacgtgctggcggtgcacctgctgctgaaagaggccggttgcccgttcgcgctgccggtcgctccgctgttcgaaaccctcgacgatctgaacaacgccgacgacgtgatgactcagttgctgaacatcgactggtatcgcggctttattcagggcaaacagatggtaatgatcggctactccgactcggcgaaagacgccggcgtgatggccgcttcctgggcgcagtaccgcgcgcaggacgcgctgatcaaaacctgtgaaaaggccggcgtggcgctgacgctattccacggccgcggcggttccatcggccgcggcggcgcaccggcgcatgcggcgttgctgtcgcagccgccgggcagcctgaagggcggcctgcgcgtcaccgaacagggcgagatgatccgattcaaattcggcctgcctgaagtcaccatcagcagcctggcgctgtatgctggcgcgatcctcgaggcaaacctgctgccgccgccggaaccgaagaaagaatggcgggcgctgatggacgatctgtcagacacctcctgccggatgtatcgcggctacgtgcgtgaaaacccggacttcgtgccttacttccgcgcggccacgccggagctggagctgggtaaactgccgctgggctcacgcccggccaaacgcaagccgaacggcggcgtagagagccttcgcgccattccgtggatcttcgcctggacgcagaaccgcctgatgctgccggcctggctcggcgccggcgccggattgcaggaggcggtgaaagccggcaagcaggcggaactggaggcgatgtgtcgcgactggccgttcttctccacccgcatcgccatgctggaaatggtgttcgccaaggccgacctttggctggcggaatactacgatcagcgcctggtggataaatcgctgtggccgctgggccaacagctgcgcgatcagctggaaagcgacatcaaggtggtgctgaccatcgccaacgatgcgcacctgatggaagacctgccgtggattgccgaatccatcgcgctgcgcaacgtttataccgacccgctgaacgtcttgcaggccgaactgctgcaccgttcgcgtcagcaggagcagccggacgcccgcgtcgagcaggcgctgatggtcaccatcgccggcgtcgccgccgggatgcgcaacaccggctag

SEQ ID NO: 79534 - DNA, 249 bp, Glycine max
  Peptide Sequence Number=SeqID_171219
atgtggcagaccaatacttcattcccgtcaacatatctggacaacagaaataacccaatgtatactgggtgctccccaaccactggaagaatgcacctcctctgcaatgggacgtggttacgctcgaccacgacattaaagataaaagtatcttccggtcatggtataagtttctcaaggaaaatgacttccatcatggagacgaggtatcactctactaccagccacacgaaagaatttgggaaatag

SEQ ID NO: 79535 - DNA, 156 bp, Glycine max
  Peptide Sequence Number=SeqID_171220
atggcaggagtaaacatattgaaaccaagtttcatttcctgcatgatcaagtctgaagatcaagttgcagacatactaactaagtcattgaagcctatcaagttcaaggaattgagagacaagttaggagtgacgtccttgacaaatctgaattaa

SEQ ID NO: 79536 - DNA, 318 bp, Glycine max
  Peptide Sequence Number=SeqID_171221
atggttaggaccagaggattaggtcgtgccttaggtcagcgtcgacggcctactgcatccgcacagaggcagcaagtcgctgtgattgcggcgcacaatgagccagtggtccctgcgccagatgttgagcctgatgtatttccggatgacccgatggaggcaccagctgattctgaggacattgtggcagacattcctgcggacacaggcgcggaggctgctgaggatgagcatgagggattttcgggtggtccgagcgacccatccgtgttgacccagtatgcggatcacgttgcttgcagcgtatggacgggagag

SEQ ID NO: 79537 - DNA, 306 bp, Glycine max
  Peptide Sequence Number=SeqID_171222
atgagtggtggattttgcggtactcatttgcagatcatggttaggaccagaggattaggtcgtgccttaggtcacgttactggtagaggtcacacgatgagccctgcgccagatgttcaggctgacgtatttccggacgacccgatggcatcagctgatgtagaggacattgtggcagacattcttgcgaacacaggcgtagaggctgctgaggatgagcatgagggatttttgggtggtccgagcgacccatccgtgttgacccagtatgcggatcacgttgcttgcagcgtatggacgggagag

SEQ ID NO: 79538 - DNA, 123 bp, Glycine max
  Peptide Sequence Number=SeqID_171223
atgtcggataggatagaacctgtatcaagaaccgaagctctgataccagatgaggtcacagaatcgcatgatgccacttcaaagatggaagataagtcaggggtagaagccacaagggtttaa

SEQ ID NO: 79539 - DNA, 186 bp, Glycine max
  Peptide Sequence Number=SeqID_171224
atggtggggacacggctccgacacggcgatggagcaccggacacgacactggatatagctggagatgattttggaccacttgatgattgtggtattcttgaaattgctagtttgtctttagatgaaccagagttagatggtgtctttttcaatgatgatgatcacctagagggtgaaaggccttag

SEQ ID NO: 79540 - DNA, 135 bp, Glycine max
  Peptide Sequence Number=SeqID_171225
atgtctcaatcaaggattgcttcttttggcagtgctactggtagtgtggagatagacaacatgaagcaggaatttgcgataatgaagacaaagttgacttttctagagaaaaacatttaccatgtgagatactaa

SEQ ID NO: 79541 - DNA, 153 bp, Glycine max
  Peptide Sequence Number=SeqID_171226
atgaggtcaaatcctcttcaagggagaggggatgatccaatcctccctaggaagataccagttaccagagccatgagcaagaggctccaagaggattggtctagagctgttgaagaaggccctagggttctcatgaacttaggggctcgataa

SEQ ID NO: 79542 - DNA, 855 bp, Glycine max
  Peptide Sequence Number=SeqID_171227
atgattctctgtgttgatgttgtcacttggcaaaggaagaacttaagagtaaccgaatacagagaaaagtttgagttgctatctaaggctgctacctcaaatccaaaacacgctggtttgaaccaacgtgagctccattttgtcttcttccgtaagccaaatagttttcaacagtcgaaaagagctgggcatgtttctgatgtgcactttgagaagacggttcttcaaggtgctggagaatttgaagatataaaatgcaagtgggcatatggtatgaatgtctttgatttagcagaatggaagaggcaaaacatcacagaggtttaccacaaatggcagaatatgttttttttgcactattattctttaattttgtcaagaataaagattattgatagtaacaatacaagattgtcccttttttctacctctatggcagtctttgccgtttattataggttctcctggcaaatggagggtggagatgttccttggtttgaaatgctaggcatattttccctctccgtctgtgctgctgttgtcaagaaaacaaaggttgctcttcctactactagtactactacaatcttgtctggaatcaatcatttgaatttgatgagaatgatgtgcaaatgtaaatttggaaggacgggggacgggtcaatcaaggttgaatggatccctcttgaaggagtgagttcgggtgaattgaagcttaaaattgaagcaattaaggtggaggaccaagaaggatcaaggggttcaactaatggttggatagaacttgttgtgattgaagcgagggatcttattgttgctgatcttcgagggacaagtgatccttatgtgaggtga

SEQ ID NO: 79543 - DNA, 483 bp, Glycine max
  Peptide Sequence Number=SeqID_171228
atggcagtgtcaatgaaggtatgttgtttcttctcaactagtaatcctcttgtctatcgtcttaagatggcgcatgagataaaagatatcaacaagagaggattccttctctctatcactaccgcaaaaagaccctacaacgacggttctaaaccaacatcgttgaaagtcaagacttttgacgatggttccataaataaccgtcttaaaaaaagtgttgcaccaaatgcattgaagttctttactagggattctttggcttcaagaaagaaaacaaaaattgtttcacatggtgatgaggacaaggcaagtaataagggcaaggaacctttagaaggacttggaggacctatggcaagggctagaacaaagaaggccaaggaagctcttcaacaagtattaaccatgctatttgaatttaggcccaagttacaagtgaagaagcttcagattgttaattgcaccatgtttcaagaagagtag

SEQ ID NO: 79544 - DNA, 429 bp, Glycine max
  Peptide Sequence Number=SeqID_171229
atgcataaggcattgcgattaaatgctcctttaccctatccacacttagttactttgttccttcaacattttaacatccctcttgattctgaaccatatgttccaatcaagatatctttcttgatcggtgctgctatggttgtgtcctttggttaccgcaaagagcgtgatggctcttgggtaaaaaagggtgctcaaccaaatgatgatgaaggacacttaccggttgaaggggactcttctctccttcagagtattttggacaggtttaatggacttcaaacctatgttggtgagaggtttgactccttggaacatcaagtggacacacgattcgaggagatgaactcaaggattccaaaggttgaaaaagatgtcaccatcattcacgattgccttgatttacctccaccaccaccatcagtttag

SEQ ID NO: 79545 - DNA, 699 bp, Glycine max
  Peptide Sequence Number=SeqID_171230
atgttgccccttttgatgttattttctagcataaggaatgctttctcaagtgatgaattaggcttggaaatactgaatatttcgctccctactacgctggctttggcagcagatcctattgcttctctaattgatactgcattcattggccacataggtcctgtggagcttgctgctgtgggagtctcaattgctattttcaatcaaatctcaaaaattacaataattccactagtcagtgtcacaacctctttggttgctgaggaagatgctgttgatgaacaaaatcaacagtcagaaagagaaatgttgatgaaggtctctaatgaggatgtaaagttggatgtacatgaccatgcagagaaagctggcaactcttcatcagcaaatgttggcagagtagctaaacttgaccatgacaaaagctatattccatcagcatcatcaggaatagttattggtggtttgcttggggtcttacaagctctctttctcatttttacagctaaaccaatgttgagttacatgggcgttgattcaaattctcctatgtttaaaccagcacaacaatacttgacattgaggtcatttggtgcaccagcagttattatttctatggcaattcaaggagtttttcgtggaatcaaagatacaaaaactcctttatatgctacagttgagtctctactaaaagaataa

SEQ ID NO: 79546 - DNA, 387 bp, Glycine max
  Peptide Sequence Number=SeqID_171231
atgggtcctaaccatcgaagcaagggacttccaatttcaggtgaggatggtgagtgttgggtgggggagttggtgtctgaggagttgcaagaatcgcaagcatggcgagacgatctagaatggattcgagtttttcgttcatggtggagtgggcttgtgacagggtttggactgcctcctcaaggcgctcagtggccgactaacgagtattgtgctccggcatcgtcagtgagcaggtttgttgtaacggaatatggcagagtagtggtaatccttaaccgcttgaagcgtttacacaaagtccttcaggtggaccgatttgttgatcacccttttgggcctggcattcccggtaagattgctatcagaaccccacctaatttttaa

SEQ ID NO: 79547 - DNA, 399 bp, Glycine max
  Peptide Sequence Number=SeqID_171232
atggcaccagtttctgcaagaactcgaatgaagtgcaagaaacttgaggaaagaaagcagaagaagaaaaagtcatcaatggtttatgctgctacaacacctacttcttctacaggcaccaaagaaatacagggtgatcatagtgaggaagatatatgttcaagtgtgtgttctacaccgaagggtaaaaggttcagaataccagaagtgctaaaatgtccaccagctcctaagaagagaaaaataacaacaacaacaactatcacatcatcgtgctcatccaagaccaagagatcctcaatagcattttttgcttcaccagatatagagctctttttcttttctgcaattaaaagtagtgtacctgctgcttcaagttttaccccaagtggagtttga

SEQ ID NO: 79548 - DNA, 195 bp, Glycine max
  Peptide Sequence Number=SeqID_171233
atgaatgttttgagtggtgcaaccctcttttgtaaagtcactcgtacacctaacatcttcatggtgtgtgtacatagggacccattaggtgttgagggaaggagccccgagtatgaaaaacctcaggatttgaggtcaaatcctttccaaggtggagggaatgatgcaatcctaccccgcaagggcattggataa

SEQ ID NO: 79549 - DNA, 189 bp, Glycine max
  Peptide Sequence Number=SeqID_171234
atggaggaggagaagaagaaggagaaaatggtggaggatgacaaacaactgaaaaagagagaaaagaagagaagagaaaaagcaagagtgagtgtgctagagaggaaaagaaagaagcatcttcagctgaagggaaggaagtaccatatcctttggtaccttctaggaaggacaaagaaagacatctag

SEQ ID NO: 79550 - DNA, 908 bp, Glycine max
  Peptide Sequence Number=SeqID_171235
gaagacatatattacctgagaggaaggtggaaatatgccacactaagctggaaaagtttaaggctgaattagagaggtgtaacatccataaacgccttaccaatttagttgataacaatatagacttagctttactgaaggagttttatgccaacctttacagctctgaagacctttcaccaaagcaagtcagagtcagaggccacctggtaaagattgatgcagacaacctcaacacattcttggagacgcttgtgatattagttgagggcgagactttaccagcatattccagatactacaggttgcccacagattataaagagattgaggttgccttatgtatattaggccgagggtttgttttgaactctgagggccatcctgggaagattctcaggaaagatttgacgactcttgctcaggtgtggagtattctctcatattccaacttggctcctactttacacacctcagacctcatagtagatagagctaggctgatctttggcctagtctctcaaatggacatgaatgtgggagcctttatctctggccagatcacatctatagcccagtctaactcttctagacttcggttccctgctttgatcactgccctgtgtaaggccagagaggttaattctgacagcttggttttcgagcgcctgaggtcggtcatcaacttggcctatattaggaaaaactgttggaatcctgatgatctaatagtttctatcagaggggccaagtgggcaaggacgaggccagctgagcctccttccacatctacaactcatattccagcacgtatctcagcagctccttctgtcccagcttctgcagattttcagcatcttgaagccatgcttcaaagcatctatcaggggcagattattctattatag

SEQ ID NO: 79551 - DNA, 705 bp, Glycine max
  Peptide Sequence Number=SeqID_171236
atgggtagggtaaggatagaggcagaggcttggttagagaatgagcatcatgcagatgatgttccccggtggcgtaggcctaccgcatccgcccgtaggcatagggcacatgttgcggttgctaaggatgttcctcaagtgattgaggatgttcttcatatgactaaggatgcacctcagatgaccaccgaggacgtagctgcggttgttgcagagggcttggatggtgatgatgctgaggggtcacctgctgatgatgctgagggattccctggtgggccacgtgacctgtcgatcctgacttcgtttgtcgaccatgtgtcacatagcatatggagtggagagttggtctcccacggtaggaaggttgataaatttaggaggccagcgcctgagatagaagacctagtcacgaccaccgaattaagtccattgatcgggtgttcagtagtcaccgacgatcctggacttatatctgcatttgtcgagaggtggcatagggagaccaacacctttcatcttctagtaggagagttgacgatcacgctggacgatgtggcatcactcctccatctttcgatcataagcgcgttccacagctttgagcctctacttgtggacgatgcggtcttcttgttgatggagttgtttgaggtcttcgatgaggaggctagatctgagactgtacgggcggatgcggcatat

SEQ ID NO: 79552 - DNA, 276 bp, Glycine max
  Peptide Sequence Number=SeqID_171237
atggcttcgagaaagctttccgcgaaaagatctaggagggacgccgcggttgaagggaccagtgccgcccccgagtttgatagccaccgtttcaggagcgccgagcaccagcagcctttcgaggccatcaaaggatggtcgttcccccgagagagacgcgtccagctcagggacgatgagtacaccgactttcaggaagagatagctcgccggcgttggacgtcgttggtcacccccatggctaagtttgacccagagatagtcctggaattttat

SEQ ID NO: 79553 - DNA, 683 bp, Glycine max
  Peptide Sequence Number=SeqID_171238
ggccatcaattcttcacggatgggtgcgatcatacccgtgcttatctttacttcctttttcccactgccggttcctaagtccactagtttcgtctcttattgatgaggcaccatctcttggtcctcatgggcgactatcttctccaactccggggaagtcccacatcttcgtcctcttcactctccgtctgatccgtttcttgcttgaaatcgatgatcggttcccaggagggcatggtcgtaccagatctgacccattcggaaagtcatcctcgcatattgcaacgacttggccttcgtgtcttagtctcacgcttataaagctcctactgatgtggcagggctggttctgccgccgttgtttttgcctaaacccattccgggctcgtaaccattccccaacatctcccgggccaccatcattgtcatatcggcaggcaaggtcgcccagagaaagaatctacagaggcaatgcttactacctcaaaagattggaagggaacgactcccaccgagtggatccacgggcatcccaaaagacagctataagccgggttaatatccattacttggaaggtaacctgacaggtatgggggcctatctgtacagggaggtcgatctctcccctaacctctcggcgggtgccgtcgaaggcacgaaccaccatggaacttggctttag

SEQ ID NO: 79554 - DNA, 267 bp, Glycine max
  Peptide Sequence Number=SeqID_171239
atggatatggcatggggaagtgccgaacatgccaacagtctctcaagcttagccgagatgcgtaattgtcccataggtggggtatcatggtacagagcaaaccatggcgaatatagtgttgatgcaatcataaacaatagtcgtccaacaaaggcaattgatagtctatatcctgattttggggacaagccaagaaatctaaggcttgctcttgcttcggatggaatgaatccttttggcaacttaagcactaaccacagttcctag

SEQ ID NO: 79555 - DNA, 351 bp, Glycine max
  Peptide Sequence Number=SeqID_171240
atgccactgaagggcaagcagttggtggtatacccctgcaaaacactttggagggccctcagtttcgcccacaaccacaaccctcacgttccacagtggttaaaaaccctcatgactatggcagaaatgggaaagttggatcatctagaggaaaggctcagggccattgaaggaggtgaagattatgcctttgctaacccaaaagagttgttcctagaacccaatatcatcacccctcccaagttcaaggtgctggaccttgacaagtacaaggggactacttgtcccaagaaccatctaaagatgtattgtcagaaatgggggcatatgcaaaagatgagaaactgctga

SEQ ID NO: 79556 - DNA, 156 bp, Glycine max
  Peptide Sequence Number=SeqID_171241
atggcctttaggaagagaaaatcaaccgcctcccgaccttaagaaccctacaacacgacgagatttgtttccgaggcagcctgatcgtcgcattaatgtggccttgttcaaggagttttatgcaaacttgtatgacccagaggataagtcccccag

SEQ ID NO: 79557 - DNA, 887 bp, Glycine max
  Peptide Sequence Number=SeqID_171242
tacacgtcctcgccatcagagggctgcacgccctcaacttcggaggactacacgtcctcgccatcaaggggctgcacgccctcagcttcagaggactacacgtcctcgccatcggacggctgcatgccctcactttcagaggactacatgtcctcgtcatcagaggactacacgtcctcgcctatagcggactacatgtcctcgccattagagaattgtacgccctcacctttagaggacaacacgtcctcgccatcagagggctgcacgacctcaccttcagaggactacacatcctcgccatcagagggctgcacgccctcacctttagaggactacacgtcctcgccatcagagggctgcatgccctcatcttcaaaggactacatgtcctcgccatcgaaggcctgcatgccctcaccttcagaggactacacgtcctcgccatcagaggactgcacgtcctcgccttagaggactacacgtcctcgccatcagagggctgcacgaccctcacctttagaggactacacgtcctcgccatcagagggctgcacgccctcaccttaggactacatcctcaaggggctgcacgcctcaccttcagaggactacacgtcctcgcctgttttagagggctacgcatgtcctctacccttaaacgcttaaccgagacttgcgctcccggttatggggtcaaccgtttccttttatcagttcttgggctaccccctgatattggaggacgaccaactgtgcgagcacaaccagagagggaggctatcatgcagctactatgtataccgaggcaagatttcacccgtgccgctgtaaagagacgagtgcgcatcatgcgcaccaacatgaccactcttacacagatatag

SEQ ID NO: 79558 - DNA, 153 bp, Glycine max
  Peptide Sequence Number=SeqID_171243
atggagaattggcgaacagcgctacgcaaaatgacttcgtggggctccagactcgaagtggagaatggagaattggcgaacaacgctaggcaattacattcgcggggctccagactcgaaggtggaggacacatgaacagcgctaggcaatga

SEQ ID NO: 79559 - DNA, 358 bp, Glycine max
  Peptide Sequence Number=SeqID_171244
actcatcatctacttgaagtggcgtctctattcatctttctccttcttcattccactgcaatcaaacctcaagaagcaaaggaatccatcgatgaagaagatccaaggcctacaagctccacatggagctacatcagagtctttacccttaacgataccgaagcttcgaaatccaaagatctaatccaagtgagtaaggatatgatgttcaactctaccaacaaagttgtgacatctctaaaagaagatgctcaagtgtacatgatcttgtctaacctagaaatggagataaaggtttccatgtgtgacctccctgttgtcagagagtttcctgaagtgttccctgaggatatatccg

SEQ ID NO: 79560 - DNA, 751 bp, Glycine max
  Peptide Sequence Number=SeqID_171245
caaggaaagtccagttgttgttgttttggctgacgtctatgaagcatttgatcggagatgcgagaagagcagcgcaagggttgtctgttgcacacccgctcttaatgtatggctggtctctcacatctttcgtcatgaaagtaaacccatctgtcccctaaaaggttaccgcatgtgtgtcgagaatgggaaagcaaattgggtaggggcatctgttaattggttcccccgatggaaggaaggaggggaagaagttttgtcttcatgtgaagggttcccaagcgtccccttgatgggaatgatgggttgtatcaattataatctcgtactttccataagacagttaggttattccatgagaggagcgccatcagaagagagtaccacgtctttcatcgcacgaggcttcagtgaccccaatgcaaaaacacttcaaagagtccggaaggcatgtaacgcggtgcaaagaaaggataaggagctcagaggaagcagcaatgggatcatcagcagttattataagtggctaaaggctagaacgcaagagatgaattggctcttaaggctaaagatttcaagtaaggaagaggttgaaacccttgaggagagcgaagaggtgcaagccttgaaggcgaatcttgaaagaacccaagtggtcaaggaaaagttcaagacaaaagccatcaaggtcaggaaggaatgtgacgagctgagggatgtcaacatggccacgaccgaagcattagaatga

SEQ ID NO: 79561 - DNA, 733 bp, Glycine max
  Peptide Sequence Number=SeqID_171246
tccttttcatctttccctcgcgggcttgttcgctatcggtctctcgccagtatttagccttggatggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccggttcgctcgccgttactaagggaatccttcgtgcgtgcacgcaaagggtcgtcgatgggtccagaactgaccggctcgcacgtgattggtctcgagcgtggctcatccaccattttatcacggcgaagtcggccatgaacccagatttcaaccaaccacgaggcgggtgctcgcgggaggtcagcatacaccccgcgcagcaacattgttacatgtttgccgttggggaaacgatgtgtgacacccagggcaggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgacgaggaggccgggcgcacggggcgccgtggtcatcccctccctcccgacggtagatga

SEQ ID NO: 79562 - DNA, 201 bp, Glycine max
  Peptide Sequence Number=SeqID_171247
atgcaggggttgcgctcgttgcgggacttaacccaacatctcacgacacgagctgacgacagccatgcagcacctgtgtacgctcccataccgaagtatgggtccctcccctttcgggtcagtaccacgtacatgtcaaacccaggcggaatgcttatcgcgttaactgcggcacagatgccctacgacacccacacctag

SEQ ID NO: 79563 - DNA, 372 bp, Glycine max
  Peptide Sequence Number=SeqID_171248
atgcgcaacggcagccagagcaacgtcaccctgtacgccagttcccgtagcgcccagggcacctccggcccggatttccgtctggagatggaaggcctgcaatatagcgaaatcccgatgctggccgccagtaacccggcgctgatgcagcaggcgctctccgcggtgcgtaacgactactcgctggcgcggctgtacgcaatgggcgccgacgcctggtcgctggcgaatcatttcgcgcaaatgcgccagagcccaggttacgagctgaacggcaatacgggcgatctgacggctacgccggactgcgtgattaacaggaagttatcatggctcaagtaccaacagggacaaatcgtcgcagccaactaa

SEQ ID NO: 79564 - DNA, 498 bp, Glycine max
  Peptide Sequence Number=SeqID_171249
atgacgctcgttcagtcgctgcttaacggcaacaaaatcctctgttgtggtaatggcacctccgccgccaacgcacagcattttgctgccagcatgatcaatcgtttcgaaacagagcgccctggtttacccgccattgcactaaataccgataatgtggtcttaaccgcaatcgccaacgatcgcctgcatgatgaaatctatgctaaacaggtgcgcgcgctgggacacgccggcgacgtactgctggcgatttctacgcgcggcaatagccgggatatcgtgaaagccgtggaagcggcggtcacccgcgatatgactatcgtggcgttaaccggttacgacggcggcgagctggctggcctgttaggtcagcaggacgttgaaatccgcattccttcacaccgcagcgcgcggatccaggaaatgcacatgctcaccgtcaattgtctgtgcgatttgattgataacacgctttttccacaccaggacgaataa

SEQ ID NO: 79565 - DNA, 381 bp, Glycine max
  Peptide Sequence Number=SeqID_171250
atgtcgcgggggtcaggagaccttagggacgtcaggcgagctcctggcagtcaacagataaaaggaacaaagaccacaaagcaaggaggcttgtgtggtggctggccagcggaagctaggggagcttctggtaatcgattaccaggggatgtaatcgattaccaggcttcaaaagagaactggaagactgtggagacctctgagggatgggtcactggtaatcgattaccaggttttcatgtcctgaaactgtgtaattcgaatctggcctctggtaatcgattaccaaggctgtgtaatcgattaccagagatgaaaaggcttaagataccccttttacttgcatgtagtggttatgaaacgaattgtgttgcggcgtag

SEQ ID NO: 79566 - DNA, 588 bp, Glycine max
  Peptide Sequence Number=SeqID_171251
atgaagttgtgtttgaaattgaagaattcaaggagaggtttgttggtcatggccttggtcctgcattcagctccagtcagttttgacacctggtggccaggggagtttgcagctggttcaagccaattgtcatcaaaggatgcatttctttcaaaagttgaagcaaagacaatctctgagattaacaacatttctgagttcaatggaaaacctgatgaaaagtcctggtatagatttgaggtgatggtcaaccacaaggaggaaagcacaaaatttttgctctggggccatgaatgcactgagctgattggacaatcagctaatgaagttaacaagctgaaaatagaagagggtgatgttgatttaaatgtttctcctcaagccattgataagttgttgggttatgtccttgcatttaaagtcaatgttcaacccaagtttaacaatgttgttgttcttagatactcaaatgacttagatttggtcaatgccgtggtggacatgctgcctgatgctgaggcatgttccaaggttcatgctcctatccttgactccgataatcctttccaacttgagtctataagttga

SEQ ID NO: 79567 - DNA, 273 bp, Glycine max
  Peptide Sequence Number=SeqID_171252
atgtctgttctgatttttaatgggttaaaattctcttattggagcgaacaagtccaatttcacttaggtgtgttggatcttgatttggctcttcaagttgaaaaacctgctgctactactgatgctagtagcaatgaagagcaaaacgtaaagcttgttccttacaacccaaccataaacccaaatgatgagtttgtcttcatggggaatagagtgaaagttctagtggaagctgttggttatcgtttaatccttgacactagtttcatttaa

SEQ ID NO: 79568 - DNA, 552 bp, Glycine max
  Peptide Sequence Number=SeqID_171253
atggcttccagaaagagaaagagtattggaagacatatactgcctaagaggaaggtagaaatataccatattgagctggacgagtttaaggctgaattggagaggcgtaacttccataaacgcctcaccaatttagttgacaacagcatagatctagctttggtgaaggagttttatgccagtctttacagccccgaaggaccttcaccaaagcaagttagggtcagaggccacgtggtgaagattgatgcagacaacctcaacacctttctagagacacctgtggtactagctgagggtgaaaccttacccacatattccagatactataggttgcccgctgatattagagaaattgaggcttccttatgtatcccaggtcggggatttgttttaaatgctgaaggccaccctaggaagattctcaggaaagatttaacaactctttctcaagtgttgagtgttctctcgtactccaatctggctcctacttcccacacctcggacctgacagtagatcgagctaggctaaactttggcctagtttcttag

SEQ ID NO: 79569 - DNA, 216 bp, Glycine max
  Peptide Sequence Number=SeqID_171254
atgaatccttcgttcccaaacaagggaagtccaccaatagatgtagaagcaagcttcatgatgatgaaccaaacaattttgatgatgccaaaagcccaagtgattgattcaagattggttcaagactttaagatcaaacatcaagaatcaaattcaagattcaagattcaagacaagaaatcaagaagcaacaagtcaagacttcatataggataa

SEQ ID NO: 79570 - DNA, 1185 bp, Glycine max
  Peptide Sequence Number=SeqID_171255
atggggttaattatccctgttggtagaaggatggtgaggaataaggtattagaatcaagaggatctattttgtcacttatgttgcggggagtggagatagtttggaatctgggcttgtactggtctaacttggtgtatgatttcctggttggaagggatgaagaggttgttccgtatcgtgctcgacagcttaggaatctcttgtgtgatctggggccttcctttattaaagctggtcaggttcttgcaaataggccagatatcattcgagaagattatatgaatgaactgtgcattcttcaagatgatgttccttcatttcccaatcaaattgccttcagaatcatagaggaggatctgggtcaaccccttgaagctgttttcagcaaaatctcatcagggacaatagcagctgcaagtttaggtcaagtttacagagctacattacgtgcaactggcgaggatgttgctatcaaggttcagaggccagggatagagcccattatttatcgagatcttttcctattccgcactttggcttcattcttaaatggcattagtatacagaaattgggatgtaatgctgagctgattgttgatgaatttggtgagaagcttttggaagagcttgattataccctggaagcccgtaatcttgaagactttcttgagaattttaaaaatgaccctactgtcaaaattcctcaggtttacaaacaattttctggtcaacgtgtgctggtaatggaatggattgatggtatcaggtgcaccaatccacaggccatcaaagaagccggtattgatgttgatggatttttaacaattggagttagtgctgccctacgacaattgttggaatttggattatttcatggagaccctcaccctggaaatatttttgccatgcgtgatgggagaattgcatatgtggactttggcaatgttgctgttctcagtcagcaaaataaacagattttaattgatgctgttgtccatgctgtgaatgaggactatgctgagatggctaatgattttaccagattaggcttcctgtccccagggacggatgtgactcctataattcctgctttggaagcgatttggcagaactctgctggaaaaggactgtcagattttaattttcgtagtgtcactggtaggcattttcccttgattgtttaa

SEQ ID NO: 79571 - DNA, 555 bp, Glycine max
  Peptide Sequence Number=SeqID_171256
atggctcctacactaccagtgtgggctcatgccttgatatctattgatcctgcccgtgcaagggatgatcctgtcatagtgaaaaatgtcccttactataaggctaagaaggctctggagaccgaggttatgaagattgatcctccaccaagaccgccaaattgcggtgatgacccttgtgaagtgcattctgtgattagaccatggctcctattgagcaatgttctcagttttaacataaaaggtagaccggagcttgaccttccattgaatgcatcatcttggagtgaggaggatctcaaagatccagataagttctatgaaatgattgctcttcttaatgcccaaagagaaatctctgataagatcttggatgcacagtgggaaactaaatggcgtcaggacaagttgaatgagatgttggaggcaaaggtgaagccatacattcaggatatagacaatgtagttcttcctgagcctattttattaaagccacaaaatcaggaaaagggatttattgcatctgcccttaattatggactcattacatggtga

SEQ ID NO: 79572 - DNA, 683 bp, Glycine max
  Peptide Sequence Number=SeqID_171257
atggacgtagcggcgcggttcaacgtcgcggttggcatgaccgctatcacggcggagcggcacgggatctggaccggatttttgcgccgctacactgaagccgtggaaattctgaaaaccctagcgcgttgctgctctgcacacctgcgaggctgcgaccccggcgatgctacaacatcggcgagcgccgccacctcctccacgcccaggagcacgctgcaagtctgcaacactattcgtacctttctttcccaaatatgggatatgctaggtgcacccagcaatattgctggtgcacccagcaattcaatgaaagcttcttctcttctctcttccccgacaagcttcttctccgcgagcttctccgacagcccttggacccatttgctttcgaggagtcttccggaagaccccttaggggttcttccggaagttccggaagaacgttttccggaaattttccggaagaagtgttcttccggaagtaaccaaacggcttccggaagaacacttcttccggaagacttccggaaaacgtcttccgggaactttccggaagaagtggttcatccggaagaattccggaagactcgcacttccggaagaagtttcaaacttccggaagacctttccggaagaacccttcttccggagtgtttccggaagaaccacttcttccggaa

SEQ ID NO: 79573 - DNA, 741 bp, Glycine max
  Peptide Sequence Number=SeqID_171258
gctttaggcggagttctaggaagagccttagggagacaggctaatgctgatgaggttcatgagcagcctcaggagccagttactaatgatgtacattctgatacacaggggtttcgaggagggcccgaagatacattagtgtttgacggattatatttatcatgtggcaaccagagttggggaaggacaataaagttggcctctcgtgagaagaaggtagaaaaatttgaaaggcatgcacctgagattgaaggcatagtgactgctacaggattaagttctctaattacatattcattggacactggcgcctttcatacctttgatgctcttgatgtagaccaagtcgtggacttgttagttgagttgcttgaacatttccctacaattgcttccattgttgctgatgaggattatcatgagaggaaaccatgtgcttgtcgatggaagtcagggaaggcattaccagtgtcaatgtatcgtaagaacttggatacattaaggtcagatgttaccattcctccacaccttgttgctccatccttatctatagaggagattgacaatagatggcttcagttttcaaaataccttataccggttggacaaatttgtagtgctcttggacagtgtgcaaaaaactacatgaaagtggtcatcgacgcagcagctattccagaaccacctgcacctacacctacagctgctgatgtagatttgtctcgacatgcagtggcataa

SEQ ID NO: 79574 - DNA, 793 bp, Glycine max
  Peptide Sequence Number=SeqID_171259
ggtttcgaagatgttctcgggatcccaattcgacgccaccaccgccttctccggaggcggtttcacgtcctcccagccgtctaccctcaacgattcttctcccgcgccgtcaaacagccgcgaaactccgggtttggtgccggtgacagtgaagcagataagcgaggcctctcaatccggtgatgaaaagtcgaatttcgtgatcaacggtgtagatctgaacaatgtaacactggttgggatgatgtttgagaaagttgagagaaatactgatgtcagttttgttttggatgatggaacaggacgaatcaaatgtcgaagatggattaatgaggcttttgacacaaaggaaatggaggcagtgatgaatgatatgtacgttcgtgtttatgggcatttgaaaagctttcaaggtgttaagcaacttgttgccttctctgtcaggcatgtggaaggaatcacttctgcaaatccttcatctggctcatctttggaaactcctgtcaaaagtgcaccaaatagatctcaggcatcaaatccagtatgtgcacaacatagcgtggatggacttaagggtattgataaattggttatggactacctggagcagcattcagataggcgagttacacatccaacattctatttgtcagatggacgtggaatacatgttgatgaactatcacgggagctcaagcttccaattgaaaagatcaagttgtcgctgaagactcttgcagatgatggtgaaatatactccaccatagatgacgaccattacaaaaaagcctga

SEQ ID NO: 79575 - DNA, 720 bp, Glycine max
  Peptide Sequence Number=SeqID_171260
tccggaagcactgagggcgtcattaaccctccatctcccatcagacgacacgtgaagtggaagatggcccgcaccaagaaaactggccatatgacgtctaaggccgcaaaggaaatcgttgagaagattgattctttggaagagcaggcgtcacaggaacaccctggccgtgtgcgtgctgctaaagtcggtgtcaccatcaaacaatacttcggatcgactccacgaagctcccgtagttcctcctccatccttcccgaagaactcgagcaactgactcaacaaatcaaggaccagctggaggagtcgatcacagaaaaaatgcaatcagaaggaattgcactacctccggagcctgaggttggtccctcagctactcgtgttagcacaaaggggaattgtgttgatccctcaccgaccgatccaaagatgggtgacttagacaaatgcgggttgtatatcgaagaaaattcttctcaactagttgccctaggaagagtttatgagggatccataactgttcacaacatccctttgttgcatggccaagtgagggttggtgttgaggaggttaaagatgcagaggctcccgttcctgtacccactgacgaggcagttgtgtctccagcaaaacctgtagatagggtgcatcctgaggtcaatgatctcctatatctgatgacattggtcatcccacagcttttcttgagacctctccag

SEQ ID NO: 79576 - DNA, 216 bp, Glycine max
  Peptide Sequence Number=SeqID_171261
atggacactgagaacgataggggatacaattgcaatggcagtagcaagactagggaggaagagattcaaaaggaagatgaaaacgatgtggaggtagagaaaaaattggttcagatcaaacaatcaaggacatatcatgggccaagaaatgcaattggatgggcagtcgaagatgatcttaaaatcattgtgtcaagaagtttggaagagggatga

SEQ ID NO: 79577 - DNA, 213 bp, Glycine max
  Peptide Sequence Number=SeqID_171262
atgtcggcggtggttggtttggttgttaacagagatatgtcggagatggacgaagatcaatggatgtatgacagtataatgtatgaagaagttgatatgaatgaacaaaatgaagacgaaggtggtgtgagtgaagaacatgttgattgttctgatgcgtttaatacttctcaggtgtttactacccgagatgatgttttgcattgggcttga

SEQ ID NO: 79578 - DNA, 411 bp, Glycine max
  Peptide Sequence Number=SeqID_171263
atggaaaccatatccaagcgatttaaagagcttgatgtctgtggcaaagttactcaaaagagtaaactccaagaaattgtctaccctgatctaaactctatgtgtcctcctccagaaaagatcaacaccaaaggtgctcagaagaaatcgatgaccaaatatcaaaaagatcaacaaagcgtgattcgtctcactgggagtatgggtgaagattcatggtctttggtgcataatcatttgcttaaagaacttgccaaatggtctgatgagtatatcaacctccttggtggcatagtcagatttgatgaattaaagcggtccctacttgttgatggattatccatggttatcatggataaatggatgaatataatcgacatgggatatgtcattgcatcaaggtttatttaa

SEQ ID NO: 79579 - DNA, 318 bp, Glycine max
  Peptide Sequence Number=SeqID_171264
atgcgttatacgaatttcaaatgcccaccagcggccattaaaattaaccaaaaagcttaccttgatgacaaaaacggcacgaaggtggtggagaagaccttaacggtagcaatggacacagaggacgatggcgatgcggcgcaaaatgcagaacgaatgaagaagagtgaatcagattgggctgcacaatgcacaaggcaagataaaatgtcaaatgaagaattgaagctgcaggatccacgatgtcggatacaatgtccaggacatcctgcccgaaaatactggacacataaatctgttatatctttaacagattaa

SEQ ID NO: 79580 - DNA, 777 bp, Glycine max
  Peptide Sequence Number=SeqID_171265
atggatagatccaagttggtttacggcctagtcacaggcatggacatgaatatcggagccctaatctctagagttacctttgatagtctgacctatgagagcctgagcccgaccattaacttggccttcattaagaaaaactgttggaacatggatgatctgacagttaactttagaggggctaggaaggtaagggctcgaccagcagatattccttcttcttccgcaccaccagctcctcccacttatgccactcctacaccagctcctcccatttcttccacccatacaccagctgcccaggactctcagcgctttgaagccatgcttcaaagtattcatcaggggcagattttattactgcagagcttgcatgtggtagctcctccagggtccattctgtcgatagagcagttcattgagaaggatgggtcttctgaggctaccatccctggagcttttgatttttcaggtgtaggagtagagatgagacctgatgaggttgttcttcttgagccaattgtgccagttatacatgaggttgttgaagcaggtgagtcacagttgagacaggaggctgctactcctgagaggacaccacagaccccagaagattcactctcaccagggatggacttatcttttgctcagcaggtagaagatcctcctacactagtacatgagagacaaccaaatcctcctacacccatcatagagatgctagaagactctaccacgccaatcctaagactgtcatccactcctccagctacccca

SEQ ID NO: 79581 - DNA, 303 bp, Glycine max
  Peptide Sequence Number=SeqID_171266
tcaaagcttgacggtcgtgatcttgtgagacaaagtgttgtcgtggtggtggcagaaattgagcctgagagagtaagggaaatcaaggtgcagcgcactggactgttagggcacgtaggtggcgaagagatgacaacgaagctcggtaaaggctatggcaatgtgggtggggattgcagactaaggtggctcaaagattataacggtacggtgattaggttagaccagaggtttggtgcgttgtggttatggttggagttggtggcattttcatggttcgaggtggaagttggcacggtgggg

SEQ ID NO: 79582 - DNA, 717 bp, Glycine max
  Peptide Sequence Number=SeqID_171267
atggcaattgacaagtcaaataagaaaagtcagaaaacgcagtatcatatgatcaacaacaacacttacctcatcaaaagcttcaaatatgtctatgcttggttgatggatgtagccctggcatctaacccagatgttggctcatccatgaattttatagagggattagccactacctcaactgctatagttagtctcttgcgctatttggtggagagaccactaacaccagaagcgctctttctggctagacaatctgtgcttgctcaagagaaaaataaattgagtgaaacccccatgctctatagctgcggtctctgtggaaaggattataaaagttctaaagctcatgctgagcaccttaaatcacgtggtcatatgatgcgggcctctgaaggaactagccatgcagatgagaaggcaataattaagccacttccacaacgtgttgtgaataggcctcctcctagaagagaggtagataactctgaaaatgaagaatgtgaagatgaatgggaggaggttgatcctgaagaggatttggttgatgaagcacgtgctgccaagtccttgactgatttgaatgtgaatgagcatggtgaaaatgttgatatggaggaagatgctgatgattttgaggagttagacccctcatgttgctttatgtgtgatcaagagcacaaaacaatagaagactgcatggcacaagcatcatga

SEQ ID NO: 79583 - DNA, 521 bp, Glycine max
  Peptide Sequence Number=SeqID_171268
aatacattcagaaggctaaaccagttggccttcctgagtctcggcatgatgacagagtgggtggtaagggttcaagaggactgcatgtgatcactccaagtgtagaagatttgttacaagctcactccaaaggtgaaaggaaagatattgagctggtagaggaggaagaaccaaagattactgctgattgttctagtgaaacctctaataaatctgagatttataaggaggaagcagggaatgcagcacagaagcataaaccaaagagggtggagagtgtcgatgctgatgcaaaagcctttggttatcactcgaaaaataagacaggagattcaactgtgctgaagataggagattcaggtaaagttgtgataaaacaagacatgaagggaggagagcataaatatgggtttaacaacaataaacgtgagaagtcagagaaggtcttcatgtcattccttcatcattcaatgtcttcatgtcattccttccccgacattttgaagtactattctgaatga

SEQ ID NO: 79584 - DNA, 272 bp, Glycine max
  Peptide Sequence Number=SeqID_171269
ggtcagggtgatgctccacaggccgcaggcgcgcccccaccacctcatcaggctggccaggctggggcatttgacatggagcagtatttacggcattggttcgccagcaggcagccaaccaccgagcacatggcagaggtagcatggcccggagattggcccgaggcccaagcaggagaggcacccccagaagctcccggcgatggagaagaagcccacgaggatgaggagatggccgatttgcttgacttcttgggagggagtggagatac

SEQ ID NO: 79585 - DNA, 741 bp, Glycine max
  Peptide Sequence Number=SeqID_171270
atgggaacaaatcaaaccggcaagaggttctaccaagtcaaggtcaaaagcctagataccaccagcatcaaggaattggggcggttgatggaacccctccaaatgcaagccttccgcaagacttacggaaagatcttagagttgaccatagcagaggtgtccatagaagccattgcatcacttacccaatactacgaccagcctttgaggtgcttcacattcgcagacttccaattagtaccaaacattgaagaatttgaggaaattctaggatgtcctctcgggggaagaaaaccatatctttcctccgggtgtctcccctctttgagcagaattgcaactgtggtcaaggattcagcaagagacctagcagcaatcgacgctttccttgcctaccaccatagcaaggaaagtccggtggtagtcgtcttggcagatctatttgatacatttgaccgaagatgcgagaagagtagcgcacggatcatctgttgcttacccgccctctgtgtttggttggtttcacacttgttccaacaagacacaagacatccatgcccgctcctgagccatcactcgtgtactgaaaagaggagaatggattgggaccagctcttggccgggataggaggtagaacaatcagttggttcccccgatggaaagaaggaaaagaaggagtccttttctcatgtggaagatacccaaacattccgctggtaggaaacgaggggttgtattaa

SEQ ID NO: 79586 - DNA, 443 bp, Glycine max
  Peptide Sequence Number=SeqID_171271
atggctctgagaaagcttcctgcaaagagatccaggaaggacaaagcggctgaagggaccagtgccgctcctgagtatgacagccatcgcttccggagtgctgagcaccaacagcgtttcgagcccatcaaaggatggtcatttcaccgggagaggcgcgtccagctcagggacgatgagtataccaacttccaggaagagatagttcgccggcggtgggcatcactggtttcccccatggccaagttcgacccagacatagtcttcgaattttatgccaatgcttggcctacacaggagggcgtgcgggatatgcgatcttgggtgaggggtcagtggatcccttttgatgctgatgccctcagccagttcctgggataccctttagtgctagaggagggccaggagtgcgagtatggccagaggaggaatcgggccgatgg

SEQ ID NO: 79587 - DNA, 513 bp, Glycine max
  Peptide Sequence Number=SeqID_171272
atgctggctactggtaatcgattactaccttctggtaatcgattactagagagtaaaactctttggcagagagtggctatcacagctgagcacgatgagccagtggtccttgtgatagaggctgttggagctttggttgaggctgtcgtatatgcggatgagccgatggtaggaggtgatgtacatgacactagggcagacactcctacaaacataggcgcacaggctgctgaggatgagcctgagggatttctgggtggtccgagcgacctatccatgctgaccgagtatgcggatcatgttgcagacagtgtatggacgagagaggagcggcctgagttgaagctatcctctcatgggaggaaggtgcatagtttaggtaggcctgtccctgccattgaggggctagttgttgggacaggactaagtcctctgatcatgtgtttggtagacactggcgatcgggggacttttgtctttgtttgtcgagcggtggcaccgggagacgtctag

SEQ ID NO: 79588 - DNA, 216 bp, Glycine max
  Peptide Sequence Number=SeqID_171273
atgggaggagcttgccacccagctcgcccaggcgagccaggttgcttcctccagaagcaaccgccttctggaggaagaatctggaaggcccatgtgatgcaatcctactccgtaagggcattgggtagaagactccaagtagattgggctagagatccaagggaaggccctagggttctcatgagccttagggtagatttcgagcccatgggctaa

SEQ ID NO: 79589 - DNA, 438 bp, Glycine max
  Peptide Sequence Number=SeqID_171274
atgtcgatctccccctgcgaaagtatcggttggtctgtgccgtcacgacatagggatcgtgcccacaaggcacccagtggacccggaggagtccgacagggccctggggttttcggctctggttacgggcctctggtcacgcccacaagacacccagtggacccggagaagttcaacaggaccctggggtttccagtcctggttacgggcctttatcagtcctacagggtgcccgtactccccggcaaggtcatgccatcgcgacatagggatcgcgctcgcaagacacctagtggaccaggagaagtccaacagggtcctggggtttccagctctgattatgggcctctgtcatcaggccccctactaatcgagctttcatcaagaggtactgcgtccccaggcaggcgcaaggcgaaaatgaattatgagccctag

SEQ ID NO: 79590 - DNA, 339 bp, Glycine max
  Peptide Sequence Number=SeqID_171275
gtttatacggatgaccactcgggtatctccgcccgtcagcgtgactcaaaagtcagtatgacagatcttgtgagcacagaagatgacgcttttcgtcttacagatagcaaaaaggtttatacggatgaccactcgggtatctccgcccgtcagcgtgactcaaaagtcagtatgacagattttgtgagcgcggaagatgacataaatctccgcgtgtcaacgggcttgtcggccgcgattgacgaagggcgcaggagacgactcagtatgacagatcttgtgaaggtggctgacaaaagcgaggctcttgctcctacgtatcctccaatgaggaactga

SEQ ID NO: 79591 - DNA, 378 bp, Glycine max
  Peptide Sequence Number=SeqID_171276
atggtcattacgcacgttttgtcatccaaaggcggcgagcccgatgacatgtggagacaaattatggtaatccacagaccttttcagcatccagagacgatcgagtccgaaggcacgcagagacaaattatggtcattctgcaacttttgtcatccagaggcggcgagcccgatgacatgtggagacaaattatggtcatccgcacaccttttcgccatccagaggcgatcgagtccggagggacgcagagacaaattatggtcattttgcaccttttgtcatccagaggcggcgagcccgatgacatgcggaaacaaattatggaaatccgcacaccttttctcaatccggagacgatcgagtccaatggcacgtag

SEQ ID NO: 79592 - DNA, 486 bp, Glycine max
  Peptide Sequence Number=SeqID_171277
atggcgaaaggtgcacggaagaacataatttgtctccgcatatcatcgggctcgccgcctctgcatgacaaaaggtgcagaaggtccataatttgtctctgcgtgacatcgggctcgatcgtctcaagatggcgaaaaggtgtgcggatgaccataatttgtctccgcatgtcatcggggttgccgcctctggatgacaaaaggttcgaaatgaccataaattgtctctgtgtgcagattaccataatttgtctccgcatgtcatcgggctcgccgcctccggatgacaaaatgtgcagaatgcccataatttgtctctgcgtgcctctggactcgatcgtctctagatgggataaaggctcgatcgtctctggatggcaaaaaggtgtgcggatgaccaaaatttgtctttgcgtgtcatcgggctcgccgtctctggatgacaaaaggtgcagaatggccataatttgtctctgcgtgccataa

SEQ ID NO: 79593 - DNA, 156 bp, Glycine max
  Peptide Sequence Number=SeqID_171278
atggttaccatggataagtggatgaatattacggatatgagatatgtcattgcttcacgatacaacgtgatcgttgtttctctttcacgacaacaaagcatgacatttttcctcttagaagttagtcgccaccagattcttctgtgcatcgcgtaa

SEQ ID NO: 79594 - DNA, 669 bp, Glycine max
  Peptide Sequence Number=SeqID_171279
atgaccaccctgacccagatatggatgacgttgctcctcagcaacatcctgcccagcgatcataattccgacctccccctgccgaagtgtcagctggtgtacgccatcctgacgcggatgagcgtccatgtggctcagttaatcgctgatgccatttatatttttgcaggtatggcgcctaccaggcatcctttggatccagataagtccaacagggccctgggatttccctcgctgatcacaggactctaccagtcattcggagtccccgttgcacctaccaaggtaattcggccgcccatcacccgggcttttattgagaagtactgtacccagagacaggctcaggggctggccaggctggggcatttgacatggagcagtatttacgggcatttggttcgccagcaggcagccaaccaccgggcacatgtgcagacccatgattgtctgtaccagatgagcctcagcatgcagagccagggcttcgcttctttttcatgccctactccagaccagttcagggcagaggtcgcatggcccggagattggcccgaggcccaagcaggagaggcacccccagaagctcccggcggtagagaagaggcccacgaggaagaggagatggccgatttgcttgacttcttgggagggagtggagatacgtga

SEQ ID NO: 79595 - DNA, 144 bp, Glycine max
  Peptide Sequence Number=SeqID_171280
atggttttccaccgttcttcatcgttcttcgtccttcttcggtcttcaaccgttctcaaagaactatgtaggtctgatttccttatcacaattgaggaatacgtaggagcaagggaaacacccttgtcgaccacaaaaacatga

SEQ ID NO: 79596 - DNA, 294 bp, Glycine max
  Peptide Sequence Number=SeqID_171281
atgtcatacgccttaatcttttctctttttctttggcaggagaagcaaaaaggtggctacactcctttaaaggcaatagcttctagacttgggaagaacaaggcgctcgaccatttctacggactactcagaaagacgcctacacatgggtacaacgagccgatgcaattaaacatctccacagatggcctacgaccacagtcaaaacaactccttgacgcatttgtaggaaaaaatcaagatgaaggcactagaggaggcaatgaagctgatagagaacatggaggccaatga

SEQ ID NO: 79597 - DNA, 164 bp, Glycine max
  Peptide Sequence Number=SeqID_171282
cgagcacaatgaggagaggagctaagagaaagaagaagcaggctcagaagccaaacacgacgcacccgaagataacaagctcaaagatcagactcgagctaaacgagccaagacctccaagcatcaatccgaacctgagtacttcgaagacaagcgcaacttga

SEQ ID NO: 79598 - DNA, 324 bp, Glycine max
  Peptide Sequence Number=SeqID_171283
atgtcggccaggaaagatgaccgatccaagtctaaaaagaagaatctgatgagaatcatgaaacaggccaaatacagtctaaaggcccaagtggagaaggacgaaggcccaagtggagaaggacaatgcccccgagtggagaaggatgaaggcccaaacttatcttccttcaccggaagtggcgtctaccctgacttatcttccttcactagaagtggcgtctacccagacttatcttccttcaccggaagtggtgtctaccctgacttatcttccttcactggaagtggcgtcatccaaatcttcatagcctgtatcaagtga

SEQ ID NO: 79599 - DNA, 539 bp, Glycine max
  Peptide Sequence Number=SeqID_171284
ggggtaaaataaagcttaaaactcctgaagaagccatggaactaattgagaatatagctgctagtgatcatgctatcttgtgtgatagaacacactatcccaccaagaagagtttattagagctgtcatcacaagatgctctgttggtgcataataagttgttgtcgaagcaactcgagactttaacaaaaacattgagtaagctgcccactcaattacatggcggaccatcaaataggccgccaccacaagggcctaacctctatgagaggataacaaagctggaggagactcttgctcaattcatgcaggtttcaatgtcaaatcacaagagtactgagtcggccattaaaaatttggagatccaagtgggacagttagctaaacaaatagctgacaactcttccttaaaatttggaaccaacacagaaaccaatccaaaggaaaagtgtaaagctgtgatgacccatggaaaaatgcaaaccatggctgaagaagagaaggatgagaagatagtggatggagataaacaacagctg

SEQ ID NO: 79600 - DNA, 441 bp, Glycine max
  Peptide Sequence Number=SeqID_171285
gcttcacgccctcaccttcaaaggactacacgtcctcgccttcagagggcagcatgcccgcaccttcagaggactacacgtcctcaccatcacagggctgcacgccctcaccttcataggactacacgtcctcgccttcagggggctacacttcctagccttcagaggactacacgtcctcgccatcagagggctgcacgccctcaccttcagaggacaacacgtcctcgccttcagagggctgcacaccctcacctttagaggactacacgtcctcagcttcagaggactacatgtcctcaccttcagaggactacacgtcctcgcttcgaagtacttccgtaacgcttccgtaagcgattctgtggaaattcttcatcgttcttcgtcgttcctcaccgttcttcatccgttcttcgttcgttcttcgttcttcaacgg

SEQ ID NO: 79601 - DNA, 274 bp, Glycine max
  Peptide Sequence Number=SeqID_171286
ctttgtcccgtcaaaacgaaaaggaggtgtctcgccagtcctgtggacgagacccaagctgactcaggctgtctcgccagccgtgtgggtgagtcccacgtggactataccgccagtcgtgatggcggctccagctggtgacaatacacccctctctccagctttgccgcaactggcaatggcgggttcagccatggcgccagtggcaatggcggtttcctccgcaaaacaaaccccctccgttatttcttttggaacagaccccatcccgtaa

SEQ ID NO: 79602 - DNA, 1038 bp, Glycine max
  Peptide Sequence Number=SeqID_171287
atgccaaaaccggttatgaaacctagaaccaaagtagtatgctacaattatggaaaacaaggtcacataagcaaatattgtaggttgaaaaagaaattaagaaacctcaatcgagatccatccatcgaagaccagattaataatctactcattgaaacctcagaagaagaaactggagaagtatcttcggaggaaaatcttaaccaaatccaacaggatgatcaagtatcatccacggaagaggaagatatccaagaggtcaacactttaacaaaagaacatgatctcttgtttgaagcgattaattccatacctaacccccaggaaaagaaggttttcctgaataaacttaaaaaatctttggaaaccaaacctaaaccaaaagaatttattacaaacaacaaatttgatgttagtaatatactcaaaagattagaaaatacttccgttaaaccaaccaccatccaagatcttcaaacgaagattaataaccttaaacaagaagttaaagagctcaaacaacaacaagaaattcatcaaatcatcctttctcattttgaagaacacaatgattccgaaaatgaggtcaaagaagataaagatgaagatgatgaaatgttcatgggattaatcaacaagattaaaatccaaaagttttatattaatattagaatcattataaatgattttgttttagatacaatggctctttttgacacaagagctgattcaaattgtattttagaaggtctaattcctacaaagttctttgagaaaacctcggaaaaattaagcacagtgagtggctcaagactaaagattaattataagttatccagtgaaaccatagaaaaccagggtcttaggattgaaacaaattttcttctggtaaaaaaccttaagaatgaagtaatcctaagaacatcattcattagatctttgttccccctccacatatccaaggaaggaataaccacttggcacttgggaagaaaaatcacctttgatttctctactaaaccaattgcaagaacataa

SEQ ID NO: 79603 - DNA, 153 bp, Glycine max
  Peptide Sequence Number=SeqID_171288
atgatacgccttctcaagagcttaaccgcaagaccagcgaggggagagggaagccatgaacgcgtgaggggaagggtagggggacgggaacgagacatgaagtggagcgaagggaaaggaaggaaggaaggagaagcacttgccttaaattag

SEQ ID NO: 79604 - DNA, 267 bp, Glycine max
  Peptide Sequence Number=SeqID_171289
atgtcactggtggttctggcagaacccctcgatgccgctgctggacctggcgaaatagggagtgcacaacaacacaataatggtggagaggagttgcacgcaagaagccttgaaggtggaggtcatacacatgtaagggctctacacgatgatgccagtgataattgggactggtggcggggggagggtggagtcgtggttctagttctagccaagaattgggtgaacaaaaatgtgggggggcatggagattgggtaagaagatga

SEQ ID NO: 79605 - DNA, 255 bp, Glycine max
  Peptide Sequence Number=SeqID_171290
atggatgaggaggaagcaataggtataggaggattggaaggtggtaagataaaggattgtgcattagtgaagggtacaagaatgaaattgctgctagtgttgggagattttggagagaagagactgggaaaggggaattgtagcccttgtgattttcagaatagcccaaaaatagacattcttcagaccttggctgtaactttgactgattatatggtctcagacacgaaaagcaagcacaaccaaaaactctaa

SEQ ID NO: 79606 - DNA, 159 bp, Glycine max
  Peptide Sequence Number=SeqID_171291
atggaaagagaagagaacaagaaaaagcacactggtaagcccggatctacgactacaaccaagaacaactgtggttgggcggtggcttgtgaaatagaattagggtacggcatttatgaaggtcttcctagagaagcagaatatagagaggaggagtga

SEQ ID NO: 79607 - DNA, 147 bp, Glycine max
  Peptide Sequence Number=SeqID_171292
atggtgcaaggttggcttgatcctggtcgatggggcagattctatgctcgagatttagatgttgaagatggggtcttggttcaggatgtgatggttgaaaataatagtcaaatggaggtattaggcttttggagtaggttgctgtga

SEQ ID NO: 79608 - DNA, 504 bp, Glycine max
  Peptide Sequence Number=SeqID_171293
atggtctccaccctgacatgctgcaataataaagcaaactatgtaggcccgagtgatcctaagactgactcgtacagttctgataattcaagggtcaggtctactagaccaacaacaagaaggaacaaattatctggctctccaagaacattggagactgatagggtcgaatcaagtgtggatttgattgcaagaggtggagaaacaatatcatactctccaagagcaatggagactgaaatgtgttgtggacaaggagaaaacacaacattaggcattccaagagcaatggagactaaaatgattgactcaagcgaggatttgactgttggaaacaccacattaagcactccaagagcaatgaagattggaatggtactcaagtggggacttgattgctggaaatacaatatcatgcaccactccaagagcaatggagatggaattggtggacgcaggtgtagatttaattgcagaacagagagagggtcatggacaaggtga

SEQ ID NO: 79609 - DNA, 951 bp, Glycine max
  Peptide Sequence Number=SeqID_171294
atgtgcgctttgagagcgttgactaggtccgtatgcaacagcagctcctatgttaaaacttccaaaccctatctcattctcaatctcatcacccatcagcaccagacccgtagaaatcttattcttgagtcttccgcttctgaattcgtcaagcttcacaaactcactggccctgattccgggattgtcgaaattagcttggacaggcctcaagccaaaaatgctatagggaaagagatgctgcgaggcctgagtcatgcgtttgagttgattaatcagaaatcttacgctaatgttgctatgatcagtagttcagttcctggggtattttgtgctggggctgatttaaaggagcgcaggaccatgagtcagtcagaaactaagatttttgtgaattatcttcgctccacattctcatctctagaggctgtcaatgtaccaactattgctgttattgaaggagtagctcttggtggtggacttgaaatggctcttgcattattagactttttctttacttgtttcttctttgatggcataggagaaaatgctctgatgggtttgccagagacaggacttgcaattatccctggggcaggtggaacacagcgactgccaagattggttggaaaagcaatagcaaaagatattatattcactggtcgaaagattgatggcaaagaggcactgtccttgggtctagtcaattattgtgttcctgctggtgaagcttattcaaaagcacttgcaattgctcaggatatcaatcagaagggtcctgtagctttaaggatggctaaaagagctattaatgagggagttgagactgatctaagatcagctttggagttggaagaagattgctatgatcaggtcttgaattctaaagatcgattagaaggtttggctgcatttgctgagaagcggaaaccaaggtatgttggtgagtga

SEQ ID NO: 79610 - DNA, 753 bp, Glycine max
  Peptide Sequence Number=SeqID_171295
atggtgatgggagaagatctctatgaccacatcaacaagtccttcaaaactttggttcaaacgttgcttgtgggaagatcaactttggatttggatgatgtgattgccgttcttagagaaaatgagagaatgatgagaactgaaaatgttgatgaagaacacaatgcaataactgtggtggagcttgagagaggaagaaatcatttaaggagacatgatgggacaagaggaagatcaaaatggcaatcacatccacaacgagatacgagtaacatgcaatgttactattgtagtgagaatggttatgtgcaagtgaggtgcaaacaaatgaaggaggacttggagaaattaaaagatatgaacaaagatggtatcaactcccaaactaatgtagtaaaaaatgttgaagatgaagatgatgtgcttttggcaacaaacataaggagcgtgaggatgaaactccatgatggtgctattcgaactttctcaaatgtgaggtgtgtgccttctgttgttgtcaatatgatttctatgagggagatgacatcacaagagtacaaatatgttggttcaaagaggggatgcaaggtgtacaagggaagatacttggtgttgcaaagacagaaaaataaaggtaacatttgctatttggatgatcaagtcttgaaaaggaaccatgatagcaaaatgaagaagaaagtgaagttttctaatgttgtggaagtattgggagatacttccgttggaggggga

SEQ ID NO: 79611 - DNA, 96 bp, Glycine max
  Peptide Sequence Number=SeqID_171296
atggaagagaagaaagaattccctaagggagagtctcaagttgttggagtggacttgggtctgcatacttgcactaagactgcattgctcgcttag

SEQ ID NO: 79612 - DNA, 519 bp, Glycine max
  Peptide Sequence Number=SeqID_171297
atggggaggaccatagggttgaggggctctgtggtggcggtggtgttgagccagggctttaacagtggtgttggtggtggaggagtgaggctagggtttgggatgtgcaaagtccgatggatttgtgcttcgtatcaagaatattttggagcaaagacagttcttggagctcatcctgcaccacgtgtagctacattttcttctaaaggccctaatgctttaaacctaaaaattatgaaggactcgatactttcagtgaacatggccagcgctatcattccctacttcatcaagaaacaccttgtcctcaaggtgggggcttgtgattgtcctacttatggtccagaatggctagcggttccaccactagattgttgtcccatgaagctggtggaagagattgctttgaaactatgggaccctggtggagttttagtttggagcagtggaagacagggtggattttggccattggtggtaaggccaattgataagctactttgcctactgaattcgtga

SEQ ID NO: 79613 - DNA, 243 bp, Glycine max
  Peptide Sequence Number=SeqID_171298
atgctggtttcggctttggaaagtatcactgatgacaataacagcaatgtcagaagtgttagtgatggtgatagtttttgtgttgatagcaaagttaatggtggtggtgtcaatggtggtggtgatgacaaccctgacgataaaggtgatggtgtcatgccagcggtgatgttggtaccgatgacaatggtgatagtgataatagtgataatgatgatggtgacggtgattgtgcaatactga

SEQ ID NO: 79614 - DNA, 225 bp, Glycine max
  Peptide Sequence Number=SeqID_171299
atggttatctgcatcttttgtcaaccaggggcaaacgcgcctatgggcgcgcagaaactaacatcgtcttctgcacccgttgtcatcctgacccatggagtcgggtggcaggcggagataccttatggtcatctgcacctttcgtcaaccgaggggaacgaattcgacggttccgctagtggggatattgaccggccgaatgatgtttcgctcgaacaaaattag

SEQ ID NO: 79615 - DNA, 405 bp, Glycine max
  Peptide Sequence Number=SeqID_171300
atggcttctccacctgcctcccttcctcctcctccccctcctcctcctcctgctccttcgaacgcatcggctttgccaccacttggtgccaagagaccaatagttcatgttgatcctgctaccggcaaggccgacggtccccacaggaagaaattaagaacatatttggggattgtggtgcgtgataaggtggacgtcacctacgagaactggaaggaggtccctactgctcagaaggacctaatttgggaggatattcaggtggaatttgaaatcctagaggcttctgatagtaggacgaaaaggaagttacttcagaccgtgggcgagagatggaggcagtttaaatcagacctcatgaggaaatgggcccttgcagccgatcaggacggtgtggaggacatt

SEQ ID NO: 79616 - DNA, 360 bp, Glycine max
  Peptide Sequence Number=SeqID_171301
atgttttccaagaaggagggaatgatgagaatcatgaaactggccaaatacaggctaaaggcccaagtggagaaggacgaaggcccaagtggagaaggacaaagcccccgagtggagaaggatgaaggcccaagtaatccttgtggcgtgtatcctgacttatcttccttcactggaagtggcgtctatccggacttatcttccttcagtggaagtggcgtctacccggacttatcttccttcatcggaagtggcgtctaccctgacttatcttccttcactggaagtggcgtcaaccaaaaactctacggcctgtatcaagcgatctgccccgtaaggttcacgtcaaaccaaaattaa

SEQ ID NO: 79617 - DNA, 1002 bp, Glycine max
  Peptide Sequence Number=SeqID_171302
atggtggcgggagtgatggtgttcgccttgcgccgctattggagtggcaccaagaaacgccagcgtatccacatgaccccagcggaacgtgaaaaggtcgacggcaaacgcaagccgccgttctggacccgtatcgcgctgatcctgtcggcgattggcgtcagcttctcgcacggcgccaacgacggccagaaaggtatcggccttatcatgctggtgctgatcggcgttgcgccggccggcttcgtggtcaatatgaatgcaaccggttatgacatcacccgtacgcgtgacgccgtgacccacctgcagcaatattaccagcagcacggcgacgcgctgtcgcatgcggtgtcgttgacgccgctggtgccaagcccggatgacgaagctgcgccgaacaagccggccgagttccactgcgacagttcgcgcgccatgccggcgatcgagctggctcagggcatgctgaccaacctgcaaagctacgatcaactgacggttgagcagcgcagccacctgcgccgcctgctgatgtgcgtgaccgacacggcggataaagtcgccaagctgccggaaacctcatccgccgaccagcgcttcctgaagaacctgcgtcaggatctgctgcagaccgtcgagtacgcgccgatgtggatcatcgtcgccgtcgcgctggcgctgtcgctcggcaccatggtgggctggaaacgcgtggccaccaccatcggcgagaagatcggcaagaaaggcatgacctacgcccagggcgtatcggcccagatgaccgcggcgctgtctatcggcgtggcgagttataccggcatgccggtctccaccacccacgtcctctcttcggcggttgccgggacgatgatcgtggacggcggcggcgtgcagagcaaaaccgtgaagaacatcctgttggcctgggtactgaccctgccaatctcgattctgctttccggtgcgctgtattgggttgcgttgaagctgatctaa

SEQ ID NO: 79618 - DNA, 785 bp, Glycine max
  Peptide Sequence Number=SeqID_171303
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatcacaatcgtggctcactgcgaactatgcctccctatctcaagccccatcctctcatcctctcacctcagcctccatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 79619 - DNA, 719 bp, Glycine max
  Peptide Sequence Number=SeqID_171304
gcagtggcttggttaagggaaaccaccggagccgtagcgaaagcgagtcttcacagggcaattgtcactgcttatggacccgaacctgggggtgaaatgccactcgaacccagagctagctggttctccccgaaatgcgttgaggcgcagcagttgactagacatctagggggtcaaggtcggccagtgagacgatgggggataagcttcatcgtcgagaggggaaacagcccggatcaccagctaaggcccctaaatgaccgctcagtgataaaggagggaaggacccgcgcgagcagtgctggacgaagcggaagcgagaatgtcggcttgagtaacgcaaacgttggtgagaatccaatgcctcgaaaacccaagggttcctccgcaaggccgaagggcgtagtcgatggacaacaggggaatattcctgtactaccctttgttggtccccgagggacggaggaggctaggcgctacagcgctgaagtaatccatgccatactcccaggaaaagctcgaacgaccttcaacaaatgggtacctgtacccgaaaccgacacaggggtgcctcctcacaaagggggtcgcagtgaccaggcccgggcgactgtttaccaaaaacacaggtctccgcaaagtcgggagccgacgaccgaagccccggtgaacggcggccgtaactataacggtcctaaggtagcgaaattccttgtcgg

SEQ ID NO: 79620 - DNA, 189 bp, Glycine max
  Peptide Sequence Number=SeqID_171305
atgaaagttatgccaagcaagctaacaaggacaggaaggaagtgggtgcataaggatgcacaggctaaagttgaatatgtgaaaaaattgcatgagcaggagaaggcccaaattgcaaagaagaatgaaggttatgccaagcaagccaacaaggacaagaaggaagtggtacttgaaacaggtgattga

SEQ ID NO: 79621 - DNA, 219 bp, Glycine max
  Peptide Sequence Number=SeqID_171306
atgcctataggttggacctcccagaagagtggagctgatattgaggaggatgaatcgacagatttgaggtcaaatcctcttcaagggagagggaatgatgcaatcctccctaagaagggactagttacaagagccatgagcaagatgctccaagaggattgggctagagctgttgaagaaggcctgagggttctcatgaacctcagggtagatttttga

SEQ ID NO: 79622 - DNA, 369 bp, Glycine max
  Peptide Sequence Number=SeqID_171307
atgaattgtcgagaaaaaaagcctgtagaatgcaccccaattccaatgccatatgctgacttactcccctatcttcttgataatgcaatgacaattataagcctagcaaagatttctcaacctccatttcctagaggatacaaccccaacgtgacatgtgcttatcatgggggagttccggggcattccattgagcattatataaccctgaaacataaggtggaaagtctgattgatgcagatacctcagagccctacactggggcaatgagaggcaccatgcatgagcctcaagcaaacctaggagcagatcagaagttctcacctagtaggttgaaaaccctaaagggcggcctaggtaaaaattag

SEQ ID NO: 79623 - DNA, 243 bp, Glycine max
  Peptide Sequence Number=SeqID_171308
atggttaacaaatcagggatggaaactttactgaagaaactattaagtcttgtggatgtgtatattgaattgattgatggtgagcatgagagtaattcgagagagaaaccggaggagactacaactataagagatgatgcattgcagtggttgacaatattaaggcttggagggattgatgggaacccggtgctgagaggaacgaggagaagaactacgtacgcgtacatgagctcaaattaa

SEQ ID NO: 79624 - DNA, 255 bp, Glycine max
  Peptide Sequence Number=SeqID_171309
atggtgggttacacaccttcaagttttaaggatttggtcttcgccagcaaaaggatcgaagtgggtctgaaaagaggcaaatttggtcatcctgctttgataaaaactggggcaaatgaagagggtgagaaagagggagaaacccatgctgtgactgccattcctatacggccaagtttcccaccaacccaacaatgtcattacccaacccttctccttacctaccgcccatttatccaccaaggccatccctaa

SEQ ID NO: 79625 - DNA, 681 bp, Glycine max
  Peptide Sequence Number=SeqID_171310
cgcaaatttgatatccctgaaggtgaaaatgcaaaaaaaaagcaaatatctgatcctacagtcaagtatggccttgatccagaaacatgggcggaatttgcaaaaagccgcaaaactcctaattggcagggtatacgaaagaaggcccaggaaattcaaaaatttaatgactgccctcacgtactgtctcgtggggggtatgaactgcttgacaagaaacttatggaggagaagagcaagcgtggacatgaggaacattcgtgtactgaaagcccaacactcaacgtcgacccaccatccctagttgcaagacacttgaagtggaagatcgcccgcactaagcggcatggccaaatgacgtctgaagtggcacaagaaattgcagacaaaattgattcattacaggaacaagcaacacaggggagttttgttctgcatgggcgacaggacatactcaacacggcccttgaccgacctgagcatccaggccgtgttcgcgtcgcagggacaggtgtcacaataagccaatactttggccaagcctcacgtgcttctagcacatcgtcaccatcgatcaaccaacaacaattggctgatatcatcggtgtaattaaggatgacataagaaagcagctacaagatgagataagaaaggaggtacaggatgagataagaaaggag

SEQ ID NO: 79626 - DNA, 285 bp, Glycine max
  Peptide Sequence Number=SeqID_171311
atgagtcatggcccgagaagaatgagaagaaaagccataaagaaagaagatccaagaaggcatatattgcttgggatggcaatgattcatcagatggttcggagaaggagatcaaccttctatccaaggactatgaaagtgatgagaacatctctcatgaagtttaacggaaggcaaaggagaagaggagaggggagacaccatccactagggaataagccaaggaagaaggagcttcaccaccaagaattgccttggataagaagcttgaagaagatgctttaa

SEQ ID NO: 79627 - DNA, 478 bp, Glycine max
  Peptide Sequence Number=SeqID_171312
acttgggttccctgctctgatcaccgtcctgtgtaaggacagaggggttacttctgacagcttggttttcgagcgcctgagcccggtcatcaacttggcctatatcaagaaaaacaattggaatcctgatgatctaacagtttctatcagaggggctaggcaggcaaggatgaggccagctgagcctccttccacatctacaactcctattccagcacgtacctcagtggtggcacctccaggatctattccttcagtgaagcagttcactgagttggtagcttggcccgggactctgtcttctctttgcaaggaagatgaaggtcccacagcccaggtaccacagcatgtggaggatgattcatccgaggccaccattctagagccttttgtcagggggatggtggcagaggagacacaggaagttgcggccacacttgagagatctcttgaggcagcttctgagcccccagcataa

SEQ ID NO: 79628 - DNA, 321 bp, Glycine max
  Peptide Sequence Number=SeqID_171313
gcccagggggatgctccgcaggccgcagatgcgccgccacctcatcaggctggtccagccggattgtttgatacaaagcagtatttgcggcatttggttcgccagcaggcggccaaccaccgggcacatagcctgggctttacttcttttccgtgccctactccggaccagttcagggcagaggtcgcgtggcctggagattggcctgaggcccgggcaggagaggcaccagcagaggctcccgacgaggcagatgaggcctgcgaggacgaggagatgaccgatttacttgatttcttaggaggaagcggggccacatga

SEQ ID NO: 79629 - DNA, 234 bp, Glycine max
  Peptide Sequence Number=SeqID_171314
atggttattactggtactattagtattgctcaagttgatgttatggatgagtttatacaatttgaagatcaagatatgtcacaagtgggaaaagaagatgaagatgtggagatggagaaggctcaagctacttcaaatatagaatcatttgttgttggagatgtttcatattctaaagcaagcacaaaggaaccaagtgctaaaatatccaaaaccaaatacaaggctgaaatg

SEQ ID NO: 79630 - DNA, 330 bp, Glycine max
  Peptide Sequence Number=SeqID_171315
atgcgtcaagctaatgatgttaaagaagcgcttcctgggaagcaacccaatttcaatttgtgttatttttggtttttcatgcatttgatcattgggaacttgttgtataatctgaacattggagcatatcagcctccctttgaatgtccttttgctaagcgcctgcttctcgctaagcgcataatcgttcatgcgctaagccagaagtttcaagcgcttagcgcacaaccctggtacctgaggttgattatttccgctaagctggctgaggtcaagctaagccagaatcaattcgagttgaattcagctaagcttcagcctaatcgctaa

SEQ ID NO: 79631 - DNA, 1727 bp, Glycine max
  Peptide Sequence Number=SeqID_171316
atggaggctgaaaggcccccacttccacaacacaactctcacactaagcccctctctcgcctcaacgaatacgtagccaaaaccagagttggcaaatggttcaagctctcccaacgcaactccaccttcaccaccgagctccgcgccggcaccgccaccttcctcaccatggcctacatcctcgccgtcaacgcctccatcctctccgactccggcggcacctgctccgtctccgattgcgtccctctctgctcagacccatccatccctctctccgcctgctcgggcctatccctccgcgtgatccagcccgacgcctcctgcaaattcagcccggttaacccgggctacgcggcctgcctcgaaaacacgcgcaaggacttaatcgtagccactatagcatcgtctcttattggttgcttcatcatgggcacgttcgcgaacctccctttgggcctcgcaccgggcatgggttcaaacgcgtattttgcttacaccgtcgtgggcttccacggctctggcaacgtctcctaccaaagcgccctcgccgcagtcttcatcgaaggagcaatcttcctcctcgtctccgcaatcgggcttcgcgccaagctcgccaaactcgtccccaagcccgtcagaataagctcctcggccggaatcgggcttttcttagcattcatcgggcttcaaagcaaccaaggaatcgggctcatcgggtacagcgcatccaccttagtcaccctcggcgcctgtccaacctcctcacgtgcctcactcgcacccgtcttaacggcagctaacggcaccgttagtttactacccggcggaaccgtctcgggtgatattctctgtctgaaagacagaatggaaagcccgaccctctggctgggcctcgtgggctttattataatcgcgtactgcctcgcgaagaatattaaaggcgcgatgatatacggcatcgttttcgtcaccgttgtgtcgtggttccgtggcactaaagtgacggcgtttccgaacacggacgccggtaactccgcgcacgagtacttcaagaaggtggtggatgttcacactataaaaaccaccgcgggagcgttgagcttcaagaacattggaaaagggtatttttgggaagccgtggttacgttcttgtacgttgacattctcgacacgacaggaacgttgtactccatggcgcgtttcgcgggcttcaccgacgacaaggggggcttcgagggacagtacttcgcgttcatgtcggacgccacgtcgatcgtggtggggaatcacggcgttgacggcgcgggcttcaccgacgacaaggggggcttcgagggacagtacttcgcgttcatgtcggacgccacgtcgatcgtggtggggtccttgctcggcacctcgccggtgacggcgtttattgaatcctcgacggggatccgggaaggtgggagaacaggaatcacggcgttgacggtggcggcgtatttctttttagcgttttttttcacgccgttgctggcttcgattccggcgtgggcggtggggccgccgttgattctggtgggggttttgatgatgagatcggtggtggagattgattgggaggacatgagggaagcgataccggcgttcgtgacgctcattctgatgccgttgacgtattcgattgcgtatgggcttattggtgggattgggacatacattgtgttgaacctttgggattgggg

SEQ ID NO: 79632 - DNA, 1263 bp, Glycine max
  Peptide Sequence Number=SeqID_171317
atgtcaacttttggtgctgaccaattcgatgacttcagacccaaagaaaaagtgctaaaagtttcatacttcaactggtggtcgtttaacactgcatttggcactttagccgctacactgtttgttgtgtacattcaagagaggtttgggtggggattggggtatggaatatcagcgattggttttctagttgcctctgttaccttctttatgggtgttccaatatataggcataaatccagaaaggggaagagccatgcaaaggagtttttcagtgtccctgttgttgctttcagaaataggaagcttcaacttcctagtagcccttctgaactgcatgagtgtgagatgcaacattacattgataggggaagacgacaaatttatcacactcctcgtttcaggttcttagacaaggctgctataaaacaagagaaaacagatgcctcaaatcccccatgcacagtgactcaagtagagagaaacaagcttgttctagggatgcttggaatatggctactaattataatcccaagcaacttctgggcagtggaagtaaccgcgtttgtcaagcaaggcacaacaatggaaaggaacctgggccccaacttccaaataccagcagcctccctgtggagttttgtggtggtcaccattctcatttgtgtccccatttacgaatgttacttcgtaccgttcatgcgtcgaagaaccggccttcacagaggaatcaaaatgcttcacaggattgccataggagttgccatccaaatcatggcagctgcagtcatgtttgctgtggaaattcgaagaatgaaagtcataagggagaaacacataactggtgcaaaagaagtagttccaatgagcatattctggttgttgcctcaacatgttctacttggtcttgcaaacacattccttatggctggattgctagaattcttctatgatcaatcaccagaagaaatgaaagtacttggcacagccttttacacaagcaccatagctgttgggaaatactccaacagtttactagtgtttatgatagataaattttcaaggaagatgagtggtaagagctggattggtaacaatcttaatgattgtcaccttgattactattatgctcttctttttgtgatatctgcgtttaattttgcggtctttctgtgggtacaaaggggatacatttacaagaaggaaaatacaacagaggtgaatgagtttgagattgtgagagcagaaaagacagaatcacag

SEQ ID NO: 79633 - DNA, 778 bp, Glycine max
  Peptide Sequence Number=SeqID_171318
aggtgtagttgttgaggactactataatggggtgagtgatagagtctgcactgtcatgtttaagggtcagcttgcggtttccacacggcctgctaagtttcttcatgcttactactactgtagggagagatttgatgagatagggaagaagatcaagagggaaagagatgtttcatctcaaatgggaagaagacacatgttaggccctccaggaaccctaaatactatcaccccttgtgcagcatgtaagttgttgagaagaagatgtgcccaagaatgtcccttttctccatatttctctccccatgagcctcaaaagtttgcttctgtccacaaagtctttggtgccagcaacgtctcaaagatgctcatggaagtaccagagtgtcaaagagctgatgctgcaaatagtctagtttatgaggctaatgtgaggctaagagatcctgtgtatggatgcatgggtgcaatttctgctttgcaacagcaagtacaatctttacaagctgaacttaatgcagtgagaggtgaaatacttaaatacaaactcagggaagctaacatgataccctcctctcatcatgttggaatgctcccttcatctggggctgtttcaattgctgctccaccgccgccacctcctccaccaccacctcctcctcctcctccttctcttcctcttcctctaacttccccctcctcttccatatacatccaacatagggatcccaccacttataccacaatttcaagtgataatatctcctattttggttga

SEQ ID NO: 79634 - DNA, 1086 bp, Glycine max
  Peptide Sequence Number=SeqID_171319
atggaaaatatgtgcattactacatttggcataataagagccatgaaggttaaacctgtggtgtgctgttgtagttcagctttattgaggggacagctgtattgtgtcaatgtaaacagctgtctccctcccttgtgtaccctatatatatgtttaatagagagcaatgaaaagtgtggtgaaagtgtgacatttcacacaaaattcaaacttcaagttagtatcaaagcgggtaaccgttctgattgccatccgccgccgccatctctggccaccatattctccggcgaagccaaggttgggtgcgcttcgaggagtgcgactcacccctgcaagtcacgtgtggagttgtggtttcttggccaaggatatcatgaccacttggaaaaaggagttggtgctgtcccaaatgacaagaaatctgagtgggaaaaacttgattttaggaagctggacaagttttacatagttcttattttgagaagcctacattcagattttgatcatgtgcgtgatcaagttcttgttggtgaccaagttccgtcaatggactctctaattactagacttcttcgtgtgtcccatgtgttgaaagatgaaaacttagttgaagtcgtgaaaacatcagccatggttgcacctcgtggaaaaggaggaggtcgtaacaatagaggaggccgcggtggaaggagtggacgtcctcaatgcacctattgcaagaggatgggttatactcaagaaaattgttactccttacatggctttcctgacaaacaagtccttccagtcccatctcctggtccacttggtaattccaaccaaagtgttagtggaatcccatctcctccaccaagttcaacaaaagttgctcctccacctcttattacatatcaacgtaggacacgacaagttggttctacagtgcctgagtcttctcctcgtgattcccatcctcctccaatagatcctcaaaccatggatccttcctcttccacttcttctcatcactctgattcagattggcctattgcctttaggaaaggtactcgatctactcgtaatcctcatcctatttataatttctga

SEQ ID NO: 79635 - DNA, 540 bp, Glycine max
  Peptide Sequence Number=SeqID_171320
atgactgaggaaaaacaaaccttaaggcgaaaggttcttgccaagtggctgaaggaaaacattcttagattaggtccaacattcatcaaaattggccagcagttctccactagggtggacattcttcctcaagaatatgttgaccagttgtccgaacttcaggatcaagttcctccatttccctcagagacctctgtagctattgttgaagaagagcttggagctcctttaggtgatatctttgatcagtttgactatgaaccaatagctgctgcaagtcttggtcaggttcatcgtgcgagattaaatggacaggaggttgttattaaagtacaaaggcctggtctcaaggatctttttgatattgatcttaaaaacctgagggttattgctgaatatcttcaaaaaatcgatccaaaatcagatggcgcaaagagggattgggttgctatttatgatgaatgtgcctctgtcttatatcaggtgatgatttctggaagttactacattgttatgttacttgagattactgaacagtaa

SEQ ID NO: 79636 - DNA, 1803 bp, Glycine max
  Peptide Sequence Number=SeqID_171321
atggctctgctggcattgaacatctcagtgtgttgtttccaacagcagcgttcccccactctcttcaaacccaccattaccaaacaaaccctctccctccccaccgcttccgctttctcttcctcttccttaactcaactcagcgtgggccaatatttacccgccaactacggcgattgggttcccaaccccgacccggagcttcgcagaagatgcggcattctgctccatccgacgtcgtttcgcggcccctacggaattggcgatcttggcgacgaggccttccgtttcatcgactggctccaccactcgggttgctccgtttggcaggttcttcccctcgtgccacctggcagaaaggccaacgaagaaggatccccttactctggccaggatgcgaattgtggcaacacgctcttgatctctcttcaaggcctcgtcgaggatgggttgttggaaaaacacgagcttcctcaaccaattgatgcagagcgcgtgaatttttcacttgttgctgatgttaaggatcctttgataactaaggctgcagagaggctcatttcaagtgaaggggaactcaaaacacagcttgagaattttcgtcgggaccctgacatatcaagtgagacactcgtttatggagacagcttagggattttaggattacgtgttatagaagttggaaggaaagaaatactagcatatgtggaagtaataagctggcttgaagatgcagcctattttgctgctattgacgacagtttaaacacaatcagctggtacaattggcctgaacctttaagaaatcgccatcttgtagctctagaagatatttaccaacaaaagcgagattttataaatgtatttattgcccaacagttcttgtttcaaaggcagtggcagaaagttcacagctatgcacagagtaagggaatcagcataatgggagacatgccaatatatgttggttatcatagcgcagatgtttgggcaaataagaaacagtttttactgaacaggaagggctttcctcttttagttagtggtgttcctcctgacgcattcagtgaaaccggccagctctggggcagccccctgtatgattggaaagccatggagaaagatggatactcgtggtgggtacgtcgcatacgacgtgcacaaaatttatttgatgaatttaggattgaccactttagaggatttgcaggatattgggctgttccctctgaagcaaaagtagctatgcttggaaagtggaaggtaggacctggaatatccttatttgataccattttcagagctgttggaaggattaatattatagcagaagacttgggagttatcactgaggatgtagtccaactaagaagatccattggagcacctggaatggctgttctccaatttgggtttggaggtgatgctaataaccctcatttgcctcataatcatgagtgcaatcaagttgtctatacagggactcatgacaatgacacaattggaggttggtgggaagttttgaaccaagaagagaaatccaatgtactacgttatctttcattaaatgagggagatgacattccatgggcgctaatccagagagtattggcttctgttgctcaaacagcaataatacctatgcaagatgttcttggattgggtaattctgccaggatgaatattcccgcaactcagtttggaaactggggttggagaattgcaagttcggtgagctttgatggcttggagagagaggcagacagactcagagaaatgctttcaatgtatggccgactttga

SEQ ID NO: 79637 - DNA, 645 bp, Glycine max
  Peptide Sequence Number=SeqID_171322
atggctacgtcttctcctctcccgttacccgaactccacttcctctctccgcaaaccacccccaaacgccgtatctccttctccaaactcccctcctcaccttactccgtttcccgccacgtcacctccaacgtctctctccgcacctcgcgaatccgcgcaactagagaagaatccgcgttggccgagcgactcaacgacgtcgaatggaccggaaacggcgccgccgccgctgctgctgacggaaatggcgcctccgttggtggatacgttaacggcgctactaacggaagcttggtgaagtacggctacgaaaacggaaacggcgtttctgcggaggtgttggaagttgaagcctctaataagctgagcgaggatgggaggaagaagaggttggaggagattgggaaagaagacgcctggtttaaacaaagtgggaacgaacaagttgaggtggcggttgcgcctgggggtcgttggaacaggttcaagacttactccacaatacaaagaacctttgagatttggggattttttgccacgtttatctttaaggcttggctgaacaaccagaagttctcttacaaaggttcgtcctccattgaagattttagtaagcttgaagaagcattggttcttctctaa

SEQ ID NO: 79638 - DNA, 876 bp, Glycine max
  Peptide Sequence Number=SeqID_171323
atggctttgagatctggtttctcttccttcacctacgacgtgttcctcagcttcagaggctcagacacacgccatggtttcaccggcaatctctacaaagctcttgccgacaggggaatctacactttcatcgacgatgaggagcttcagagcggaaaggaaataacaccaacgcttctgaaggcaattcaagagtccaggattgccatcaacgcgctctctataaactacgcttcttcctctttttgtttagatgaacttgcaaccatccttggctgcgccgagaggaaaacactcttggttttgccggttttttctcacgtgcgacaccgggaagatagttatggagaagcgttggttaagcacgaagaaaggttcgagcataacacggagaagttgcagaaatggaaaatgactttgtatcaagtagctctcttgtctggctatcatttcaaatatgggtacccaccttaccgatcttccttacactatggatatgagtatgagttcattgggaggattgttgagcgggtctgcatcaagattaatcttactcatttacatgttgcgggttatttggttggactagagtcacaagtgccaagagccatgaagcttttggatgttggatctgatgatgttgagaaatctctcataaaagttaagactgttacattgcatgacttgactgaggacatgggtaaaaaatttgtcactcaaggatcagcaagagagctgggaagcaaaggaagctataatccaagttttggaagacaacagagtgagactattgaatcagcaaccgctggtacagtaagcggtgttcaaatagccgttgttgggatcttctccgctgctagctcttcttcttactag

SEQ ID NO: 79639 - DNA, 795 bp, Glycine max
  Peptide Sequence Number=SeqID_171324
atgaatcccactgaagagaaaaacgaggaagagaaaagtgaggaagaggtggaggaaatgtgggagggcattttggagaaggatccgaaaaacgttgaggctctgaaggtggttttgtatgggaagattaggagagggaaatcgaaggaggctgtgaaggttgtggaggatttgattgctgcggagccgaatgaggtggagtggaggctcttgcttgcactttgttatgagactatggggcagttgagtaaggctaaaagattgttcagggaaatcttgaagaagaggcctcttctagtcagagctcttcatgatttgatcagattagttgaattcttcattccaacagatatgttgcataccttagatttagctttggagggtttggctatggcaatgcacaaaatccatgaaggtcctgctgtatttgaaatgctaaataatgctcaagagttagcttctcgcgaaaacagagttaccgaggagagaaatataagaatcttaattgcgcaaatgcatgttgtccagggtaatttggaggagggcttgaaaagatttcaagaattgattgatcaaaatcgtcgagattttaggccttatatttgccagggaataatatacagtctcctgggtaaaaatgaggaagcggcacagcagtttgaaacatatcaaactcttgtgcctgaagaatttcctcagagacgattcctcgatgatgttgccatagcagcaaaaagatcatccctggaacagtttaagaaggaattcagagatcaattttcttatcggaaatag

SEQ ID NO: 79640 - DNA, 612 bp, Glycine max
  Peptide Sequence Number=SeqID_171325
cgcttaacgctcttgttcgggctcgcctgtttcttgactccggacaaatcgctcaaaaaggcgaaacgctttcaaaagcgattgctattatagataacggattaaaaaccggtctaaacatggaagtccaaagtgaattaccaggcaacctccctgctttatatgactatatggttccaccgcttagccactggcaggcgttacatgctcagagcattgctatgctaaatcttgcacattctggtcaatgggatgcgcttatcgagcaggaaatgcattacgtacaactggtggaaaggatttctcaaacgcccatcatgtcatgccctccggctcaggttgagcaagcgcgtgcgctgctggaaatgatcctcgaaaatgagaatgcgctaaaggcgttgctgaaagtccgcatggacgagctgcgcagcctgattgatcaaaccggtaaacagcaatccatcacgtctacctatggaaagctgtcagggaatattctttatccagaaagcggtgaattgtggcgagaagtcacggcattagcccccaaccttaacgaaatcggcatcaatatgatctggctgccccccgcttataaaggcgcgtccgggg

SEQ ID NO: 79641 - DNA, 615 bp, Glycine max
  Peptide Sequence Number=SeqID_171326
gcggaatttgaaatcccaaaggcttctgacagtaagacgaaaaagaagttacttcagactatcgatgagagattgatgcagtttaaatcagacctcacgagaaaatgggcccgtgcagccaatcaagacggtgtggacgacactgatgtgtggaaaaaggcacaggccatccagacacagaatactgcccctcacgttttgtctcgtgggggttatgaatatttggagcagaagctcttgggtgagaagaccaagaagaagctggaggaagctgaacagtcaggaagtgttgatggcgtcattgaccctctatcccccgtcagacgccaagtgaggtggaagatggcccgcaccaagaaaataggggagataatgattgaggccgcaaaggagatcgctgagaagatcgattcctttgaggagcaggcacgacacagggatccttcgtcccccatggacgtcaggatgttctcactgctactattagacgtccagagcaccctggacatgtccgtgctgctggagccggtgtcaccatcaagcagtacttcagatcagctccacggacgtcctgcagctcttcctcgctgcctcctgaagaattgtagcagctga

SEQ ID NO: 79642 - DNA, 501 bp, Glycine max
  Peptide Sequence Number=SeqID_171327
atgaaacatcagacagaaggtgcagtttttcatactccttggctttatggtggaactaactacaggagaatggttgaacccttatacatttctgaatactacatagaagggaaaaaagactatgtggctagcggaagatctagacattatgaagtgttggaagagtggttgaaagaagggaagaaagatacaagcgattcgaatgcaaacagtacaagcagaaagaacgtggaattaattttaactgttgattcttgcttttgggcatatgttgaagaggctctccttttgtgcaaacaattgcagaatgtacaatctagtgagaaagataagaaagaggcaactgagaagttgctcgaattcgtgaagtatgtttatgggtcgctcaaaaaatatgaagtgtcaccagagattttcctgatggaaagcagctacatgacttggtgggataagtataagggaatttcagggatcttggtattaccctcccttgtattgtga

SEQ ID NO: 79643 - DNA, 279 bp, Glycine max
  Peptide Sequence Number=SeqID_171328
atgaaaggagccctccatcacctgccgatcggcgcactcttattagccgcaaccacctcagcccaggcgctgaaagcgccagaagtggatttacgcgatccaaagctgtgggaagagaaaaaggtcaatccgctaaacgatatctccgccccctgcgaagtggcaagcggcccggattgcccagtctgggaagatcaaaagtccgatattcagcgtgaaagagaacggcgagagcaacgtcgttggcaaaccggctatgagcactggcgcaagtattaa

SEQ ID NO: 79644 - DNA, 375 bp, Glycine max
  Peptide Sequence Number=SeqID_171329
atgcagcggttgcagcaaacggtgttgaggagctgctgtggcgttgggcggaggcataccactacatgtcggtccctcaatggcaaacatagggtatggctcaaagtcaacctaagcatgatctggaggttcttcacgggcgccccctataggctggggttgctggcccttaaaggtaacgggaacggcgtggctagcgttctcgttgggcatgtgcatggtgtgcagtgtataattgagggggtaagccataggggtaagcattcctattatgccccatgtgtgaactgccggtgctggccaagacctctcctccctgtcccaccatgtccgggatgggttggttcgcttggtttatggcagatggatgggtag

SEQ ID NO: 79645 - DNA, 174 bp, Glycine max
  Peptide Sequence Number=SeqID_171330
atggagtggcgtctccattcatctttctccttctctattccactgccattcatcttcaagaagcaaaagaactccattgatgaagaagatccaaggcctataagctccatatggagctacatgatcaaggctttggtgatgacaaaaagctcaaaggtcaagaacacttcatga

SEQ ID NO: 79646 - DNA, 453 bp, Glycine max
  Peptide Sequence Number=SeqID_171331
atgtgtgccaaagctagagtgatgagtgaaatagagaaggtacatgaacagatgaaggccgacatggaggccatgaaagagcaaatgaccacaatgatggaagccatgatgagtatgagaaaaatgatggaggtcaacacggataccgtcgttgccgcaagtatcgccactgaggtggacctgactcacccatatggcctcaatcaagtaaatcgtccagtctcggatacggtaggtcagggaggcgaagcattgggaagtataggcggcccccattttgtgcaggtccagagcaagcattccttcccaccatatggcttgcctcccaactatacaccacccaatgttgcacacgctcccaatgagaatgtcgataacaaccccaatctggtcatgcacaggtccctcaacccatgggggagacacatgaagtaccttgagaccacactctag

SEQ ID NO: 79647 - DNA, 231 bp, Glycine max
  Peptide Sequence Number=SeqID_171332
atgacccttcacttagcgcaaatgcacaactcatccttcttccagattcctccttgcgctcagtcgaggagtgttgcgcttagcggatggctcgctaagccagcatattggcttagcgagaggttttgcttgtcctcaagcaaatatagaacagctcactggtccccaagtgacaataacatgcagtcactatgtacaaaggtgtatgcacaaaagttattgtatggatga

SEQ ID NO: 79648 - DNA, 1872 bp, Glycine max
  Peptide Sequence Number=SeqID_171333
cgcgctcagatcgtgcgaccagtattcggcaacgatcagcaggtcgcgctgcgcgctgtcgcgcacgtgatccgcccactctttgaagaaccaggcgggaatgtgtttggcggcgtccaggcggaagccgtcgcacggcaggctttccaacagccagcgcgcccagtatttgagctcctccgtcacggcggtattgcggaactccacgtcggcgcccatcagatagtcgtagttgcccttttcgtcgtcgacctgatcgttccagccgtcgtcgccatagtcgttggcgattttgaacacccctttgtcgtccggctgctcaacgtagtcgacgccgctgaagcatttgtaatcccagataaactcggaatgcacgccctggcggccgggaaaggtgaagcgggtgtaggccagcgcgtcgaagccctggtcgtcgatgtcgttgcggttgttggcgtccaccttgaacacgtgtacctgttctttctcgtccgcgccgagcttgtggttgaacaccacgtcgtagagcacccccacgccgtgttcgcgcagcgtattggcggcgtgttcgagcgccgccttgtcgccgtatttggtggccacgctgcctttctggtcaaactcgccgagatcgaacagatcgtaagtatcgtagccgacggagtagccgccggaagcgcccttgcaggcgggcggcagccacagatcggtgatgcccagttcggcgaggtgcggcgcgcgctcggcggcctcctgccacagtttgccgccgtcggggtagtaccagtggaagaattgcagcagggtggtttttttcgtcatgagccagcgtcccggttagccagaaggagaggagcagttgccgttaaagcatgggctacttttggcaaaagggacaaaatggcgcgttctgacctgtcgccgatagcccgccgcggtgttggcgatggcgccaacatcaaatcctttgtcgctgatggtatcggcgatttgcgaaatcgcggcgctgatcaccatgcccagcaggccaccggagttgttgttgccttcgttactggatgcggtggcggtaccggtccacagctgtttgccgttgcgcagatcgaccaggcgagcggctacggtaacgcgggtttcgctgctgatcaccatgtagctggtgccgtattgcgtgacatccaggaaggtttcctccactacagcgaccggcaacacatagtaaccggcctcggccagcggcaaggtggcgctggcgagcacgctgtggctggctttgacgtccggcgactggttaaccggcggcaagaccaggatcgacttcggcttgctctcatggaacgccgcatagtcataaggcgtctgcttggcacagccgctaagcaacagggtggcggcaacggcgaggaaagaaattcattaaacggcgccgactccgggaacagcgttttttccgtgttgaattcattcatggcttgtccgtcgttgccgatttttgctgtacagcagccccagctgcgcatgcagacctggcggtacggctttatccttggcgcgggatttctcgacgatctctttcagcgcggcgatctgctgctcagggctttgccccctcctgctggtagtattgatagagagaagtctggtagccatcccaattgtaaagcgttttcggcgcggcgcagccggccagcaggggcgccatgcgccgttttcgataccggtgaccaggttattgacggcttcacgcacggccagatccagcaccttgccgttgagggtggagtcgtagctggcggtgcccccgaaaccgatgatttcgcgattggacagttcgtattcaccggcaccctgagcggaatagacgacttctga

SEQ ID NO: 79649 - DNA, 1626 bp, Glycine max
  Peptide Sequence Number=SeqID_171334
atgtcgtgcaatatttggctcggccgtaataacgctttcaccacttacgtcggtttggtggttgaaatcgccattcaggaagggcggctgcgggtgctccgcgcggtatgtgcgattgactgcggcaaggtgataaacccaaatttggtgcgcgccaacgtagagggtggcatcggctttgcgctgaccacctgtctgcacagcgaactgcactttgaacggggcggcgtggtggaagggaatttcgatcgttatccgctgctggcgatcgccgaaatgcccaaagtggaagtggtggtgctcgacagcgcgcgtgcgccgcagggatgcggagaagtgtcgactgcggtggtcgctccggcgatagccagcgcgctgcataaggccaccggcaaaacctatcgtacgatgccgttcccacgcgagttctcctcgcgccagcagctgcgcttcgcttttctccgccagcccgtcgatggccagcttgatgatgtcggagcgggtaatgcgcacgatgccgctgcgcgccgcctgcacgatcacttcatcgatggcttcaatgtggctgtccgtcaggctgacggaaatcgccttataggtgcgtttgcggccggccggtttggcttccggcgcgggtgccgcgaccggcagcgtgtgcgaggtggcgctgttgatgaattcgtcttccgacatgcggcattcaatttcgctctgcgccttttcgttgttcgcctcatgcacggtgatggcttcgccccaggcgtcgcggtaaatcttgcggtcgcacaggcggttactcaccagcgtaaactccgggtattcgctcagcacctgcgccgcttcgttggcttcgttgataaagatattggtcgggcacatgttcagcacgatgtagcctttgaccttctcgttgtattcctgcgcggtggagaacatctccgacagatagccgatggtgtcgagatccatctgcgaagggcgcagcggcgagaggaacagatcggcggccagcagcccggagcgcagttcggcgctgtcgcggccggcggtgtcgacgattacgtagtcgtaatggcgatccagctccagcagcgtttccttgattttgcccgacgcggccaccaccggaatgtgcggcagcccctcgacgttctgacggtcgttgtaccaggtcatgatcgatttctggtcgtcggcatcgacgatgatcgccgtcttgccttgcttaagaatcagatacccggcgatattcaccgctttcgtcgatttgccgacgccgcctttttgcgagccaatcagaacaatcatgctgccatctctcaagttaacaagaacaactcgcgaacaatatgcaccaactgcggcggcttgccaagccagtatgtcctgtcggtggcgttacttcttcatcatcgccttcaggttggcgaacgggttatgggtggcgacgccgacatctttctgcgcgtcttcaccggccaccaccgtcgaaccgtattgatcggcctcggtgtatttcgagtgctcgtggtcgtggcagtacaggcacagcatttcccaattgctgccgtcttcggggttgttgctgtgatcgtgatcgatgtggtgcaccgtcagttcgcgcag

SEQ ID NO: 79650 - DNA, 201 bp, Glycine max
  Peptide Sequence Number=SeqID_171335
atggctgaagatcaaccacagagggtaactcttgaagattattctagctcgaccatgccgcaattcttcacaagcattacgcggccagaagttcaggctcacaacatcacatatcctcattccttgattcagctgattcaaggaaatctgtttcatggattgacaaatgaagacccttacgcatacttggctacttattga

SEQ ID NO: 79651 - DNA, 375 bp, Glycine max
  Peptide Sequence Number=SeqID_171336
atggagataaccatgcaatttggggaagccttgcaacaaatgccgctctacaccaaattcatgaagcacatcctcaccaagaaggggaaaccaatcaatcacaagatcgtatggggtagtagaagatgtccttgtcaaagtccaccatttaatttcccggtggagtttgtcatcatggacataaaagaagatgcagagattcctcttatcttagacagacccttcatgctgactgccaattgtgtggtaaatatggggaatgacaatctggaaatgagcattgacgaccaaaaggggaagataggaggtgcttcaaggtggaggagatcgataaagaagacgttggtgctcttcaaaccacacagacttcactag

SEQ ID NO: 79652 - DNA, 411 bp, Glycine max
  Peptide Sequence Number=SeqID_171337
ttctacggagtgcccgtcgcccccaacaaggtcatcaggccccctactaaccgagctttcatcaagaagtactgtgcccccaggcaggcacagggcgagacaccacagctgcctggggatggccggcagcgggcaacagacgcactgccgccacctccagagcctctcagctcatctatagaggctggagcattgcctaggacccgtggccgaccagcaggcgaccaagtccaaagccaaagaagctccccgcgaaatggtccaggaaaggcaccattgaagaggattccagtgtggcctcacaagccgacacaggctttgacaaacaccgattctagagtgtggaacatcaatagcatttcgaggccatcaaaggatgatcattcctcaaacacagacaggggcagttga

SEQ ID NO: 79653 - DNA, 336 bp, Glycine max
  Peptide Sequence Number=SeqID_171338
atggaatatacgaatttggggatccacgatcatgtggctccgcatgcccccaaactcttgggtcatggtaacaaatggtggggtggtcgacaaaagcagggcttttgctcctacattttggatgttagcatttcgtttctaaacgaccatttagaggaaacactgggtccaacaaaaataggagaaaatcactcaaagtgtatcaatctcacacaggtcaaggtttatgataagttgggattttggctcaaggcttgtagaacgactggtcatgatatatgtcagggtttggccagcggttcggggataaaggggatgatacacatgcaacaatga

SEQ ID NO: 79654 - DNA, 276 bp, Glycine max
  Peptide Sequence Number=SeqID_171339
atggtttcttttgatgagtctaatgctattcttccaagaaaggatattctagatgacattaaagatttcttagaagaaatggacattcatggaaaagattctaaaggaaaaggagaaggaagcaatgaggattctcaagttgatgaaaccaaaacaaatgatgatcttccaagagaatggaaagcttctagagataatccccttgacaacatcattggtgatatctcaaaaggggtaatgtcacaacctacccttcggcgggagggcgacgtgtga

SEQ ID NO: 79655 - DNA, 90 bp, Glycine max
  Peptide Sequence Number=SeqID_171340
gtggttgccgcccagctcgcccaggcgagccaggttgcttcctccagaagcaacagccttctggaggaatattctggaggaatattctag

SEQ ID NO: 79656 - DNA, 222 bp, Glycine max
  Peptide Sequence Number=SeqID_171341
atggaggagccccggggcattccattgagcattgatttctcaagtttatgccattattgtaaaccacagcttacaatgttaaatgaaatggataaagttgatatctttgtccctcatcctctcacaaacgcatgtttgcttattcaactttcactggaatatgggtgcaagccattggtctgtttgctcaagcgacctgcgctcctgagtgttgacttctaa

SEQ ID NO: 79657 - DNA, 675 bp, Glycine max
  Peptide Sequence Number=SeqID_171342
atgcagtcccagaggcaatctcaggggacttgcactgcctcccgagcctttggttggtccctcaggtcctcgagaaatgatcttgagacgggtgactcagataggtgcggcttgtacatcgaagcagatcctgcccgcctggttgccctagggatagtttatgagggatccactgttgttcataacactcctttgttgtctggccaagtaaaggtgggtgtggagcaggttacagatgcagatgctccagttcttgtacccactaatgaggtttccttattggggcaaacaattcacaccttccttacttggccgacacatctggtcaagtctttatcacatcaggcaactgtgtcttcagcaaaaccacctcaaaagccccatccggaggttgatgatccactttatctgatgacattgaccatcccagagcttttcttaaggccttaccaggttacatgggatgccaccatgttcagggtctttaatccagacttcccgctctacataaagcacgaagacctgtccgaaattgcgcacgatggtcaatgtctcagcatatcagtgttacagttgtggattatgcatctaactgaaacaagtatgcgagcggggaattctaatatctatggattcctcgagccacagtccattcagaggtctgggcaatcgtag

SEQ ID NO: 79658 - DNA, 273 bp, Glycine max
  Peptide Sequence Number=SeqID_171343
atgattggtacctcaaagccttacactagggcaatgaggggcaccatgcatgagcctcaagcgaacctaggggcagatccaaagttctcacccgtcgatggtggacccttgggtactagtaacctcaccttgcagaaggactacacatcctccccttcagaggactgcacatgtcctcaccttcataggactacacgtcctcaccttcagagggctatcacgcccttcaccttcagagggctacacgccctcaccttcagagggctactatag

SEQ ID NO: 79659 - DNA, 192 bp, Glycine max
  Peptide Sequence Number=SeqID_171344
atgggtgccaagcacctcacgaggaccaaagaatggtcgcacgtcatcgagcaaaggtccccggacgaaattaggggggttgtatgggatggccctaggcctatgttgcattctggagtaatggggcatgccacattgcccccattctcttgctattcatgccaaaacatgcgcccaccaagtgctcggtga

SEQ ID NO: 79660 - DNA, 420 bp, Glycine max
  Peptide Sequence Number=SeqID_171345
gttctatcaagtcaagatcaagagcctaggagtcaccagtctaaaagagttaggacagttgatgggtcaactccagcgaaaagcctttcacaaggcctattgtaagatatgggacctaactatggcagaggtctccacggaggccatttcctccctcacccagtattatgaccagcctttgaggaaaccgtatcttttctcagggttctatccctccttggctagaatttccaaaatagtcaaaatctcggcacaggaactggatcaggggaagcaagtcgaaaatgaggtggttggagtaccaaggaaatgtttggaagcaaaggcgagaaccttggcaagtcaagacgaatgggctccgttcatggatgtcctggcactcttgatcttcggagtgtcctctttccaaatatgggatgg

SEQ ID NO: 79661 - DNA, 294 bp, Glycine max
  Peptide Sequence Number=SeqID_171346
atggattgcaaatccataatcgcgttacggattgacaatctgtataggctatacgtgttgaagaaaaatgacaggtgcaagaaaaaaatcccacacttcaaaagtctgaaaatctctcaaaatgaacaacatagtgagaatatgacacgtaggaagaagagcaacaagaacgccatggctaatgctccagggaatgacgactttctaagagacacgatgattggtggattcatgacattcgatttcttccttcatgtatgtgttcttccttataatataattcctttcatgtag

SEQ ID NO: 79662 - DNA, 270 bp, Glycine max
  Peptide Sequence Number=SeqID_171347
atgtcagaattcacaagtgattctcctcaaatttcagccagcccgcttgaactagactttgtaccttatacttcagggccctacaatgctcaatggagtgccccagaactcctccatgataagaacatgttgtgttcgagtcgtatgatcgaaaaaacaaagagtggtacctggagatatgtcgcgggggtcaggagaccttggggacgtcaggtggggtgctattgcccaaaaccaagcttgaccaatcccgacccaacccgggcatag

SEQ ID NO: 79663 - DNA, 288 bp, Glycine max
  Peptide Sequence Number=SeqID_171348
atgatgataacaaaagatgatgacaaaggtgatgacaaaaagctcaaagatcaatcaaagaacaactcaagtgaatcaaagatcaatcaaagatcaatcaagaacaattcaagagttcaagataagaatcaagaagaattcaagactcaagaagaaagtttagagtcaagaatcaagattcaaggttcaagatctcaagaatcaagatcaagattcaagactcaagattcaagaatcaagagaaggcttaatcaagataagtatgaaaaggtttttctcaaaaattga

SEQ ID NO: 79664 - DNA, 591 bp, Glycine max
  Peptide Sequence Number=SeqID_171349
atggaggctagcctgttcattcctagaaaaggctttgttctaaatgctgagggccaaccatggaagctcctcaggaaggatcttactaccttggcccagacatggagtatcttctgttactccaacctagctcctacctcccacacctcagacttgaatatggacagagctaggttggtttatggcttagtcacagggatggacatgaacattggcgacttgatctctgggcagataaccattatggctcagtccaactcttctcgcttaggcttcccagctttaatcacaaccttgtgtaggtcgaggggagttggatttgatgctcttacttcttacaagaagagcctgaggctgttcattaacttggcctatattaaaaagaaatgttggaatgtgaataaccaaacacttaattttccaggggcaaggaaaactaggtccaaagcagttggtgttccctcttcttttgcaccaacagctgacatcccttcaccttctactccaactccgcctccaccatcaacagccccatctgcccaaagctcccagacttcacatgctaagttgcagagtttgtttgagggatag

SEQ ID NO: 79665 - DNA, 107 bp, Glycine max
  Peptide Sequence Number=SeqID_171350
gccatgttgcgacaactagcattgaaaacatagctgatgcaaagggtggaacgatatctgatgaagaaactcagtttagtgaccatgatgataaggatcaaaagtag

SEQ ID NO: 79666 - DNA, 171 bp, Glycine max
  Peptide Sequence Number=SeqID_171351
atgaagagtaacgatacaacatgtaagatcatagggagaccagtcaggatcacggtgttttgcgagaatgctccaaccatatgggatcaacataggcttaaaggagcactcaaatcgggtgacccccaaggcctacactccaaagagtccgtcagggcctctccctgctaa

SEQ ID NO: 79667 - DNA, 243 bp, Glycine max
  Peptide Sequence Number=SeqID_171352
atggacccgaacgtcattgagattccacctccgactgcaaacaataacaacacttgtaattccattaaacaaaaagagactcatcttctccttgaagtggcgtctcctctccctcttccttctccattccgctgccagtcatcttccaagaagcaaaggaatccattgatgaagaagatcctaggcctacaagctccaatggagcttgcatcatgtggtatcagagcatcttcatctaggtga

SEQ ID NO: 79668 - DNA, 651 bp, Glycine max
  Peptide Sequence Number=SeqID_171353
atggcatttgggaccatggctgctcgcctaagcgagttgatgcttcatcctgaagtaactggctcgcccaggcaagctggtcctgatcaagaggctcgatctcctcaaaggaagaaatctatcacatttgccaagtctccttcgtcatcatctcctggggcctcggccgcgggtaagggttggggtcctggcactgctgctgcaatgtatactgatagaagctatcgttcaactgcacctggcccctatggtttgctgcttgctggtcagccaaatgctacatgtagagctccatcctctgcatgtgagttgagatggactctagagattgtagctactgtggaggtggaggtggtgcgtctgcggccgactactactggtcctgccccggtgtctcggaggtgcgatacctacaaactggtagatggcatccgagataagctaggctacatgaacactaatctgggtcaggatagcgtagaccaattgacatataggcaacgggagatcaaaattatgatcactgggaaggatcttgttgaggagaagcgtcatctagatttgggtcaaggtggtcatggtagtgcgcatgatccgcacttgcctccttgtcacgttccgtgcaaaatcctgtctcagggagcacagtag

SEQ ID NO: 79669 - DNA, 534 bp, Glycine max
  Peptide Sequence Number=SeqID_171354
atgacagctagtggtggtcactggtggtcactggtggtcgtgggtggtgaaggaggaggtatggggaagaagaggggagaaaaacgcaaaattttgttcgcctgggctagatggcctaactcagactcgcttaggcgagttctgagcgaattctactccaacatatttcactgcttctgtgcaaagcaagaaacactcttatatgcgctctatcataagaggaatattccaaggttcacagctttagaagtgccaaacaaatataagacaccttatccattacctacgagggatcctctaagtttatctagaatgtggagaccacattttacaacattaagagtcatcaagaattttgattcaatgactcttgaagagctcgttaggattcttaaggtccatgagcaagaacttgatcaagatgaaggaacaaagaaagggatgtacctagcctttatgattcaacaaacaaaatgcaactatgcatccaaagagtcatcgtccaaggctcttgctattaatgatgcttcataa

SEQ ID NO: 79670 - DNA, 612 bp, Glycine max
  Peptide Sequence Number=SeqID_171355
atggtgcttgaacttgtcagagagttttggaggactgccaaagtttacaggaatgaagacattggaggatactttggtggaaaagttcctggaatacaagtgaagctaacagctgagatgattgttcaagccattggctacgaacgtcacagaaccaagttcatgaataattgggaaaatgaacttaaaaaccacattgggtactccatgatgttcttgtatgagacatttgtagatgtgcaagacaaaatctacctagatgagaagtttggacttaagactggatgggacgatcaactggacacaatttgtgagaaggttgcacctgttcaacagcgtccacctcctactctcgttgctcccaaagcaacaattgtcataacaaatttcaccaagaggcctatagagaagaagaagaaagaagaagaaaaaatgaggccgaagcgttaccgaatcgcaaccgtgatcgatttctacatcgttcttcgttcggtgttctttgttcgtcatccggttagtatttgttttaagaatttggatacgatctatgcacccttaggggtcctctttgttgctttgcacatcttcatctcattcttctaccatcagtaa

SEQ ID NO: 79671 - DNA, 216 bp, Glycine max
  Peptide Sequence Number=SeqID_171356
atggttcttcatattcgagcttctcctgctattgtttggcttcagcctgtttttgcatctccatcagttggcagtttagtttgtcttgtttcctctgaagttcaactgccattccttgacctggaacccaagggttctgatcaggagagaatctttaaagtacttgtgcaagtcaaagacaaaccaagagcaacaaggaggaatatcatggattaa

SEQ ID NO: 79672 - DNA, 423 bp, Glycine max
  Peptide Sequence Number=SeqID_171357
atggctggactacattctattctaggccttgaaggatttaacatgtctagtcatatggccccgaagaaacttgctgctaagagagctaggaaggccactgcaagggaaggatctagtgcagccccacaagcggaaattgagtttgatggatgtcgctttcgaagcgaggagcatcaacactattttgagatgattaaggattggtctttgttcaaagaaagacggctgacagagcctatggtgaagtatgatcttgaagtagtcatggagttttacgcaaacgcctggcccattgaagaaagaattgtggacaagcgctcttggatgcagggccaatggatcccatatgacacagatgctatcaacgaatgcttgggggcatccattgatcttagaagagggacaatgatgcaaatacactga

SEQ ID NO: 79673 - DNA, 552 bp, Glycine max
  Peptide Sequence Number=SeqID_171358
atggtctgtgttgaaaatgatgatatgactggttgtttacttgttggttcctttacctttgaatgtcgtattatgcattatattctatgtcgtgtgttgcttcctcgttctactaaccttgtgcaagcctctgaggaagatttgattttgttatgggcactaaaaactggccgtcaaattgactgggcccatcttgttcgttaccgtatgcataaggcattacgggcaaatgcacctctcccatatccccatctggttaaatgttcatttgccattggagccgtcgcagttgtgccttttgggtataggaaagatcttgatggccaatgggtttttaaacaggatctcccggctaatgctcccgacgaacgcactccatctccaccaccaagggatccctcctctacattactgaatgatgtcctcaatgagcttcaggatcttcatgcttttgtaggagaaagatttgattcactcgattctcgcattagtcatcttgaggatgacatgggatttatccaccatttctttgatcctctgaccaattcttag

SEQ ID NO: 79674 - DNA, 909 bp, Glycine max
  Peptide Sequence Number=SeqID_171359
atgacactctttcgttgtgcttgccattcttcagcatcatcagcagtgaacacaacttgccctactgagggtttctttcgttcctttctctctgtggctccccctccgattccggctcctcctctggttcctcttccccctccgactcccgttcctcatgtcgctcgcgctcctttactcggtcctgttctccctcgtgctccaaatcctcttccccctcctgctcctcttcctctccaagctcccgcagcctcagctgtcccccgcagaggagccactgtaagggggttttggagcgccgccagaaccaccgcgtttcatggatctcggctgctcatttgtttctggagaaagtctttcctgatcattgaatttgaaaaattaaaattgaagcctaaaatgtttcaggtttttgctgctgatatattcacctcaaagttatgcaacgatgtttcaaaccagcaagcgggcatgcaattcaagaacaagggaaaccagtcagggtcacgatgttttgcgagaatgctccaaccatatgagatcagcataggcttaaaggagcactcaaacccggtgacccccaaggcatacactccgaagagtccgtcagggcctctccctcctgattcagacatctctgggtttctgcgggaaagaaaaaggctacaatgcgaagggtgtttctctcagttcagacataatatcgaaattcccaatggtgaaaatgctcggaattgtgttgtgaacgtggtgctcatatttcacgacgatccaacggtgaataagtctgagatcgtcgttttactgagacaggtttggtggcctgcgggaaaagagagggttttgagagaaaagagaaaaaacgaaattgtgaggcagaggaggctgaggagtcagtctcaaaactga

SEQ ID NO: 79675 - DNA, 1464 bp, Glycine max
  Peptide Sequence Number=SeqID_171360
atgatgataacaaaagatgatgacaaaggtgatgacaaaaagctcaaagatcaatcaaagaacaactcaagtgaatcaaagatcaatcaacgaacaactcaagtgaatcaagaacaattcaagactcaagaagaaagtttagggtcaagaatcaagattcaaggttcaagatctcaagaattaagatcaagattcaagacacaagattcaagaatcaagagaaggcttaatcaagataaagggtacatctacttggatttgactgagaacgagagagggtacatctctggtggatcatttctagtggagggtacatccactaggttcaaagagaacaagggagggccactcgatccaacagaagtcttcgttgaagcaattgcatcccttactcagtattacgatcagcccctaaggtgcttcagattcgaggatttccagctaccctccatggcaagagtagaaaaggtagttaaaatctcattgcaagagttagaccgtgtgaagcaaaataggaacggggtagtcgaaataccaaggaaacatttggaaggaaaggcgaagtcattggccaatcaaggagaatgggttccatttattgacaccttcgcactgttgatatttggagtcgttttctttccaaatgtggaagggttagtggacctagtagctattgatgctttccttgcttatcaccataacaaggaaagcccaaccatctctattttggccgatctctatgacacgttcgaccgaagatgcgaaaagagtagtgaaagaattatttgttgtacgccggctctctacgtgtggttggaccaactcttggctagtatggagcgagcatccattaattggttccctcgctggatggaaggaagaactagggttttatccgcatgcgagggatttccaaatgttcctttgatgggaacaaggggttgtattaattataatctcgtccttgccataagacagcttggctaccccatgagaggagcgccatcagaggaaagcatcatgcctttcatcgcacagggtttcagcgaccctaacgcgagggacaaagagcttaggggaagcagcaatcaggtcatcggcggctatcataagtgtctgaaagtacggacacaggggttggattggctcctaaagctaaaggctgcaagagagaaagaggctaaagctccaaaagaaagtgagaaggcacaagccctaaaggcgaagctcgaaaaagcccgagcaatcaaagagaagtcaacagccatcaaagtccgaaaagaatacgatgaactaaaggataccaatatggccgcagctgaagccttggaacgagaaaccaagatggcccgaaaagaagaacttagcgtaaacaagttccgaggagctttatggggcaacaacagtgagcttaagctccgaagagacgaaagggatcagtcgtgggtcgaaggcatgatctag

SEQ ID NO: 79676 - DNA, 234 bp, Glycine max
  Peptide Sequence Number=SeqID_171361
atggtgaagttggagcgttttccgctaacagaagaagttcttccatataaaggaaattcttctaacggaagaagttcttccgtaagttcctacggaagaaggttcttccgtatgaagaatttcctttatatggaagaacttcttcagttagcggaaaacgctccaacttcaccattttcgcagagagactcgcagagaaatgaagtcatcaaccccacggccaaaaaagcataa

SEQ ID NO: 79677 - DNA, 825 bp, Glycine max
  Peptide Sequence Number=SeqID_171362
atgggcctgcttcagactttcttctttttcttcacttttgttgcctttttgcttaatggttttcgagacttgggtcagtctaggggctatgcctggggagttgtcgtgctggttcacatgtatgaccagctaaatgaagcttcgcagacccccacacgacagatgggtgggtacttaacgctattacagtgctggatatatgagtattttcccagtgttcatcagtgtgtcactgatgatggatatgctgagaagaccccacgtgcctccaggtggcttacgatgaaggcgcacatgaaggggatcaagggagcgccgtacagggcacgtttagatgctctgacgatcacggacgggcagctcagatggggtcatgttgtggtctatgtcagaccagagagggtggtacaacagttcgggtacatgcacaccatccctccgctgccggttactagtttgttgtcgtatgaggacataagcgacaggtggatgcatttcggggatcatctagcacctgcgggtgagatttgtgttgtccccagccaggaaggtgatgagcccagacatccacctgccccagatgtggatgcatacgtcgagccacatatcccagaggttccagtcccagctaatctccctagaccttcagtggttgcttatgaaggttgtgaagcaatcgcaaaaaggttggagcgtgtgctcaaccttaggatggtcactgcaagaactgagttacatgagatcatggaagattgtctgcggatcgctaggggtgacacctctgatggaagtcttagggcacgacgtagacagcgcatagattag

SEQ ID NO: 79678 - DNA, 312 bp, Glycine max
  Peptide Sequence Number=SeqID_171363
atgtattttaatggtagtgaccctgaagatgataacaatgacaatgatagtgacaataccaatgatgatgattctagtgttgatgctggtagtgggggcaatgctgttggtagtggagataaaattgtcggtggttgtactaatgatgatgatgatagtgtcgatggtagtaacaatgataataataacagcacgaatgagtattataaaatatctattacatatggaagaagttcttctttagtaaattttttacggaagaagttcttccgtaaccgtaaaagacttgttacggaagaagttattccgtaa

SEQ ID NO: 79679 - DNA, 589 bp, Glycine max
  Peptide Sequence Number=SeqID_171364
gtgtgacgggaaccccgaaggactggcagagacccgtgatcaatgctggaaacccaaggccctgttagacttatctaggtctagagggtgcctggatggcatacaccagctgacacttcggcagagggaggtcggagttatgatcgctgggcaggatgttgctgagcagcaacatcatccacatctgagtcagggtggtcatgctggtgtgcatgatccgcacccgcctcccggcagcggttcaggcaaaatcctaacctggaactggctaagggcgtctgcatcaaaaggaatccactggccccttacctatgaccgcatgtcctgcacgccctcctcccgatgcccaacgccagcgaactatctcttcctgaaaatctgtgtactcatcgtccctgagctggacgcgtctctctcggtggaactaccatcctttgatggcctcaaaacactactggtgctctgcgctcctgaaacgatggctgtcaaactcaggagcagcgctagttccttcggccgcagtgtccctcctagatctctttgcggagagcttcctcggaggcattcctgcgaggacaacatttggaaa

SEQ ID NO: 79680 - DNA, 366 bp, Glycine max
  Peptide Sequence Number=SeqID_171365
aaattcgacaggcctactccagagattgaaggcttagtagctgccacaggattaagtcctctgatcacatgtttggtggacactggagaggtgactatctccctggatgatgtggcatcgttgctacatctgcccattacaggcgccttccatagctttgaggctcttcatgtggacgatgtcgtcttcctcttagttgaattgcttgaagtgaattctgaagaggcaagagctaagacagtacaattccatgggagtggaagctatgcatggggagctgctgcattggtccatttgtatgagaatttgaatgatgcgtcaaagagcaatgccaggcaactagcaggatatatcacacttatatag

SEQ ID NO: 79681 - DNA, 429 bp, Glycine max
  Peptide Sequence Number=SeqID_171366
atgtggacctttcataccagccgacaaattgattgggcacatctagtccggtatcgcatgcataaggcattgcgattaaatgctcctttgccttatcctcacttagttacgttgttccttcaatattttaacatccctcttgattctgaaccatatgttccaatcaagagatctttcttgatcggttctgctatggttgcctcctttggttaccgcaaagagtgtgatggctcttgggtaaaaaagggtgctcaaccaaatgatgatgaaggacacttaccggttgaaggggattcttctctccttcagagtattttggacagtgacacacgattcgaggagatgaactcaaggattgcaaaggttgaagaagatgtcaccattattcgcgactactttgatttacctccaccaccaccatcagtttag

SEQ ID NO: 79682 - DNA, 468 bp, Glycine max
  Peptide Sequence Number=SeqID_171367
atgggtagaaatgtgtctgcattgataggtaaatttgttcctcacattcttgagaaatgtaaggacccagatgtggtgattcatttggcaaatagaagtgttgtttacctcacaggtctcatagaggatgtgctggttcggagtcagaatgttacaggaagtacatatacttctgacttgctttatgaggtacaggctggggaaccttcttcttctcctaccatggttccttccacggttcaaccaccacccacaccagagttgaagcccttaccagcaaccctcaaatatgcttacttggaggatgaggaaaaatttccagtgatcatctctgcctcccttgctgctgagcaagaggagaagttgttgctaattctcaagaagcataagaaagccattggctccaagagtttgatttggagatccgtgatcggagtggtgcacaaaacctcgtggatgaccatctga

SEQ ID NO: 79683 - DNA, 300 bp, Glycine max
  Peptide Sequence Number=SeqID_171368
atggatgagaatacaaagaaaagaccggaggaagctactcagactggaagcactatgggcatcattgaccctccatctcccatcagacgacacgtgaagtggaagatggcccgcaccaagaaaactgggcagatgacgtatgaggcagcaaaggaaatcattgacaagattggttcgtttgtcacccatggatgtcaagatctcctgactacttccattgggcgaccagaacaccctgggtgtgtgcgtgttgctggagccaatgtcaccatcaagcaatacttcggatcggctccatga

SEQ ID NO: 79684 - DNA, 333 bp, Glycine max
  Peptide Sequence Number=SeqID_171369
atgtttgtcctcacaggaaaatggctccgagaaagcttcttgcaaagagatccaggaaggccaaagcggctgaagggcccagtgccgctcctgagtatgacagccatcgcttctggagcgctgaacatcagcagcgtttcgaggccatcaaaggatggtcattccatcgggagagacgtgtctagctcagggacgatgagtataccgacttcccaggaagagatagttcgtcggcggtgggcatcgctgtcagttcctgggataccttttagtgctggaggagggccaagagtgcgagtatggccagaggaggaaccaggccgatgggtttga

SEQ ID NO: 79685 - DNA, 147 bp, Glycine max
  Peptide Sequence Number=SeqID_171370
atggtggcacaatggaggtttggagacattagaaagggatggcggtggaggttcaaagaagaatgcatcccggctagcgacgataacgttgagtctcaacgggaatgcgcaaaagcaccagagcacgcaaggccaacaaccaattga

SEQ ID NO: 79686 - DNA, 219 bp, Glycine max
  Peptide Sequence Number=SeqID_171371
atggcacatattgttgacaagataaaaaccattgatggatctaaagaaactctgaaacttgctataaggataactgagctctggtttgttgggacgccgggcaggtctgaacaagctgagatggtcattgttgactctgacggtaatcagatccatgtggtctgtaagcaagaccagttaaaggcatggaaaatggatttgaaggttgtacttatgtga

SEQ ID NO: 79687 - DNA, 543 bp, Glycine max
  Peptide Sequence Number=SeqID_171372
atgcagatcatacgcaccagcatgaccactttgacccggacatggatgacactgctgctcagcaatgtcttgcctagcgatcacaattccgacttccctctacctaagtgccagttggtgtatgccatcctgacatggatgagcgcccatgtggcccaggtgattgctgatgccatttatttgtttgcacgtatggctcctactaggcaccctctggaccaagataagtccaacagggccctggagtttccgacgctgatcacaggcctctaccagtcctatggagttcccgtcacccctagtaaggcggccaaccaccgtgggcaggtgcagatacatgagtgtctctaccagttcagcctcagtcaacaggggcaggtttctgccccttttgtatgccctactccggagcagtttagggctaaggtcgcatggcctggagactggcccgatgcccaggcaggggaggagcctgcaagatcccctggtgaggcggatgagtcccatatggatgaagatatgactgacctgctcaatttctaa

SEQ ID NO: 79688 - DNA, 288 bp, Glycine max
  Peptide Sequence Number=SeqID_171373
atggttatgggagatttcatcagcagactctccttccccgcatgtttgcattttagtggagaaaacaccgagactttttcaagtctcacaagttatccagaactacgtaggtctgagttcctcattggaggatacgtaggagcaagagcctcgcttttgtcgaccataccgccttttgtgccgatgactaagagctgcacccatgatacgcggagataccttacggttatccgcacccttttgtcatccagaggcggcgggcccgatgacaagcagagaccaagttga

SEQ ID NO: 79689 - DNA, 309 bp, Glycine max
  Peptide Sequence Number=SeqID_171374
atggaaacatgtttagcagtggaggaccttttgcaacggatgatagaccaaggtcggctggaaatcgacgatgagggggatgaagagcagcacatatgcatgcagtccgcggatgagggaggtcttggaaagcctaagcctttagtgatatatttcaccagagacgcagctccccaaatgccccgatacccctcggtagttaaacctattccgtttccataccaaaatagtcacccaattccatggaggtatgtgcctccaagcgaaaggaaggaagaagccaccgacatcagctcgttgtcggcaaag

SEQ ID NO: 79690 - DNA, 540 bp, Glycine max
  Peptide Sequence Number=SeqID_171375
atggggacaaggggttgcatcaattacaatcccgtcctcgctataagacaacttggttaccctatgagaggggcgccatcagaggaaggcctcataccttttattatcacgagggtccacaaggcatgggaaatgttgcaaagaaaggacaaggaacgtaggggaagtagcaacaggcccgtcgacagttaccgtaggtggttgaaagcctacacacaagatctggattggctcctgagtttgagaaccactaagggggtggaggttgaaactctggaagaagacgaagaggtacaggccctcaagacagaacgtgagaaagcccaaacaatcaaagaaaagttcaagtcagcagctgttaggatccgaaaggagaacgccgaactgagaggcatcaatatagccaccgtcaaggccttggagcaagagaccagagggcccgtagggaaaaacatggccggaacaaattccgaggggctctgtggggtagtaacagcgagcttaagctccgaagagaggaaagggaccaatcgcgagtag

SEQ ID NO: 79691 - DNA, 531 bp, Glycine max
  Peptide Sequence Number=SeqID_171376
atgattgagtctcaaaaactaaactatgtcagacaacatcaacaacaactcagggttgacaaatacatcaatttaactggctctaatgatcatcctgaaacacttggtagggacagaggaaagagaattatactgccaagtagttttgttggtggtcaaagatatatggagcaactgtattttgatggcatggaaatttgtggacatcttggatttccagacttattcttaacaatgacatgtaatccaacatggccagaaatacaacgcaaggtcacacaatccaatctgacctccaataattgccctgatattatcacacgagttttcaaaataaaactcaatcaattaatgaatgacttaaaacatggcaatatctttggcaacattattggatatatttatacaattgagtggcaaaaaagaggattgccgcatgcccacattttaatttttctgcacccttcaaacaagttaccaaacccacacgatattgatcaaatgatttcagcagaaatacctgacaaatag

SEQ ID NO: 79692 - DNA, 78 bp, Glycine max
  Peptide Sequence Number=SeqID_171377
atggtctacgaactttacgtgaaaggttcgggagttgtatttacgcacggggaagacaagtggtctcagatatcttaa

SEQ ID NO: 79693 - DNA, 252 bp, Glycine max
  Peptide Sequence Number=SeqID_171378
atgcaaaggctgaaatgcttatatacgagatgctctcgggaacggaagcttctagcacactccagacatcttctcaaagatcccaacggtcagatcatggacaagtgtcttttgaagtcgcaaagaaaatttcgagaagatccaacagttaaagaaggctgggcagcgtttttaccgaggcagctgcatgtagttttctctagaagcttcattaagaggcttcctccagaagcttcctcgtggcttctttga

SEQ ID NO: 79694 - DNA, 234 bp, Glycine max
  Peptide Sequence Number=SeqID_171379
atggattgccatcatcaaaaaaggggagattgtggaagtaatgtcttccaaggttattttgatgatgccaaagaatcaagagttaagcaaagtttcaagcaaagattcaagaatcaagtttcaagtttcaagattcaagattcaagaaaaatcaagatcaagattcaagaatcaagagaagacacattcaagataagtactaaaaagtttttcaaaacattgagtagcacatga

SEQ ID NO: 79695 - DNA, 150 bp, Glycine max
  Peptide Sequence Number=SeqID_171380
atggactcgggaaggttccaagttagtgtacaaggtaacagctacccactgggggtgatactgagggccttccgaagtgttttcaaggggtataccaccaactgcttgcccttcagtggcatatccgagccaaggctcgaagtcggctag

SEQ ID NO: 79696 - DNA, 381 bp, Glycine max
  Peptide Sequence Number=SeqID_171381
atgactagaggaaatccatatgacttacaaccctttgatcctgatatagataggacatttcatagattagttagacatcatttagtatcttttgagcatcctaagcattctgttattggtgattttgagcattatagttttaaacattctgattttgtacattctgagaacacgacacaatctccaccccgtgagaggactctaagggaaatggctgcacctgatttcacctacgaaagcttgtgcatccaataccctgatgaggatgtcccatatgttcttaaaactggactaatacatttgttgcccaagtttcatggtcttgcaggtgaagatccttataagcatcttaaggagttccatattgtttgtttcacatga

SEQ ID NO: 79697 - DNA, 546 bp, Glycine max
  Peptide Sequence Number=SeqID_171382
atgacccctgctgaagccaggaatttaattgagaagatggcttccaactccaaacaatttagcgccagaaatgatgctatagtcattagaggagtgcatgaggtagccacaaactcatctacatcatctgaaactaagaagcttgaagactctgtggtttatgctcctctaccgaccaacatacagacctttttccttctgtgcaataatctggagcaattgaacagcctgaagcatatgctgcaaacatctacaatagacctcctcaagctcagcagcaaaattagccacaacagaacaattatgacctctccagcaacaggtacaatcccgggtggaggaatcatcccaaccttagatggtcgagtcctccacaacagcagcagcagcaacaacaacaaccttattttcagaatgctgctggcccaagcagaccatacgttcctccaccaatccagcagcaacaacaacaacagcaaccgcaacagccctaaaaatagaaaacagttgaggcccctccgcaaccttcccttgaagaacttgtga

SEQ ID NO: 79698 - DNA, 510 bp, Glycine max
  Peptide Sequence Number=SeqID_171383
atggtaatagaggaaggatacacaggaggagaggttgtgacaataattatggctatattgaatggctccttggaagttgcatctccaagcttcactgcttttgctgctggacaagctgcagcctttaagatgtttgaaacaattaaaaggaaggcagagattgatgcttatgacattactagtcgacagcttgatgacatttgtggagatatagaggttagggtggtttgctttagttatcctactagacttgatgaactgatattcaatggattttctctttcaataccaagcggcactactacaactttggtaggagaaagtgggagtgggaaatccacagttgttagtttggtagacagattttatgatggtgcaattgttgaagagaatattgcctatggaaaggatggtgcatttgttgaagaaatcaaagatggggccgaactagctaatctttccaaaattatagataaacttcctcaggtctaccctcaaatctcaatttaa

SEQ ID NO: 79699 - DNA, 198 bp, Glycine max
  Peptide Sequence Number=SeqID_171384
atgactgtcgttggggtttgtgactgccgcgaagtggagcatcctccgttggagtcagacatcaacacaagcttttgcaaacccttttcacctgactgctctgtctcaactccaccgttcacgggtggcaccatgatagggaggcagttatcagtggcagtgagtattgtttgtgttccacaaacccttttcacttaa

SEQ ID NO: 79700 - DNA, 258 bp, Glycine max
  Peptide Sequence Number=SeqID_171385
gaggaagtagggaatgcagcacagaagcataaagcaaagagggtggagagtgtcaatgatgatgtagaagcctttggtgatcaccgggaaagttcagattgctctatgcattctaaagctgaagcactagaacatatgaagaaaagagatacaggccatcaaagtgtgtcattggagaatataacaggagattcaactgtgctgaggataggagattcggctaaagttgtgattaaacaagacatgaagggaggatag

SEQ ID NO: 79701 - DNA, 507 bp, Glycine max
  Peptide Sequence Number=SeqID_171386
atgggagagttgatttgcgccatcgcccgatcgccacctagtaccacatatgacggtggtacctggagatatgtcgcgggggtcaggagaccttggggacgtcagggtgatatggcctctggtaatcgattaccaaggggtgatggggcactgatcgcgatggcagcgcagttgatccatgatcgcgtggtgatggagtgcctagagggtgtttgggagaccctcgaaggcaatgagaggtgcagattccgtggcacaattcaattcactgctacttcattaccagttcaagtgttagagttgtcatcctctgaagaggatcttgaagaggacccaaaggagttaccccctgaacctgctatggacgcccttgacttacctgaggatgatgaagacccactccctgatgttgatcctccagaggatatcatgtcagcatctgaggcagactctacagaggagagtggccctagagggataacgaatagtgacgactcttcatcatag

SEQ ID NO: 79702 - DNA, 576 bp, Glycine max
  Peptide Sequence Number=SeqID_171387
atggcactcagagagcaaaccaaggagggtgtccagaatgttagacctgagtctaaaagtatcctatccccgcttatcccacagacaaaaacggatgaggagcatgttccttcccccaatgactctcttccaatgaatgtctatcataatgttatggcacaatttcaatcatgcccatcacgaagcttgcaagtgcttccttatgatagtagtagtagaagtagtcaccaacaatttccaaggtaccttccgttccaaatgactcgaatcaatccacaaggcatacctccagcaatgatgcctcagtataataaaggacatttatggcctcacccaccaactctcacagatttcccaaaattcgtgcatgcttgggagaggtcctggccctcgaagccagtctttaagcctgtgcctatcaactttggtgccttcattgacatgccggattcaagcacgacgtcgaggtcttttgacaagctcaaagatgccctcatttgcctcactcatcaacaactttccctgggtgactcaatgaactccatgactaccaaaattgatgaactcctccattga

SEQ ID NO: 79703 - DNA, 834 bp, Glycine max
  Peptide Sequence Number=SeqID_171388
atggtgtgttcaaaagtctgttttgggaacatcggcagagtggatgcggatttgatggtatccctgcaacagtactggcaaagaaaaggggcttgtgctaggttgaatcaagcctttttaaagcatcatctcgacttggagctcaatatcatgcttttgaaagtggagatatcgatacgggcacacattgactggcacagactgaggaagcaggaaaatctagagtttccaatgaaggattgtcgttataaagcatcgcaatgtgaaagcaacacccatccccttgtcagtgacataaacgacgaaattgcggggttaatcgcttcagggccagtggtggtggtcgaatgggggcaggaagaagtggtaccagctgtggtagaggacttggtggcacgcggaaaggggtggggttcatcgagaaggaagcccgaggccgaaccgcctgacgatggtctagaaatttctcctcctggagtcgcgcgaggcctattgcttggactagggtcaagggccgatgatgcggtttgccaagtcctcgaactccgacagaatgatgcaatggttaaacgctcgtgtgcgggtgtgccatggtattcgaaaagctggttgatcttgaagatccaaccaagcgggtctatgccatcaaatcagggcacatctaatttcattttatgtgttgacgtagttgtaggtggagggggagggcaaatgagggcatctttgagcttgtcaaaagacctcgacgtcgtgcttgaatccggcatgtcaatgaaggcaccaaagttgataggcacaggcttaaagactggcttcgagggccaggacctctag

SEQ ID NO: 79704 - DNA, 885 bp, Glycine max
  Peptide Sequence Number=SeqID_171389
ttcgcagtgggtggacttttagtgatagtgtcgggtgaagaggacatgttagtgagctgcccttcctccgcaccatacgtagaagcggcggaagaatcattggaaatagctttccaatcctttgaagtggtgagctgcgcctctgtggaaccaagttcgtcgctaccttctctctccaaagcggccataatggtggcacgcgttatgctcaggaacggatttgagcccataatgggtctaggcaaggactgcctcgggaatgccgacgtggtcgatatcaagggaaatccatacaagtatggattagggtatgaacccgggatgctggggaggaggaacgtgccgtcaagatttcgggcagatagggtatggcccggccgtattagccagtgtttcaccagtgctggaatggtgtccgaggaggaggtggcagcaatagaagaggaattccctcaagacccaccaagttttgtgcaaccatgccaccccgattcccaagtggggaactggcgcgtgataagccagtcagaagtctataccactgattcaattacttgtgaaatgtcatttttccatatttgcaacttagtcattgcaatgaatccttctggactagaatctacagagctaggcttgtcagaatgtagcaactcagcaattgaagactgcaacatgttcaaagagtattggcatctttcctttgtgaactccaaggagaattcagctgatgattttttggagacatgggaccagcctcagatctttttcatcaatggagtcatttgcttcttgaagatgaatggaagcagaatcgagaaggaagaaagattgttggagacgccacttcaaggagaagatgagtcaagaagaagctcaccaccatag

SEQ ID NO: 79705 - DNA, 273 bp, Glycine max
  Peptide Sequence Number=SeqID_171390
atgctcttgggcatcatgttcaggcttgagccgttgtcgatgagtactttggccataacatgttccatgcatttgaccgacacatccttctacggacatgtcttgggctacgtgagcttcattcaagacttttaccaacaaatctcggtgaggcttagagctcatgagaagctccagaagggagactctagtcggggtcttattgagttgttcaatgacttcgatctcgctttgttggataatacggaggaactcgctagcctcctcgagtga

SEQ ID NO: 79706 - DNA, 1059 bp, Glycine max
  Peptide Sequence Number=SeqID_171391
atggaaacgtctcgaaagcgtcacggaagcacctcgacttggatatttttcacggcaaaaatttttctcactaatttcgagagatttctcaataccagaagggctaaactcatttgctctatcctccttcccctatttataggagaaaagagggaggtggttgccgcccagctcgcccaggcaagctgggttgcttccaccaaaaggcaccgccttcttttggaacactcaagaaggcccaaaactttacagattacgcaacgatgcttgtttttccttttggaatgttgtgaaactttatggattatgcaacaatgcttgtttcgagggttccgaagggagaaaacaaggttcaaggaccaaacgcaagtactcccggacgaaattaggtttgtggccttgggaaaaatatatgagcgagggtctaccatacatagcgtggcgtatacagatgatgtcataagggttagcgttgaaaaagttattgacagtgatgctgaagtctcgttgccaacgtcaaaaattcagtatgtcagccaggtccttcacacattcattacatggccgacacccattgtaactctggattcagttattactccaaataaagtgactaaagttgttaaacagttgaatgatgctgttgtaggtgaccccttgcgtgagttgattaagagcctgtacgacatttatgagaagcctattcagtttgtgtgggatgttactaaatttgggattccaactgtagatgcatccttgttcttaacacatgctgatgtcaatgaattaatatcaggcgacaaatgtttgaacatagcaatactacatctgtggatcattggatacacaatgcaaaagatatacatgggcaatgtcaagattacatcaaaagatgggttaaggaatcccaacaggagtgcatttaagacattaaagactacttttgacggaaaaattgatcaaactacaccccggtggattgaagtaaagtggtttggtgatggcacaccacaagacatcaagaccatgacaacattatggaaaaaatgggtactgtaa

SEQ ID NO: 79707 - DNA, 341 bp, Glycine max
  Peptide Sequence Number=SeqID_171392
tcaagagatctttctctatcggtgcgaatgtggtctcctcttttgtataccgcaaaaaaagggatggttcttgggtgaagaaggacgctcccgcacaggccgcagaagaatgctctccatcaccacctcctcagagagatgattcttcatctcttatgcacaacattcttgacagactggatggactccacactttcatcggtgagcgctttgattcattggacaaccgcattgatgccattgatgcacggtttgcaggaatggatacccgcatcactcagcttgaggaagatatgagttacattcatcagtgcttcgaccttccaccaccatcctcatag

SEQ ID NO: 79708 - DNA, 597 bp, Glycine max
  misc_feature (22)..(22): n is a, c, g, or t
  Peptide Sequence Number=SeqID_171393
gcacgtcctcgccttcagaggnctgcactcccaccccttcagagggctgcacatcctcgccttcagagggctgcacgtcctagccatcaaagggctgcacgccctcgccttcagagggttggcttcgcgccctcgccttcagaggactgcacgccctcgccttcagagggcttccgtcctcgccttcagagggctacatgcactcgccttcagagggattcacgtccttgccttcggagggctgcacgtcctcgccttcagagggctgcacgtcctcgccttcagagggctactcgtcctcgccgtcagagggttgtacgtcctcgccttctaagggctacatgccctcaccttcagagggctataggtccttgctttcagagggctacacgtcctcgccttcagagggttgtacgtcctcaccttcagagggcttcatgtcctcgccttcagagggcttcacatcctcgccttcagacggctatacgtcctcgcctttcgagggcttcacgtcctctcctttcgagggcttcatgtcctcaccttcagagggttgtacctcctcaccttcagagggctacacgtcctcgcctttag

SEQ ID NO: 79709 - DNA, 536 bp, Glycine max
  Peptide Sequence Number=SeqID_171394
cttgcctgtctgatgcagcagtaatgatggcccgggtgatgttggggagtggttacgagcccggaatgggtttaggcaaggacaatggcggcataactagcctgataaacgccgaaggaaatcgtgggaagtatgggttaggctataaacccactcaggcagatataaagagaagcattgcgggaaggaaaagcggaagtcaaggttcacggttaaaacaagaaggcaaaggaaacccaccctgccacataagtaggagctttataagtgcgggtctaggggacgaaggtcaagtcgttgcaatatacggagatgatgttccgagtgcattgaatttggtacgaccgttccctcctgatttccgactaggaaattggcaagtggaggagcgcccggacatttacgcaacaagcataatatccaacaccgagtccctcgaaggtactaatacctgggacccgccaacgacttcaagcaagaaacgagtcaaacggaggatgaacaaaacgaggatgtgggacttcccccggagttag

SEQ ID NO: 79710 - DNA, 1236 bp, Glycine max
  Peptide Sequence Number=SeqID_171395
atggcactcacacaaagctgcgcgaatcacttcccccgacggagtttaatccgtataacgtgggaaaaatcatcggaaccagggattgagatgaagagcaaacggttaacgctggtgctgtcgcaggcggtgagccgcgtgatgctggatgacatccgcgccatcgtgccgcccgaggcgctgaatgtgttcattaatggcttagatagcttgccactacgccacgctggactgcgtgcagagcgaagagaactgcgcgctgctggcgtcagccattgtgctattcagtatgatgaaaacccaccgcgcgctaatccagctcgcctaacgctcaggatgcatatgaaaatcggtctgctgttccccatcgccattatcgttgccggtgtcagttttctggtctggtttattgccagcggcgccatgatgcccggtcgccagcgttcatctgcttcactcttccttcacatcagtttaacaaaaccgagcgtggagcccctgcacatgacccttcatcatcaacactacattaatggcgcgtttgtcgaggcgcataacgatagctggattgaagtgattaacccggcgacggagaccttgctgtcacgcgtgccccagggcagcaaacagcaggcggcggcagccattaccgccgcagaagccgctcagcccggctgggaagcgttaccggcggtggcgcgcggcgactggctgcaccgcatcgccacggcaattcgccagcgcgagcctgagctgagcaccaccctcgtggcggagggcggcaaaacccaggcgctggcgcaaaccgaagtgctgtttaccgctgactacttcgactacatggcggaatgggcgcgacgctacgaaggggaaatcgtcaacagcgatcgcccaaacgaaaacatctttgtgtttaagaaagcgattggcgtgaccaccggcattctgccgtggaattttcccttcttcctgattgcgcgcaaagcggcaccggcgctgatcaccggcaacactatcgtgctgaagccgagtgagatcaccccgaacaacgccgccctgttcgccgccattatcgacgacctcggcctgccgcccggggtaattaacatcgtttacggctatggcccggaggtgggacaggaactggccgccaatccgaaagtcgggttagtgagcctgaccggcagcgtcaacgccggcatcgccaccatggccgccgcagcgccgaatgtgacc

SEQ ID NO: 79711 - DNA, 213 bp, Glycine max
  Peptide Sequence Number=SeqID_171396
atgcagagcttgtcagtagagcagttcattgagaaggtatcctggcctggaaccttgccttctgttgtgagagatggtgagggtcccagtactcaagtacctcaacaggcaggcaaggcacaggtaaggcaggaggctgctactccagagagatcaccacagatttcacaagatccaccctctctagtggtggatcaatcttctcttcagtaa

SEQ ID NO: 79712 - DNA, 797 bp, Glycine max
  Peptide Sequence Number=SeqID_171397
ggctgaatctcagaggatcggggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataactcccacttatcctacacctctcaagtcatttcacaaagtcggactagagtcaagctcaacagggtcttctttccccgctgattccgccaagcccgttcccttggctgtggtttcgctggatagtagacagggacagtgggaatctc

SEQ ID NO: 79713 - DNA, 92 bp, Glycine max
  Peptide Sequence Number=SeqID_171398
atggcacgtaaaccgaggcaggatttgagcgtttcaaaaaggtcagatttttctcttcttgtggctgagtatgagtcacatcaagagaaaaa

SEQ ID NO: 79714 - DNA, 258 bp, Glycine max
  Peptide Sequence Number=SeqID_171399
atgaacagcagaaaccaatcaaggtacttaggaacggatgcaagtggggatggggtcacgaccgaccgatcgttgccccttctctgcgctaaacaagcggagaacgtcgcgcaaggcagcccagctctaataggcaaaacgctaacccataaggaaggaggggacatggttaatgttcctctaaaaaaaaaagtgcaggttagctcgcctgggcgagctgagctcgcctgggcgaccaacccctgcaccaaaatataa

SEQ ID NO: 79715 - DNA, 1071 bp, Glycine max
  Peptide Sequence Number=SeqID_171400
atgtacatgtcggaagtgtcgccaaaggacatgcgcgggcgcgcgctcagtatgcagcagttcgccatcgtgttcggccagatcgtgattttctacgtcaacttcaaaatcgccagcctcgccagcgaagcctggctggtggaaatgggctggcgctggatgttcgcctcgggcgtcatcccctgcattctgttctgcatcctggtgttcgtcattcctgagtcgccgcgctggaacgtgatgatgggccgcgacgatcaggcgctggcgatgttgaccaaggtttccaacgccgcccacgcgcagaatctgctgaaagaaatcaaagactcgctgcagcaggatcaacagcagcggcatcggaagctgaactacggcgatgtgcgggtgcgtttcatcctgttcgtcggctgcatgatcgccatgctgcagcaggtgaccggcgtcaacgtaatgatgtattacgcgccggtggtgctgaaaaccgtcaccgaaaacgcgcaggaagcgctgtttcagaccatctggatcggcgtgctgcagctggtcggttcggtcatcggcgccatgctgatggatcgcatgggccgcattccgctgatgcgttacggcacgctgggcgccatcgccggcctgctgctcacctcgtacgcgctctacactcaggccaccggctatttcgcgctgttcggcatgctgttcttcatggtgttttatgcgctgtcctggggcgtcggcgcctgggtgctggtgtcggaaatcttcccgaaccgcatgcgcgcgcaggggatgagcatcgccgtcggctgcatgtgggtcgctaacttcgcggtgtcacagtcgttcccgatgatcaacgaccacccttacctgttctcgcatttccacggcgccttcccgatgtggatcttcgccgcctgctgcctgttcagctactggttcatcggccgctatattccggaaaccaaaggcgtctcgctggaaaaaatggagcaggtagtgctggccaaacgccaccgccaccccctgcccgacggcaagccgctgccgctggaaaacggcaaatcctga

SEQ ID NO: 79716 - DNA, 420 bp, Glycine max
  Peptide Sequence Number=SeqID_171401
atgttgagtcaacatcccaatattttaaactacactgactctgtgatgaagagagaatctcctttatccctgcattacaaattgtttgaggggacacatgtcccagacattgtctcgacatcagggaaagctgctgcttcaggtgctgtgtccaaggatgctctgattgctgaactcaaggacacatgcaagatgctggaagcaaccatcaaagccaccacagagaagaagatggagctggaacggctgatcaataggctctcagaaagtggcattaatgatggagaagcagctgagcaagaagatgaagcagctgaggaagaagtagaagcagccgaggaagaagaagaagctgctgaagaagaggaagatgcagcagaggatactgaatcagatgatgattctgaagccaccccatga

SEQ ID NO: 79717 - DNA, 225 bp, Glycine max
  Peptide Sequence Number=SeqID_171402
atgtcgcaacgtgccctttgcgggcgagcgaaggcgaggctcacgggtgcgctttccaaaggaggaaagatgcgcggagtcgccaccaacgtttatttgtggaaaacgtcggaaaaaccgaaggaaaccggtcgaaatgaaaattctaagttcgggagttgtcgacaaaagcggggcttttgctcctacgtaccctccgtcgaagaggaaatcagacctacgtag

SEQ ID NO: 79718 - DNA, 738 bp, Glycine max
  Peptide Sequence Number=SeqID_171403
atggttatcggttcaaggacgcaaggtgcccctgctttttcagggcgctacagcgctgaagtaatccatgccatactcccaggaaaagctcgaacgaccttcaacaaatgggtacctgtacccgaaaccgacacaggggtgcctcctcacaaagggggtcgcagtgaccaggcccgggcgactgtttaccaaaaacacaggtctccgcaaagtcgggagccgacgaccgaagccccggtgaacggcggccgtaactataacggtcctaaggtagcgaaattccttgtcggactcggtgaaatagacatgtctgtgaagatgcggactacctgcacctggacagaaagaccctatgaagcttcactgtttcctgggattggctttgggcttttcctgcgcagcttaggtggagggcaaagaaggcctccttctgggggggccagagccatcagcctcccaaaaggtaacggaggcgtgcaaaggtttcctcgggccagacggagattggccctcgagtgcaaaggcagaagggagcttgactgcaagacccacccgtcgagcagggacgaaactcacatcgacgggaaggtttggcacctcgatgtcggctcttcgccacctggggctgtagtatgttccaagggttgggctgttcgcccattaaagcggtacgtgagctgggttcagaacgtcgtgagacagttcggtccatatccggtgtgggcgttagagcattga

SEQ ID NO: 79719 - DNA, 222 bp, Glycine max
  Peptide Sequence Number=SeqID_171404
atggatacctcagagccctacactggggcaatgagaggcaccatgcataagcctcaaagcatattttttttttctaaaaacaacacaaaaaacaacaaaaacaaaatagaaaccccaagtcaacccccgctaaatcgcgggaagagcaatgcaaactacacatgcatgaagttcgataacaatgaaaggaaaaaagaaataaaatccgccaagggcgagtga

SEQ ID NO: 79720 - DNA, 393 bp, Glycine max
  Peptide Sequence Number=SeqID_171405
atgttggtgcgcatgatccgcactcgtctctttgtagtggcacgggtgaaatcttgccccggtatgcatagttgctgtatgatagcctccatctctggttgtgttcgcacagttggcgccctccaatatcggggggaggcccaggaattgataaaagaaaactactggccccttaatcgggagtgcaagtcttgccctccgaagtcgaggaagtgtcaccctttgaagacgacggcatctaggcctcagaaggcgacggcgtgcaggcctctgaaggcgaggacgtgtagtcctctaatggcgagggcatgcagccctctcaaggtgaggacgtatagtcctctgaaggtgaggatgtatagtcctctgaagcgagggcgtgcaaccctctga

SEQ ID NO: 79721 - DNA, 342 bp, Glycine max
  Peptide Sequence Number=SeqID_171406
atgtttgatcagcaagcagttgtttctccagcaaaacctccacaatggccggatcctaaagtcgatgatccgctatattcgataacattgaccatcctagagcttttcttgaagcctttccaggttaactgggatgctaccgtgttcggagtgtttaatctagacttcccactgtacataaacgcacacgatggtcagttcagcatatctgtcatacatttgtggattctgcatctgactgagacaagtatgcgagcgggaattccgatgtgtatgaattcctctagccacagtctattcagagatctgagcaatcgcagtttgaattggaaagctacatga

SEQ ID NO: 79722 - DNA, 303 bp, Glycine max
  Peptide Sequence Number=SeqID_171407
atgttgcctgatgctgaggtcctattttatggagttgttcctcttcattattgtatcaatcaacatcttacgcagacatgttcaaagattgaagttgcaacaccgtttgattccaatgatcctgtccacgatgaatgtcaatccatttctataacagcaaaccatgatccacttattggacttcccttgacaccaacaaaacgacagtcatttaatgaatgtgatgatgaagcaagaagctcccagatttcaccaactcagctatcgtccaacaaattagcaaaacatgggaagatagaatag

SEQ ID NO: 79723 - DNA, 446 bp, Glycine max
  Peptide Sequence Number=SeqID_171408
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccaggcgtttccccctggcggctccctcgtgcgctctctgttcctgcctttcggtttaccggtgtcattccgctgttatggccgcgtttgtctcattccacgcctgacactcagttccgg

SEQ ID NO: 79724 - DNA, 405 bp, Glycine max
  Peptide Sequence Number=SeqID_171409
atgtctcttgccactctctttggaaaacttcaacaacatgaaatggaacttatgagacttcatcaccatgaagagaatgatataaagagaaaaggaataacactcagaacctcatcatcttttattcaagaagaaagtgacaaagaggacttgactgaaacagaagaagatgatgatgatttcagactctttgtgaaaaggttcaataaatttctgagaaacaaaagaaataaaagaaaatcaaacatcaatacaaagaagaaagaagaagactcttccttagccccatcatgctatgaaagtaatcaaccttggcacatgagatccgattatcttgtctttgaaagaagaattgaaaaatccgacaagaggaatctcaaagaaaagaaagaaaagaaagcatag

SEQ ID NO: 79725 - DNA, 459 bp, Glycine max
  Peptide Sequence Number=SeqID_171410
atgatttacagatcatggctaggaggtttaggtcgtgctataggtagacttataggcagagatagacatgatgagcatgatgcagctgatgttcccgagaggcgtaggcctactgggcaatgggttcatcagatgactacggctgaggatgttgctgacatggctgaggatgtccctgatgtgattgaggaggcacctgagatgcgtgcggacgattggcgagataggtgtgccgccattcgcaatagcgagaagcgtgcttggcagatagaagatggtgtcgccattgtcgttgacgagatagctgacgtggaagctgtctcgctactcccactggcgagatacattgtctccttccttcttcatattgctatactgcttccacccaatggacccatgaataagttccggtgcggcaaatttactgtaaatgaagcaacctcctaccaaacacagtaa

SEQ ID NO: 79726 - DNA, 1788 bp, Glycine max
  Peptide Sequence Number=SeqID_171411
atggcatttccgaacaagaagctcatcgacgaccccaatgatgttgtgactgaattcattgaaggtcttgtggagacatattccggactacagtatttagatggctttcctctggtgaaggttgtcttacgtgcagatgtttcagctgcaacatatgataaagttgcaatcgtatcagggggaggaagtggccatgagcctgcccatgctggatttgtcggagaaggaatgcttacagcagcaatatgtggagatatattttcttctccacctgttgactcaattctagctgggatacgagctgtaactggtcctaagggatgtcttttgattgtaaagaactatactggtgatcgtttgaactttggcttggctgctgagatagcaaaatctgaaggttataaagttgagactgttattgttggggatgattgtgcactacctccacctcgagggattgcgggaagaagaggtttggcagggactattctggttcacaaggttgcaggagctgctgctgctggtggtctttctcttgctgatgttgctgctgaagcaaaacatgcatctgaaatagtgggaacaatgggtgttgctttgactgtgtgctcaattcctggtcaagttgcatcagatcgtttggggccaggaaagatggaacttggtcttggaattcatggagaacctggggcagctgtggctgatattcagcccgtaaatgtggtggtttctcatgttctacagcaaatattgtccacggtatgctgtatgccacaatattgcatgaaagctcttgatgggttaggtgccactcctacaatggaactaatgattatagctggaaaaacagttccaaaattacagctagaacatggattggctgttgatagagtttatacagggtcatttatgacttctcttgatatggcaggtttctcaatttctattatgaaggctgatccagttattcttcaacgattagatgctccaactaaagctccttattggcctgttgctgctgatggtaatcacccgcctgctaagattcctgttccaattccagcatctcgatcagcaaagactgatgagccacgaagtcagccattacaactaaatgagcaaggccaaattcttgaggtagccattgaagctgctgcaaatgcaattataaatctgaaggacaatttaaatgaatgggatggtaaagttggtgatggtgactgtggatcaactatgtatagaggtgcaaaagcaattcttgaggacatcaaaaattaccctctaaatgatgctgcagaaactgtcggtgaaattggttcatcaattggaagatccatgggaggaacaagtgggatcatgtatgatgccattcctatgcctcctttaaacacattcggtgctaaaagcaagttcccattctggtgtcacttcaaaacaattccttttgttgattcaggggctgaagcactcgcagtttccattgctgctgtaagtaaatatgggggggctagtgctggatatagaacattgttagatgcccttatcccagcatcgttggttcttgaagagaaattaaattctggagttgatccttgcatcgcatttgttctctcctctgaagctgcattggctggagctcagtcaacggtagacatgcaagcacaggctggacgttcgacttacttttctggagagattctttcaacagttcctgatcctggtgctatggctgccgctacatggtacagagccgcggccttagctgtgaaggccaaataccagagctaa

SEQ ID NO: 79727 - DNA, 459 bp, Glycine max
  Peptide Sequence Number=SeqID_171412
atgcatttctttcatgaaattcatggcctcacctatcctctgattcttgcaacacccatcaatcaatatactataactccaaacatcaagtgccatgcccctcttaatcagctggttaaacaacacaaccgccaggtcaagatgttgcccttggcacaaaccatccaacaagaaactttgataaaaggagtgtggttacctatagagctgacaactgacccgtgtagatacagttttgtgttgttctttaaatttgtagagttgcttaactttgatgttgcatctgatgcattttctacctttaaggatcttcttactaagcatgtaagcgtggtctctgaatttttgacagcttactatgacgagacaaggtacataagagagcaagagtgggtgtgtgcacctgttccactagcagttgctaatagaaaagttgaaatcactggccctgtggattag

SEQ ID NO: 79728 - DNA, 234 bp, Glycine max
  Peptide Sequence Number=SeqID_171413
atgagtattgaggcatatacgatgagaaccctattggttgaaaactttgttgacatccttgagatgcgtatcaagagaaggcttctaattgatattgtgcttgtgatggatgatgttgggacatatatccaagaacatgcatgggaggtcctttgggttctgcatatgattgatgttggtgatgaccaggataatattgtgattcaaatttacaaagttagaaataataattaa

SEQ ID NO: 79729 - DNA, 2454 bp, Glycine max
  Peptide Sequence Number=SeqID_171414
atgacggggcgaaagtgttctctgagtgcaatgtttctgctatgtttgagtttgattagcatagcaatcaatgctcttgaggtttcatatgatgaaagggcacttacaattgatggcaaaagaagaattttattctctggttccattcattatcctcgcagcactcctgaaatgtggccatatttgattcgtaaagcaaaagaaggtggacttgatgtaattgaaacatatgttttttggaatgcccacgaacctcagcgtcgtcaggtttctcattgggacaaaaattttcgaggtctcccagtttggttgcacaatattcccaacatggaatttaggacacataatcgtgcatttatggaggagatgaaaaccttcaccagaaagatagtggacatgatgcaggatgagacactatttgccgtacaaggaggacccattattattgctcagatcgagaatgagtatggaaatgttatgcatgcatatggtaacaatggaacacaatatctcaaatggtgcgctcaattagctgactcttttgaaactggtgtgccttgggtcatgtctcaacaaagcaatgctcctcaattcatgattgactcgtgtgacggttattattgtgatcaattccaacctaatgacaatcacaaacccaaaatatggactgagaattggactggcgggtataagaattggggtacgcaaaatcctcatagacccgctgaagatgtagcttatgcagttgcaaggtttttccaatttggtggcacatttcaaaattattatatgtaccatggtggtaccaactttaaacgaactgccggaggcccatatgtcactacttcgtatgactatgacgctcctttggatgaatatggtaatttaaatcaaccaaagtggggacatcttagacaacttcataaccttctaaagtcaaaagagaatatcttaactcaaggttcctcacaacatacagattatggaaacatggttacagccacggtgtacacttatgatggaaaatcaacttgcttcattggaaatgcacatcaatcaaaggatgctacaattaattttcgaaacaatgaatacaccattcctgcctggtctgtttctattcttccaaactgttcttcagaagcttataacactgcaaaggtcaatactcagacaactataatggtcaagaaggacaatgaagacttagaatatgccttgagatggcaatggaggcaagagccgtttgtccaaatgaaagatggacaaattacaggcatcattgacctgactgctcccaaactcctggatcaaaaggttgtcacaaatgattttagtgattacttatggtacatcaccagcattgacatcaaaggagatgatgaccctagttggaccaaagaatttaggctaagagtgcacaccagtgggcatgtactccatgtatttgtcaatggaaaacatgttggtacccaacatgctaaaaatggacaattcaagtttgttcacgagtccaagatcaaattgactactgggaagaatgagataagtctacttagtaccaccgttggattacccaactatggtcctttctttgacaacatcgaggtcggtgttcttggtccggttcagttggtggcagcagttggtgattatgattatgatgatgacgagatagtcaaagatctcagcaaaaatcaatggagttataaagttggactgcatggggagcatgagatgcattacagctatgagaatagcctcaaaacatggtatacagatgctgttccaaccgatagaattttagtttggtataagaccacattcaaaagtcccattggagatgatcctgttgtggttgatttgagtggattaggaaagggtcatgcttgggtaaacggtaacagcattggtaggtattggtcaagctaccttgcagatgagaatggttgctctccaaaatgtgattatcgtggtccatacacttctaacaagtgcctgtcaatgtgtgcacaaccttctcaaagatggtaccatgttccacgctcatttcttcgtgacgatgatcaaaacacattggtcttgtttgaggaattgggaggccagccctattatgtcaactttctcacagtaactgttgggaaagtttgtgcaaatgcctatgaagggaatacgttggaattagcatgcaacaaaaatcaagtcatctctgaaattaaatttgctagcttcggcttaccaaagggtgaatgtggatcttttcagaagggaaattgtgaatcttcggaggctttatcggccatcaaagcgcaatgcattggcaaggataaatgttctattcaagtttctgagagagcacttggacctaccaggtgtagagttgctgaagatagaagattagcagttgaggcagtttgtgatatacgagtaagcggcgaagggaggaaacactag

SEQ ID NO: 79730 - DNA, 357 bp, Glycine max
  Peptide Sequence Number=SeqID_171415
atgatgaagaaccaggaaacaacaacccccaatgaaaggggtccaatgctgcaaaacaatagagccccgaaaagagccatgttctgcaaggaaagcgaaaatgaaaaaacaaaagaaatcagaaactcacgttttgccgacacctccggtggtttcagaggagatagtggagaaaggaaactcgcagatggcgacagaagtgccatagttggtggccaagcgaacgacttggacctcgtcgctacctacgccgatggtgaagaggttgaagtcatagtgggtgggaacagggttgacgccattttgcgattcggcgcgaacggtgaaggtgcggtggcgcgtggagagagaaagtag

SEQ ID NO: 79731 - DNA, 630 bp, Glycine max
  Peptide Sequence Number=SeqID_171416
atgaagtttcggtacgcgatggtgtgttcttcgaaccagaaccgaagcatggaggctcatttcctgctcaagaggcagggcttcgacgtgtcctcgtacggcaccggtgcccacgttaagctccctggtccttccctcagagaacccaatgtctacgacttcggaaccccctacaagcacatgatcgaggacctccgcagaaaagaccccgatctgtatcctcttctctctttttctttatggaaccttgacttagagtgcagctacaaacgaaacggaatctttccaatgcttaaaagaaattcaacagtcaaattagcaccgcaacggtggcaagaaaatgccgctgatggttcctttgatgtggtagttacatttgaagaaaaagtgtttgatatggttattgaagatctccataatagagatcatgctttattgaaaactgtgctggtaatcaacttggaggtaaaagataaccacgatgaagcagccgtgggagcaaggcttactttagatctctgtcgggagattgaagctgctgaatcatgggaagagtcaattgatgaaattattgctggttttgagaataaacatcggcggaagcttttgtacagcatctccttctactaa

SEQ ID NO: 79732 - DNA, 210 bp, Glycine max
  Peptide Sequence Number=SeqID_171417
atgcagggttaccttatggttactcgcacctttcgtcaaccaggggcaaacgagcctgttgattcacagagactaacattgtctcctgcaccttttgtcgtcctgacccgtgaagtcagggacagcaagtcaggtggtaggcagagataccttaaggttatccgcgcctttcgtcaaccgaggggaacgaattcggcggtatcaggatga

SEQ ID NO: 79733 - DNA, 137 bp, Glycine max
  Peptide Sequence Number=SeqID_171418
atggctacgagaaagctttccgcaaagagatccaggaaggacgccgtggctgaagggaccagtgccgctcccgagtttgacaaccatcgttttaggagcgctgagcaccagcagtgtttcgaggccatcaaaggatg

SEQ ID NO: 79734 - DNA, 201 bp, Glycine max
  Peptide Sequence Number=SeqID_171419
atgggggctgttttgggtgaaaaaacgtgtttccgtgaagaaaatctaagccgaggtgctgcagtaacgcttccgagacatttctgtgagcaaatctgtgaagattttccgtcgttcttcatcctttcttcgttcgttcttcggtcttcaaccggtaagtgttcgaatccgagacttccaattcatttcttccgcttttaa

SEQ ID NO: 79735 - DNA, 270 bp, Glycine max
  Peptide Sequence Number=SeqID_171420
atgccgttgaacagccccatgatcagcccggctccgagcgcggccgggatggtcagcccggcaaacgccggatcgagcgacaccaccatcgccaccaccgccgtggtacccagcattgagccaaccgacaggtcaatgccgccgcacaatgttgatggaggcctgacgcgtgatattcagcaggttagcttcggtaaaaaagttcggggcgacaaagccaaataccgccacgatcaggatcagaatcggccagatgcccacggtttgtag

SEQ ID NO: 79736 - DNA, 436 bp, Glycine max
  Peptide Sequence Number=SeqID_171421
atggctgatgagcaccagcaaagagttacccttgaggactattcaagcagttcagtgcctctgaaaacctgggaagaagttgttgacaagtttctaaagaaatatttcccagagtcagagactacggaagggaaagctgcaatctcttcatttcatcagttccctgacgagtccttgagtgaagcattggagagatgggctgagtccacaaatcaagcaactgttagatgcttcagcagggggaaaataaagttgaaaacccctgaagaggcaactgagctaattgagaatatgtcagccagcaatcatgccattttgcgtgacagagttcatcaactcgcaaagaaaagcttgttagaactatcatcacatgacgctttattggcacagaataagttgctttctaagcaacttgagattttaacagaaacactcg

SEQ ID NO: 79737 - DNA, 199 bp, Glycine max
  Peptide Sequence Number=SeqID_171422
cattgagaggacactttccctagtacgagaggaccgggaaggacgcacctctggtgtgccagttatcgtgcccacggtaaacgctggagcctccggtagcacagccgagacagcgatgggttctctgccccagcggggatggagcgaaagaagttttgagaattcaagagaaggtcacggcgagacgagccgtttctaa

SEQ ID NO: 79738 - DNA, 150 bp, Glycine max
  Peptide Sequence Number=SeqID_171423
atgatggcacatcaaggacataccctcacctcagcctgcagcagacccttccactcctcttctagagatgccagaggacccgactacaccagtcctgatgaggaggatgttcagacacaggacacccaggaccagtcacaggaattttga

SEQ ID NO: 79739 - DNA, 414 bp, Glycine max
  Peptide Sequence Number=SeqID_171424
atggacgaagatcaatgcatttatgacaatataatgtttgaagaagttgatatggattatgaaaataaacaagaatgtggtgtgaatgaaccacatgttgattgttcggatgcttttaatacttctcaggtctttggtacccgagatgatgttttgcagtgggctcgatcgattgctcatgaaaacagatttgttgtagtcactataaggtctgacacacatattggtagtagagaaagaagtttatttgtgttaattggtcgtgaaaggagtggtcagtataggtgtaggaagaaagaatttgttagaagagacactgggagtaggaaatgtaattgtcccttcaagcttcgtgggaaactagtgattggagggcaaggttggattatcaagttgatatgtgggtattcataa

SEQ ID NO: 79740 - DNA, 402 bp, Glycine max
  Peptide Sequence Number=SeqID_171425
atgacgttgctcttagcaacattctgcccagcgaccacaatgccgatctccccctgcggaagtatcagttggtctatgtcgtcccgacataaggattgcacccacaaagacacccagtggatccggagaagtccaacaggggccctggggtttccagctctgattacgggcctctgtcacttcaacggagtgcccgtcacccccagcaacgtcatcaggcctcctactaaccgagctttcatcaagaagtattgcgcccccaggcaggcagagggcaagacaccacaacagcctggggatggccagcaacaggcaacaaatgcaccgtcgccacctccagagcccctcagctcatctacaaaaaggttagagtattgcctacgacacatggccgacaaatag

SEQ ID NO: 79741 - DNA, 225 bp, Glycine max
  Peptide Sequence Number=SeqID_171426
atggcttccggggcttctgggacttccgtaaaatttctgaaaaccttgggaagcaacccagctcgcctgggcgagcagggcggcaacctcctccccccttttcctatatataggcgaagggaggctgttccaaatatccctaacctccttggctatgcatttcagctgtttttggtgaaaaaaattgtttccgtgaagaaaatcaaagctgaggtgcttccgtaa

SEQ ID NO: 79742 - DNA, 138 bp, Glycine max
  Peptide Sequence Number=SeqID_171427
atgaatgaaataaagaaagcaaaagaacatcacccagatgaagattctctgatgccgcataatatggctccatgtagagcttgtaggccttggatcttcttcatcaatggaaatggaatggagaagaaggaaaggtga

SEQ ID NO: 79743 - DNA, 177 bp, Glycine max
  Peptide Sequence Number=SeqID_171428
atgactcgaacgcaacatgtgcatgtcgtgggggagccctggggcattccattgagcactgatttgcaagtgcaagccattggtcaagcgacctgtgctcctgagtttggacttccaagaccgttcaatcagagattactcgtcttgcacgttggtggggttgccgtaaaacaatga

SEQ ID NO: 79744 - DNA, 90 bp, Glycine max
  Peptide Sequence Number=SeqID_171429
atgacattaagggtcatggcagctcgcccaagcgagttggagctcgcccaggcaagttattgcttcaacctgaatcttttgaaagcgtaa

SEQ ID NO: 79745 - DNA, 527 bp, Glycine max
  Peptide Sequence Number=SeqID_171430
atgtttgataaacaggcaactgtgtctccaacaaagcctccatattggtcggatcctgaagctgatgatcccttgtatctgatgacattgaccatcccacagcttttcttgaagcctctccaggttatgtgggatgctaccatgttcagggtgtttaattcagacttcccattgtacatcaagcacaaagatctcttcaaaattgcacacggtggtcaatgtctcagcatatttgttatacagttgtggattttgcatttgactgagacaagtatgcgagtggggaattttgatgtgtatggattcctcgagccacaatccattcagagatctaggcaatcacaatttgaatcagaaagttacatcaagagttggatgcagagttcaaaacgcgatgtctaccttggagcctacctaaatggcgggaactggcaaatggtcgccattctgcctaaggaaaaccttgttgtctggttttgttccttgcataacaggccagacaattaccttaagggagtaattaatag

SEQ ID NO: 79746 - DNA, 579 bp, Glycine max
  Peptide Sequence Number=SeqID_171431
actctagtggtcgtggagcaaggggaaagcttgccctcttactccaggtttactagactaaggcctgatcctcaggagcttgtatccctgggaggggatttgtacttaatgccgaagggacccaaaaacccagggctagaagatttgaggccccatctccttcagttgcccctgcttcctctacttctgctccctctacttttgctctcccttcaccaccaacatctccagttcttccagagcctgcaccagggccagctcctaattatgcagagctcgcaggatgtggtccaacagcggccagttatgagcttggaggagtttgttcagaaggtggcttggccaggagtccagccttctcctttgggagggggtgaggcctctgtagcccaggagcctcagccagaccagaaggatgacattctaaaggcctcaaagcccattccacaggaggatgttgcagcagctaccctacaggtgactccacagcctccaccagagtctaccacttcagcgctggacctgtcatctcctcagcttgagccatctacaccagtgccaaacctgcctctttcttag

SEQ ID NO: 79747 - DNA, 438 bp, Glycine max
  Peptide Sequence Number=SeqID_171432
atggcccgcaccaagaaaactgggcagatgatgtctaaggcagcaaaggaaattgttaagaagactgatgttctgactgcttccattgggcgaccagaacaccctggtcgtgtgcgtgttgttagagctggtgtgaccataaagcaatactttggatcggaacttgcactgcctctggagcctgaggttggtcccttagtttctcgtgtctgcacaaaggagagttgtgttgatccctcagggaatgatctagagacggatgactcagacaaatacgggttgtacatcgaagaaaatccttcctgcctagttgccctaggaagagtttatgagggatccataacggttcacaacatccctttgttgcatggccaagtgaaggttggtgttgaggtggttaaagatgtagaggcttctgttcctgtacccactaacgag

SEQ ID NO: 79748 - DNA, 562 bp, Glycine max
  Peptide Sequence Number=SeqID_171433
caactcttcagtgaaacgtagtgcatcatgttctgaaccgcctcagccaacaaggatcatcccgatgttggatcaatttgcgccatttattcaaggtttcattcttgacactgtggatgtgaaagtagacagtaattgtggatatcggtcgattgccactttattaggtatgggggaagattcgtggccgttagtgcataacgaattgattaaagaatttggcagatggtcgcatgagtacatcaacctcttcggtggcacagagagatttgaacaattaaagttgtccctacttcggtggccgttagtgcataacgaattgattaaagaatttggcagatggtcgcatgagtacgtgaacctcttcggtggcacagagagatttgaacaattaaagttgtccctacttgttgatgggttttccaaggttagtgtggacaagtggatggatataacgaagatgggatatgtgattgcatcacgtttatttgaaagacattgtcctttaccgcctctagcattgttgtggtcaagcaatttttattctcaggcaaagcagtag

SEQ ID NO: 79749 - DNA, 375 bp, Glycine max
  Peptide Sequence Number=SeqID_171434
atgatggaatccttcagccagatgcagtcgcagtttcagtctcagaggcaatcacagggaattgcactacctccagagccagaggttggtccctcaggtcctcgtgtcagtacaaaggagagttgtgttgctccctcagggaacaatccagggatgggtgactcagacaagtgcggcctatatattgaagaaaatccttcccgcttggttgccctaggaagactttacgagggatccacaacagttcacaacatcccgttgttgcatggccaagtcaaggttggtgttgaggaggttaaagatacagaggcaatgtctcagaataaagcacagccatattcggggtgtttaatcaaaacttcccgttgtatataa

SEQ ID NO: 79750 - DNA, 609 bp, Glycine max
  Peptide Sequence Number=SeqID_171435
atgacgttgctcctcagcaacatcctgcccaccgatcataattccgacctccccatgcctaagtgccagctggtgtacgccatcctgacacggatgagcatccatgtggctcagttgatcgctgatgccatctatatttttgcaggtatggcgcccgctaggcaccctttggacccagataagtccaacagggccctgggattccccgcactgatcacaggactctgccagtcgttcggagtccccgttgcacctaccaaggccgcaggcgtgcccccaccacctcatcgtgctggccaggctggggcatttgacatggagcagtatttacggcatttggttcgccagcaggcagccaaccaccgagcccatgtacggacccatgactgtctgtaccagatgagccttagcatgcagagccagggcttcgctcctttttcatgccctactccagaccagttcagggcagaggttgcatggcccggagattggcccgaggcccaagcaggagaggcacccccagaagcgcccggcgatggagaagaagcccacgaggatgaggagatggctgatttgcttgatttcttgggagggagtggagacacgtga

SEQ ID NO: 79751 - DNA, 276 bp, Glycine max
  Peptide Sequence Number=SeqID_171436
atggtggtcatcctgcccaaggaacacctagttgtctggttttgttcattgcataacaggccagacaactaccttaaggggattattaatagacaaaaaggaagtactgagtgcggctactatgtgatgcactggatgtccaccatcattttaggaacttttagaaataattgggaagcgtattttaacgatcctagaccattggagccagagagattaaaagcattgcggatccagtgggcacagttttatctccgagttagagatcaggcctag

SEQ ID NO: 79752 - DNA, 537 bp, Glycine max
  Peptide Sequence Number=SeqID_171437
atgagtcgttttatgcctgcggcgatagtttcggcatcggtgcttttcatcaatgactgccgcgccgaacagttgatcgaccgcggccgcgttgcgttacgcggcgccattcatcagggtgcctgcgccattaaggtcgatgatgctgaacaaaccatcgcgatgggggtgctgccgctggcgcgcctgcagcgtgacggtaaagggccgggttttcccttctctatccagctggtcaattgtccggtggagtacagcgcgtcgggaggcgtggcacgcaccttttctatcacctttgaccacgatggcccgccgggtcagcagcgttttgctgtgtatggcgatgccaaaggggtagagctgatgattacggatacgcagggcaacaccattgctcccggtgaggcgcagccgatcgatcagcatctgacgcagcagcacgacctgcgttatcggctcacgctggtcagcaaccagcagcaactgcacagcgggagttacgccgccgcgattcgttttcacattaattacaactga

SEQ ID NO: 79753 - DNA, 360 bp, Glycine max
  Peptide Sequence Number=SeqID_171438
atggatctcaatggaaaagtcattacaaatgatgataataaagagattggtgacgttgttaatacccttatttttacaatagctcaacattttatcgattttaggtggtatagagacaccttcctaactcgagtttacacaagagaggatagccaacaaccttcctggaaagaaaaatttctagttagtcttccaagatcattcggagataagaaagtagctttgaaaatttgtcaagatgtccaaaatccaaagacaattagccaaagagaaggcccagacaaagagagatttaggatctctgctgcaacaatttggactacccgcctatccaaagcaaaagaagaaacaaaaccttag

SEQ ID NO: 79754 - DNA, 315 bp, Glycine max
  Peptide Sequence Number=SeqID_171439
atggttaaagcacgtcaaaaagggaacgatgaagaacggcgaagaaccttcacgaaatcgctcacggaaacgtctcggaagcgttacggaagcgcctcggcttggattttcttcacggaaacaattttcctcactaatttcaagagaatcctaaataccagaagggctgaacgaaattactcggccctctttcccctatttataggggaaaagagggaggtggttgctgcccagctcgcccaggcaagctgggttgcttccatcagaaggcaccgccttctgttggaacctcctagaaggcccaagtgggcctag

SEQ ID NO: 79755 - DNA, 414 bp, Glycine max
  Peptide Sequence Number=SeqID_171440
atgacagaaaccgtttgtacggataatcgcttgggcatttccgtacgtcacctgacttcactggtcaggatgacagaaagtgcagaagacgacgtaaatctctgcgtgttaacaggtatctctgcatgtcatcagacttcacgggtcacgatagcaaaaggtggggcagtcgacaaaagcggggcttttgctcctacgtatcctcaattcgtgatgaggaactcaaacctacatagttcttgcaaaaatggtgtggataatcgtaaggtgtctctgcatgctaccggactctcgggtcgctggacagcaaagggtggggtggtcgacaaaagcggagcttttgctcctacgcatcctcaattcgtgatgaggaattcagacctacatagttcttgctctcgtgagactaaatag

SEQ ID NO: 79756 - DNA, 330 bp, Glycine max
  Peptide Sequence Number=SeqID_171441
atggcacggaaaaaggttctcccgcagtcaatgttacaactgtggaaaaaccttcttccgtgcgatctcacggaagaaccttattcttccgtggcttcctgtagaagaagttcttccgtgagatggcacggaagaaggttcttccacaattacaacggtggaagaaccttcttccgcggaaatgttaaggagtattttgggaattctaaaaaattgcttggtgcaccagcaatcttgctgggtgcccctagcaattcccttagtacagccacctatctttgggcctttgctccaaaaacactgctgatcatggctggtcgagtgcagtaa

SEQ ID NO: 79757 - DNA, 249 bp, Glycine max
  Peptide Sequence Number=SeqID_171442
atggagaaagcatgggtatcaatttctcttccatctccatttcctcctcccctttcaggatgtggttctaagtggatgcaggagtcgcaaaaaataaggttgcaacaaggtgtcatggtggtgaggtgtcatggtggcaaggtgtcacagtggcgagttatcacgatggctgcagagagagatagagtcacgaagtatagcttagacggagaagaagagagtgcgaggaaaatagggcttgtgttctaa

SEQ ID NO: 79758 - DNA, 534 bp, Glycine max
  Peptide Sequence Number=SeqID_171443
atgacacactttgatggcctctatctcttttcttcatatgttctagtgggaaagcataaaccaaagagggtggagagtgtcaatgctgatgcagaagcctttggtgatcactgggaaagttcagattgctctatgcattctgaagctgaaacactaaaacatatgaagaaaagagatacaggccatcaaagtgtatcattagagaataagacaggagattcaactatgctgaagataggagattcggctaaagttgtcataaaacaagacatgaagggaggagagcataaatatgggtttcacaacaataaacgtgagaagccagagaaggtaagggtggtgaatgatgaaactggcgacaaacatgagttgtatgaagtcctaaggattccatctagaacaaaaaaccgatgcctcaagttttttactgagggcaggaggggtattataaacatcgttttctacatctaccaaacaccaaatccaatgcatgttaaatacaatcaatactttgactatcccagcccattataa

SEQ ID NO: 79759 - DNA, 234 bp, Glycine max
  Peptide Sequence Number=SeqID_171444
atgcctttgtgggtttatgtttacagtgaccctggagctcacctatcagtgaagtttccatcaaagtctgagaatgatttgctgaaagatacgggttggtattacaaggaattgctcgagaagtatgggtggaacgatgttgtggaggttatagaggcaatgggagagggagacgtgtttcatttgttgaatccagattgtgacaatgttgtttcctttatcaaccatagttaa

SEQ ID NO: 79760 - DNA, 357 bp, Glycine max
  Peptide Sequence Number=SeqID_171445
gaggaagaggcacatattggtgttgattcttctagtgcaacctctaataaatctgagaattataaggaagaagcacggaatgcagcacagaagcataaagcaaagagggtggagagtgtcaatgccgatgcagaagcctttggtgatcactggaaaaataagacaggagattcaactgtgctgaagataggagattcggctaaagttgtgataaaacaagacatgaagggaggagagtataaatatgggtttaacaacaataaacgtgagaaggcagagaaggtaagggtggtggatgatgaaactggtgaacatgagctgtatgaagtcctaaggatgccatctagatgtgtatga

SEQ ID NO: 79761 - DNA, 564 bp, Glycine max
  Peptide Sequence Number=SeqID_171446
atgatgatgggtggagacttgcaagctttagatggtccaattagtaaaattatgctttctagcgtgtgtgagtgcatcatatcccgcaccgtgctttttgaatacaatgaattgttgatgtcgatatttgtctgtaacccaaatttacattttaatgatgtatacaagatcatggcttctccacctacctcgcctcctccttctcctcctcctcctcctcctcctcctatttccgatgcatcagcttcaccgtctgccgtgaaatggacacgcaaagcctcacgtctacgatccttgtctgctagaccagctggtgctaagagaccagtggtccacattgatcctgctaccggcaaggctaacagtccccacaggaagaaattaagaacttatttggggattgtggcacgtgataaggtggacatcacgtacgagaactggaaggagatccctactgctcagaaggacttgatttgggaggatattcaagcggaatttgaaatcccagaggcttctgacagtaggacgaaaaggaagttacttcagactgtgggcgagagatga

SEQ ID NO: 79762 - DNA, 1286 bp, Glycine max
  Peptide Sequence Number=SeqID_171447
gtacctttgatcccaatggtcgggatgacatactcagtattgccattggacgacccgagcatggaggtcatgttcgtgctgtggggtttggggtgacaataagtcaatactatggaagagcttcacgtggttctagtagctcctccacatctgtcagccaacaacaattggttgacataattggcacctttaaggaaaagtggaggaataagattataggaaaccttaaggaaaaaatgaggaatgagatagaagaagaaaagaaatggggattgcagtacacatcattgggtgagccagatatacaggtattaggggcacgtgtgagcacaaaggggagtaacattgaaaatgcaatcaacccagcaggggaagaagatggtactcatgtgataccgagtatgggattcgtggcttatgcagatgatgtggtttgggtcagtgttgagaaaatttatgatggtgacgctcaagtcccatttctgatgtctgaaattcaatatgtcaggcagatcctttacacattcattgcatggcctacacatcttgtgaaacttgtattacatgaggacattgtagtctggttttgttcgttgcgtaagaagcctgatattcatatcatagatgcaattaacaacagtgcaataaagacattaaagactattttggatggtaaaatagatcaagttgcatcgcagtggattgaagtaaagagacatgttcaaagcgaaggctatgagtgtggttattatgtcatgcattggatgtggaacatagtaaccgggggattgaagaatgattggaccatggccaagtctttgttttgttgtgaagctacccattttgcaggtcattgtcaaggacaagatttggatagtgctgatcatagcccaattcacatcaaccaacttaaggttaatttagaataccttggtagagttgtgttcaacataaatggtgtgctttatcctgacagcgttgttggaactgattcacacataactatgattgatggcctgggtgttgctagatggggagttggtggaatagaagcagaagctgcaatgcttggccagcccatgagcatggtcctacctggtgtcgttgggttcaaactattatgcaaactacgagatggtgtcacagctactaacttggtgttgactgttacacaaatgctaagaaagcatggggttgttggcaagtttgtagagttttatggggaaggcatgagtgaactgtctttggcagatcgtgccaccatagcaaacatgtctcctgagtga

SEQ ID NO: 79763 - DNA, 588 bp, Glycine max
  Peptide Sequence Number=SeqID_171448
atgtatgaatacaaggttttgatgatgccaaaagaaaaatcaaacaaggttgcttcaacaaacattcgaaggttaaacattgcttcaagattaatacaaggttacttcaacaaacattcaaaggtacttggtcttgctaagagaactcctgctgtaatgttagtgttttctctattcaatgttaaaacactaacccctgacgctgtttcgacgctcctcgcaaacccttccctcggtgtggttggtgaagctggcgccccaaggtttggcggcaaagcaggaaatgcggctgtagttgatgaggatgaggttgttggagttggtgaaggcgacggggtggacttgaacgagttcaatggaggaaacgagaggagaatcagtgacgaagccgtagaagcagagattgagggaggaggaggtgttggggagagaggcgaagaggttgcaataagtgcttttgtgggcaatggaatctcgccaaggagcgcattagttgaagatgacggtggaggagagtgtgacgttgaaggagggaggactgaacttggaatacataaaagagctaatcaacttcatttcatcccttga

SEQ ID NO: 79764 - DNA, 3213 bp, Glycine max
  Peptide Sequence Number=SeqID_171449
atgggtcagcaaacccgccgggaatcctattccggccccttaccttcctccgcgcatcggaaagattacaattacaactactaccactaccgttgtcaccattatcattctgaaccgcgcctcttcgagtttaccagcaaggacgagactagtgatctgatcttgccttttgacaaactcgagaggctgagtcaggatgatgttagggaatgtgcttatgaaatatttttcaccgcttgccgctcatcccccggatttggaggccggcaagcgcactcgttctcgtcgtggaataacgacatgaagtcaagcaatgtggtgatgtcgccgacaagtaaggtgaagcaggctctagggctgaagatgttgaagaggtcaccatcaaggagaatggtgtcgggtggcagcggtggaccgtcgtcgccggtcggcggaagtagtccttttcatcagtccgggtcaccgttgaggccacgacggccgatgacttctgcagagatcatgagacagcagatgagagtgactgagcacagcgataaccttctgaggaaaaccatcatgaggaccctcgttggccaagcaggaagaagagcagaaactatcattctccccttagaacttctaaggcatgtaaaaccttcagaattcagcgattccaatgagtaccacatgtggcaaaagaggcagctcagagttcttgaagtagggctcctcacacacccttcaatccctctagacaaagccaccacctttgccatgcgccttcgcgacatcatacgcagtggcgagtccaagattatagacaccagcaaaaactccgacaccttgagaaccctttccaactcggtggtttccttggcatggagaagttccaacagtacccccactgatgtttgccactgggctgatggattccctttgaacattcacctctactcttctcttcttcaagccattttcgacaatagggatgacacattagtccttgatgaggttgatgagcttcttgagctgatgaagaagacatggtccatattggggatcactaggcctattcacaatgtgtgctttacttgggtgttgtttcaacagtatgtggcaactgggcaaatagaacctgatcttctatgtgccacacaggccatgttgagtgaggtggctattgatgcaaagcgggaaagggaatcgttctatgtgaagctcttgacatcagtgctgagttcaattcagcgttgggctgagaagagactcattgattatcatgagcatttccagagagggaatattggccaaattgaaaatgttcttcctgtggtgttgtctgtcacaatgattctaggtgaagatctcgtaatatctgatggtggggaaggggttgagaagcgagatataactatagtggactcatctgggtataggattgactattatattcgatctaccataaaaaatgcatttgaaaaggtaattgaggcagcgaatgccaaggctggtgaattggaaataaagggagaattcagtgaatttctgcttcaattagctcaggagacagaagagttggcaatgaaggaaagagagaattttactccaatgctaaagaaatggcatccagcaccaggtgcagttgcagcattgatgttgcacagctgctatgggcatgtgctgaggcaatatttaggtgacgtgacctcactcactcatgagacagttgaggtgttgcatagggctgaaaaggtagaaaaggttttgctccaaatggtggttgaggaggactgtggtgagggtgaggataatgacaaaacagttatgagagagatggttccttatgaagttgattcaatcatattgaatctcatgagaaaatggataaatgaggcattgagcaatggaaaagagtgtttgcaaagagcaaaagaaactgaaacatggaatccaaagtccaaatcagagcaatatgcgccatcagccgcagagttagtgcaattggctaagacaactgtggaagaattctttcaaattcccgtaggaaaaactgaagatatagttcaagaacttgctgatggattggaaagtctcttccaggactacatgatgttcgttgcagcatgtggtacaaagcagagctatattccttcacttcccccgttgacaagatgcaaccgtgactcaaagttgatcaagttgtggaagaaagctagcccttgtggtgctaatatctcagagctagaacacatccatgaaggtcataatcctaggccatcaactagccgtggcacccagcgcctctatgttcgtctcaacaccttacactatctcctctctaacatcaacacccttgaaaaatcactctcccacacccctggtgtagtcccttcttcaagccgcaaacatagcggtccctatcttgaaatagtcaattcctccatcccagcagcatgtcaacatgtctcagaagttgcagcataccgtctcatattccttgactccaattcagtcttctatggcagcctctatgttggtgacgtagccaactctcgcattaggccagcgctgaggatcctcaagcaaaacatcacgctgatgactacacttgtggcagatagagctcaagcacttgcaatgaaggaagtgatgaaggcatcctttgatgcattcctcatggttttgcttgcaggtggaagctcaagggtgtttaacaggtctgatcatgtgatgatccaagaggacttcgagagcttgaatcgcgttttctgcacgtgtggggagggactaatagcagagaatttggttgagagagaggctgcggtggtagaaggtgtcattgcattgatggggcaatacactgaacagttggtggaagatttcagcattgccacatgtgaaacaagtgggattggagtcatgggtaatggcctcaaattgcctatgccacctaccacgggaaggtggaataggtcagatccaaacacaatactgagggtgctgtgcagtagaaatgacagagctgcaaatcatttcttgaagaggacattccagttagcaaagagaagagatatactattggcaatgatgcatattgttgccctgcaattcttgccttgtgacacggagggggagcagggttctatatttgaaagcacacaaagtggttgccaaatggagaaatatgggacgaagaaagcaatgcttatgtcattaagcattgaaacataa

SEQ ID NO: 79765 - DNA, 93 bp, Glycine max
  Peptide Sequence Number=SeqID_171450
atgaactttcccgtttctaatattgacgtgaaaaggctaacaccgaacctcgttccgagcctctcgcccactcgcttgatggtttacatttaa

SEQ ID NO: 79766 - DNA, 147 bp, Glycine max
  Peptide Sequence Number=SeqID_171451
atgggcgccaagtacctcgaagtggttaaacgagggtcgcatcccaacaacggatggtccgcggacgaaattaggaaaatgctaagcgccattgctgcgctaagccccaaatgcttatgggattttacaacttcaatttgggcttag

SEQ ID NO: 79767 - DNA, 198 bp, Glycine max
  Peptide Sequence Number=SeqID_171452
atgattcgtgcaccttctgatgtagctccatgtggagcttgtaagccttggatcttcttcatcaatggagtcctttgcttcttgaagatcatggcagtggaatggagaaggaagaaagatgattggagacgccacttcaaggagaagatgagtcaagaagaagctcaccaccataggaagtcatggataagagcttga

SEQ ID NO: 79768 - DNA, 297 bp, Glycine max
  Peptide Sequence Number=SeqID_171453
atggattctaaggatattaatggttgcctcatggataaacataaacctgtggtgacatcttctttggtttgtgaaaaggttgaagatcatgtcaacggagaagatgatagtgattccaattctttgttgcctcctcggagaggtggcatgtccagaaactgtgaaaagactcgccggaaagtgcagtggaatgataggaatggaaacaagcttgctgaggtgttggaatatgagccaaggaagaggaaagaagaggttgacatgtttttgctcttcctaatttgggtaatgtcgtga

SEQ ID NO: 79769 - DNA, 213 bp, Glycine max
  Peptide Sequence Number=SeqID_171454
atgcctcaccaaaagaggaaaactctatatgaggcttcattgtcatcaagcgagccgaagatccaacatgaccatagatcgacctccactccttatggctcacacagacccgagtatagggcccaatatctcaaagtgtgtgcaaaatgtgtaggtgtcgtgtgtgaacagagcaacctaagaattacccaaccccacctgcaaaacaactag

SEQ ID NO: 79770 - DNA, 402 bp, Glycine max
  Peptide Sequence Number=SeqID_171455
atggaggcatacatacccttagggtggaaaccactcaacctcgagcggtacgatgagacaaaaaatccaaatgagcatctggatgccttcttgacacaggcgaacctctacaccaatgacaatgcgattctatgtcgtgtcttgcatatgttccttaagggggtagcattgacttggtacaatggactcccagccaggtccatagacaacttcgacaccctctttgaacgattcagtgtgcagtacaccaccaacaggtctcaccacatgattgcagtcgccttggccacattgcattcgatgttcctcgccttacaccccgacaaatttgcagatagtctgtgcaaaaaaccacccggtagcatggacgagctatgcaagcaagccaaaggcaacatctag

SEQ ID NO: 79771 - DNA, 456 bp, Glycine max
  Peptide Sequence Number=SeqID_171456
atggtggagaagttcctaaagaagtattttctggagtccaagactgctaaaggaaaggtagagatctcttcattccaccaattccctgatgaatcattgagtaaagctcttgaccatttccgtggtctactctggaaaactcctacccatgggttcactagcaaccatgccatcctccgtgatcgagcttatacacttgcaaagaagatccttcttgagcttacatctcaggatgcactgcaagctcaaaacaagctcctagccaagcaaatagaaaccctcatgaagactcaaaacaagcttcctcaacagttgcatgttatgcaacctacttcatcctcagtaatgcaagttaggggatgcaacatttgtggtggaacccatgagttagtcatgtgcatggctcaagatgatgcatccaaagaggtcaactatattgccaatctgaatcgttaa

SEQ ID NO: 79772 - DNA, 2577 bp, Glycine max
  Peptide Sequence Number=SeqID_171457
atgtcgtatcgcccaagcgggaactccaggaccgaggtccgccggaaccggtacaaggtggcggtggacgcggaggaaggtcggagacggcgagaggacacgatggtggagatccgcaagaaccgcagagaagagagtttgcagaagaagaggcgcgaggggctccaacctcagcagatgcctgcgtccgttcactctagtttggttgagaagaagttggaacatctaccatcgatggttactggtgtttggactgatgataataacctgcagctcgaggcgacgacgcagtttcggaagctgctttcgattgaacgtagtccaccgattgaggaggttatacagactggtgtggtttctcgatttgttgagtttctcatgagggaagactttccgcagttgcagtttgaggcagcttgggctttgacaaatatagcttctggaacgtctgaaaacacaaaggttgtgattgatcacggggctgtcccaattttcgtgaagctacttgcttctcctagtgatgatgtccgcgaacaggcagtgtgggcattaggaaatgtcgctggggattcgcctagatgtcgtgatcttgttctaagtcatggggctttgcttcctttgttggcacaattaaatgaacatgcgaagctttctatgcttagaaatgctacctggacactttcaaacttctgcaggggcaagccacagcctccttttgatcaggttaaacctgcacttcctgctcttgcccgtcttatccattcgaacgatgaagaagttttgactgatgcatgttgggcactgtcatatctttctgatggtacaaatgataaaattcaagctgtaattgaagctggtgtttgtccccgacttgttgagctgctgctgcacccatccccttcagtgctaattcctgctcttcgaactgttggaaatattgtcactggagatgatatgcagacacaggttatcatcaatcaccaggctcttccttgccttctgaatctgttgaccaataattataaaaaaagcatcaagaaggaagcttgttggaccatatcaaacatcacagctggtaataaacagcagattcaggctgtgattgaggctaatctaattgctcctttggtcaatctgcttcaaaatgctgagtttgatatcaagaaagaagctgcttgggctatctcaaatgctacatccggtggttctcatgaacaaatcaagttcctagtaagtcaagggtgtatcaaacccttgtgtgatcttctcatctgtcctgatcctaggattgtgacagtttgtctggaaggccttgaaaacatcttgaaggtgggagaagctgataaaaatataggcaatactggtgatgtgaatctatatgcccaaatgattgatgaagctgaggggctggagaaaattgagaacctccagagtcatgacaacacagagatttatgaaaaggcggtcaagattcttgagacatactggttggaggaggaagatgagactatgcctccaggggatgcttctcagtcagggttcaactttggtagcagtgacgctcctactgtgccatccggagttttgggtggtctatccgtaaagtcctccattatgacgcgacagcagttgggggataagtcaacgtcttgtcattgtcctaatgtccttgggtcgtacgaagtccagcaagttaatacatggttgctggactggcttgggttttttgcaatgcctgcattacacggtttcagtaaggcttatggaaacaacaattctagcatcaggctacttggtcctagaatttatggtcttgagagaggactcaatactaagttgattcaaagacttatagctacaagagctgaaggaagtaaacaaaccacttgtaacaccaaatcaaaaattaacaaggatgaaattttagcaagtgctactgcgaaagtaaatagaacacggctagatcagtcgcagaaaattctgtacccggatgtgcaagagattgctcagtatgaaaacttatctgatctggttactattattgtttttgatcttgagactacagggtatagcaaagtaaacgaccggatcattgagattgctcttcgagatctcaagggtggtgagaacagcacttttcaaactcttgtaaatcctcaatgtcatgttcctaattcacgtattcatggaatttctacgaagatggtgaacatacctgatgttccaaggatggaagacctgattcccatattgttgcagtacattaaaagccgtgagaaacaaggaggatatgtgttatggattgctcacaatggtcgtgcttttgatgcacctttcctcatccatgagttcttccgttgttgtgctgagcttcctcggaactcgctgtttctggacacccttcctttgggacgtgaactgatcaagtctgaaggaagaaacctttcttcagcatctcttgttgcccttcgggagttctacaaagttaaagtggatggatcagctcacagagccatggtagatgtgaacacattgtctcagatacttccaatgggcttaaacagtgaaacttcctag

SEQ ID NO: 79773 - DNA, 1050 bp, Glycine max
  Peptide Sequence Number=SeqID_171458
atggttagaatcagaggtttgggtcagactttaggcagagttataggaagagccctagggagagaggatgttcatgtggatcatgcagatgacaagatccatcaacaaactgaagaagcagttgttgatgatgtggcgaatgatgtcgagggttttccaagcgggccccacgacacattagtgttgcaagactatgtttatcatgtggcagcaaaagtttggaatgaagaggaacatcttgagatgaaattatcctcctatggaaggaaggttgagaaatttggtaggcttgctccagagatcaaaggcttagaaaccaatagtttccatctgtcggtaggagaggtgaatatcaccttggatgatgtggtatcgctgttacatttgcccattacaagcgtgttccatagcttcgagcctttttatgtggacgatgttgtcttcctcttagtcgaattacttgaatgttggatctatgagcacttttcttctgttggttctgttattgctgttgatgattatgatgagaggaaaccatgtgtctgttgttggaagtttgggaagacattatcaatatcgatgtatcataagcatttggatagattgacattcgatgctatgtgttggattccatatgatgaccatcgtgcattcatggagtttgagatcattcctccataccctgttggtccttctctatgtatagaagacattgatgatagatggattcagttttctgaatacattgcaccgcctggggatcctcctaaacattcgctcgtgcaacacgatgacacgttttttgaaccaaatgttgctcagcacccggtgacggcaatggctatggatgaagcacctaaagatgcacccgctgatgcttgccaagcaatagctgaaaggttgaaaaggcttctcagccaaaggatagtgattgaaggaacagaagcatacactatcaccaaagaatgcctaaggatcgcaagaggtgtcactgtacaatggaatgtctacgttcgatcaagacgaaggtggcgtatgaaagacgcatga

SEQ ID NO: 79774 - DNA, 660 bp, Glycine max
  Peptide Sequence Number=SeqID_171459
atggctggtgaggttcttattgagctgcgtacactacccgggtttaggtctgagctacaacttgatgagctcttcgataggttttgggcctctgtcaaaaatgtctttgcaccgatctatatcgaattcatcggtcaggcttgcttggtagacgtaccttcaactgctatgggggtaaggcttgataggctccctggtaagacaatagggtgctaccttcaggctctctacataacactgtcatgcttgcttttgatttgccttgacgattacaatatctctggtcaggatattgatggagctgccttgatcgatgagaaccttggacaccataaagtttgcaatgataatggagacaaccatggggtcatcatggttgacggggttaattcccttgaagtccctatccatgaaaggcgagttcctgttcttgtggaggttgtcacttgcgtcgtcactgctggtgtctttgtctacctcgatctgctctatctcttcttctgtatgcatcgtgattcctctgctggtgtcctctgggtcttgctcttgtttggtggttgtctgtatttggtcgcatataacaccggcctaggaggtttcattgggggtagcctgatgggtacctccaagttgaaagcttcctccagaattgtggtatga

SEQ ID NO: 79775 - DNA, 228 bp, Glycine max
  Peptide Sequence Number=SeqID_171460
atggcacatgataaagatatcaaatattacagccttgccagcagcccagcacaagtgcaagaagatgctcctgcggtgtttatacgtggaacatttaatgggaagtacaaggatggagtcctaagtggaggctttggagagggtggcaatgagctggagtcagttccaaaagggactggatgcaagataggaagcaagattcccccggaaaaattcacgcatggatag

SEQ ID NO: 79776 - DNA, 501 bp, Glycine max
  Peptide Sequence Number=SeqID_171461
atggcaacaagcgaagaagtggttgcggcggcgccggaggcagccgcgccggaggcagggttgaagcacaaactggagagaaaatggacgttttggtgcgacaaccaatccaaacccaagcaaggcgctgcttggggaacctctcttcgcaaggtattcaagcccagcaagttgcaaatcaatgccgattttcacttgttcaagactgggattgaccctaaatgggaagatccagagtgcgccaatggaggaaagtggtctatcaccagcaacagcggcaggaaggctaaccttgataacatgtggcttgaaactatgatggctttgattggggaacaatttgaggatgctgaggacatatgtggtgtggttgctagtgtgcgccagtggcaggacaaactttcgttgtggacaaagacagcagcaaatgaagctgcccagttaatggcagaaggtggcatggaccactcaccccaaaaaatgctacagcagcatatctaa

SEQ ID NO: 79777 - DNA, 1587 bp, Glycine max
  Peptide Sequence Number=SeqID_171462
atggacccaattttgccagactcgcagagacccttcttgggaggatgtgcgcaaaaaggcacaagtcatccagaaacagaacactgccccccacgttttgtctcgtggggttatgaatatttggagcagaagctcctggctgagaagatgaagaagaagctggaggaagctgcacaatcaggaagcgttgatggcgtcatcgaccctccatccccggtcagacgccacgtgaagtggaagatggcccgcacgaagaaaacaggggagatgacgactgaggctacaaaggaaatcgctgagaagatcgatgttctcaccgctgctattggacgtccagagcaccctggacatgtccgtgctgctggagtcggtgtcaccatcaggcactactttggttcggctccacggacgtcccgaacctcttcctccctgcctcctgaggaattacaccagatgcagtcccagattcagtcccagatgcaatctcagggacttgcactacctccagagcctctggttggtccctcagctgctcgagtaagcacaaaagggaattgtgttgatccctctggaaacgatccagaggcgggtgactcagataggtgcggcttgtacatcgcaacagatcatgcccgcctggttgccctggggagagtttatgagggatccactgttgttcataatactcctttgtttcctggccaagtaaaggtgagtgtggaagaggttacagatgcagatgctccagttcctgtacccactgatgaggtttctttagtggggcaggcacttcacaccttccttacttggccgacacatttggtcaagtctttatcacggcaagtagctgtgtctctggaaaaaccacctccaaagcccaatccagaggtcgatgatccactttatctgatgacattgaccatcccagagcttttcttgaggccttaccaggttacatgggatgccaccgtgttcgaggtctttaatccagatttcccgctctacataaagcacaaagacctctccgaaatcgcacaaggtggtcaatgtctcagcatatcagtgttacagttgtggattctgcatctcactgaaacaagtatgcgagtggggaattctgatatctatggattcctcgagccacagtccattcagaggtctgggcaatcacaatttgagtatgaaagttgcataaagacttggatgcagagttcaaaacgtgatgtctatcttggagcctacctaaatggcggacactggcagatggtggtcatcctgcccaaggaacacctagttgtctggttttgttcattgcataacaggccaaacaactaccttaagggtattattaacagtgctttaaaaggtcttgatgatgctccacattctaaatcaaaggctcctgctaggtggattgtcgtcaagtgtaatagacaaaaaggaagtactgagtgcggctactatgtcatgcactggatgtccaccataattttaggaacttttaggaatatctgggaagcgaccattggagctagagagattcaaggcgttgcggatccagtggacacactattatctccgagttag

SEQ ID NO: 79778 - DNA, 507 bp, Glycine max
  Peptide Sequence Number=SeqID_171463
atgggcagttactttctcaaaatcttgtttgctgtgttagtgtgcttttcacataccaaattattcattcttggcttcatctcaccattacatgtgaaatgcatagaaaaggagagacaagcactcctcaacttcaagcaaggcctccaagattactctggcatgctgtctagatggagtgacgatgacaatagtagagattgttgcaaatggaaaggcattgagtgcaacaatgaaacagttcacgtacaaatgcttgatcttcgtgcttcagatgttcatttttttactgacttgagttttgttggggggattccttctcaactgggaaatctctcaaagttagagtatcttgatcttaaaaggatttttgttggtggagcaatcccttctcaactgggaaatctctcaaagttgaggtatgttgatcttgcgggaaattcactttctggagaaatccctttccaggttgggaatcttcctatcttgcaggctctcagactttga

SEQ ID NO: 79779 - DNA, 566 bp, Glycine max
  Peptide Sequence Number=SeqID_171464
tcaaggtgcaccttttgagggcaccattgttgatgactggaaattcgattattctagtcatgatactcgccgtatggtttgcaatgaccaggctgaaatgaccggtagattgctggccggatcattgacatttgataatcgcatcatgcactatataattatcgactgggctcacttggttcagtaccgaatgcataaggcattacgggccaatgcacctcttccatatcctcaattgatcactctctttctctgtcattttcaaattcctcttgatgacgaaccttttgttcaagtcaagcgttcctttgctataagtgctggtgcagtcacttcatttggataccgtaaggatcgtaatgatcaatggctgaagaaagatgcacttcctcctcaagatgagcgtactccttctcctcctcctcagcgagatgattcagcccttatgactgaagttctttccgagttacggggtcttcgcacttatgttggtgaacgctttgactcttcggataatcgctttgtaggaatggatatccgtctcacacagcttgaagaggatgtgg

SEQ ID NO: 79780 - DNA, 210 bp, Glycine max
  Peptide Sequence Number=SeqID_171465
atgtcagaattcacaagcaattttcctcctcgaatattagccagcctgcaccaattagactttgcaccatatgtttcagggtcacacaatgctcaatggaatgccccggaactcctccatgataagcacttgttgcattcgagttatatcatcgggaaaatggaggttgaggaatctttgttgggattatggctaccattgcattattga

SEQ ID NO: 79781 - DNA, 681 bp, Glycine max
  Peptide Sequence Number=SeqID_171466
atgacgacatacttaacactgccattagcggggtttggtgtgacgattagtcagtactatggaagggcatcgcgtgcctccagcaactcctccatatccatcagccaacaacagttggctgagatgattggaagccttaaggaacagtggagaaataagattatcggaacccttaaggaagaaatgaggagtcaggttgaagaaaaaaatagaaggagcttggagaaaatgaaacaagagttgaaagataccacaaaaatagagttttcacaaagaggatcacaatactcacccccaaatgaggctgacatacaacaattaggtgcacgtatcagcacaaagggaagtaatgctgaaactggtgtcaacctttcagtggaagatgttgctgatgtcataccacgtttatggatgagtggagttcaagcttcggtcatggttccgtgtatgcattccttgagccacagtccttgcacaattcaccttcaaaccgaaggttatgaatgtagatattacgtgatgcattggatgtggaacatagtaagtggggagttgaagactgattggaccatgtggtttggtgatgacacaccgttggacaaggagaccatgacaacaattcacaagaaatgggcaacttattttttaaagcataaagagacgcggtgtaaaaaggcttaa

SEQ ID NO: 79782 - DNA, 1059 bp, Glycine max
  Peptide Sequence Number=SeqID_171467
atggccacaagcctttggattatgaaccgggccggttgccgcgtcgttcgatgggccgccacgaagtccggtgacgatgagttcacggcaaagtcggggtacctatttgagctgagcgcgacgaaggcggattcgctagggaatactagataccaaaaatcgcagccatatgctcgcggaagcctctgctcatggctcgccacttggtgcaaaccagcgtcgcattcgggaagtggttcggtctccgctacatcgatactctcttggaccgctccgggtcaatgtttcaggcttcataacgctcttgctctgggaatgaactatgtcttcgctgaaagctgggctcctcaatacggcaacactgttttgtctaagtggcccattaaacgctggaagctacagaaaatctttgatcaccacgattacagagtggccaatggattggactgttttgagtaccctgctatcagctgcagaaaacacagtgcagttttgactgattttggtggtgttggtgatggaaaaacatctaacacaaaggcctttcaatatgctattagcaatctcagccactatgcatttgatggtggagctctccttgttgtgccaccagggaaatgttcgtctttgtcgcaaactgacctgcgctttcgtgactgcaaccacattgtggagttcgtctttgtggagttcgtctttgccacttatcgattgagggtactcccagggcgttcttcttctttctccttctgcctgagttcgtctttgtcgcaaactgggctgcgctttcgtgactgcaaccacattgtggagttcgtctttgtggatttcgtgtttgccacttatcgattaagggtgggaatcgattttggaagtccattgtgcttggctttaagactcccagggaagccatcaaagtgtggtgccttgtctgataaagagtgtggtggtttgagctatgatgatgcttggaatgcatgtagtaatcaaaaccgggaccattttcatcatttggttggtttcctcaacttgagtcacaatgcaaagcatccatggtga

SEQ ID NO: 79783 - DNA, 402 bp, Glycine max
  Peptide Sequence Number=SeqID_171468
atggattatgctgcgatggttgttaagcgtctcaaagtgatcaaccaaggtctgtacaccgacaacaattgtccccggacaaaattaggggtgcagatagccgtgaggtgtctctgcgtgtcatcagacttgccatcttcggatgacgaggatgaccatattggcctctgcatgtcatcgtactttccgtctccggatgacgagggtgcggataaccgtgagggagcagatgaccatattggtctctacgtgccatcagacatgccatctccggatgatgagagtgcggataaccgtgagggccagggtaaaagttctaatcctgggtcaaggtttatggtcgaaggattgaggttttggctcaaatgggcttgcggaaggtcagacgtgacatatgtcagg

SEQ ID NO: 79784 - DNA, 612 bp, Glycine max
  Peptide Sequence Number=SeqID_171469
atggtgacgtattatggatgcaagctaagcatgtttcagaacatgtttggaatggagaagaagaccggaaattacacatcagacgagttgtccccacagagatgcgcagcgccaccgattacaaaattaaatcaatcggagtttctgtgggagccttacacaacaaatgttatgtcagtgttgcctccaatttgtttggttggtagtgtaacgtggtgcgcggcggtgccactcatttgtttccatgttgttgagtggcaccaacccgatagagtgttgcgacaatttggaatgcaacaacctattcccaagcgaaaaacgaagatgtttgtcgacccaaagaatgcaaacacagctacattggctgaagttgtggagacattacagtatatggtgtcaccacaagggaggaacacatggacagttgatgatctcgtgccttatgtggagaagataacgattttatctgaagagcaagagagaatcactgagcctgtggcacatggtctagcatcagagcgtcgatttccaccacaagagtttcacatgcttcagtcaagtgttgaaactcgaggttttgacagacgaagggaggctgttgaagcgcaataa

SEQ ID NO: 79785 - DNA, 62 bp, Glycine max
  Peptide Sequence Number=SeqID_171470
atggacctcagatcgactgcacaaagatgcatgcacctgactcaacactcagatgcaatgtg

SEQ ID NO: 79786 - DNA, 1382 bp, Glycine max
  Peptide Sequence Number=SeqID_171471
atcatagtcaaggatttactcatctgataatatctgctcttcgccgattcctgaaaagatcaacaaccactacagaagactcattggaggtgaaagacctagttgcccatctacttgtagatattatttggggccagatcgatcatgatgaaaagattgtcctgaagctactcgagatttttgatgtaaaactaacaaatgttgagaaagcaatgtgtcaaattaaggaaaaacatgatttaagttgtggtacagcaaaagaatttgttgaacagtatattgttgagttggtaaaatcccagttgtacatgacagctgtcactttaatagagcaattctctgtctaccagtatggccagtcttttctccttgatatgatacagagtaatcaattcaaagccgcagagaagtgggcaacatttatggggaaacaaatgctatccacacttgtagaggagttcattgagaggaacatgctaaagaatgcccatgagattataaagaaaaataatctaaagcaggattttcctgatgtatacaaaaggtgtaaagaaagctcactaaaaaacttggcagaaaaaggatgctgggaggttgctgaggcaagaataaacaatgatagacagcttatggaatatctggtttatttggcaatggaagctggatacatggagaaagttgatgaactgtgtgatcggtactccctatccaggtttttggacatcaatgatgacaaacacaaaactgctttatttcctgcagtacctgaaacaagtaatctgcaagggcattatttaaatcttgatgaattattggttgaaagcatcatttgggttgatgaagttgaaggtttgcttgatgcaacaaggcatattgagggttttaaagttataggtcttgactgtgaatggaaacccaattatataaaaggcagcaaaccaaacaaggtttctatcatgcagattgcttctgaagattcggcttttatctttgatctgataaagttacacaaagaagtgcctgacattttagataactgtctatctcgcattttgctgtcacctagaattctaaaacttggctataatttccaatgcgatgcaaagcaacttgcttattcgtatgaagagttgagatgtttcaagaactatgaaatgttgctggacatccagaatgtttttaaagaacctcggggtggtttggctgggcttacagagttagaatacgctgctctggatgctgttgtacttgttcacatattccgccatcttccttgtcaaggacataataaagataaatctgagtggaagtcttgcatcgtgtccctcaccgaaaacgccaagaaattcaagaaatgtgtaccaaagattgtagacacttga

SEQ ID NO: 79787 - DNA, 276 bp, Glycine max
  Peptide Sequence Number=SeqID_171472
atggcctgtgcatgcgttgaaggtgtctcgcaggaagcaatggcggcattgcttacgtggaagccttcttacccgtgggagcagcgagacaaccttctcgccagtgggagcagcgagacagcgtccacgtcaactgtctcgctaagcacaatggcggcaccctcttccatcctccacgtcaccaagcttctcgccactgctgatggcgcatttgccaacaaattttgcttaggaaagagggttacaacttacaatgaccagcaaatcaaagtctga

SEQ ID NO: 79788 - DNA, 565 bp, Glycine max
  Peptide Sequence Number=SeqID_171473
aggatccccttatgttgctccctcagggaatgatccagggacgggtgactcagacaaatgcggcctatatattgaagaaaattcttcccgcttggttgccctaggaagacgttacgagggatccacaacagttcacaacatcccattgttgcatggccaagttaaggttggtgttgaggaggttaaagatacagaggctctcgttcttgtgcccactgacgaagttaccttagtggggcaggcacttaacactttccttgcttggccaacacatcttgtgaagcgtttatcagaacaggcagctgtgtctccagcaaaacctccagaaagcccggatgaaaaggtcgatgatcccctgtacctgatgacattgaccatcccacaactgtttttgaagccgctccaggttatgtgggatgctaccatattcgggcaatatgatgaccctattctgatagcagagggatattatgagtccgtgactaaggaggtggaggtgactcttctctggtcgtggtgcaaactcccatccaagctagggatgctcatctcatctgaatattaa

SEQ ID NO: 79789 - DNA, 702 bp, Glycine max
  Peptide Sequence Number=SeqID_171474
atgttgaagctcattgcatcctcgcgcatccaccgggtgcaccccacggtgctccgtcccgcacaccattccgcctcgccgctgctcagagtgctgagttctctcggcgggttaagctggagaaacgctaatgttggaggcagtgtagcaaaaactgttttggcattaccattgatacacagaccacttttcccaggattttacatgccagtctttgttaaggatcccaaattattggcagctttacaggaaagtcgagaacgacaagccccgtatgctggtgctttcctccttaaggacgagccggaggctgatcccagtgtagtatctagttctgacgcagataaaaatgtatatgatttaaaaggaaaagagttgtttaaccgtcttcacgaagttgggactcttgctcagatttcaagtatccatggggatcaggtgatcctgattggtcatcggcgtctacgcataacagagatggttagtgaggatccacttactgtaaaagtcgatcatctcaaggataaaacttacaacaaagacgatgatattataaaggccacatctttcgaggttatatcaaccctaagagatgttcttaaaacaagttccctttggagagatcatgttcagacttacactaaggtttggacccttctctgtatgtgtttattggaacatggaatcggggtaagggattag

SEQ ID NO: 79790 - DNA, 120 bp, Glycine max
  Peptide Sequence Number=SeqID_171475
atggcacacttacttatttgccagctcttggaacataaaagacatggtgggaagccatgtgaaggtgtggtagtgagacaggagatactcttgactcctgatcgttattacaagacataa

SEQ ID NO: 79791 - DNA, 2886 bp, Glycine max
  Peptide Sequence Number=SeqID_171476
atgcccagttttcatgttttaatttattcttctcaggacgagcctccaagtgaaagaaagattatcaaattatgtgaatatgctgcaaaaaaccctttccggattccaaagatagcaaaatatcttgaagaaaggtgctacaaagaactcagatctgagcacatcaaactggtcaatattatagcggaatccttcaacaagttgctttccatttgtaaggtgcagatagcgtattttgctgttgatgtgcttaatgtaattttggagctcttgagctattctaaggatgagaccattcagacacttggttgccagtgcttatcaaggttcatctactgtcaggtggatgctacttatactcatagcattgaaaagttggtgcggaaagtatgcatgctatcacaggaacatggtgaagcacgtgaaaagcgctgcttgagggcatcaagcttgcaatgcctttcagcaatggtttggtttatggctgaattttcacacatttttgtagattttgatgagattgtacattccgctttagataactttgattggagtagacaaaatgaagaagctgatgccagggaagaggcacatcataattgggtggatgaggttatccggtgtgaaggtcggggtggttcagttattggtaatgacaatcgctctagttgcttgatcatccagccacgacctgaagtaaaggatccttcccttttaaccagagaagaaattgaaaatccagaaatatgggctcagatatgtattcaaagaatggttgaattagccaaggaaagcacaactatgcgtcgtgtgctggatccaatgtttgtctactttgactctagacaacattgggctcctcagaaagggttagcaatgatagttttatcaaggatggcctacttcatggagaactcaggaaatcagcgcttaattctagcttctgtgatacatcatctggaccacaaaaatgtcatgaatgatcctcaacttaagacctgtgttgttcaggttgccacatctttagctatgcaaataagatcagggagtggcttggcagagattgtttttgttggtgtcctttgcagacatcttaggaaaagccttcaagcctccagtgaatttgttggagagcaagagttgaacttaaatatctcacttcaaaattccattgacgactgcttacaagaaattgccaatggggtaattgatgcccagccactttttgacttgatggcgataaccctagaaaatattccatctggtgttgttggtagagcaaccattggatctctgatcatccttgctcgtgcactcactttagcattaagccgcctacattcacagcagggatttcctgaagctcttctagtgcaactcctaaaagtaatgttgcatttagatgtggaggctcgtgttggagcacaccttatattttccattcttctttttccaagttccttccatacacatgaaatttcctctctgcggtccagatatctaggtcaacacaacaaaaggcattctcatgctgcatctgtgtctgcatctgcttcaattacagctttacttgaaaagctccgcagaaacagagatagcaccaaggcagaaaatcatgggaatattgttcatgatcaagaaagggatattgtggcagaagattggaaccagggctgtggcttaaagaattcccctaacttttacaaattcacttctatcattgatagggctacaggatcaccaagtttgactgacacagaaccatatgttatgaaactaactgaagatcaaatggcccagctgctttctgccttttggattcaagccaatcttcctgataatttaccttcaaatattgaagctatggctcattcattcattttgacactaattgtcttacgcatgaagaacctgaaagacagagataacctggttatccgcttcttccagcttcctctgtctctctggactatgttgttggaccaaagaataatgccccctgcttgccagaggtctgtctatgtattgtctgctggcatgttggcgtttgcctgcaaaatatatcagattcatgatctgaatgatgtgtttgcgtcattgccaatgtctgatgttgatccattcttgagtgtcagtgatgattatcatgtatatgctaagatccatgtggatgtgagagaatatggtactgctgctgataatcagttagcatgttcaatgttgtcagagttacagaacaaaatacgggaatgtcaatcgatcataagggatgctttggttcataatttagctaacgtcactgagctggatgcagatgaactggctatgctattgtcagagaaattcaagcctgatgaagagtttgtgttcggtccacagtcaatgcttgatcagaatcaaataatttttcattcccaggagtcactgtcatttgatggggattttccctcaaattcagcaggtggtgaagatgacacaatcagtgaagcatctgtctctgacctttctcgatttattccaaagatgccaatatccccttccgcacctcaagttatcagcattggacaacttatggaatcggcattagaggtagctggtcaagtggctggaacagctatctccacctcgccccttccatacaacgccatggctagtcagtgtgaatcactcgggacatgtgcaaggaagaagctttcaaattggctggcctttgagaatcattacagccaagcacctgataaatcgtttctggcaattgctgatattaggaactcagcacttgagaaggtagcaaatggtgttgggcatgcccagctgccaagggacccaatgaagctgcctccggcaagcccttttgacaatttcctcaaggctgctggatgttag

SEQ ID NO: 79792 - DNA, 270 bp, Glycine max
  Peptide Sequence Number=SeqID_171477
atggagaccaaagaggagaggaagatgatacttccatcgccatcggagacccaactcatgaaccttgttaatgtctccatcaccaatgcaagtgctggcgagtcccatgcacaaaacgcagcagctatgtactcagcctcagtagtagacaatgccactacaggctgttttttagaagactatgaaactgctccagaaccaagtaagaatgcaaagccagaagtgctcctgcgatcatccaaatcaccaacaaaatcattgttggtgtaa

SEQ ID NO: 79793 - DNA, 528 bp, Glycine max
  Peptide Sequence Number=SeqID_171478
atgttccggatcaacttgatccagaaaacgcttaaggatcacctgatccgtaagctcctccaagcttccctactccgacatcaatggcggaaacagaggacagtggcgcttacctcgacggtcgacgctgacgacgctccctcgacgatggacggtgtcaaaaccctgcacccgaaggctgaagcgagtgggagaggcagcaagaagagaaaaaggggaatggcatggttgcagttgcagagaatcatcaccaataccaagggaggtgctaatttgatctcaccgctcccacgattcttctcgaaatgttccccctatgttttgaaagttggaataccagagtttctaaacgggattgggaagggggttgagtcccacgttcctaagcttgaatctgaaatcggtgatttccagaaacttctcgtcattcgaacccttaaactcaagaagctcggtattccttgcaaacatgtaaagaaaaacgatggagagagagagattgctgagcactggcatttgagagagtaa

SEQ ID NO: 79794 - DNA, 771 bp, Glycine max
  Peptide Sequence Number=SeqID_171479
atgactcctgagagtttctacttgaaactcgccgagttgttggagtcttctggactgagtctcattaaaggtgatgttgtgaacatgaaagttatgaataatgctctattttccaattctgcttggcagtttcaatgtcagagaaacattgctggacttgtacctgttttacttggaggtgaccagaagaggaggatatcacccggtccacttcagaagaagcggaattcaacagctagtttaccttatataatggatattaaagatggtatgaaggtcacagagatctccaaggactactcttgccacatgacaaggactgggtatgtggaacagcctgtgcttttacctccaccctcaaatgccttagatggccagaaaatcctacgtttggctattgatacatggaggaatatgtctgaaattgagaaacagccatatgtggaggaaagcaagaagaaaaaggaagaaattaaggaagcaatgaatgaccacaataaacagcaaatcacccaagataccatcagggaggagaagtggcatagtctgagtggtgattatcttgtaacttcacaacctgagacagataactcccttttcaacaaagccactgttgggttagctcttaaaatgaccgaaaaagcaccaacagatccttcatatctaatggactggaatgcttttttgttcactggattttcccaattagggaatccgagtaactccactagtctagttataggtaagttattttttgctcagaggccatga

SEQ ID NO: 79795 - DNA, 318 bp, Glycine max
  Peptide Sequence Number=SeqID_171480
atgcagaccattcctgctcctcctgttgattcatggatgtcgtatgatgatatacacgataggtggatgcactactcggatcatatcgttccagcaggtgagatgtgcgctgtgccaggtcagtgtgccagtgactacatggactggttcttccgcatctcgcatcttttcatgacaccaggccacgcattagatcctctgcctgatggtcatgccccgcacccccgagtcgtccctctggccccacagacggatatccttcacgtgtcggagctaggagcatcgtcgacatctgtggaggagtctagacatgcagtg

SEQ ID NO: 79796 - DNA, 273 bp, Glycine max
  Peptide Sequence Number=SeqID_171481
atggtacaagtagatggtacatctacttgggttgttgtaactgagaacaagagagggtgcatctcttgtggatcagttcaagtggaaggtacatccacttggttgttcaaagagaacaagagagggtacatctcttgtggatctttgcttgtaaaggattttataaggttgaaaagaaatctcaagcaccgcaggtcgcctggattggcgaaagttaccgtgattccattattgatatatgagatgtaccatgttgttaaggtagaagactaa

SEQ ID NO: 79797 - DNA, 1005 bp, Glycine max
  Peptide Sequence Number=SeqID_171482
atggagtgtgtttcctcaaatgctcagagatggggtgaaccccactgctttcaccatatcatcttttttgaaggcctctgtaagggtttgaaagctcttccatgtggccagttagttcatgctttggccttcaagattggtgtccaaggatcatccatatatattgataatgcacttatggatatgtatgccacttgttgcaataggatggatcatgcaaggatggttttcgatgatatcacaaccaagactgatgttaccaggactacttttatcactggcttctcaattgcagctaaagcttgtgcatcaattggatcgggtattttgggcaagcaggtaaatgctgcagtggttaagcatggatttgagtccaaccttcctgtcatgaattccatactggacatgtactgcaagtgtcattgtgcatctgaggaaaaacaattattctctgaaatgactcataaagataccatcacatggaataccttgatagctggatttgaagcattggattccagagagtctctctgcatattttctgcagtaggtgcatgtgctaacttagcagttctgtattgtgggcaacagcttcatggtcaaaatgctatgcacaaatttgtctcctggacttcaatgatgattgaatatggggatcacggatacggtaaagaggctgttgagttattcaatgaaatcgtcagatcaggtattaaaccagataagatggtatttatggcagttctaagtgcttgtagccatactggactagtggacgaagggatgagatattttatattaatgaccagctattatgatgtaacccctgatatagaggtatatgaatgtgtggttgatttgcttggacgtgctggaagagtaaaggaagcttatcaactaatagagagtatgccatttaatccaaatgagtctatctgggcagcccttcttggagcttgtaaagtgcataaacaacccagtgtggccaaattagcagagctttga

SEQ ID NO: 79798 - DNA, 312 bp, Glycine max
  Peptide Sequence Number=SeqID_171483
atgactaccaattataacattgtttggtttggtcccaaactagatggaaaattagatttttactactgggaggctttgatgagaacacatttgagagctcacaatctttggagttttgttgagatgggactagctaaaggaactgatgatattgctcggaggaaagacccgttggtgctgccgcaaattcaacaaagggtagatttttcaatttttggaaaaattgtaaatgccaaaacagcaaaagaagcgtgtgatatcttgaagctgtcttacaagggagtggaaaaggcccagaagttgaagctgtaa

SEQ ID NO: 79799 - DNA, 195 bp, Glycine max
  Peptide Sequence Number=SeqID_171484
atggagccagcggaagaaggtgttcttccgcaggctcctgcggaagaaactaaaaaggttcttccgcgaatgccagcggaagaaggtcaagaagaagaacttcgtcttcaacctccagcaccaaacaacaacaatgtcatctatcctaaggccattaacgcgattctaacagatatccaaagccaatggagttag

SEQ ID NO: 79800 - DNA, 117 bp, Glycine max
  Peptide Sequence Number=SeqID_171485
atggcattcttagggagacttcgtcctctagacgatcgtgaactcgaggttgacattcatttttcgaaatggaaccgtcattcacaacgagtgtgggaacaacagatgcaattttaa

SEQ ID NO: 79801 - DNA, 267 bp, Glycine max
  Peptide Sequence Number=SeqID_171486
atgaaacgtgtactactctcttatgaaccaaatcagatcctatggaccagggataagcacttcatggtcaagaaaatgaaagcaattaaaaacttcattcctccgtgtgaacacgaagctcaatctggttctgatttgggacaaattagtaaagcagagaaacagattgagaagggtttagggttgagcgaagaggttaggttgggagtttccgagcctggtgggtttggtgtgatgacaaattccaaagctacagctgggatttga

SEQ ID NO: 79802 - DNA, 1854 bp, Glycine max
  Peptide Sequence Number=SeqID_171487
atgggcggaggaggcggagcggcgacggcgcaggcagaggcgcagtactcgacggcgaagacgtcggtgtggtgggacatagagaactgtcacgtgccgaaaggatgcgatccccacgccatcgcgcagaacataagctccgccctcgttcgcacgaactactgcggccccgtttccatctccgcctacggcgacaccactcgcatcactgccgtcgtccagcatgccctctccagcaccggcatctccctcaaccatgtccccgccggcgttaaagatgcaagtgacaagaagattctggttgacatgctgttctgggcagtggacaatcctgcacctgctaattacttattaatttctggtgatcgagatttttccaatgcccttcatcagttgcggctcaggaagtataatatccttcttgcacaacctcagaaagcttctgcaccattagtggcagctgctaagagtgtgtggctttggactagtctcttggctggaggaccccctcttatgaatggtgaatcacaacaacttggtaataataacatccaatcatcttcagacaccttacctattcctgtctctaatgctgttcagataccacagcacatgggttccttttcagaagttcatgcaggaaatcagaaatttccaaacacaggaaggcaacttgattctagacatcatgggaaaacgaatgggagaaatccaagtaaaacaaatggacccaaggccctgaatccagctccagaaaattatagcaatataaattcttctcaaactggcaactatacccataatgttcccccaagtggatctaccccaaattttatttgtggcaatcctgatcaaatgcggggcaagaatggtaatctacattcacagccattaagatcaaactcttttcctttgcaacctccttttataccaaataattcattttctccaaatccccaaacttttgcaacttcagtagtgccacctagaactggtggacccagcttctctgcagcaccactacttaatgtaccaaatattagcaatcggaaaatttctggatatcctagtaatgctcatgatccacgccctgttaaacaatggaatggagacttgaaacaaagttctaacaataatgctccaagtcctgtaaagtcaattggcgaacaaactggacatatggtacagaacacacaacaattgtataatggccatccacatggtccagaataccaacctacatcattgacaactatgggtaataataaccttcctggcaatggtatatggggatctccaggatgccctaaaccttctgaatatgtccaaggtcttataggggttgttttacttgccttgaacacattaaaaattgaaaaaattatgccaactgaggcaaatataacagattgcattcgatgtggagatcccaagcaccgcaacacagacgtcaagaaggctctggagaatgctattgagcagcagatggtggtgaagcagaatgtaggtgctttgcagttgtttattggtaagaatgataaggtttggaagtgtgtaagccctgtaggtggtaatcctaagaagcactcaaaagagacatggaatgaaattaaaaaattcctatcaactccttctggaagattagtcataatgggtactcagtgcaagtatgaagcaggtattgtgattagaaatatgtgcttgaaaaatcatgctttgggtgatgtcctacagattttgaacatgttgattaccattaaaaaatggattgtgcatcaacaatctggctggcaaccacttaacatcactcttactgaggtcaattctgattcagaggacatagcatgcccatag

SEQ ID NO: 79803 - DNA, 387 bp, Glycine max
  Peptide Sequence Number=SeqID_171488
atggtgaaggataggtgccctggtgctgaagaagctcttatggcattggttaacacatttgagagtagagattttcaaaatgctttgtttgtttataaagagatggtgaaggcatccaatcagattgagttggctttagatcaatttagaagaatggagaataaagggtacaatccgaatagcaagacctttgagattcttgtaaagggtctcatagaaagtggtcgagtgaatgaagctgctactaaacacataataaggtttggaagagaagttgaaggtttgaagactctcattcagtgtgttatacgtgttcagtgcgacgcagtcgcgggtagcactcccttagcgcaaaaaagtcacatgaagaagcttgatatcacgtga

SEQ ID NO: 79804 - DNA, 162 bp, Glycine max
  Peptide Sequence Number=SeqID_171489
atgccagatggaaagaatgctccgggaatagttacaagagcaacaaaagaagaaaaggagaatcagggttgtcaatccccaagcgaagatgaattgtattgtatgggaattgggaagcacgcttctcagctactttttgaccccgccaagtcacatgaataa

SEQ ID NO: 79805 - DNA, 588 bp, Glycine max
  Peptide Sequence Number=SeqID_171490
atggagaacggcaacggcctgtctcctgcgagcttggcctccaccgatctcgacatcgatggagaacggcaacgacgtttggaggtaggtgtagttgcggtggagaatggtggtgacatggttcctatagaggccccactccatacccttcgtcctcgccttcttcctcttcctcgcgtagatctcactcggcctccaatgttcgacgcttccaaggtcgcaaaggacaagcacggttggatctttgatcctatcgctctcgccctcgcttttggcatctcaagcggagcagtgacgtgtggatcgcttcacatgggagaaattagggttgggaacaaaagagcgaatcaaagacaccacatttgtaatgagactttccttatttggggtgctactaccaagtttaggcctctaaaggtatatatacttttcttcacatctcaatatctcatcattatgggacgtgttgatggacacaatcctcatatcaggaaggatttgcccttgacttggactaatgtctatgaggaggccactaattcatctgtatcattaagtaagaggaaattggcctttgcattttcctag

SEQ ID NO: 79806 - DNA, 288 bp, Glycine max
  Peptide Sequence Number=SeqID_171491
atggtgtggataacgtacagctcaggtgctggaaaattgaatataaaggaaggaggcgtgttagattggtgcatattgtcgagtttaggtgcagaaggaaccaactgcagctgcatggagtggacgatgtaccggttaagttcatcacaggagtatatcaacgacggtggtttcaagaaagatgtgccatctttggaggaagtggtcgtgctgaaagggatttgcacacttcaacaatcacatttatgtgccggtttcccagggatttcaatgttggaacgcgaataa

SEQ ID NO: 79807 - DNA, 468 bp, Glycine max
  Peptide Sequence Number=SeqID_171492
atgtcagcgttcatttcccacaaccttaaacccggcggcatcatggtgtccccttctctgcaccaccgttcctcattccctttgcaactttctttgaaagcacccttctctgcttcccatcctttagtcctcacccgaagactcttccttccttcggtttccggcatctgggacgctctcaccggcggcaacaacaacaatgcccgcgaagccgttctcgcaattcgacgcggaatgcttcttttccgccagggtgatgtttcggggtctcttgcggagtttgacaaggcaattcagttggaccctcgtcaaaaggcgtgtagatttgaagaggcagctgagcagtttcggttagatgttgcccaaaatccaaatgacactgaagagtccatatggtgctttctgtgtgaagctcaactgtttggagtggatgaagcaaggaagcgatatcttgaggcaagtccttga

SEQ ID NO: 79808 - DNA, 570 bp, Glycine max
  Peptide Sequence Number=SeqID_171493
atggcaggtggtaataggcaaaagaagtcttcttcgggtttcttctctattttcagcatcttttcatcaaggaagtccaaaggagggtactctgatgcccctgattcgtggcgcagagtctatcctagcgattacgacaaaggtaactggggtgttgctgaacccaatattgacatgaaagctgaagctttcattgccaagtacaagaaacgtgtttcagaatctgcactctatcaacttgatccagctgctgagaatgcttaccaatctttattccttcctaatgttatctaccggattatttgccctttggcctttgggcaaaagaagtcatcttcgggtttcttctctatgttcaacatcttttcatcaaggaagcccagaggagggtactatgatgcccctgattcgtggaggagggtgtggcctagcgatgatgacaaaggtaattggggtgttgctgagcccaatattgatatgaaagctgaagcttttattgccaagtacaagaaacgtgtttcagaatctgcactctatcaacttgatcctgctgctgctgagaatgcataa

SEQ ID NO: 79809 - DNA, 264 bp, Glycine max
  Peptide Sequence Number=SeqID_171494
atgaaaattggttccaactgttggccccaattatcagtcagtggaataatcgagttgagttttgggtcgacgcaatgggatgtgcccggagcaatacctgatatgggtgacttattaggtgttgatttgcgtcatgagttttctgtagaggctgagcaacaagggtggagacaacgcgcaagaagaaatccagatcgtcaagcccgaaggtgggatcgaccatgtggcacatcctcacgccatcacggacaccataatgactga

SEQ ID NO: 79810 - DNA, 225 bp, Glycine max
  Peptide Sequence Number=SeqID_171495
atggctacatcgcatgcagggaaacgccctaacctccccaccacttctccttgctcccccagaagcagaagaggggatgatcacagtgactgggataggctccctagctggggaagcagggaaaggctacgtcagcctgtgaatgtatgtatacatgattttgatgatgtcaaagaagaatctaacaaggctgcttcaaatgataagcatttgcttcaagaataa

SEQ ID NO: 79811 - DNA, 861 bp, Glycine max
  Peptide Sequence Number=SeqID_171496
atggttaaggagtccgggatcactgttttatcagaacaggcttgcttggcagatggtcaaagcttgaattggagacccttcctctattttcatgatttgagtgccttcagccactatggggtgagacttggcaagctccctggtgggaggataaggtgtcatattcagttttttttttgcgtagcattgtcgtgcttgtttttgatcttccttgatggtcataatctcctccgtcagggtggggaaattcatcttcagatgcagtggggaaattcaatctcctgccaatcaaagcaaagtaagagtggagatgtcctagtcgatgaggaccttggacaccctgaagttgtcgattatgatggagacaaccatggggtcgtcttggttgatagggttgatacccttgaagtctctatccatgaaattgatgtcgatgtcccagatggcgtggagctggtgcttgtgggactggctgaattgtcctttgtaggagaatccgcttgcaatggtgttgatcacccttcttatttgttgggtgggttcatgttcttatggcctagtagtgttctatgttgtgatcgataccgcgatggtatctacagtatttggtcgcatctaacaccgacccgtgaaaacttcctcgaggatggtagtgcgattggccgtcaggagtatgtaacactcgtatctaggcccttttgggagaggctgacgcttttttccaacttgtctgacttggttcttaaatttggacatttttttcatctggatgtagcccttggctcgttcatgcaactcgtccatgctactaggaattttttttgcatagactgtatgcaaacttgccaagcctcaaagtga

SEQ ID NO: 79812 - DNA, 159 bp, Glycine max
  Peptide Sequence Number=SeqID_171497
atgattgtgatggtgactactacggtagatatgacgtataagaatggcaaaactgaactcttaaagatatgggcattggatagaagactccaagaagattgggccaaagatgcaagagaaggccctagggttctcatgagccttagggtagatttctga

SEQ ID NO: 79813 - DNA, 330 bp, Glycine max
  Peptide Sequence Number=SeqID_171498
atggaacctacaaggggccctttctgtgatgaatcagatggtcaaaaattccctgccaaattggttgttggtttaggaatgaaggctatgagagagcagtcatactttgtgaatgttcagtctgtccattacatcttcttgtggctagctaaaagtaatcaggctaatttaattattttaaaaaccaaaaaatgtgcaaggataaatcaaccaaaatctggaaaggataacctaactctccctttaactttagggaagataacatattcttcttctactaagagagagaaaaagataagactatgtccaaatgccttcttaaatatttaa

SEQ ID NO: 79814 - DNA, 1689 bp, Glycine max
  Peptide Sequence Number=SeqID_171499
atgacgagggtttatgggagaacattcctacttaactgcgtaagcacaaagctgatggcatcacccctagggtccccgccacattcagagaatcctctagaggttacttcaaggaggactagacaatccaccaggctaagaagcctgactactagaagcttagataacccacgaccaattgttaacgtcaatcctactactagtagaggctcagggccccataaagaaaaatttcacagttatctaggggttgtggcaagagaaaaaattccgattgtccactcgaattggagtgttgtaccggacgatctaaagaccctaatatgggaagatattttgtcttccttgacatctagatttgtctatgctgacaatgagggacaacaaataactgatcctatagtgaaatacggtcttgatccagcaatatgggccgaattcgcaaaaagctgccagacccctaattggcagggaatacaaaagatggcgcaggaaattcagaaatacaatgactgccctcactcactatctcgtggggtttataatctacttgacaaaaaacttatggacaagaagaggaagcaaagagaacattatgctaagtttactaaaaatccttcactcagccatgaccctccatcccaagtgtctcgattgttgaagtggaagatggcccgcacaaagcgttatggccaaatgacctctgcagcggcacaagaaatttcagacaaaattgtcgacctgaacatccaggccatgttcatgttaaaggggcaggatgagatacagaaagaggtagaagaagaaaacaagcagctgcaggaggcttggcagagagcagttgaagatgaacacatacgcaatttggagagaatgaagcaagacacaaagggtagctgtgctgatccaaaggcaaaaggattacctatagagccttctgatgttgttgtggatctaatgggcttgtatgtagtacatgatcagagtactatgctagtggccttgggaatagtgtacgacaattcatccaccatacacaatgttccttatgcagatgatgtgcttagggtgaatgttgtcacagtttaccacagagaagctctggtcccttatcctacattagaggttcggtttgtcagccaggccgttggaacattcgttgcatggccgacccatcttgtgaaaaaagtatctgatgagttgatcccctgggagaattggttaagagtccgtatgacgtttatcaaaaggctatcgagttgtcgtgggacgggtacaagcataggttttgctccagcttatggtttccttgagccccagtctatacaccacgcaaaggatagatgtgaagaatgtgaacaatacatagaaagttgggtcaaggaatcacatcgagaagtgtacttaggaccttacttgaatcatgtagtttggttttgttctctacggaaaaagcctgatcttcacattaaggccgcagttaacagtcatgtacaagctggaggctatgagtgtggatattatgtgatgcattggatgtggtgcatagtcagcggcggtttgaagaatgaactacacaagtggttttatgatggaacaccattagacagtgacaccatgacgacactacgcaagaaatgggcagcctattttctacaagttcaaaagaaggatgttacacaagtttag

SEQ ID NO: 79815 - DNA, 510 bp, Glycine max
  Peptide Sequence Number=SeqID_171500
atgaatccaaaaccggtagaagcagtaccagcatggtcaaaccaaattatcttcaatgcttcaaaggaagctgaagaaggaatagcttatcagtggtcttacatggctgagaatgagtgtaagtgcaatgaccttctggatcctggagttgaagggggttgttgcccgcatagaaaagaatcaaagccgctaaattgtagtagtgcatcacttttcttgcacaattactttgcaacagtttctaaaagtgcaaagaaacttattcgtgaaagcaagatgttcttgaacatgattgttgccaacacatttggagcctttgcaattatcacagttgatgcattcggtggtttcattctgtcaaaaaaaaagcaatgcaagcaagttttattaataagtatgcatctgaatgtccatgcaacatttgataagccacaagaaacaataactgaagatgaatcatctaacgaaggaaccatagcagatattgaattaccatgcataggcatctaa

SEQ ID NO: 79816 - DNA, 234 bp, Glycine max
  Peptide Sequence Number=SeqID_171501
atgtctgaagaagttgaaatgaatgtcgaaaatgaggaagatgctggtgttaaagttgattgctctgatgtctttaatacttctgagccagtttcgggaggagacgattggatggtgaagttaatttgtgggattcacaatcatgaaatggcaaagtcattggttgagcatccatatgcaagtcgactgacaaaggatgagaagattgttgttgctaatatgacgaagtccacg

SEQ ID NO: 79817 - DNA, 147 bp, Glycine max
  Peptide Sequence Number=SeqID_171502
atggttggagcattcttgcaaaatagagtgaccctggctggtcaccgtatgattttacttagtgagagtgacatgatgactaggtggatgactttaaagaacctcgggctagaggacgctgggacacaatgctctgataggatgtga

SEQ ID NO: 79818 - DNA, 393 bp, Glycine max
  Peptide Sequence Number=SeqID_171503
atgaggagggcatgcaggaaaatatggcgatcggtgccttgcacgagcaggaaaagcttgcgaaccgactcgaggaaggacatggaggagattctgagggctaagctttcaactattaaggaagaaccagaattgtgtgatgagaactttgcatcaccaagacatgtgcgtttggccaagaaacaagggaagaaggttaaaggaaaagataagacagggcggtgtttagttccacatgttaatctgaaacaatcttatgtcctatttattacagggtttgcatccaaagatttggctaacttttgcataatcaataactcaaatagttttctatatgcattatgccagcccacattggaggagactgaaagaaaacaagttagagccctttag

SEQ ID NO: 79819 - DNA, 3399 bp, Glycine max
  Peptide Sequence Number=SeqID_171504
atggacatcaaaacctttgctttcgccccatcttctccgccgttaccggtaatcgccgccgccaagctcgccggaatctctccctcgattgatacctctctctctcctgactcacctcccgcatttatcttctccgatgggctcaagttgcatggagcatatgctcttctacgttatatcggccgagttgccagccttcccaatttctatgggcaaaatgcattagaatctagccagattgatgaatggctggactatgctcctatcctctcatctggccctgcttttgagaatgcatgcaaatatatagatgagtacctggagaagtgtacttttttggttggttattcattgtcaattgcagacctagcaatctgggcaggtcttgcaggttctggaaagagatgggaaagtctaaggaagtcaaagaaatatccaaatcttgcacggtggttcaattcaatagtggcagaacatggtactgtgttaaatgaagtcacatcagtgtatgctggcaaaaaaggattgggagaaccaacagcaaccaagtcaaaagaccagtcagtaaacactgataaagtgaagaaggtgaatggggatgtatctgagaacaacaaaggaggaagcaaaccatcagcagaaatagatcttccagatgctgaagttggaaaagttcgcttgcgatttgcccctgaaccaagtggttatcttcatattggacactcaaaagcagctttgttgaacaaatattttgctgagcgatacaagggtcaggttattgtgcgttttgatgataccaatcctgctaaagaaagcaatgaatttgtggacaaccttattaaagatattgatacattgggtatcaaatatgaacaaattacatatacgtcagattacttccctgagttgatggagatggctgaaaaattaattcgccagggtaaagcatatgttgatgacacaccacgtgaacaaatgcaaaaagagagaatggatggcatagattctaaatgcagaaataatagtgtagaggagaatctaaaattgtggaaggaaatgattgcaggaacagagaggggcttgcagtgttgtgtccgtggcaagttggatatgcaggacccaaacaaatcacttagagatcctgtttattatcgttgcaatccaatgccccatcatagaattggatccaagtataaagtgtatccaacttatgattttgcttgtccatatgttgattctatagaaggaatcacgcatgcccttcgatctagtgaataccatgatcgcaatgcccagtattactggattcaagaggacatgggtcttagaaaagttcttatctacgaatttagccggttgaatatggtctacactcttctgagcaaacgaaagcttttgtggtttgtacaaaatgggaaagttgatggatgggatgatgcacgatttcctacagtgcaaggaattgtgcgtagaggtttgaaaattgaagccctgatacagtttattgttgagcagaatgttgatgactcttctctgatactcgtacagggggcgtccaaaaatctcaatctcatggaatgggacaagctctggaccattaataagaagattattgaccctgtctgtcctagacacactgctgtcattgcagacagacgtgttttgttgactctcactgatggtcctgagaaaccttttgtccgcatcatacctcggcacaagaaatatgaagctgccggagataaagctacaacatatactaaaaggatatggcttgaccttgctgatgcagtgtctttatcagcaggtgaggaagtaacattgatggattggggaaatgccatagtgaaggaaatagagaaggaccaagatggaaatatcatagggttgagtggtgttttgcatcttgaaggatctgtgaagaccacaaaattgaaactcacttggctacctgagatagatgaactagttagcctgacattagtggagtttgattatctaattacaaagaaaaagtccactatggaccacattgaagaggccatcgcgaaactcacttccaatcaactcaaccttatcgctactcaaaacaccatgtccaccaaactcgacaaatttcttcagaaaatggcccatctcgaaaccagtcaacattcggccatggctttcacagttggttgggtagcagatgcaacattggtgcgcccctttatcaagtggttttgttctggtggtataaggagcaaaaatttggcacatgcccaacccaatccacatgaaatgcttccacatgcaattctgttttgtgccacatggaactgtgtgctatttgggaaaggtggtatgatgtctatggttgttaagtctaagacagaggattctatgaaatgtgaagttgttgatggaggagagctcaagtcaaggcgacttttgaattttagaggaaaaagtgcaacactaccttcaatcactgagaaggattgggatgatgatatcatgtttggagtggataacaaagttgacttctatgctgtttcctttgttaagaatgctgaagttgttcatgaactgaagaattatttgaagagctgtggagatcttggcactgagctccatattgaagagggtccacttttgcaggaagagataatcaacttgtgttgtagcatgggaaaggctgttattgtgacaacaaatatgctagacagcatgattgttcacccaactccaaccagaacagagttcccactaaaagctgtgcaagtaatgcacacagtagcattgcggacagaagccactatacctggtggtaaaatgccacctaacattggtcaagtgttgaagaaccacatgtgtgagatgtttgcctaccatgcaaccatgatgtctaacacccttggaacctcaattattgtctccactggaacggggtttcatggctcaagtgaaaatggtcttcccccacacaaagcaacacctctatttgataagcttgcatttgaaaagacacaacaagcactaggtggacatgttcctatcgtattactaggagacttgtggaagaaatttatttctcatatacaggaattaacaaccgtgtcttgcatttcatctgtagtagcagtgcttgaccataactatcaccttgaggacaaggtgtttttcaatggcataggggatcttgaagaaggggaggatttcattgatgtggttaacccatgtaccaaaaaggagactttagcttatggagactccaacatgcgaaatcttcagcgtggagatttattgcaactggagagaaagggatatttcaggtgtgatttacccttcattcgcccctcacaaccaatcgtgctatatgcaatccctgatggcaggcaacagacaagtttgaagtaa

SEQ ID NO: 79820 - DNA, 603 bp, Glycine max
  Peptide Sequence Number=SeqID_171505
atgacatatgtgcttggtgtcttagttttccttgccgcaaagtcagaatttgttaaggatgcagatgaagctgctctacttcaagattttttcatttgcgttgagatgcttgttgctgctgttggccacttttatgcatttccatacaaagaatacgctggggctaacataggtggatcccgtgggttgacagctagccttgctcatgctttgaatttgatatttttcttccggcagtttgcaccaacataccatgattatgttctctacaaccatggtggtgaaggtgaagagggaactaggaagtataggtcacgaacttttgttccaattggccctgagatggacacggtgagaagaaataagcatttgtttggaaacaagacagatgacgttcaactctcaaattttccttcaaatagtagcagcccctcaaattctgatcccatctctgatgttccacattctggtgcaatgaaatcttccttacttgtggatgtgtcaaattctttgtctgtgccatacgatatgacacttatcgacttggatgcatccagttatcctgaaaaagttcctgcagctgataaagccggttctaggtga

SEQ ID NO: 79821 - DNA, 281 bp, Glycine max
  Peptide Sequence Number=SeqID_171506
aaattgacctaaatgttgctttaaccaacggagatgaagcacgattatctgaaacccagaccattgtagtgtttaagtctgaggaagctttggcacctaatgaagttgaggaagcaatcccactagcgtgggcaccaacgtgggatcctaatgaagatgacgaagcttttgatgatggtgggatcctaatgatgttgacaaagctttcgatgacttggaaggtgaagaatcgtaggaacctgatgaagtatctttggcaccaggtgaagcatcttttctaa

SEQ ID NO: 79822 - DNA, 1644 bp, Glycine max
  Peptide Sequence Number=SeqID_171507
atgagcttcaaaatcatggttaggaccagaggattaggtcatgccttaggtcacgttactggcagaggtgtgggtagaggagatcgtgatgattccgatgatgctctgcaacgtcgatggcctaccgcatccgcacagaggcagcgagtacctgtgactgcggcgcatgatgagccagtggtccctatgccagatgtagaggctgatgtatttccagatgacccgattgcaccagctaatgtagaggacactggggcagacattcctgcagacacacgcgcgcaagctgttgaggataagcatgaggaattttcgggtggtccgagcgacccatctgtgctgacccagtatgtggatcacgttgcttgcagcgtatgggcgggagagcgtcctgagttgacgttatcgtctcacgggaggaaggtccatagtttaggtaggcctgtccctgccattgagggactagttgctgggacaggactaagtcctttgatcgtgtgttcggtagacattggtgatcggggacttttgtcctcgtttgtcgagcggtggcaccgggagacgtctagtttccatctccctatgggagagttgacgattacgctggacgacatctcctcacttctgcatctgcccgtggttggcgacttgcatgcctttcagcccttgcacgtggatgatgcgattcagatgctggtcgacttattgatggtctatgcagaggctgtcaaggctgagacagggcagtgtcgtggactgtacgtacgcttacaatggtacgtgatatctacgagcgccgatgccaggcaggcccttcgtgacctcagtcagaccgagaggtacgtctggggagtggctgcgctggtgcatatgtacgaccagctgagcgatgcctctatcagcagtagccgacagcttggcggtgacatcacactactgcagtgttggatatacgagcattttcccttagtcgtagagtccactgctgatcaggactacgaagagaattccccatgtgcctgtaggtggattgcgacaaagaagatcgtgaagagcatacgtacaccggtgtacagggagcgcctgaaccgactctggattctggatgtctgttatagggtcgtgcggaagtttggatacacccagaccattcctgctccgcttgtcgattcatgggtgtcgtatgatgatatacacgacaagtggatgcactactcggatcatatggttccagcaggtgaggtgtgcgctgtgctaggtcagtgtgccagcgactacatggactggtttttccgcatctcgcatcctttcatgacactaggccacgcatcagatcctataccagatggtcatgctccgcagccccgagtcgtccctcagaccccacagatagatatccctcaagtgccggagccaggagcaccgtcgacatctgcgagtcccgctgtggaggagcctagacatgcagaagtttgccatgggattgctgagaggttggagcgctatctgagcttaagggtggtcacgccaggctcatcaacacatgaggtgatcgaagaatacctcaggatggccaggagtgtaacacaggaccagctagtatatgttaggtctcgacgcaggcggcgcacagatcaggcatag

SEQ ID NO: 79823 - DNA, 984 bp, Glycine max
  Peptide Sequence Number=SeqID_171508
atgggggagacaatagcttccaatcctactttgcaagtgtctgtttcatttggtagatttgagaatgattccttgtcttgggagaaatggtctgctttctcaccaaacaagtacttggaagaaaaagcttactttgaagctcattacaagaatgttgcggctcggaaagccgaattgctggctcaagcgaagcagaaggagaaagattctcctagatcacaacatcaaaatggtgaagatctgagttgtaacacttgttggactgatgcagaatgtgatgatactcaaggttttatggaaggggttaagtttaagcaagaaaccaattcaattggtgagattgttaggaccgatgagagtaatttggaggaggatgttgcaatttcaagagattatcaaggttcatctattgaaggagagaaagagaatgaagaactagaaagcagatcaggtagttcccagatagagaaacttgaagaagttgtctacgttgaacaagggggaagtaaagaagaaaatcctaacgttgaagctgaagatgttaaggaaattccacacaatgtaaacaaagagcctgcacaggctttagaaattgaagcaaaatatgtgacattggatcatccaaaggtatctaagaagttgtgggtgttacgaatcaagttgatccgtaaacattttacagcatcttttggatcaacttggaccgtaacatgcttacggatcaacttgatccgtaacactcacaactccactttcagatcagcattctacactattgccggcaacaatggtggaaatgacagggtcacgacacttacctcgacagtggacggtgacgaagctccctcgacggtagacgacggcgttgctcttcgcggaagcctccttgatgcaccacaacaacctcctattcacggcaacaatggtggcaagctcctcaacgaaaaagaagaagaagaacctcttcccacaacctcctcttaa

SEQ ID NO: 79824 - DNA, 528 bp, Glycine max
  Peptide Sequence Number=SeqID_171509
atgcattccagaatgcttgttccaggatggatttatgagcattttgtaaccattggcgctaggaacaatgtcttgggatataaagaaaagtctccatgtgtcagccgatggtcaaataagtcatctttgtcagtaatccattacaagaaactaattgatgagcttaccatcaagggagttaggtggactccatatgagacgcagaggaatcatcgttcgtttgagaatatatccttattcttcagagtctcgcatccttttgtacaaccaatatattttgctccaccccttgatgcaactatggatcaggcacatcttgcaattgaaacatgttataggattggtcgactattgcaacgcactgatgcatattctgtgactgaagaggcattggcattagcgcgtggagtaactgatgatggtcctatgaacaccagtagggcatggggtggcaccagaggtgggcatggcagaggagaacatatgcccatattgtttgtttacttgttccctttatgtctatgttga

SEQ ID NO: 79825 - DNA, 1476 bp, Glycine max
  Peptide Sequence Number=SeqID_171510
atgacaatgaagctggttttggtagttgttgttgaagttgcatgcttagtttctgggatcttgtcctttggatctgagacactctctgagctttctttcttagaaaatgatgtcgtctcaacaacaagaccttcctcttcatctcaacttcaacctcaacctcaacctcaacctcttatggtggacctcactctcattcatgaagctgattctaaaggagctgtctgtttggatggaacggtgcctggataccatttggatcgtggatttggatctggtgcagatagttggcttattcatttggagggaggaggatggtgtaataccatcagaaactgtgtctatagaaaaaatactcgtcgtggatcctcaaaatacatggaaaatcaaataccattcacgggaatattgagcaacaaacctgaagaaaaccctgatttctttaactggaatagagttaaattacggtactgtgatggagcatctttcagtggagatagtgaagatgagtctgcacagctccagtttcgaggacaaaaaatatggctagctgcaatggaggaattaatgtccaaaggaatgcagaaagccgatcaggcacttctctctggatgctctgcgggtggtctggcatccataatacactgtgatgagttcgggagcttgtttggaaaatcttccaaagttaaatgtttgagcgatggaggtttttttcttgatgcaatggatgtatctgggggacgcacactgaggactcttttcggaggtgtggttcagttgcaggatgtacaaaaaaatctgccaaaaagttgtctcgaccaactagacccaacttcgtgcttctttcctcagaatatgatcgaacatgttgagaccccattgtttctactcaatgctgcttatgatgtgtggcaggtccaagccagtttagccccaccttcagctgaccgccttggttcttggaatgaatgcaaatcgaaccatgcaaattgtagctcatctcaaatgcagttccttcaaggtttctacatctggtcagtagaacctaaagtcccatctttgtccctttatccaaacaacaaactcaatatccaaaagtcccttccatcgacctgcccactatccaccgtcgtcggcctctcctcttccttcctagattttgatcatattcgtgatcaagtcttaactggccaagaagttccttctctagagaatttaattacacggctccttcgagtcccttcaccaataataggaggaaattcagttgacagtattaaaacttatgtcatgttatctaatcgaagggacgagatggtcatggaaatcgaggaggacgagctggaagaggagatcaccctcaatgttcttactgaatgtggtacacgtcggatgattggcgtaggacatgaatctcatggtctttactacctcaagcctaatctttctttggtttgcagtgctgccacatcataa

SEQ ID NO: 79826 - DNA, 318 bp, Glycine max
  Peptide Sequence Number=SeqID_171511
atgccatccaccaatgtcttctcaaacaagaaaaagggaaatcacatcatcgaaaccaatgtctttgttgccgacgttggatcgaaagccctgctggcagtccttgattcagaagttttaggggtactgcgaaagccttgtcgggaaggaacgaagaggttgtcgaacagaatcaagctagaggcaaggaacgaaggtgctgcgtgggcgcgactaggtttgaagaaaaacctagaggtgctgaggttgaaaaagaagctagaggcaaggtttcaacgtgaaagggcaagaggtaagcaacaagtgctgacaggttag

SEQ ID NO: 79827 - DNA, 78 bp, Glycine max
  Peptide Sequence Number=SeqID_171512
atgttgctatgtcaaggttctattactctacacacagaatttgatcatcctttgccgcctcctctaggtttatcatga

SEQ ID NO: 79828 - DNA, 999 bp, Glycine max
  Peptide Sequence Number=SeqID_171513
atgggatgttacattgaggatgcacgtaggatgtttgacgaaatgtcggatagagacttggctttatggtctgccttaatatgtgggaacatgtggaattatgagtggcttgaagcgcttctactattcggaaagatgagagaacaaggtctgatgcctgattcggtgattgtaacatctgtcttaccagtgtgtggacgattggaggctgtgaaattggggatggcattgcaagggtgtgctgtgaggagtggctttgagagtgatttgtatttctccttcgcaatgatagacatgtattgtaaatgtggtgatccatttgatgcccatcgggtgtttagtcgcatggtttataaagatgtagtttcttggagtacctcgattgttggctactcacagaaccgcctataccaagagagttatgagttgtatactggaatggtaaatgtgggtttagcaacaaatgcaatcgttgttgcaagtgttcttcctacttttggaaaactcaagttgttgaaacaaaggaaggatatgcacaactttgttcttatagaaggactcatgcctaatgttgttgtaggaagtgcattgattgatatgtatgctaattgtgggtcaatcaaggaagtagagtcaatatttgagtgcatgtcaaataaggatatcatggtgtggaattcagtgataataagagtgaagatctttaaacaaatgatggtaaggaatgtcataacatatagcactatgatctctgccagtggagctcatggcctaggtgaaaagggtttggcattttatgagcaaatggaggaggaaggaattagaccaaacaaacaagatatgaaacactacttgtgcatggtggatctcattggtacaacaggagatctcgatggtgcatacaagttcatcacaaggatgcatatgacaccagatgctaatgtcttggggagcttactaggtgcttgtcgacttcacaacaaagtgaaattggcttag

SEQ ID NO: 79829 - DNA, 648 bp, Glycine max
  Peptide Sequence Number=SeqID_171514
atgtactggagtcaccatcgtgatatgctcttgcattcgtgtccctcgccgtgcgtggcacacgctggagtcgtaatgctagaaaaagagctcaccaaggacgaaccttggatgagccgcattaaaaaccctccaagccaaaaccctagattttgtatttttgggacaaaagacttgagtagggaaaaaagtacaatattgggttcagagtgtaggtcaactgaagtagaacttcagttggtacgctctgttatcgaggttagttgtgacccagaagggaccttcccaattggggctaagctttcccacttggggattttttctggcttcacctttgactctttatacgaggtcgccagtagtctccttgtcaacgattccttgacttctacgaggatcatggcgtttgtgtcatattcaattgcgactagtaagtatgtgacagctcctagggcttttggcagcggtcctaatatgtccattccccacatggaaaagggccaaggagagctcaggcttaaggttattaggtggagtatgtggcacatttgcaaactattgacatcgtttgcatctcttggtgaagtcaagggcgtctgccctcagtgttggctagtagtagcctgctcgcaccattttggtggctag

SEQ ID NO: 79830 - DNA, 2373 bp, Glycine max
  Peptide Sequence Number=SeqID_171515
atggtgaatttagaggtcacaaagtacagcaaagccacagggattggcaaaggtggcagtggtgggaagaagaggaaagctaaaagtatccggaagcattactttgcaatgcaaagaagacttcgccagtgtcggcactttgatgcaaagaatgcgactgaggggtgtgaagttaaggagaatttaagtttaaacagtaatgttatgagtaataatttagttagtgatgttcctatgtggaaaactattgagggtgtttctttgtttgatatccagttaatattgaaggtcatgtatgactgcatgcaaaggggttcaatgaaacctgtatttatagaagatgagcgaggcaaggctgacgtggagggtggacacgtgtctctgagtgtcatctccctaagtgtggatgagcgttgtttggtgtcgagcgtggtagccttgaaaaatgtgagagttgcgagtcgatgtggcttgttaagcccccgagcttggacatgtgttgtccgagctgcttttgccaagttgtccatgatggacatgtgtcagcccattagagatcgggaggccatctcgataggcggtccctcgtttgaggatacttgccgaggtgtctccgatagcaagtcgtcctcgtcggaaaagtcaatcctagttactatgattatctccctttctgcttttgtgggtgtgaggagagttggtggcagtagagatgtgagggacgatgtgctgaagtataggtcatccttgacctcagtggtgagcatcgttgtgcttcaaagccaggtaaagatggtgaatgctgaggactcctataagctggtcgttcaggcttgtaagagtgatgacttcccatttctgagggcggacccttttttcaaggttctggctattgatgtcgaggttgatggaatgccattgatgttcaatagggacggggagctccgtttcctgctttactggcagtatgatcataccaggttcaagttgtatgacgaggatctactgacccttatgaagagggtcgataaagaaatcttgaagcagctgtcggcctcactggatgcgcggtccattttgtctcttccgttggcaagtgatcctcttgttgccttggatggaataatgggtgactttgcttggaggccactcatgaagcaggtcgaacttgcaggtgggatcgtgccaccgtcttttgttgctctgtctactggagaagggagaagagagacgattttgctaggtcgtcttgctcaagatgtgcctccgactgcgcctaccgttgaggttcatgctgttgctattgaagctactcctgttatccctgcccattcacctcctactgttgattgtcgatgtaacgaccattggtgctatggcatgcctcattcgtcgacttcgatggctctccttgctgttatcttggtggctatggtgtcgccttcttcgtccttgtgccctcacatctccctggatcatttgtacacctctatgttgattcactatgggaatgccactgatttttccaaggtttttctccaaaggagcttgatgattttggaggagaatgaattgcggcaccaagaggcggtgcaaaagattgcgtctctggaagtggaggtggtcggtgccaccgttgcttttgctgaggtcgtaaggatgaaccgtcaactgtctttcaaggttggcagtgccttggccaaactgctgcgcgcctggttggatgctggacttgggtgcaaagtggagagcatggcgactgagaaggatgagcttgccaagaggattactgagttagaggtccgacttactgattcagagtccaagctggtagagtctgagttacgggtggccaaagagagggaggccgacaaggagcttgaagaggagttgctcttgtacaagaaggaagttgtggagcagcatgagaaaggctttgaaaaggctgttaggcagggtagtttgtttgcaaaggacctcgacttgggtcaggatgtgaaggatgacatcctgcttgatgaggaagtgattgctactaaggaggaggaggaggctgctgatgaagggcagggtgttacggagcaaggcgatgatcccattgaccgtggtggtcttgtaaagagtgttgcagagtcatctcaggtattgcctaaccagtgtgggggtaggtcgttggacttgctgagtgtatcttctgatgtcttaccaaatagtggggcgacagttcgcttggtggaccttagaccattgacggtgatcgtcctagctgctccatggtggaccttgagttttggtaccaagggaagaccttgggttttagataagcttgcattcatgcacggtggtccttgggtttgccgagccttggactag

SEQ ID NO: 79831 - DNA, 1446 bp, Glycine max
  Peptide Sequence Number=SeqID_171516
atggaaaaccaccaccaaatgcaacaaccaaaccgtgaatttaccatactaagatccaccgatttcctccgccagaatctcaatttatatcccacaaccgtcaacaccggagaacatgccgatccttccatcaaagaagtggattttttctcatcaagatcaccaacaaagaatagtgacactgataactcgagtccagaagaaccacatgatcatcgtcatacgaacatggctaaggacgatggatcaccaactcttttcaatgatcagctcgtaaacactgcgctgaatctaagtccgagtgctgggttatcaagatcagcagcaaatgatgaaaatattgaaactttgctgactacacttcaaagggaatcactaagactaaaagaagagaattgcaaactgagaactatgttggaccaaatcaccaaaaactacaaccagttacaattgttcattgctttgcagaagcagaagcagtgtcagatggagacaaatttaaatgggatgatgtttggtcaacatttattggacccacgaggaccattcaccaaattagacgctcaagttgcaccatttccagatgataaatctggtcaacggggtcatcctgaaactgatcctgtagaagatgttcttgaacaatcaacctcacagagttggggctcatccaagagtcccaagtttgaagagtccaactctagtgagcttcctttaaaaaaaaccagggtttccgtgcgtgcaagatcagaagctcctctgattagcgatggatgtcaatggaggaaatatggacaaaaaatagccaagggtaatccttgtccccgtgcctattatcgttgcactatggccgtaggatgcccggttcgtaagcaggtgcaaagatgcatggatgacaagacggtgttgataacaacctacgaaggcaatcataaccatcctcttccaccctcagccatagtcatggcaaattctacctcagcagctgcatctatgttcttatcttcttcatgttcaacatctaataataacgaagcactaagtaacactgtaggagtattctcttccatgccctacatcccaatggcaacgctctcaacctctgcaccatttcccactatcacccttgacatgaccaccaacccctctgccctaacatcccctcttccattgcatgcaactacttttcctcagctactaggacaccctgtcatcttcccccacaagatgccacatccattattaggccaacaacaacctttgtttacgacagagacgatgagtgcagctattgcttccaatccgaatttcactatagcattggcagcagcgatctcatcaattattggagctcctagaggaaatgatggaattaacaacaatagtagcaatggtggaagtgatcttcctcttaatgggacatctatgttgcctggatccacttag

SEQ ID NO: 79832 - DNA, 558 bp, Glycine max
  Peptide Sequence Number=SeqID_171517
atgattcatatcagattgacgaatggaacattttcaaattatccgaaatcttctgggtgtgcaagtatattgtttcctttgcatttcaaaacctcatgtgcttcttccatcagcagtggaaaaaccatggataatgtgccaaaaatcaagacagagcctggcttcgaagatgaaaatggtccatcgcaccacgacagagccatgctccaccaacatcactacagacagctatcaaccggacaactaacacgtgtccaagccctgcgcctggtgccgaattcagtgactttcaacatgcttcttaatgaatacaaggccacgtgcaacagcttggatgttccaagtagtatgtacaacttcatgaaagagaaacggttcactcaattgaacatagcatactgtgccgaaatgccgctttgtttacaattagtggcgaaagacgacaaaaattggatctggatggagagatttttccaaatcccaaagcttcaaagctggaatttgtttgaatttcctgatcccaatgtcaactatgctttcatttggccttgtttataa

SEQ ID NO: 79833 - DNA, 1707 bp, Glycine max
  Peptide Sequence Number=SeqID_171518
atgaataacatgtgtagccttcataataatttgtacaatgactttgaagatgcatcttcaacttctactagagtagcaaatagtgaaatgcatgataattccttggtacgtgaacatgcaaatgatccacttcagcaaacagatgaaggttatttagatgacaacactgaaattggaggaaatgttgatagtttgctacatgatgacaatcacctgggtgatgatggtgatgaatgtgctcatgacattagcacaggagacccttctaaaacatgtccatattgccacactgctatgtggtatgaagaaagaacaagaaaagataaaaatcaggctaatgccaaatatagtctttattgcgacatggggaggaatgatgatggaaccactaaacaggttgtcgatgagattaagcactatcttgatggcaggttatactttcattttcctggtcaaaactcaataatatttgtggatgatgatgacattgatgttttgttgtccaagccaactattaaagagtctatgtttacgtcttggctccaagctaacagcatttatcatgaagcaaaagatctaacatacttgcatttcgtttcaaagtttacatacattgccaagtctagatgttggaggccacgtaaaggtggcaatacaattggtagacttaactgggtgcctccaagcactagcgaaatatattaccttaggatgatgttggttgtggttaaaggactgacaacttatgaaaaaatttgcacagttaatggtactggcaaaacctttatgtggaagacattatctgatacactacgttcaaaaggtgatattgttctgacagttgcttcaagtggtatagcctcattgttattacccaatggtagaactgcacattctaaatttgttattcttgtgcctacattagagaactccacatgtaatatccaccaaggaatagaacaagctcgactactaaaggctaccaagttgatcatatgggatgaggctcctatggctcataagtattgttttgaagcattagataaaacattgaacgactttatgctcatgtctaattccgacagtgttccatttggtggaaaagttgtagtctttggaggtgatttcaaacaaatttttcccatcatcacaagaggaagtaggtccgatatagtgaatgctactatcaatgcttcgtatctgtgggactactgcacagttttaaagctaactaaaaaaatgcatttgcagtcaaacctaacaatcacaaatgcacaagaaattaagaggttctcgcagtggctgatagatgttggtgaaggaaagctagagatttcaaatgaattgttgattaaaaatttcaacgatcatattgaattaattgtcggtcatacttatccatacatccagcacaattataaagatgaggaatttctgaagtctagagctattctagcttcaacaaatgagattgtggaccaaataaatgactacatattaaacattatctcaggtgatgaaaaagaatatttgagttgtgattcaattgacataacggatgttgcatcaagtgaatctcatgaagctgttacaccagaatttctacattcatttaagacatcaggcatgcctaatcataagataaggatcaaaataggcacacctattatgttgattcagaatttagatcaagtagaaggcctttga

SEQ ID NO: 79834 - DNA, 301 bp, Glycine max
  Peptide Sequence Number=SeqID_171519
cattcagcagtattctggtgcctttggaacatccatggaagagaggctatcaaaggttgtgagggctctaagaggaggcgctcccgagttgtggctagagtggaaatggatgagaaacaggaaaactgggtgcaagaaaacacgggagaagatgaaggttcttgttcttgggtgcaagaaaataaaggggaagatgaaggatgatcaatgcaccggcagcttggagccttggaggctacagacagatataaaagaagttatccaggtaggggaaacaaagacatttgacccaaggctgaag

SEQ ID NO: 79835 - DNA, 642 bp, Glycine max
  Peptide Sequence Number=SeqID_171520
atggttgtgcagtctctggacgacgttgttcaccagcaattgatggtttcagccacggcggagaagagttcggaatccaaaatcgccgtgacggcaaatggcgggaacggtgctaagtccgccgagaagaaactgagagaattatcggaggagggttcgacaatgccgccgcggaggtcgagtgcgaggattcaagcgttgcagaaagcggaggaggaacttcttgctcgtaaaagagcagagggagttgaggaaaaagacaattgcaacgatgaggtgaaggctgggaaggcgaagaagcgcaataggaaaagtagtagtgacggtgaggagagtgtagttgtggaagtagaggttgtttcgccgccgatgaaaaaaggggtggcctaccgcaagggtaaggtggtggacggagtgaatggaaatgttaaggtaggagaagtgaatgggaaggagggattggaaaatgcgggtgggggtttgggggagaagagtgacttgcttaaggtcaaagagacgataagactgtttaataagtattaccttcatttagttcaggaagaagaaaagaggtgtgggaaggcagaggctgagcggaaagctgctaaaaaggcttcaaaatcgaagatagtacaatggtaa

SEQ ID NO: 79836 - DNA, 972 bp, Glycine max
  Peptide Sequence Number=SeqID_171521
atgaggatgaggatgaggagtaacttgtttaaagttacccttggaaaaggtgctccacctgaagaatcaaagaccactgctaaacgaccagatctaaaggccatgatggaaaataatgagatattgtaccctgagaaaagaattggcaacattccaggtattgatgttggatatcagttctattctcgtgctgaaatggttgcagttggttttcatagccattggttaaatggcattgattatatgggccagagctatgccaaagcgtacagctatgaacttccagttgctgttgccattgttatttcgggcatgtatgaggatgatctggataatgctgaggatgttgtgtacactggtcaaggtgggcataatctgactggtgataagcgtcaatttcgggatcaaaagttggagcgtggtaacttggctctgaagaattatggttttgttccatggaaaggttatgccattgttggtaaattgtctgcagttctatggtatttagtggaagggattcaaaacaccaacctctcccttctcccttttcctaccaagccaacattatacctgcttaattgttctgagcaatgtgtgcctgttagagtcattcgtggtcatgaatcttcaagcagttacactggtaaagtatacacatacgatggcttgtacaaggttgtcaattattgggcagggaagggaatatccggatttacagtctacaagtttagacttaggaggcttgaagggcaacctacattaactacaaatcaggtatattttacatatggacgtgtacctcaatctctaacagaaatacaagggttggtttgtgaagatatcactggaggtcaagaagatatgcccattccggctacaaatttggttgatgacccccctgttccacccacaggcaagttcaataagggaagaaagaaaacgttgaatagggaatgcaagagtgtattttag

SEQ ID NO: 79837 - DNA, 867 bp, Glycine max
  Peptide Sequence Number=SeqID_171522
atgaggaggacagaattttctgagcagatttatgtaatgttttcacgtagatcagattatggtcccatagatttcacatattgtaagtcactcaaggttgcaaaaaatgtgaagcttcccatgaatgccaccggatgcaaatgtgaaggcatttgtaatgacccaacaagctgtgcatgtgcattgcgtaatggctctgattttccctatgtatctcgggatggtggcaggttaattgaagctaaagatgtagtatttgaatgtggtcccaaatgtggttgtggtcctggttgtgtgaaccgaacgtctcaaagaggacttagatatcgtctggaggttttccgtactgccaaaaaaggatgggctgttagatcctgggattttataccttctggagcaccagtttgtgagtacaccggaatacttgctagggccgaggatatggatagcgttctagaaaacaattatatttttgagatagattgcttgcaaactataaaggggctcgggggaagagagcgacgatcacaggatggagagattcctgcaaatcttttggacaaatatcatgatcaatgttctgaaagtgtgccagagttttgtattgatgcaggatctactggaaatattgctaggtttataaaccattgttgtgagcctaatctgtttgttcaatgtgttttgagcacacacgatgatttgagattggctcgtataatgttgtttgctgcagacaacataccccctttgcaggaattaacatatgactatggttacgtgcttgatagcgtgttggactcggatgggaagattaagcaaatgccatgctactgtggagcctcagtctgcaggaagcgattattctaa

SEQ ID NO: 79838 - DNA, 891 bp, Glycine max
  Peptide Sequence Number=SeqID_171523
atggcacatttgcaagaaatagatcgagtcaagaatgaagttatacgtttagagcgcgaatctgtcattcccattctgaagcctaggctcataatgacactggccaatcttattgaacatagttctgaccgggctgagttcttgaagctctccaagagaatagagtacacaattcgagcttggtaccttctacagtttgaggacttgatgcaactttactccctctttgatcctgtacacggggcacaaaagttggaacagcagaagttatcttccgaagaaattgatgtgcttgaacagaatttcttgacatacctatttcaggtcatggaaaagagcaacttcaagatagtgacggatgatgagattgatgttgcacattcaggccagtatcttctaaatcttcccataacggttgatgaatctaagcttgacaagatacttctgaagaaatattttgaagagcatcatcatgatgaccttcctgatttttctgataagccagaaaagaaaaaccctggattaactccaatggattgggtcaagtttcttggatcagctgtagttggtctggttgctgtagttagttcacttgaaatgccttcagctgattggtgggtcatcattgctgttgtctccacagtaattggttatattgctaagacttacttcacgttccagcaaaacatggctcagtaccaaaatttgattacgcagtcaatgtatgacaaacaacttgacagtggaaagggtacgcttcttcatttgtgtgatgatgtcattcaacaggaaaattgtttagaaagtaggatagggctggctgttctaatggtgcctgaaactggccagcttttttctgcccaacccttactctatcttgctttggtttga

SEQ ID NO: 79839 - DNA, 414 bp, Glycine max
  Peptide Sequence Number=SeqID_171524
atggttcttccatcgactccacatgaaaacatagagatagaatctcttgaaacgaatgaagtacctaatttgatggatgagattcaaggattgcaaaacatgttcaagtatcttctagaagcagaaagccaagtgggaacggataaaaatgatgaaaatgttgctggttactctgttggagctgggcataatattcaaggattgcaaaacatgttcaagtatcttctagaagctgaaagccaaatgggaacagataaaaatgatgaaaatgttgttggttactctgttggagttgggcatagtgtacctgttgctgctggtgttggggataatcgcttcctgcatcctaatccaaaatgtaatttacatctcaaattagtgattttgaaatataaaaaatttcattttggataa

SEQ ID NO: 79840 - DNA, 321 bp, Glycine max
  Peptide Sequence Number=SeqID_171525
atgactcataacccaactatagaggagttgataaacaaaatacaactctctcccaaaataatgtcaacgtcatcacgtcggctcgacagctcctcaccagaattttactccctgcaccctgctgttgtcattctgctcccacaacaatgttcgcgatcatcacagagttcgtcaagaccacccagtcgtgcacgtaactgccccccccccctaggtgatcagcctggggcccataggagttccctaccaggtgacgagccccctcattacaaagtacactctgccacaattattctatttcttgtgtcgtatgaggtatga

SEQ ID NO: 79841 - DNA, 252 bp, Glycine max
  Peptide Sequence Number=SeqID_171526
atggaccctaagagaataaaggtcattcctaagtggcctactccaccaagtgttgaggaaagaatccatgagtttcaagaacctctggatttgaggtcaaatacttttcaagggggagggaacgatgcaatccttacccccccccccccaaaggcattggatagaagactccaagaagattgggccaaacatgcaagagaaggccctagggttctcatgagccttggggtagatttcgggctcatgggctaa

SEQ ID NO: 79842 - DNA, 240 bp, Glycine max
  Peptide Sequence Number=SeqID_171527
atggatacctcagagccctacactggggcaataaaaggcaccatgcgtgagcctcaggcgaacctaggggcaagtcaaaatacctaccgccttaagagggctgcatgccctggccttcagaggactgcacgtcctcgccttcaaagggctacacgtccttgccttaagaggatttcacgtcctcgccttaagagggctacacgtcctcgccttcagaggactacacgtcctcgactttag

SEQ ID NO: 79843 - DNA, 120 bp, Glycine max
  Peptide Sequence Number=SeqID_171528
gggctaatattgatgcaatcctaccccccaagggcattggatagaagactccaagaagattgggccaaagatgcaagagaaggccctagggttctcattagccttagggtagatttctga

SEQ ID NO: 79844 - DNA, 174 bp, Glycine max
  Peptide Sequence Number=SeqID_171529
atgactaaagcacgtcaaaagggggtatggaaaaccgaagaacgacgaagaacgaacgaaagatggcagaaaatcttcacggaattacccacggaaacgttttggacgcgttacggaagcgcctcggcgtggattttcttcacggaaacgatttttttcactaatttcaagtga

SEQ ID NO: 79845 - DNA, 357 bp, Glycine max
  Peptide Sequence Number=SeqID_171530
atgcagagttcacaacgcgatgtctatcttggagcctacctaaatgggttccactgtagcggacactggcagatggtggtcatcctgcccaaggaacacctagttgtctggttttgttcattgcataacaggccagacaactaccttaaggggattattaatagcctaaatcaaaggcttctgctaggtggaatgtcgtcaagacaaaaaggaagtactgagtgcggctactatgtgatgcactggatgtccaccatcattttaggaacttttaggaataattgggaagcgaccattggacttagagagattaaaagcattgcagatccagtgggcacagttttatcttcgagttag

SEQ ID NO: 79846 - DNA, 669 bp, Glycine max
  Peptide Sequence Number=SeqID_171531
atggtggaaccatcaaagaagcgcaaaggttcttcaagtagaagccaacgacactccgaggctcaggatactccaattccttcctccatttcctcatcctcattgttcttatcaaaagaacaatgtatacgatacacaaacctcttctcctctcgttctatcattgaccctaacttcatagatatggatttcttttctaatgagagtttcgaatgcattcaagcatttcaaaacttaaatctcattccttttatctctttaaaactgtctgtgtattttgaattggtaaaagctttttattctaaccttgaaattcaagaaagtaccttgatttctgaggtttatgggataaagatggtcattgaccaatccctcttctatgatttgacccaattgtctagtgacggtgtaccatttgaaggtgcactggacgatgattggaagtttgatttttttgtgcatgatgtccgacggttggtttgcaccaaccaagcggatatgaccggaaggctgcttgccggttcattggctcttgaaagccgcatccttcactatcttattgttcgtatcttactcccaagatcttcaaaccttgcacaagtttctgaagcagatcttatagtcatgtgggcctttcataccggtcgacaaattgattgggcacaccta

SEQ ID NO: 79847 - DNA, 330 bp, Glycine max
  Peptide Sequence Number=SeqID_171532
atgggttttcagaccttaccttactccaacataccaaacatcactgatatatatgtttttattgtaacgacccgcctcgtcactacggagttgattacaaaacacaactctcccaaaataacgccaacgtcatcacgtcggctcggcggctcctcaccagaatcttactccctacaccctgccactgtcattatgctcccacgaacaagatgcaatgtggtacgtaccaacaacaacaaaatctcaggaaatagcctaagcatgtccacacgacactctcacttagggaactgtgctgagtttgtcgagaccacccggttgtgcacgtaa

SEQ ID NO: 79848 - DNA, 314 bp, Glycine max
  Peptide Sequence Number=SeqID_171533
atgggaggtgcaaatagcaattttgaaattttgaatttgagcctttcagagtattttcgaagcaggattgcttctggaggaagcaacccagctcgcctgggcaagctgggtggcaacctcctccccctttttcctaaaaataggcaaaagggggttgttctaaatatccatcagccccctggctatgtatttcagctgttttgggtggaaaaaattgttccgtcaagcaaatccaagccgaggttttccgtcgttcttcaccgttcttcattcgttcttcgttcgttcttcgttcgttcttcgttcttcaatgg

SEQ ID NO: 79849 - DNA, 453 bp, Glycine max
  Peptide Sequence Number=SeqID_171534
tcgttcggagtccccgtcgcacctagcaaggtgattcggccgcccatcacccgagctttcattgagaagtattgcacacagagacaggcccagggggatgctccgcaggccgcagacgcgtcgccacctcatcaggctagcctagctggatcgtttgatacggagcagtatttgcggcatttggttcgccagcaggcggccaaccaccgggcgtatgtacagacccatgattgtctttaccagttgaccctcatcctgcagagccagggttttacttctttttcgtgccctactccggaccagttcagggcagaggtcgcatggcctggagattggcctgaggcccaggtaggagaggcgccagcagaggctcccgacgaggcagatgaggcccgcaaggacgaggagatgaccgatttacttgatttcttaggagggagcggggccacatga

SEQ ID NO: 79850 - DNA, 453 bp, Glycine max
  Peptide Sequence Number=SeqID_171535
atggggtttgcgggtggtagtggtagcaaacccaatactttccccactcagatcacttgttacaaatgtggtaagccaaggcacatctcctcaaattgtgctgataaaggcatgacctgttttaattatagacaaagggggcatattcaaagagattgtccatatcccaagaaggagcaaaatggtaggggcctgaatgatcaaactggacattcgaaggccataagaagagtctttacctttaacggtgccgaagcttcaaaatccaaagatctaatccaagtgagtaaggatatgatgtttatctctgccaaccaagttgtgacatctttaaaagaagatgctcaagtgtacatgatcttgtctatcctggaaatagagaaaaatgtttccatgtgtgacctcattgttgtcagagagtttcctaaagtgttccctgatgtcataccctaa

SEQ ID NO: 79851 - DNA, 703 bp, Glycine max
  Peptide Sequence Number=SeqID_171536
atggcttctaggaaacataaaagtattggttcaagacccatagtgcagtatgagacaaggagattctcttccttagatgcttggacccgatacacagataatgtcttggggagaaacattttaccagagaggaaagtagagatatatcacactgagctagatgagtttaaggctgaattggagagacataatttccataaaggcctcaccaatttagtcgataggagcatagacttggctttggtgaaagagttctgtgcaaatttatacagttctgaggaccgtccaccaaatcagtccagagtcaaagactatagagagatagaggttgccttatgcacacctggtcgagggttcatcttgaactctgagggccatcctgggaagattctcaggaaggatctgactacactagctcaggtgtggagtgtcctcttatactccaacttagcccccacatcacacacttctgacttgacagtggatagagctaggctgatctttggcctagtctctcgcatggatatgaacataggagcgctgatctctggccagatgacctctatagcccagtctaacacttctagacttgggttccctgctttgatcaccgcattatgtagagccagaagggttacctctgatagcctcacttttgagcgcctaagcccaatcattaacatggcctacatcaagaagaatt

SEQ ID NO: 79852 - DNA, 220 bp, Glycine max
  Peptide Sequence Number=SeqID_171537
atggaacttcaacgtctcaaccaaaatgaagagaccgacaaaagtaaaagaagcatagcactcaatgcctcctcctcaatgcaagaagaagaagaagaagaagaagaatctaatgatgaagaggacttctcactcattgtgaagaagtttcataaattcgttaaaaatagaagaattgagagatgccataacttcaacaatgggaagagatctcaagaag

SEQ ID NO: 79853 - DNA, 252 bp, Glycine max
  Peptide Sequence Number=SeqID_171538
atggaactaattgagaatatggttgctagtgatcatgctatcttgcgtgatagaacacactatcccaccaagaagagtttattagagctgtcatcacaagatgctctgttggcacagaataagttgttgtccaagcaactcgagactttaacagaaacactgagttgcacactttgtggtggagctcatgaatcaggctgttgtattcccactgaagaattaacacatgaagttaattatatggggaactag

SEQ ID NO: 79854 - DNA, 258 bp, Glycine max
  Peptide Sequence Number=SeqID_171539
atgactatgaaaaagaggctaagttttgaagtgcaaaaagtagcagttggtctaagcgtgcatccaccgctaagcgcagcttcagtgtgcttagcgccaaggagaatctggcagagcggtacaatgcccagggcacaaaattccacaatacaccatagtgtctatttcgagaaaagagctctggaggtagcaagaggagcagcttttgcagagatacctagattttgtaagctcattattgttaggctttctctctaa

SEQ ID NO: 79855 - DNA, 420 bp, Glycine max
  Peptide Sequence Number=SeqID_171540
atgactaatgcaaactgtccgcaagagtcattgcatccagtctcaaacgggaatctaagatatatctacaaagaatgggaaattgggattgaaattgataccaatgtgaagagagaagaggtggagaagctggtcaatgacttcacggagggagagaaaggaaacaaaatgagaaaaaagatcgtggagttgaagaagaaggcaggggaagccactacacccagtggttgttcattcatgaacttggacaaattcattaaggaggaaccaatcaaggctgtagagaaatctcatgtacatcatactgttggggatatcactacaacagcctttctcagtgcttcaacagtagtaaggcatgcacagccaacacgggataagctccagtggaagtcaaggcctccacatgctgcaaagtga

SEQ ID NO: 79856 - DNA, 1431 bp, Glycine max
  Peptide Sequence Number=SeqID_171541
atgggcctgctgttcctgcgcctgccttcctcgttcctgccggacgaagatcagggcatcctgttgaccatggtgcagctgcctgccggcgccaccgagtcccgcaccaacaaagtgctggaagaagtctccgactacttcctgaacaaggaaaaggacaacgtggtttcggtgtttaccgtcgcgggcttcggcttcaacggtaacggccagaacaacggcctggcattcgtcagcctgaaagactggggcgagcgtccagggagcgagaacaaggtcgaagcgatcgcgggtcgcgccatgggcgcattctcgcagattaaagaaggcctggtattcccgttcaacctgccggcgatcatcgaactcggtaccgccaccggcttcgacttcgagctgattgaccagggcggcctggggcacgagaaattgaccgaagcgcgtaaccagctgttgggcatggttgctcaacatccggacgtgctggtgggcgtgcgcccgaacggcctggaagatacgccgcagttcaaactgatcgtcgatcaggagaaagccaaggcgctgggcgtcagcatcaccaccatcaacagcacgctgagcaccgcgctgggcggctcgtacgtcaacgacttcatcgaccgcggtcgtgtgaagaaggtatacgtacaggccgacgcgccgttccgtatgctgccggaagacatcaacaagtggtacgtgcgcggcacgagcggccagatggtgccattctccgccttctcttcggcgaaatgggaatatggctcaccgcgcctggaacgctataacggcttgccgtcgatggaaattctgggccaggccgcaccgggcaagagtaccggtgaagcgatgaacctgatggaacagctggcgtccaaactgccaagcggcatcggttacgactggaccggcatgtcctatcaggaacgtctgtcgggcaaccaggcgccggcgctgtacgccatctcgattctggtggtgttcctgtgtctggcggcgctgtatgaaagctggtccgtgccgttctcggtcatgctggtattgccgctgggggttatcggtgcgttgctggccgcgacgatgcgcggcatgaacaacgacgtgtacttccaggtggggctgctgaccaccatcggtctatcggcgaagaacgccatcctgatcgtggaattcgccaaggatctgatggagaaagaaggcaaaggcctgatcgaagcgacgttggaagcggtgcgtatgcgtctgcgtccaatcctgatgacgtctctggccttcatcctcggggttctgccgctggttatcagcagcggtgcgggctccggcgcacagaacgcggtaggtaccggcgtaatgggcgggatgatcaccgccaccgtcttggcgatcttcttcgtaccggtgttcttcgtggtg

SEQ ID NO: 79857 - DNA, 371 bp, Glycine max
  Peptide Sequence Number=SeqID_171542
caaagacgccagcacccttcccttataagagtgacaaggcagtaccgtggaggtatgacatacagggatccgatgaaaggcaggatgcgtctgtcatgcgtgttgggactggcatgccggctgctaagatcatgaatatttcgggtacaagtggcatgactcgtagtggacgtattttcgctcctcccgaactaccagcaaagttgaaagacaaggggaaggcaaaagcagatataggcgagagggagaagacgggcttgaccgcgaataacgaggcccttgtcggaaagtttgaagaggaaaaggatgaccttagcaagagggagatatcggctgaggaggcaaccaaatttttgagaatcattcaatag

SEQ ID NO: 79858 - DNA, 510 bp, Glycine max
  Peptide Sequence Number=SeqID_171543
atggatatggatgacgttgctatttggcaacattctgcccagcgaccacaatgccaatctccccctacagatgtatcagttggtctgtgccgtcatgacatagggatcgcgcccacaagacacccattgggtttccagctctggttacgggcctctgtcagtcctaccgggtgcccgttcccccagcaaggaatggcacccacaaagacacccagtggacccgagaagtccaacagggccctggggtttccagctctggttacgggcctctgtagtcctacagggtgcccgttccacccggcaaggtcacgtcatcatgacatagggatcgcgcccgcaagacacccagtggacccgaagaagtccaacagggtcttggagttgccaagctctaattacgggcaggcacagggcgaaacaccacagcagcctggggatggccggcagcgggcaacagacgtaccgccatcacctctagagttcacctcagctcatccacaaaaaggttaa

SEQ ID NO: 79859 - DNA, 837 bp, Glycine max
  Peptide Sequence Number=SeqID_171544
atggtgccgctaagcgcgaaccttgaaaagcttagcgcaaatccttgcggcaatggccagctaagcggaccatgtctcgctaagtcgccaatggcttctaggaaatgcaagagtattggttcaagacctacatcacaatatgatacaaggagatttcactcctttgatgcttggaaccagtacacagataatgtcctggggagaaacattttgcctgagaggaaggtggagctctactacactgagcttgagattttaagatggaattggagagacttggctttggtgaaagagctctatgcaaacttatacagctctgagggcccttcaccaaagcaagccagagtcagaggccatttagtgaagattgatgctgattgtctcaacacattcctagagacacctgtggtattggcaaaggattacagagagattgaggctgccttatgcataccgggccgagggttcattttgaatgttgagggtcatcctgggaggattctcaggaaagatttgactactttagcccaggtgtggagtgttctctcatactccaacctggcccccacatcacatacctatgatctgacagtggacagatctaggttgatctttggcctagtctctcgcatagacatgaacataggagctcttatttctggccagatgacttctatagcccagtctaacacttctagacttgggtttcctgctctgatcaccgccttatgtagagccaaaggggttgtctctgacaaccttacttttgaacgcctgagcctgatcattaacttggcctactttaggaagaactgttggaatcccgaggatctaaca

SEQ ID NO: 79860 - DNA, 261 bp, Glycine max
  Peptide Sequence Number=SeqID_171545
atggatgaagatgatgataatgatgctggaaatgatttagtatttgaagatgatgatgcactaaattgggcaactgtgaagcaaaaagcagtccaagaaaataatgaggatctagagtttgaggatattgaacttgaatctgaagaagaagaaatcatgattaattttgaggcgtctgatggagaaaagggtgagggagatactccactaccttatgataacaacgaagaggattatgttggaattgaagaagatgattag

SEQ ID NO: 79861 - DNA, 396 bp, Glycine max
  Peptide Sequence Number=SeqID_171546
atggttttgcaagccatcttcaacggcgccttcttgacaatgagttcttcttcaacaactctcttcattggcagttctgcaagcactcttgttgtcgtcgattctcgccatcatcagttcccatcattgttgtttcttgtttgtggggttaaagcacatttgctcagaatttgtggtagtgggattgctacttgttcgaaagttactgatgcatatttggttgatttgaggagggtttgtgaagaggctgaaaacatattaaagtctaagaatgttcctttacctactgacaaaaggactccaacaccaccaacattaccaccaaaaagaagaaaatcaagcaatatagagagtgcgtttaatattgaggataagaatcatcttagagcagagata

SEQ ID NO: 79862 - DNA, 852 bp, Glycine max
  Peptide Sequence Number=SeqID_171547
atggctagtgtttgcacccatttgacgttgggtatgtgttcttgcaccccaagctttgcttgttcttcatccaccaagaagaggaagctttgcaacaaagccaatgttggttcaagaaataagaagttaaagaatgaagatgatgaggtttggaagatcaagaaagtgttgaaagagagcgatgttgggagcatgagcaggttgatactgacgagagaaatggcagagaagtttgtgctgcctgtgttgggggatgatgctgatcagattgatagtggagtttctgttcagatttgggatgcggacaccaactccatgcactctcttgttttcaagagatgggtctcttcaagaagctatgtcttcattggtaattggattaaagattttgttgcaagaaggggtttaaggaaaggagatgagattggttttcaatggaatccattcaagaatggctttgaattctctgttcttcaagatggtgtattcagtgatgagaattctatgcttgttgcattttctgttaacttggtatctgtcaatctctgcttgtgggttctgagtcccaggaacaaactatactacttgctatcatacaagagctcagagtttctgcatggaatgccaacaattcagattgctgttcctgggaagagataccttaggaacttcagggccttgagagtttacaagattttcgacaatcacttcagtggtcctattccgggaagcattttttctccagggaagctagaagttcgtatccttactcagaacaattcaagtggtgatcttcctgaggaaatcaggaattggcaaacccttttctgtgttcaaatctcatcttcttga

SEQ ID NO: 79863 - DNA, 591 bp, Glycine max
  Peptide Sequence Number=SeqID_171548
atgggtggagccgtggaggtggttgcgacgcatgatagtggttttgatgttgttttgttcggatctggtgacgggcagtccagtgccaagaacacaaaaaccttgcatgcccatttgcttataactcgtgatttgcagtctaatatcttcttgatgaactctttgctcgatttgtactgcaaatccactgatatggttgtttctcgcaagttgtttgatacaactgctcttccaaatcttgtttcttggaacatcatgatatctggttttgaccataatcaaatgtttgaaaagtcattgaagatgttttgtaggatgcatttgcttggtgttgagcctatgagtttagttataggagtgttctttcggcctcttgtgctttgtgagctgcaatattttgcaaacaaggtggaccaggggttcggcggcggggaccatggtgaagaggagttctgggaggatcacgacagtgtactccaccatgccattcctaacagcgagaaagggagaagagagtcaacagagaaagttaacggatcccgactaatgggaggaacctcggacaaaattttacaaatattaagaatctga

SEQ ID NO: 79864 - DNA, 255 bp, Glycine max
  Peptide Sequence Number=SeqID_171549
atggtggtgagctttttcgagactcatcttctccttgaagtggcgtctcctctctctcttcctttctccattccgctgccattcatcttccaagaagcaaaggaatccattgatgaagaagatcctaggcctacaagctccaatggagcttgcatcattctagtggagggtacatccactaggttgttcaaagagaacaagggagggtacatcccttgtggatctttgcttgtaaaaggatttttacaaggttga

SEQ ID NO: 79865 - DNA, 870 bp, Glycine max
  Peptide Sequence Number=SeqID_171550
atgtacttgcatgatcaagccatgatataccctcctggtctgcatatatttagggcaactaatgtcaagatggttgctaatagggtctgctttcatttactagtatgggatgctagcaagaagaagggattcaagttgtattacaaggcacaaatgccctcaaggaccttctggagtcagatagtgtggatagattcccaaaaaacctccacctctggctatgatggcagtgatactattgtgtaccatgacattgttcaagttttacaacatacaaggaagtatcactttgatgatgtctatgtctgcttcataagagatgatgacaactactcctttatccaatgtcttctcatgcttcccatcattcaatatgagggaacctacaagttgaagaagatgacagaagctcaaatgatagcctatgtgactcaactctatgaggctcaacaaaaacagagagctgaagatgctactgctatgattgctaagcaagaagctgctgagaaagaacttacaaaaaatggtgtcatggatgaaactggtaaagcgtccaatgcagctatgattgatgaaattgaactaatcattctagatcctacgtctaagcagccaacaattttaaatgaggccatctctcgagataagggtgaccatgatgctgtaattgtatactcaacaagttttagtcctacccctctcaactacgcacaacctgccaccatcattcatgatcaggttcaagatatgataggacaagtaatagagtcctttgcagaacgtcaatggcaagagaataagaatttctacctctctatgcagaatgccattacaacacatttctgcaaccttggcgtcatcctcgtatag

SEQ ID NO: 79866 - DNA, 720 bp, Glycine max
  Peptide Sequence Number=SeqID_171551
atggcctctacaaacaccctcgtcactaaagccatcctaaccatggaaatcaccaccattcacactgaaaatgagccttccatccaaaccatatcctccaaggttgtgggagtgaaggtcgtactattaagtgacaccattgctaaggcaacaaggtgtttgcgcgagggtataacttaccaagaaggttgggagaacatgttactacagctctctactgagacaatgctgacaaggctagaccttggtctagacaactttgacattacaaggaaaatcaagaagatcatggttgaacaacagaagaagaagaaaaccatgaaacagtcccaaagggatgaagaagaaaatgagatgttggaaaagagaccaaaagaaagcatgagtctagcatccattcttccttcaaccattcaacaatgggtcaagacaagggctaccaaggccaacccaaaaattggtgataaagaatgggtagtttccttcacaggaaacaaggaagatccatccttcacttcatcatatggtgagtccactgatgacactcccatcacaccactccacaagacttggatcttcttcatcaatggagtcctttgcttcttgaagtttaatggtagcggaatggagaaggaggaaggtgattggagatgccgcttcaaggagaagatgagtcaagagcaagctcaccaccataggaagccatggataagagcttga

SEQ ID NO: 79867 - DNA, 337 bp, Glycine max
  Peptide Sequence Number=SeqID_171552
gtgcgtcttccaagaaaggaaaatgcgcggagttgccaccaacgtttattcgaggaaaacgtcagaaaaaccagaaaaggcgtggtctacgaactttaagcgtgaaaggggaaaagagggaggtggttgccgcccagctcgcccaggcgagctgggttgcttccaccagaaggcactgccttctgttggaacatcttggaaggcccaaggagattaagtgtagtgctagaagtggcctaaagagtacttgttgtagccagaagtggcatagagaatacttggttgtaatcaaagatttgattagtggaacccttcaaggtttgaaggagaacaggac

SEQ ID NO: 79868 - DNA, 1626 bp, Glycine max
  Peptide Sequence Number=SeqID_171553
atgggtgggcgagggcaaggacagagctacggtagagctaattggaggagtaggaaaaacataacatcgttttactttacctgtttccctgacgacgcgacggaggaagaactatggtaccatttcaaagcgtttggtgccgtaagggaaatcttcattgccaagaatagaaacaagaatggtaggaggttcgggtttgttagattcgaaggcgtcaaggatgcacagaagctggagtggacactcgacaacaccgtgtttggcggtctcaagatgcacgtaaatattccaatatttggaagaaacaaggtcgctaagccaatctcgaacacgaacaaagcgaggcacgacgtgcacaaagaagaagcaatacctcgtcatgttcaatctatatcgactacagaccatgggtcgtacgcggaggtagtagcaagaaataacgcaacttcagggtcaaggagaaccgcaggtactaccagaggcaataatggtacatcatggtcttcagtgtacctagatatcccaaaatcgttgatgaagagggcaaacgagacgtgggtgggaagattgaaaaatctcgccatgtttgacagggtagaagatgacctatactgggatatcagcgccgacatctcgtcgaagtacatgggtgctgacatggtcttgttgcaaggcctctctgacgaaggcgcaaagcacatgatgcaggaggaagaagagggaggacttactccattccattccttggagaaatggagccctaagctgcgcataggttacagactgacatgggtttattgctggggattaccaatcacggcctgggacatgcatcagattggaaacatagtggccgcaatcggcgacatgatggatgtggacgatgctgtcgagttggttaaaaggatggacagggtacgggttcttgtcaaaaccctgtggcagccatacatacaacacactgttaatgtgcatatacacggggaggtgtatattgtgcatattgtagaagaaaatggcagcaattccgacacttgctatggccggaagggaagtgcgtatggctcatctaaagaattagaatctgcagatagtgacgtcggtacgctaaacgggattaccagcaatgcgtggatgactggtgaggaggtggaggtcatggtggcagagccaaacgccgagttgcagaatccatatagcaccacctcgacggtgggaccagagctccacatgcaagtacagggattcagcgacaacacggttgtcagtgcacccaccgtggtcacgacgatggccggcgttcaagcttcccctcccggaacccagaatcccgttgatgctcttttatccagcggacaaaaaaataacgttaacccaaagggtaaagatgttatccgctgtgcaaacactccaacggacaacgggcagtcatcgcacagtggtacatgcccaatggactctgccgccaccaaccttgcatgtgagagacgagattttcacgaaattggcattgcagacacaattgggattctaatccctgacgcgagggttgaccatgagcctgaaagaggaaagcttgagggagaagggcagcacgagaatatgaagacccacatttcaaattaa

SEQ ID NO: 79869 - DNA, 3405 bp, Glycine max
  Peptide Sequence Number=SeqID_171554
atggagggaagtgggttagaaagcagtgaagcaaaggctagttcttggacaagaaacctggaacttcccacctttgatggaagcatagaaggggaaactgattcaaagggtaacaattttgagtgtgacgatgacccattgcagttcttgaaatcagaaaacagaagtaaagaagtttcagtaatcaagaaccacacactatgtggtggagaggaaaccaaaaacaatgaagcaatattagtaagagaaacaaagattgaaaaagttatgatggaggaagaagttgatccttcgatgaagagggagaaacacaaggaaaacaaagtgaagaatgtgggctgcgaagaccattttcttgataacccaataccaaagatgatcaagaaggaagttgaagctggtgatgcagtcaagcctcattcttttcaagattcagattttcataaaaagattgttatgatgaaacagaattcattgttggacccaaattcgatcatgaaggtggacagaacatcaatgatgttggaatcttggaatgtcaacttgctggatgtgcctttagcattaaactttgttgcatctatggctgacagctcagcagtggagctaaagggagaaggaattgggtcattcccagttaagctacaaggggtgcagttgtcttccaacaattggagaaaacttgaggaagtttctgtgtgcaattccagttttcaaattccaaccttgaggacaagagcagaaggatccaggggtaaatcagcagaagatggtgaacaaaatatagatgagctttctttcacagaattaagagataagctaattgccctagatcctctcaataaaaagcacatcatcagcattaataaagctgaggccgagttctggcgaaagtcagaaggatatagggttggatggagtgatgaaatattgggctttgattgcggaggccaacagtgggtatcagaggcatgtttccctgctggaaaactagctaatccaagcatgaaagaccttgaatacattgaagagctgaagctacttatagagaaagaagacatacctgcacctgctccaattgagcagcgctggacagctagcagtaggagttccttgagtcctgcttcaagtccgtctggggatgatatattttcttgggtaggtataatcatgtacctccctaccatggatggtcggcaaaggaaagatataacagaagagttctttcattataggcatttgactcaggcaaagttatgggatcgttactccgcatatgaacactgggctaagattgagaaagatacagagagagagtcaaagagaaagggagtgaacgagtatgagagggagcctgtgcgagagagaggacgctcgagtgctagagacctaaaagagagtcttaacggaagggccagatacagaaagagtaaggaggataggaggagaagaggtcacgccattcacgaaagagatttctacagaccagctgccaatcacagatgcatcaataacaaacaccaggaggacccttggattcaagtgggagagtccgttaatgaaacttatctctggaagttattccaggaatggggaaaagtgtgggaggtgttcatacctaaatcaaagaataaacagggtcaacgatatggttttgttcgttttaaaggtgtagaggatgaagggggagacgttgttcgagcatggaaggactccatgaatcctatggaacccaaacaaccgagactcaacaatatgcccttcactagcatgaaatcgtatgcggaagctgttaagcacgatcatacgatgaaagggaaggagattgaggtgcctttgtcagggaagaatggatcagaagctcctgttgcatctgtaacattgcagactgcaaagtggaaaactaattggttggatcatctctgggtgggtcgtctaaaaaatagaggaatgtttgagagggcggtggatgaggttcaggaggtggtaggtatggaggtgaaggtgtcatattggggggatgacatgattatcctccacgacatggacgaagctaaagcagataagatcaacctcagagaacaatccaacggagagacaccgctatattcaatccagaaatggacgccggagttgaagcccgaattccgtttaatatggattcatatctggggtgtccccttggagatatgggacgctgaacacttcgcgaccttgctttcgacatttggagaaattattgaacttgacgaggagacggcggaccgttcgagacttgacgtcgcgcgggttctgatacgcacaaaggagaaacctatcttctccaaatcgatggtggctatggttaatgaaacggagcatcacttgttcttgagggaggaggtatctcgagctatgggaaaacggcagcgttggtcggaattggaggcttttccgccatcaccgttcacgacaacaatggaggattccgacgaagacttgacaacacgcatacctgacggagcatcgtcggaatatttgggggacggatgtcggcgccggtggaccaaggccatcaacctttggcgcgcggagtccgaggctttctcagacgatgacgtgtcgtctcaccatggggagttgcttcctgctgtggacctgccatcctgctccgtgcgtcaggaggatcacaacggtcctctcataggctctttgcatgcaagtggaagggaggttcgtaggttcaccttccctggtcagaagcagacgatgattgaggaaaaaggtgatgaaggtcccaaggacgttgataccgtcaaaggggctgtccttcgggcctttcagcatggtccagaggatattacctctgagttatgccctgcggtcaaaccaaattcaaatctctcaattaaagagatatgtggttcgaataataacactcagaatagggggatggaaggggtcatgcaggacttgggcctgaatactaacggcccagtatcaaagggagaggaaactgcttataacttaaaagtttattctagagaaaaggtgggtgcaggaagaaaatctttgggccatacaaatagaatttctaagaccagaagggatgacaataagccatcacctctggaccttgcaaacagtggccccattcatatggaagatgacttgttagggggggtggatgcagctgatgtggttccaattccgcctcagacctgtctcagtcccattccttcaagcagctttatcaatgttcttgcagaggctgaggaggacttccaccatgaagtagccaggcatttgggcttgacctttgatgaacataaggcctcttttgataacatgaagactgtcaaggatattagtgagactgtagtagcttcaccagctatgatgggaagggataatcttgcctcatga

SEQ ID NO: 79870 - DNA, 624 bp, Glycine max
  Peptide Sequence Number=SeqID_171555
atggacgaagatcagtggatgcatgacaatataatgtctgaagaaattgatatgaatgaacaaaatgaagatgaagatggtatgaaatcagaacatgttgattgttttgatgcattcaatacttctcaggtgtttgctacttgtgatgatgttttgaattgggctcgagctgttgtttatgaaattagttttgagtataggtccaggaagaaagattttgtaagaagagatactaacagtaggaaatgtgagtgtccctttaagctgtgtgggaaatcaatggttggaggccaaggatggatgatgaagttaacgtgtgggagtcacaatcatgaaatgacaaagtcattagttggacatccatacgttggtagattgactaaggatgaaaagataattattgttgatatgacaaagtcaatggtttttttaagagactattgtcccttaccacctttagctttgttatggtctagacattatcatcctcaggcaaagctgatgagaatcatgaaactggccaaatacaggctaaaggcccaagtggagaaggacgaaggcccaagtggagaaggacaaagcccccgagtggagaaggatgaaggcccaagtggagaaggatga

SEQ ID NO: 79871 - DNA, 759 bp, Glycine max
  Peptide Sequence Number=SeqID_171556
atggttagaaccagaagtttgagtcgggctttaggtaagtgttggatttatgagcatttttcatttgttgctgaggctattactgctaaagattatcatgaaaggaaaccatgtgcctactgctggacctctggcaaggcattaccaatgtcaacgtatcgaaaacgtctagatagattgatttttgatggtgtttgttggatggcttacgatgaccaccatgaagttagagagttcgagctggtttctttgttttctgaacatatccgatggggtccaattgttgtcatacactggccagagagggttgtgcggcagtttaggtatgttcaaactattcctccatactctccagatttgggttgtgcctggacagtgtgcagctacatcgattggttgtacatgatttctcatcccttcatgagatcggcacagcctggggatccagttagacatccatctatcatgcaagatgacacatatgttgaaccagatattcctcagtactcgatggttgcagcaactatggaggaagcacttgcagatgcacattctcatgtagagcggcctcgacatgcagtggatggttgccaagcaatagttgaaaggttagaacgattgatgaacctgaggatagtgacagaagatacaaaagcatacagtgtgatggaagactgcctaaggatcgtcagaggtgtcactgcgaaacacaatgtatatgtgcagtcgcgacgaaggcagcgtatgaaagacgcataa

SEQ ID NO: 79872 - DNA, 240 bp, Glycine max
  Peptide Sequence Number=SeqID_171557
atggaggtgctcatgattcaagccaagatagaagaggatgaagaggaatttgttgaaatggaggatttgcttcacaaaacaatccgagtagaacaacaattgaaaagaaaaggtgtggccaaaaggagttccactaattatggttcttctagttggaaggacaagggtaaaggggtttccatctctaatgcaacacctataccatcaaaaactcctccaagattccaagaacaatcctaa

SEQ ID NO: 79873 - DNA, 234 bp, Glycine max
  Peptide Sequence Number=SeqID_171558
atgcatatagaatgtatgagtgggcgaaactcgcatatagaccaaggatcactcatagggctccccaaatggatgggtgatgaggacaaggcaagcaataaggacaaggaacctttagaaggacttggaggacctatggcaagggctagaacaaagaaggccaaggaagttcttcaacaagtgttaaccatgctatttgaatttaggcccaagttacaagtggaaaagctttag

SEQ ID NO: 79874 - DNA, 837 bp, Glycine max
  Peptide Sequence Number=SeqID_171559
atggttatcggttcaaggacgcaaggtgcccctgctttttcagggcgctacagcgctgaagtaatccatgccatactcccaggaaaagctcgaacgaccttcaacaaatgggtacctgtacccgaaaccgacacaggggtgcctcctcacaaagggggtcgcagtgaccaggcccgggcgactgtttaccaaaaacacaggtctccgcaaagtcgggagccgacgaccgaagccccggtgaacggcggccgtaactataacggtcctaaggtagcgaaattccttgtcggactcggtgaaatagacatgtctgtgaagatgcggactacctgcacctggacagaaagaccctatgaagcttcactgtttcctgggattggctttgggcttttcctgcgcagcttaggtggagggcaaagaaggcctccttctgggggggccagagccatcagtaacgggaggcgtgcaaaaggtttcctcgggcccagacggagattggccctcgagtgcaaagacagaagggagcttgactgcaagacccacccgtcgagcagggacgaaactcacatcgacgggaaggtttggcacctcgatgtcggctcttcgccacctggggctgtagtatgttccaagggttgggctgttcgcccattaaagcggtacgtgagctgggttcagaacgtcgtgagacagttcggtccatatccggaccgggaaggacgcacctctggtgtgccagttatcgtgcccacggtaaacgctggagcctccggtagcacagccgagacagcgatgggttctctgccccagcggggatggagcggtgggatcctctag

SEQ ID NO: 79875 - DNA, 376 bp, Glycine max
  Peptide Sequence Number=SeqID_171560
cgcatttgcatcatttgcatcaaatcatcatgatcatcatcaaaacaccaaagtcatttgcttctacagcttcgacctgcagtctattatgagtgtggatgagtttctttctcaggtggcttggccaggagtccagccttctccttctggagggggtaaggcctccgcagcccaaaagcctgcgccagcagaggagctcgtgccaatagcagacgatgagcttgttcctcctaagctgtttatctttgagactgatccagttgctcaggaggaagcagcagctcctcgtgtttctctgcacctgtcggggcccgttttcgaaagtaggcaatatatatatcaaaacgctcagaatgagaccctgagcgtggtttag

SEQ ID NO: 79876 - DNA, 288 bp, Glycine max
  Peptide Sequence Number=SeqID_171561
atggcctctttaaactccttgtttttcaaaagtattttcaggaacaggttattccaagatcatgatgaagaccaagccaacttctgtctcatgacaaaatctcatgaaaacaacaaagaagaatttgtaaggaataagtggtacatcgacagtggatgtttcaagcatatgacaggagatgtatccaaatttacaaccatttcccccaagaaaaatggacatgttacatacgatgacaacaatattagtaaaatctccaaagaggtaacatctaagccatctctatga

SEQ ID NO: 79877 - DNA, 121 bp, Glycine max
  Peptide Sequence Number=SeqID_171562
agtgcttgtcgcccccaacaaggtcatcaggccccctactaaccgagctttcatcaagaagtactgcacccctaggcaggcgcagggcgatacaccacagcagcctgaggatggtcggtag

SEQ ID NO: 79878 - DNA, 495 bp, Glycine max
  Peptide Sequence Number=SeqID_171563
atgtatcagcaggggattgcattgacttggaccatttggaagcaaagaaatgatgtgatattctccaatgggagtttcaacactaaaagaatattagatgatgcaattttcttgttgtggacatggctcacacatttggagaaggatttcggtattcatttcaaccaatggtcatccaatatcagagcaggattttctaataggaagaagattgcttggatatcttggagacaatgctgtgcttctagagatttgggaggtttggggatcaaagatattaagatcctcaataatgctctcctaatcaaatggaaatggctgatgtttcatcaaccagatcatctttggaacaggattttgatctctaaatacaaaggttggagaggattggatcagaggcctcaaaagcagtacttttctccttggtgggctgacctaagggccattaaccaacaccagagtatgattactgcttctaatcaagtttgctggaag

SEQ ID NO: 79879 - DNA, 243 bp, Glycine max
  Peptide Sequence Number=SeqID_171564
atgagaattcaagggactaaccgcctaagaattctttgtcctaacacattggagggtacatcctttgtggcacaagtagagggtacatctacttgggttgttatattgagaacaagagagggtacatctcttgtggatcagttcaagtggaggatacatccacttggttgttcaaagagaacaagcgagggtacatcccttgtggatctttggcaactcaagaatattagtgggatcctctag

SEQ ID NO: 79880 - DNA, 537 bp, Glycine max
  Peptide Sequence Number=SeqID_171565
atggaggaggatgttcctcaggtgactgaggatgtccctcatatggctgacgatgttgctcagatgagtgaagatgcgcctcagatgaccgcggacgtagatgcgactgttgcagaggacttaggtcatgatggtgctgaggggtcacgtgctgatgagggattccctggtgggccccgtgacccatcagttctgacttcatttgcgaagcatgtcgcacatgctatttggactggacaggagcgtcttgagctaaagttggtgtcgcacgggaggaaggtgacgttaattgggaggccagtgcctgcgattgaaaggctggttgttgccacaggattaagtccattgatcgagtgttcagttgtaaccggcgatcctggacttatatccatatttgtggagaggtggcacagggagaccaacaccttccaccttccagtaggagagttgacaatcacactagatgatgtgtcatcactcctccatctccctatcagtggcgccttccacagcttcccggctctttccgtggacgag

SEQ ID NO: 79881 - DNA, 1074 bp, Glycine max
  Peptide Sequence Number=SeqID_171566
atggctacctcaccaaaagaaactgcagctcctggttcacccgctgtaccatcatctccgcaccaggaacaaccagaattcaacatccaacccatacagataattcctggtcaagcttctgtccctgagaaactggttcccagaagacaacagggagtgaagattgctgtaaaccctagccttgcaacaagttctagggaagtagacacggagatggacaagaaaatccgcagtatggtgagtagcattttgaaagaagcctctgtgcctgaagctgatgaagatgttccaacatcttccaccctaaatgtttctatgcctgatgttgagaaagatgttccaacatcttccggcccaaatgatgaagtactctcttcccccagcaaagagagatcaacagaggaagatgatcaagccgcagaggagacccctgcaccaagggcaccagaacctgctccaggtgacctcattgacttagaagaagtcgaatctgatgaagaacccattgccaacaggttggcacctggcattgcagaaaggttacaaagccgaaagggaaaaactcccatcaagaggtctggacgaatcaagactatggcccagaagaagagcactccagtcactcctgccacatccagaagaagcaaggttgctatcccctccaagaaaaggaaagaaatttcctcatccgagtctgatgatgatgtcgaactagatgtctcgacatctaagagggccaagaaatctggaagaaaggtgcctggaaatgttcctgatgcaccattggacaacatctctttccactccattggcaatgttgaaaagtggaaatatgtatatcaacgtagacttgccttggaaagagaactgggaagagctgccatggattgcaaggagatcgtggatctcatcaaggctgctggactgctgaagactgtcagcaagttgggagagtgctatgaaggcttagtcagggaattcattgtcaacattccctctgacatatcaaacagaacaagtgatgattatcacagagtgtttgtccgaggaaagtgtattagattctcccctgct

SEQ ID NO: 79882 - DNA, 462 bp, Glycine max
  Peptide Sequence Number=SeqID_171567
atcacgggcctctgccagtcatttggggttcccatcgcacctagtaaggtgattcgaccgccgatcacccgggccttcatagagaagtattgcacgcctagacaggtgcaaggtggcgcaccgcaggcctcagacgcaccgccgccacctcatcaggctgatccagctgggttatttgacacggagcgatatttacgacatttggttcgccagcaggcggccaaccacagggcgcacgtgcagacccatgactgtctctaccaactcagcctcagtctgcagagccagggtttcgctccttttccatgccctactctagaccagttcagggcagaggtcgcatggcctgaggcccaggcaggggaggcgcctgcagaggctcccgacgatggagaggaggcccgcatggatgaggagatgacagatttgctcgatttcttgggaggcagcggagccacgtga

SEQ ID NO: 79883 - DNA, 174 bp, Glycine max
  Peptide Sequence Number=SeqID_171568
atgggttttcctttgccggcagtcacttaccttgctgaaaatttatctggtctgaaggccaaggttcaacaaggtctaaggttgtgtctcaatggggtattttatcgtgggaaccccaatcttgatatctggggcgaaacaaatttgggtgtcaaggtgtcgatttcgggctga

SEQ ID NO: 79884 - DNA, 303 bp, Glycine max
  Peptide Sequence Number=SeqID_171569
atgaataaaggaaagagtgatcttagtcatttacttagtgtgaaaaagcatactatcgataagactggtttggagtataacaagaaaactgacttttccaatagaactaagtttgcatcctccaaaaagttgaacccaaacaaggtctccaaaatgaaaaacatattgcatcctaagcctaatgcaaagacttgtcattattgcatgaaaagagggcagacatcctataaatgctatgttaggagatttgatgttcctagaggtgtgcctaaaagcaacagactcactatggtacttggatag

SEQ ID NO: 79885 - DNA, 588 bp, Glycine max
  Peptide Sequence Number=SeqID_171570
atgaccgatcgtctcaatgagtcgatctcttgctttctcataaggagggttcacgccttcaccttcagaggactacacgtcctcgccatcagagggctacacgccctcgccatcgtaaggctacacaccctcaccttccgaggactacatgtcctcaccttcagagggctaaacgcccccgccttcgtagggctacacgccctcaccttccgaggactacatgtcctcaccttcagaggactacatgtcctcgtcatcagaggactacacgtcctcgccatcagagggctgcacgccctcacctttagagggctacacaccctcgccttcgtagggctacacgccctcaccttccgaggactacatttcctcatcttcaagggacaacatgtcctcaccttcagagggcgacacgccctcagctacacgtcctcgccttcagagggctacacgtccttgccttcagaggactacacgtcctcgccatcagagggcttcacgccttcacctttagaggactacacgtcctcgccattagagggctacatgtcctcaccttcagagggctacacgccctcgccttcgtag

SEQ ID NO: 79886 - DNA, 216 bp, Glycine max
  Peptide Sequence Number=SeqID_171571
atgttgttggaattgtgggtcgaagaaaaccctacactactcttggaacagacgtgggtgctcaaagctcaaagctttctatgctgccagttaacaagcttgacgagagttacacgccgagcaaagtttccatccgtgccggagattaagaccgtggaactcgtgaaggcaactgggtgggtttatctatccttgtctggagctgatcctaggtaa

SEQ ID NO: 79887 - DNA, 426 bp, Glycine max
  Peptide Sequence Number=SeqID_171572
atggtgaaagttgggaaccttcttacgtgccgatcaacgtctcattttccgccaaaaagttggcccagggcttccccggtatcaacagggacaccagggattttatttatttctgcgaactgtccctcctgttcagctactgacggggtggtgcgtaacggcaaaagccccccccggacatcagcgctggcaagtgtagcggtcccgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaa

SEQ ID NO: 79888 - DNA, 1809 bp, Glycine max
  Peptide Sequence Number=SeqID_171573
cccatcgaagggttcgtcgaggatcagcaggtcaggctcgggcatcagcgcccggcacagcagggttttgcgcgtttcgccggtggagaggtatttgaagcggcgcgtcagcagggcggtgatgccgaactgcgcggccagccgctcacagcgcgcggcgtcttgcacctcttcctgaatgatttccgccgcggtgcggccggtgtcgtcctcgtccgcgctgagcagatcggtgttgttacgttgccactcgtcgctgaccattttttgcagctgttcgaaggagatgcgcaccgcgtgctgaaagtcgctgcggcgctcaccgctcagcagaaccagttcgtcggccagcgcgcgcgccagggcggatttgccgctgccgttggcgccgacgaaggcccagctgtcgccggcctggatttccagcgcgtccagcgtcagggtgcgggcgtattgcagggtgatgtcaatcaacaaaaacgcaacgttacgttgcgcttaacacaacgtggcgacaatcacgcgatcggcgttgaacagggcgtgtacggcggtgccgacgctcagctgcaggcgctgcagctccgccgtcgtcagggtggcgcacagggtttcgccacccgccagcgtcaccagcacctcgctgtgttcggcgcccggctgaatgccggccaccacgcccgccagcgcgttatccgcgccggcatgctccgcgggcgccttgatcagcgccagcacctctttgcccggcgtcagctgcagccggtcggcgctttgctgggtgacggccgccgtcaggcgagtggtgccgtcattcaacaaaatcgccaggtgctgctgcacctgctgatgatcgcgttcgatgacggtaccgaagaactgattgcgcgcgctggtttgcagcgagaagcgcgagatggccgccagcaggctgtcgagcggcagatcgtcctgctgcaacacgtcgaaagctttttgctgcacctggcccagcaggtcatacagctggatcaaccgctggccatagtgcgtcagctgtgcgccgccgccgcctttaccgccggtggcgcgttccaccaccgtgtgttccgccaactggttcatctcattgatggcgtcccaggcgcttttgtagctgatgcccgccagtttggcgccctggctgatggagccggtgtgctgcacctgtttcagcagcgcgatgcggcgcggatcggcgaacagcttttgctggagtttgagagtcagaagaatttcggcctgcatagcgcatcctggatgcttcacatgagtacgacacgccggcgtcttgtcacgcccagaaaatcgttatgccttgccgccgcctgggtcggcggcgcactgacggcgccgttggctttcgccgccgactgcgataaatcccgcaatgccacgggatgcgaagaacagctcaccgtggaggcggcggcccccgccgggcgctacgatgcgttgagcgccgtgagccgcagcgcttcgcagcttgggctgaccgctcgggagacgccgcgcagcgtcgatatcatcagcgcaagagcgatccaacagcggggcgatcgctcgctggccgccgccgtcgagcacgccactggcctgtccggcgtcgcttcgccgacgctgtccaacaacttttccgcgcgcggtttccggccgatcgcctggctgtataacggcgtggagatgcccggcagcacgctgcagctgggcgatccggcgcattacgacagcatcgagatactgcgcgggccgggatcggccttgaacggcctgagcgccgcgggcggcagc

SEQ ID NO: 79889 - DNA, 689 bp, Glycine max
  Peptide Sequence Number=SeqID_171574
tccaagcctcttggagtcttctatccaatacccttggggggtaggattgcatcaatccatgtccgctccgaagccatcgctcgtgtgtcgataaagaagagtagattgggaccaacacttggctgggataggaggcagaacaatcaactggtttcctcaatggaaggaaggaaaggagggagttctcttctcatgtggggactacccgaacatcccgttgataggaacgaggggggagcaccggcggaagagagcctctctcctttccttgtgagatatttcggcgcgcaaagtttcaaggttatacaaagagtccataaggcgtgggaaagcccgttaaggaaagataaagaacttaggggcatccataatggcatcatcggtgaagaggatgaagaagtccgagctctaaaaaccgaactaggaaaagcaagacttgccaaagaaaaaatcaagttagtcgctacagacatctggaaagagtgtgccgagttacgagaagaaaatgcggctaccgcaagagcccttgaacaagaaaccaagagggctcgcaaggaagagcatggccgagaaaaatttcgtggagctttgtggggcagcaacaatgagctcaagcttcgaagggaagagagagaccaatcacgagcacatagcatggtcttaaaagaggagttagctgcttgctcaag

SEQ ID NO: 79890 - DNA, 231 bp, Glycine max
  Peptide Sequence Number=SeqID_171575
atggcaacggaatggagatggaagagagagaggagacaccacttcaaggataagatgagtctagaagaagctcaccaccataggaggccatggataagagcttggaggaagaaggagatgaatgaagggagaggaagagaagagcacgaaattttgtgctctaaaagagctttgaaatctgaacccactaatccaagatcaagtccaagattctccactaagtgtgcttag

SEQ ID NO: 79891 - DNA, 759 bp, Glycine max
  Peptide Sequence Number=SeqID_171576
gaattagaccacaagaagcaagtcgaaaatggggaggttggaataccaagaaaatatttggaggcaaaagcaagaatcttggcaggtaaaggcgagtgggccccgttcatagatattctcgcactgttgattttcggaggagtcctctttctgaatgtggatgggttggtggacctggcagcgatcgacgcttttctcgcctatcataaccacaaggaaagcccggttgtcactatgctagtcaacctatatgacaccttcgaccgaagatgtgaaaagagcaatacaaggattgtttgctgtactccagctctttatgtatggttagtttcacacctttttcgccaagaggagcatctgtcaactggttccctcgatggaaggaaggaagaaccggagttcttatcatgcggaggatttccaaatgttcccttgatggggatgaggggttgcatcagctacaatcccgttcttgctataagacaacttggctaccctatgagaggggcgccactagaggatgagctcacgcctgtcatttcacgagatttcaataagaccaacatagagacagttcagaaagtccgcaaggcatgggaggtgttgcaaaagaaggacaaggaactcaggggcagtaacaatgggcccatcggtgtggttaaaagcccacgtgcaagaaccgctaaaagagaggaagttgaggcaccagaggaagacaaagaagtgcaggcccttagggcggaactcgagcaagcctaa

SEQ ID NO: 79892 - DNA, 516 bp, Glycine max
  Peptide Sequence Number=SeqID_171577
atgggtgatcaagaggagacacaggaacagatgaaagccgacatgtcggctctgaaagaacaaatggcttccatgatggaggccatgttaggaatgaggcaactcatggagaaaaacatggtcaccgctgctgccgttagttcggttgccgaagcagacccaactctcctagctactgcgcaccatcctcccccaaatacggtaggacgaggaaggagcatactggggcacaacagtaacccccatttgggatacaaccgggtggcttacccttatggatttccacctaattacacgccgccagtcatgcaagatgatgcgggtcatgtctcttctcccatccttgaaggggagcctcctcgacagcctgacgaggtccacaaagatcatcaagagtatgcccaaggggatgtcgagttctaccccccgatccccgtcaaggggccgtcacccaacactttgcctctacccaacctcgcaatgtcgtcatccccccaaaattcggggatcctctag

SEQ ID NO: 79893 - DNA, 457 bp, Glycine max
  Peptide Sequence Number=SeqID_171578
gtggtaagcatttcctccgtggattccttctctgggcaaccttgcctatcagatatggcagtaatggtggcccgggtaatgttagggaatggttacgagcccagaatgggtttaggaaaggacaacggtggcataacttgcctgataagcgccaagggaaatcgtgggaagtttgggttaggctacaaacccacacaggcagatataaggaaaagcgttgcgggaaggaaaacggaagtcaaggctcacgattaagacaagaagacgaaggaaacccgccctgccacataagtaggagctttataagcgcgggtctaggggacgaaggccaagtcgttgcaatatgcgaagataatgctccgagtgggtcggatttggtacgaccatgccttcttgatttccgactaggaaattggggagtggaggagcgcccagacatttacgcgacaagcataat

SEQ ID NO: 79894 - DNA, 576 bp, Glycine max
  Peptide Sequence Number=SeqID_171579
gccctcaaggcagagcttgagaaagcccaaacagtcaaagaaaagttcaagtcagcagctattaggatccaaaaagagaacgccgaactaagagacgtcaatatagccaccaccaaagccttggagcaagagaccaagagggcacataaggaagaacatggccggaacaaatttcgaggggctctgtggggcagtaacagcgagcttaagctccaaagagaagaaagggaccaatcacgagtagaaggcttgattctgaaggatgaattgaaggcttgcctaaggtcaaagaggagtttgtctcaacgattatgcgagaccgaaacaaacatgttagccatcatcagcaagtaccaagaagaattaaatttagcccgagtgtacacggaaaagaaggctagaggaagggtgattaactcgttacatcaagaagcaacgatgtggatggaccggtttgctcttactttgaacgggagtcaagaacttcccctattgctagccaaggccaaagcaatggcagacgcctactcccccccgaggagatccacgggctcctcagctattgtcagcatatga

SEQ ID NO: 79895 - DNA, 351 bp, Glycine max
  Peptide Sequence Number=SeqID_171580
atgccgatgttggatcaatttcatccatgcagtcatgattccattgaaaacattgttgatgtcaaagcggacggtaactgtgggtattgtgcaattactgccttattagttatgggtgaagattcatggtctttggtgcgcagccatttgcttaaagaacttgccaaatggtctgatgagtatatcaacgtgcttggtggcatagacagatttgaggaattaaagcggtcactacttgttgatggattatccatggcaaaacagtgccctacttcatatattagtagaatgcaacaatacaaaaatttgttgatgttgaaaacagactttgttgatttaagtgaagattga

SEQ ID NO: 79896 - DNA, 645 bp, Glycine max
  Peptide Sequence Number=SeqID_171581
atggcacgtattgctgacaagataaaaaccatcgacggatctaaagaaactctgaaacttgctgtaaggataaccgatctctggtttgttgggacaccgagcaggtctgaacaagctgagatgatcattgttgactctgacacatcattggtgttgttaacgaggttgtctttcgtcatatttcacctagaattagttgtttttcatcttcattggatccaacttatgctttcatttctgagtggtacaggatcctatccatgctcggttagcaattctttgaaggcttctaaactgactattaacgagccactggcaccaattgaagaattcaatcagaagctttcagaattgggcattgagatccggtcaattttgacacatcgttcccagtggagttcacagccttcaggttatgctcagttaccatcaagggagacattcatttccaagtcaaaggcaaagagcatttctgagataaacaacctttgtgaagagtttgtttgtgttactgttggtacaatcacaaggattcttatggacaatcattcatggtgttatccatcttgcattcagtgctataagaaaatagatgtctatctagaaccatttgtgtgcccatgtggcaaacaggggatcctctag

SEQ ID NO: 79897 - DNA, 207 bp, Glycine max
  Peptide Sequence Number=SeqID_171582
atggtgaagcatggtgtcatggaggtagttggtgtcgagggtcatggctacgttaatggtggcggagggagaggagccgcagtcctcaccgttgccggcgggggcctcccggaagagagggagcttcggggaaggacgactgacaacaataatttaacggtattaaacaattttaacggtgtggacctattgggaattaaatggtaa

SEQ ID NO: 79898 - DNA, 108 bp, Glycine max
  Peptide Sequence Number=SeqID_171583
atggtgtatattgcaactcatgccaagcttgaaagacgagacttttccaatgaggaagagaaggaagtagaactgcttgccatggaaggaagaacagttgctggttaa

SEQ ID NO: 79899 - DNA, 294 bp, Glycine max
  Peptide Sequence Number=SeqID_171584
atgaagtacggggtgaagagtctagtgaggaagtctacccccatgaagaagatcatttacaatggcctagataatgagattaccctcacctatcttggcactaaatttgtgttgcattctcaaacaccttcacaagtagctaaggatcaagtacaaataaaactcaaatgggataaggaaaagaatagaaaaagaaaagaagaacaacctttaatggttaaggaggagtgtaaggagataagtgtctccaccaagaggttagctaagaaggaaagtcattttacaatggcctag

SEQ ID NO: 79900 - DNA, 146 bp, Glycine max
  Peptide Sequence Number=SeqID_171585
atgggggatgtgcaagaggctgctacaaatggaatatctcaaagtgatgtagctccatgtagagcttgtaggcctcagatcttcatcatcaatggagtcttctacttcttgaagatcaatggcagcggaatggagaaggaggaaag

SEQ ID NO: 79901 - DNA, 737 bp, Glycine max
  Peptide Sequence Number=SeqID_171586
tcttctatccaatgcccttgcggggtaggattgcatcattgagccttctaacacttaagtatgaactcttcaatatggaagagggagaagatatccaaaccatgtttggacgtttccaaaacattctgaacaagcttcactctctagccatcaagaatcttgattcaataactcttgaagagcttgttggaattcttaaagtccatgagttggagcttgctcaagatgaaggaacaaagaaaggaaaatcgctagcccttacaattcaaagaccaaaacacaactctgcgtccaaagcccttgttgttaatgatgcttcaaaagaagaatctgatgaagaagatgatgagctaaggcacttcaagtcagaatgtcctgacattgaaaagctaaaggataagaagaagaaattcttcaagtccaaaaggaagaccctcatgagcacttgggaggacctgggcaattcatcgtctaaagaggagagtagggaagaagccaacctatgtttgatggctgatgcatccaccagtaaagcaaaaccagcactggacgcaagttcagatgatgaagactctcagcctgatgacactatcaactctaatgatggctctgtttatgaggaagtcaaggtactattggatgaaaaggtatccagtggacacaaaactcttaagaattttcaagacttggaagaaagagtgaaatccttaaccacaactcttgaagatccaaaataa

SEQ ID NO: 79902 - DNA, 549 bp, Glycine max
  Peptide Sequence Number=SeqID_171587
atggagtgtaagttgcatccatctaaggttgcagcaaaggctgtcacattgtccattaagccttctacatcgggagcaattccaaaagatcatcaggaactttttttccagcgttttaaggccatattggattggagattatgtctggaacgatctgttatcataattgaatgcatcgggtattattctgagtgtgcacgggcaaaaacaaatgggcatctgaaaaggtgggtgtatgcacacaggtggttctatcagcttgcaggatcacgccactcgcatgtcagaggagcttggtcgatctgcatacgtagatggggtctttcagcaaactcattaaagaaaggatactggaagaatttgaggctagactatctcaagctaggtctaatgctgcatcaagtgttgctgcgggaccaaagcataagggacgcctttacagtacttgagaccttgctcatgcttataaatatggagatgagaacatcatttagtatatgcaaggatcttacagttgcgctcaagatgctgcagagattaactgactga

SEQ ID NO: 79903 - DNA, 276 bp, Glycine max
  Peptide Sequence Number=SeqID_171588
atggcaagaaagaaagtgagtgagagagaaagagaaagaagccttttgccacgggagaaagagaaatggaaaaagaaaaagaaaaatgaaaagacttgggatgaagattggaaaagaagacacctgcaacaatacgtggagcaaccaagggagtgggaaatgaaaaggttagaaaagaagacacctggaacaatacgtgaagcaaccaagggagtgggaaatgaaaaggttaaaagaccaaaaaaccaagaaaatggacagctgtcacaaccttag

SEQ ID NO: 79904 - DNA, 339 bp, Glycine max
  Peptide Sequence Number=SeqID_171589
atgccttccaaggttattttgatgatgccaaagaatgaagagttaagcaaattccaaagattcaagaatcaagttttcaagaatcaagatcaagattcaagaatcaagagaagactcaatcaagataaggtacatctacttggggattgttatactgagagcaagaaagggtacatctcttgtagatcagttcaagtggagggtacatccacttggtttttcaaagagaacaagggagggtacttcccttgtggatctttggcttgtaaaggattttacaaggttgatcaagaaccacaggttgcttggggactggatgtaagcacagtttgtggctga

SEQ ID NO: 79905 - DNA, 482 bp, Glycine max
  Peptide Sequence Number=SeqID_171590
ttcttcttggtgtgggagttcaacgacaagcaacggcagctcgtggtggccactcgtggtcgtgggtggtagagaagaaggtgttagggtttggcgagctcgtctcgccaagcggtagaccacttttcgcgcttagcgtgacaattcgtgctgagtgcaactccccttgtgctaagcgtgacaattctcgctcagtgcaattccctcttgggaaaatggctacaccacctaactcccatcctcctccacctcctactgattcacattcaccttctaccatgaagaggctaagaaaagagactcggttgagatcattggctactagaccagttggggcaaagagacccttggtccatgtggatcctgcaactgagaaagccgacgatccccacagaaagaagttaagaacatatttggggatcttcgctcgtgataaggtggatgtgacatacgagaattggaaagaagtccctgctacctag

SEQ ID NO: 79906 - DNA, 999 bp, Glycine max
  Peptide Sequence Number=SeqID_171591
atggcagaatcatcaaagaagcacaagggcttatcttcctctaccaccactacaggccaacgccgccacggtgcttccggtgactttccagcaccacccaatccatccctttcttcaccatgctctctcactctattttctttcgatgatcaacatcagaggtattactcctccttttccaatcgtgccattcttgatcctaaattccttgattttgatttctttgaggatgaaacctttgactgttatcaagtttttcaaaactctgagttagtgaattttatgactctgaaatttccttattattcggaattagttcaattcttttataacaatttagaaatttgtgaaggaatcatattctctgaagtacacaaaatatccattgttgttgatcaatcattgttttattctctcaccaaattgagtagtcaaggtgtaccttttgaaggagccttagttgatgattggaaatccatttattccagtcatgatgctcgaaaaattgtctgtgatgaaaatgttgataagactggttgtttacttgttggttcttttacctttgaatgtcgtatcatgcattatattctatgtcaagtgatgtttcctcgttccacaaaccttgctcaagcttctgagaaagttttaattctattatgggccctgcaaactggtcgtcaaattgactgggcccatcttgttcactatcgtatgcataaggcattacggaaaaatacacctctttcttatccccacctagttactctgattctgcagcacttcaacattcctcttgctaatgaaccttttgtcaaggttcaacgttcatttgccattggagccgctgcagttgcatcctttgggtataggaaagatctagatggtcaatgggttcataaacaggatctatcgactaatgctcccgatgaacgcactccatctccaccaccaagggatccctcctcttcattactgaatgatgtccttagtgagctttga

SEQ ID NO: 79907 - DNA, 717 bp, Glycine max
  misc_feature (4)..(4): n is a, c, g, or t
  Peptide Sequence Number=SeqID_171592
atgnaggtttttgggataaaaatggtcattgaccaatcccttttccatgacttaacccaattgtccagtgatggtgtaccatttgaaggtacactgaatggcgattggaagtttgatttctctgcacatgatgcccgccagttggtttgcaccaaccatgcggatatgaccggacgccttcttgccggttcattggcttttgaaagccacatccttcattatcttattgtgcggattttacttccacgatcttccaaccttgcccaggtttctaaggaagatcttgttatcatgtgggcctttcatactgggcatcaacttgactgggcacacttagtcagatatcgcatgcataaggcattgcaattaaatgctcctttgccatatccacatcttagatcctttttaattggtgctgctgtgattgcttcttttggttaccgcaaagagcatgatggctcttgggtcaaaaagggcgctcaacccgctgatgaagaaggcaacctaccagttgaagataattccactcttcttcgaaggcttatggacaagtttgatggttttcagacctttgttggtgacaagtttgatgccatggaattgcaagtcgacatgcggtttgatgccatggaatcaaggatcaccaaagttgaagaagatgtctccttcatccgtacttgctttgatccaccaccaccgcctccatcatcatcttag

SEQ ID NO: 79908 - DNA, 923 bp, Glycine max
  Peptide Sequence Number=SeqID_171593
atgccgctgacaattcccggcttgcaaccgtggcaaggcgtcttacaatcgaccccattcccggccgtaaaggctgccgttcaagagaggtggaagatgagcgagcaggaaaaagacttttttgaacaggcgatggcggacgtggtgccgctggcgagcgggcggcagacgctgtacctcaagccgcaggagacggtagacaaaagcgcgcggcgtgaagcgcagcggctgcggcaggaaaacttcctcagcaccgatttcctcgaggtgatcccctgtgaacagccgctggagttcaaaggggaaggcattcagcagggcgtgctggacaagctgcgcaacgggcgttacccgccgcaggcgtcgctgaacctgttgcgccagtcggtcgaggccagccggcaggcgctgtttcgcttcatcgtgcaggcggaggcgcaaaacctgcgttcgctgctgatcgtgcacggccgcgggcggcagaacgaaagccatccgaatatcgtgcgcagttacgtcgccaaatggctggcgcagtttgaacaggtacaggcgttttgccgcgccttaccgcgcgacggcggcgagggcgcctgctacgtcacgctgcgaaaatcggcgcaggccagggcggaaaactttgagcgccacgccaagcgcagcctccagcgaataacggccggcgccggtcaccgccagcaacagcaagccgccaatgatgctgatgtttttaaagaagttgatttcgttgcccatcatttccatgccggtcattttccagaacggatggccgataaacgcggtgcccaaaacattttgggcgaaaatgaccgcgatagggcgagtaaacagaccgagaataagcgcgatgccgaaaataaactccaccagcacggaaacgatcgccgccaaataatgcatcg

SEQ ID NO: 79909 - DNA, 152 bp, Glycine max
  Peptide Sequence Number=SeqID_171594
gtgttgaggaaaaaagcccagagtttcaagaacctcgagatttgaggtcaaatccttttcaagggggagggaatgatgcaatcctacctcgcaagggcattggacaaaagactccaagaagattgggccagagatacaagagaaggccctag

SEQ ID NO: 79910 - DNA, 294 bp, Glycine max
  Peptide Sequence Number=SeqID_171595
atggtgccgctaagcgcaacctctaaggagcttagcgcaaatccttgcgctgtttggttcctttatttgcaaatgtcatcaagaaagagggctagaaccgatgacatcctttcatcatccatcccagctcctcaatcagtcgccatagaactagatgtccaacacccgcaaactttagtccctatgctacagagcctattcaaaggacaactcattatcatgcacaacctgcgagagttggctcagaacaggccaattatacctctagagtattttcttgagaaagtagtgtag

SEQ ID NO: 79911 - DNA, 233 bp, Glycine max
  Peptide Sequence Number=SeqID_171596
gcgcagggcgagacaccacaacagcctggggatggccagcaacaggcaacaaatgcaccgccgccacctccaaagctcctcagctcatccacaaaaaggttagagcgttgcctatgatacatggccgaccaataggcgaccaagtccaaggccaaaggcgtccagctcaagacgttaaagaagcgctactaggaggcaacctagtaacttttaaatctctgcttgttacttga

SEQ ID NO: 79912 - DNA, 479 bp, Glycine max
  Peptide Sequence Number=SeqID_171597
atgactagggacaatccaggtgatttacaaccctttgatcctaaaatagatagaacctttcatagattacttaggcatagtgttcatcctgatcattttgtgcattttgagcattctgagtattctgttgctggtgattttgaatattctgattttgagcattcgactactaattttcatactgagaacatggctcaacctccacctcgtgagaggactcttagggagatggctgcacctaatttcacttatgaaagcttgtgcattcaatatcctgatgagggtgttccatatgttctcaagactggactaatacatttgctgcccaagtttcatggtcttgcaggtgaagatcctcataagcatcttaaggagttccatattgtctattccaccatgaagccccctgatgtccaagaagatcatatctttctaaaggcttttcctcattctctggagggagttggcaaagattggtt

SEQ ID NO: 79913 - DNA, 81 bp, Glycine max
  Peptide Sequence Number=SeqID_171598
atgggtacagttaccaatgttcttcttatgaaggtttttcctgtacctccaaattcatataggaaaaacatgccaccttga

SEQ ID NO: 79914 - DNA, 197 bp, Glycine max
  Peptide Sequence Number=SeqID_171599
aagaatcaaacaaggccgcttcaaaggataagcactgcttcaagattaatacaagattgcttcaacaaacaaagtcttgcttcaagatcaagccttgcctcaaaacaaagggtttcaaagtcatccaaggcactggtaatcgattaccaggcaatgtaatcgattacaagaagggaagtttgaaaaataactattaa

SEQ ID NO: 79915 - DNA, 359 bp, Glycine max
  Peptide Sequence Number=SeqID_171600
gtatggcgcctaccaggcaccctctggacccggataagtccaacagggccctgggatttcccgctttgatcataggactctgccagtcgttcgaagtccccgtcgcacctagcaaggcggccaaccaccgggcgcatgtacagacctatgattgtctttaccagttgagcctcagcctgcagagccagggttttacttcttttccatgccctacttcggatcaattcagggcagaggtcgcttggcccgaagattggccgaaggcaccagcagaggctcccgacgaggcagatgaggcccgcgaggaagaggagatgactgatttacttgatttcttaggagggagcagagccacatga

SEQ ID NO: 79916 - DNA, 207 bp, Glycine max
  Peptide Sequence Number=SeqID_171601
atgatgaaacacaactccaacatccttattgaaagagacaacatcgagggtgggcccgtcgggaaacctgtcgtgccagctgcattaatgaatcggccaacacgcggggagaggcggtttgcgtattgggcgctagcggagtgtatactggcttactatgttggcactgatgagggtgtcagtgaagtgcttcatgtggcaggataa

SEQ ID NO: 79917 - DNA, 633 bp, Glycine max
  Peptide Sequence Number=SeqID_171602
atggccccgaggaagcttgcctcaaagaggtccaggaaggacaaggcggccgaaggaactagttccgccccggagtacgacagtcaccgctttaggagcgttgtacaccagcaacgctttgaagccatcaagggatggtcgtttctccgggagcgacgcgtccagctcagggacgacgagtatactgattttcaggaggaaatagggcgccggcggtgggcaccactggttactcctatggccaagtttgatccagaaatagtccttgaattttatgccaatgcttggccaacagaggagggcgtgcgtgacatgagatcctgggttaggggtcagtggatcccgttcgatgccgacgctatcagccagctcctaggatatccgatggtgttggaagagggccaggaatgcgagtatggccagaggaggaaccggtctgatgggttcgatgaggaggccatcgcccagctgctatggaggcgagtgcgaatcatgcgcaccaatatgaccgccctgacccagatatggatgacgttgctcctcagcaacatcctgcccaccgatcataattccgacctccccatgcctaagtgtcagctggtgtacgccatcctgacacggatgagcatccat

SEQ ID NO: 79918 - DNA, 773 bp, Glycine max
  Peptide Sequence Number=SeqID_171603
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgacttggactgtcaagtgtaacccagagtatgatggaatgatcttgcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 79919 - DNA, 894 bp, Glycine max
  Peptide Sequence Number=SeqID_171604
atggatttcttttcaaatgagagttttgaatgcattcaagcatttgaaaactccaatcttattcctttcatgtctttaaaattgtctatttattctgatttagtcaaagccttctattcaaacctagaaatccaagaaggcactttaatttctaaagtttatgggattaagatggtcattgaccaatccctattctatgatttaacccaattgccaagtgaaggtgtaccatttgaaggtacactaattgatgattggaagtttaatttttctgtgcatgatgcctgccggttggtttgcaccaaccaagtggatatgaccggaaggcttcttgccggttcattggcttttgaaagccgcatccttcattatcttattgctcgcatcttgctcccaagatcttcaaaccttgcacaggtttctgaagaagatcttattgttatgtgggtttttcataaaggcctacaaattgattgggcacatcttgttagatatcgcatgcataaggcattgcgattgaattctacattgccatatccacatctagtcaccctcttccttcaacactttaacatcccttttgattctgaaccctatgttccaatcaagagatcctttctaataggcgcttcagtcattgcatcctttggttatcaaaaagagcatgatggctcttgggtgaaaaagggtgctcgacatgttggtgaggaaggacgtgatggagaagattcatctcttctttcaaagattttggacaggttcgatggtcttcaaacctttgttggtgaaaggtttgatactttagagttacaagtggacatgcgcttcaatgagatggagtcaagaatcaccaaggtcgaaagaagatgtctcttatattcgttcaagctttga

SEQ ID NO: 79920 - DNA, 1126 bp, Glycine max
  Peptide Sequence Number=SeqID_171605
cggaggtatttacggaagccgtcgtatccctcgcccaatactatgaccagccgttgaggtgtttcacgtttggggacttccaaatggtgtcgactattgaagagtttgaggaaatattaggatgccctcttggggggagaaaaccgtatcttttctccgggtttcttccctccttgaacaagattgcagctgtggttggagattcggcaaaagagatggatcgcatgaagcaaacttggaacggcgtagtgggcttgcctcggaaatacttggaaggcaaggcaagggatatggcgaaccaagagaagtggggcccgtttgcggatatattagctttgttgatttttggggttgtcctctttccgaacgttgacggtttggtggacttagccgccattgatgctttcctcgcatatcaccatagcaaggagagtccagtggtggctatcttggcagatttgtttgacacctttgaccggagtgcaggattgtctgttgtttacccgctctttgtgtgtggttggtttcacacctattccaacaagacacaagacacccgtgtccacttcaaagttatcgctcatgcgccgaaaaaggaagagtcgattgggaccaacatttggctggataggagagcaacgcaatcaattggtttcctcatgaaggaaggcaaggaaggagtctcttttctcctaggataccccatgaggggagcgccaaatcaaaacggaaaggtctctcgcctttcctttatcgaaagactcaaggtgatacaaagagtccagcctcaaggcgtggagaagtccgttgaagaagacaaggagcttagaggcatccgaaatgcgtcatcggtggagaacttcgaagctccggaggaagatgaagaagtccaagctctaaaattagagctagggaaggcgagactcgccaaggagaagttcaaatcaaccgctacacacatccggaaagagtgcaccgagttacaagaggaaaatgcggccactgcaagagcccttgaacaagaaactaaaagggcccgaaaggaggaatatggccgagaaaaattccgaggagaactgtggggtagcaacaatgagctcaagctccgaagagaggaaagagaccg

SEQ ID NO: 79921 - DNA, 327 bp, Glycine max
  Peptide Sequence Number=SeqID_171606
atgatcggccctctcaatgagtcaatctcttgctttctcataagggtggacccttgggtactagtaccctcaccttcagagggctacacgccctcgccttcagagggctacacgctctctccctcagaggactacacgtcctcgcctttagagggctacatggctacacgccctccccttcagaggactacacgtcctcaccttcagagggctacatgccctccccttcagaggactacacgtcctcgccttcagagggctacatgccctcgccttcagaggactacacgccctcgccttcagagggctacaggccctcgcctttag

SEQ ID NO: 79922 - DNA, 522 bp, Glycine max
  Peptide Sequence Number=SeqID_171607
atgaaattttattgctacgtgaatagagaaaatgatgacacatcagccctcaagcgcaaggtccaaagtttgatagaagtcgaatggttgacatttcaagaggacgggcccaacataaagacaaacccgcttgccaatcaaggaaggggagcttttaatgccatcgaggcaagtagctcacgcgggcccaagcctttgaaggacgtaacaacctccagaagatttatctatgaagccctacaaaagtcgggcatgattcctcgcggtgggcacaagaaggattcctgtttgatgcatcccagtacgtcgcacaacatggaagcgtgttcggcggtaggagacctattgcaacaaatgatataccaaggccggcttgaagtcagtagtgagggagaagaggaacaacatatatgcatgcaattcgcagatagggaaggtcctaaaaagcctaaacccttggtgatacacttcaccagggacaaggctccccaaaggccccgactcccctcggcgatatcaagc

SEQ ID NO: 79923 - DNA, 725 bp, Glycine max
  Peptide Sequence Number=SeqID_171608
ggagaagcttgccacccagctcgcccaggcgagcaaggttgcttcctccagaagcaaccgccttctggaggaagaatctggaaggcccaagcaacaggaacttgtccctattgctgaggatgctcctgacgtgactgaagacgcacatgcacaagctgaagaagttgttgatgatgctgagggatttccaggtgggccacgtgacccatcagtgctgactgactatggtgaccatgttgctatcatcgtatggaatagagaggaatgtcctgaattgaagctatcctcccatggaaggaaggttcaaaaatttgggaggcctgctcctgaaattgaagggctagtcgttgccacaagattaagtcctttgatcgcatgttcagtggacactagcgatcagggacttatatccacttttgtagagatttacttgaagtctccggagaggaagctagagctgagacaacacaatgtcatggggcatacgtactcctatcgtggctacgagatatttatcagagtaaatatgaggccagacattggactgttgcagctcagtggaagctacgcatggggagctgccgtcctagttcatatgtatgataatttgaatgatgtttgtaagagcgacaaccaacagcttgctggttacatcaccctattacagcatttttcctctgttgctgagtctttgactgatccagactatgatgagatgtcaccac

SEQ ID NO: 79924 - DNA, 468 bp, Glycine max
  Peptide Sequence Number=SeqID_171609
atgcaacaacagggagctcattttgcaaaggactattcttttgtagattatcactgggagtcagaatggcaaccttattatcacaatgaagcagaaggattgtctaatctggatgacttgttaatgcaattcaaagatccaatagattcaatgcaacaagcatttaaaagagctgagactcagatctataagttggtggacgacatgactaaagttctggtcagaagagaagaagaatatgcagagattgaaacacatcaagaaagcattcttcaagttaacacaatccatcatcaattgatgaccaaagaagaaaaggatgaagtcttcattattccagaatatccctgcatggcaactactggatatgttgtaggcaagtttcaaagaatcaaagagttgttcaatcaagaatcaagattcaagaaaagaatcaagagaagactcaagatatgcaagaaccattaa

SEQ ID NO: 79925 - DNA, 1062 bp, Glycine max
  Peptide Sequence Number=SeqID_171610
atggaaaccattttcgtttttaatggtatgaatgcaaacgctggcttactggtcggatctgctggtcgttttgccgccggtggccgcaaacggtatgactggctggcatttagccagcgtaatgacgtggatggggcaagagtgagcaataaaaccgcaacgctacagcagcagctggcacaacgcatcatgattctggacggtggcatgggcaccatgatccagagttacaaactggatgagcaggattttcgcggcagccgcttcgctgactggccgtgcgatgtgaaaggcaataatgacctgctggtgctgagtaagccggacgtcattcgcgaaatccacgatgcttacctggcggctggcgcggatattcttgaaaccaacaccttcaacgccaccccgattgccatggccgattatgaaatggccgcgctgtcggcggagatcaacttcgaagcggcgaaactggcgcgcgcctgcgccgacgcgtggacggcaaaaacgcccgaccgcccgcgctacgttgctggcgtgctcggcccgaccaaccgcacctgctcgatctcgcctgacgtcaacgatcccgcgtttcgtaacatcaccttcaatcagctggtggacgcctaccgcgaatcgacccatgcgctgattagcggcggtgctgacatcatcatgatcgaaacggtgttcgataccctgaatgctaaagcggcgatctatgcggtacagagcgagatggaagcgatgggcgtgacgctgccgctgatgatctccggcaccattaccgatgcgtcaggccgcacgctctccggccagaccacggaaggattctacaactcactgcgccacgcggagccgctgtcgttcggcctcaactgcgcgcttggtccggacgaactgcgccagtatgtgcaggagctgtcgcgtattgcggaaggctatgtcagcgctcaccccaacgccggtctgccgaatgccttcggcgaatatgaccttgatgcggcgacgatggcggcgcagattggcgagtggcgcgcgccggcttcctcaacattatcg

SEQ ID NO: 79926 - DNA, 660 bp, Glycine max
  Peptide Sequence Number=SeqID_171611
atggccccgaggaagcttgcctcaaagaggtccaggaaggataaggcggccgaaggaactagttccgctcctgagtatgacagtcaccgctttaggagcgctgtacaccagcagcgcttcgaggccatcaagggagagcgacgcatccagctcagggatgacgagtatactaatttccaggaggagacagggcgccggcggtggacatcactggttacccccatggccaagttcgatccagaaatagtcctcgaattttatgccaatgcttggccaacagaggagggcgtgcgtgacatgaggtcctgggtgaggggtcagtggatcccgtttgatgcagatgctatcggccagttcctgggatatccgttggtgctggaagagggccaggagtgcgagtatggccagaggaggaaccggtctgatgggttcgatgaggaggccatcgcccagctgctatgtataccggggcaagattttgcccagactgctgcagggaggcgagtgcgaattatgcgcaccaacatgaccaccctgactcagatatggatgactttgctgctcaacaacatcctgcccaccgaccataattccgacctccccctgccgaagtgtcaactggtgtatgccacctgccaggcaccctttagacccggataa

SEQ ID NO: 79927 - DNA, 462 bp, Glycine max
  Peptide Sequence Number=SeqID_171612
atggtggcccgggtcatgttgggaggaaaccgcgggaagtttgagttaggctatagacctacgcaagctgacataaggaaaagtatctcggaaaggaagaacaaaggtcaaagcccgcggttgggacaacaagccgaaggggccccgccctgccacatcagtagaagctttataggtgcgggtttcagacatgaaggccaagtcgccgcgatatgcgaggatgattccccgaggagatcggatttggtacggccatgtcctcctggtttccgactaggaaattggcgagtggaggaacgcccagacgtttacgcgataagcataatatccaatgacgagtccctcgaaggtactaatactcgggacccggccgtcaatttcgtgcaagaaacgggtcggatggagagtgaagaggacgaggatgtggggcttcccccagagatggagaggataatcgcttag

SEQ ID NO: 79928 - DNA, 891 bp, Glycine max
  Peptide Sequence Number=SeqID_171613
atgcttggagtactctgcgccactcgccccaaaccttggcttctctccctcgtccacgtccacgcttccctgcctcgcctacctcattcccctctatcaccttcagcctcgccgccgccccgtcgccgccattccaccgcctgcaaactttttctctccggcggcgctgccgcctccatatggcacgctatcatgccccgaggtgatgacggattacggcgcggcgttgttgccgtccatgacttgaagggagagggatcgtggaatgtcgcttgggacgcgcggccggcacggtggctccaccgccccgactccgcgtggctcctctttggtgtctgtgcttgtctggcgccgccgccgggttgcgtggatgctgacactaattctgctggaatcgctgtggatgaaagttgcggccttctcgataaggaacgggaggaggatgaggtttctgctgattacagagtcactggggtacctgctgatggtcggtgtctgtttagagcaatagctcatggagcttgcttgagaaatggggaaaaagcacctgatgagaatcgtcagagggaattggctgatgaattaagagctaaagtcgtagatgagctgctgaaaaggcgggaggaaacagaatggtttatagaaggggatttcgatacatatctgcagagaattcaacagccttatgtatggggtggagaaccagagctattgatggcttctcatgttttgaagacaccaatttctgttttcatgagagacacaggctcggttgaattggtaaacatagcaaaatatggtgaagaatacaggaacgataaggacatttccatcaatgtgctatttcatgggtatggtcactatgacatactagagaccttacgaccataa

SEQ ID NO: 79929 - DNA, 576 bp, Glycine max
  Peptide Sequence Number=SeqID_171614
atgacagaaccaagtgagacccttttctcatctcatcctgtgtcttctgtacactttcttttcctttttctctctcactactgtctttggggtgaagatatgggtgacccttatgggctaccggaggatctccggcggcttataccagccagaagtacccatttgaacccttcaaacacacacctacttgagccactttgtcttcaccatggtctcagtagtgctgtttcttctgctactactccacacactagttttgaccccaacatggttggggacgttttcttccctcgtggtttcactcaccactttgctcatcatcatgattattcttcttcctctggtgtaaaccctgttgttactgctactgctgctgctactactactgtctcggatcatgcattctgcagcatggagagtgcagagaaagggtggtttgggtttgactccgggaacaacaggtggcctagacaggagaccctttcgcttctagagatcagatctcgtcttgattccaagttcagagagaacaatcagaaagcacccttgtggaatgagatttctaggtatatatga

SEQ ID NO: 79930 - DNA, 225 bp, Glycine max
  Peptide Sequence Number=SeqID_171615
atgttcaccatgctgagattggatctggaggcaataggaaaggatctccttgcagcattcagtgggtttgaggcagtggcaccaaagatgcatgcttttttggtggatatgagggtggagggtgaatcagagaatggtggtgtgaaaggactgagagtgatagtgagcaaaagggagaaagatctaaaggtaatgatggtgatgatcaagatttttgagatctaa

SEQ ID NO: 79931 - DNA, 1455 bp, Glycine max
  Peptide Sequence Number=SeqID_171616
atgacccaaggtaatattgctaaatggaggaagaaagaaggagaaaagatagaagtgggggatgtactatgtgaaattgaaactgacaaagctacactagaatttgaaagtcttgaagagggatttttggctaagatattggtacctgaaggttcaaaggacgtgcctgttggacaaccaattgcaataacagttgaggatgaaaatgacatccaaaatgttcctgcttccgtggggggtgagactggggttgaagagaagaaaccaacacttgggggtgtctcagatgagaggaaatcagaatcaacttctagtgtagttaatgcatcagaacttccacctcatctccttcttgaaatgccagctttgtcaccgacaatgaaccaaggaaacattgctaaatggaggaaacaagagggagacaagattgaagtgggtgatatattatgtgagatagagacagacaaagctacacttgaatttgagagtcttgaagaggggtacctggctaagatacttgctccagaaggttcaaaagaagtggcagttggacactctattgcaataacactgctcttctacaaggttgaagatgcaagtgatattgaagctataaagaattctgttagcagctcaacaaaccaacagaaggccccccaacgtggcactaaaagcgaggtcaaagctcagaaaaacaatataacacgtattagtccagctgcaaagttgctaattgcagagtatgggttggatgctccaacattaaatgcaactggtccttatggcaccctactgaaaggggatgttctatctgcaattaagtcaggaaaattgtctccaaaacctgcttcatctaaagaaaaggcattgtcatctcaaagtcatcaacaagttgcagcttcccaagagtcaaaatctgacttaaaaaagtcagatgcttatgaagattttcctaatagtcaaattcgcaaggtgatcgccaagagattattggactcaaaacaaaatacaccacacttatatttatcatcagatgtcatactggatcctcttctttcccttcgaaagggtcttaaagagcagtatgatgttaaagtttctgtgaatgacattattatcaaagttgtagctgctgctctcagaaatgtaccagaagcaaacgcatactggaatgttgagaaggatgaggtgattttaaatgattctattgacatatccatagcagttgccactgagaaggtttctgatgaagagcagatgaattatcgctatttctacaaaaccagtgattgtgtgtttgaaaaccttgacaagagagctgttgggactggtcaatggagagtagtggagaaaggcaaagatgttgagctccctactgcaccagaggtgattgggaaaaggaacgtactggttttctgggaagccaaaggcaaccgttttactaaaacaaaatga

SEQ ID NO: 79932 - DNA, 585 bp, Glycine max
  Peptide Sequence Number=SeqID_171617
atggaggatggcgttgcaggcgatagagtgatgtatctccgtccctttcattacacaatgagcagaaacagcgatgaacctgcgatgactgaagaagcaccaaccaaacagtccctagcgaacatcttctctttgttccgcaaaatcaattttcaactccctttcctcccacccaaacctgaagaaccgaagcttgaggctcaggctcagcaggagggtccgaagcctggccgtgtacagtttccgaaaagccaagtggcgctgattgcttcttcgcctctgcaagctgaacctgatgctgaccactctcccgctgccaagacaaccaatcctcttattctctggcagatttatgcaataggagcgattgcgatttcatcatgggtttgggcaaggtggaatgagaggaagggccgaggggggtctcccagtgatgagagggagaaattttcattagctgtatacagctatgaagcacggacactccagtcccttgtcgtgtctggtgtccgacacgcgtccgtgtatccacgtgtccgtatctgtgtcgtgtccggtgtccgtgtcggtgttggtgcttcatag

SEQ ID NO: 79933 - DNA, 208 bp, Glycine max
  Peptide Sequence Number=SeqID_171618
atatgatatcaaaattcccaatggtgagaatgctcgtaattggattccgaacgtggttctcaaatttcacgatgatccaacggtgagcgagtccaagatcgtcgtttttctgagacaggttaggtggcctgcgggaaaaagagagggttttgggagaagagagaagaaacaatattgtgaggcagaggaggctaaggagtcagtctga

SEQ ID NO: 79934 - DNA, 309 bp, Glycine max
  Peptide Sequence Number=SeqID_171619
atgggcgatagtctgctgtgggtctacgaaggccagaccatcgaattcctgcagcccgggggatccactagttctagagcggccgccaccgcggtggagctccaattcgccctatactggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 79935 - DNA, 396 bp, Glycine max
  Peptide Sequence Number=SeqID_171620
atgaattcagccattctgatctcggtcattccggaaaataaactcttagcgacgacgttcctaaatggaaaactccacacgactccggaatttcaaaaaaacactattgacaacaacgaagtaaatactaacgtaacagttcaaacgacatgtatgcacaaaacaaaagtcaatcaaaacgaaacaaacgttagtccctcagttaaacaaaaagatagcatacaaatgataaatgatggaacatacgaatttggggatcccacggtcatgtggctccgcatgcccccggactcttgggtcacggtaacaaaaagtggggtggtcgacaaaagcagggcttttgctcctacgtatcctcaatttgtgatgaggaactcagacctacgtagttcttga

SEQ ID NO: 79936 - DNA, 359 bp, Glycine max
  Peptide Sequence Number=SeqID_171621
gcaccctctggacccagacaagtcaaacagggccttggggtttccggcactgatcacgggcctctgctagtcattcggggttcccgtcacccccagaaaagtgatctgaccaccgatcaccgaggccttcatcgagaagttcgccagcaggcggccaaccaccgtgggaaggggcagggttccgctccttttgcatgccctactccggagcaatttggggctgaggtcgcatggcccggagactggcccgtggcccaggcaggggaggagcctgaaggatcccccggtgaggcagaggaggcccgtatggatgaagatatgactgacttgctcggtttcttgggaggaagcggagccac

SEQ ID NO: 79937 - DNA, 192 bp, Glycine max
  Peptide Sequence Number=SeqID_171622
atatgtttctacagtctgaccgttgggatcttgaaaactataacttttgatctcctcctaagcgagaatggcgcgctaagcgcaattccaaccgaggggaattgcgctgagcagcccaaagctgcactaagcccaattccaatcaaggggaattacactgagcggccccaaggtgcgctaagcgagccctag

SEQ ID NO: 79938 - DNA, 591 bp, Glycine max
  Peptide Sequence Number=SeqID_171623
atggggacaaatcaaaacggcaaaaggttttatcaagtcaaggttaaaagtctagatgtcactagcctcaaggaattgggacgattgatgggacctctccaaaggcaagccttccgcaaagtgtacgggaagattctagatttggccgcagcggaggtatttacggaagctgtcgtatccctcgcccaatactatgaccagccgttgaggtgtttcacgtttggggacttccaaatggtaccaactattgaagagtttgaggaaatattaggatgccctcttggggggagaaaaacgtatcttttctccgactttcttccttccttgagcaagattgcagctgtgattggagattcaacaaaagagttggatcgcatgaaacaaactcgcaatggagtagtgggcctgcctcagaaatacttggaaggcaaggcaagggatatggcgagccaagagatgtggagcccgtttgcggatattttagctttgctgatttttggggttgtcctctttccgaacgttgacggtttggtagacttagccaccattgatgctttcctcgcatatcaccatagcaaggaaagtccagtg

SEQ ID NO: 79939 - DNA, 900 bp, Glycine max
  Peptide Sequence Number=SeqID_171624
atggataatatcttgggaagaaacattgtgccaggaaggaaggtggagatctaccacactgagctggatgatcttaagactaaattggagaggcgtaacttccataaacgcctcagcaatttggttgatggaagcatagacttggctttggtgaaggagttctatgcaaacttatacaggtctgagggtccttcaccaaagcaagtcagggtcagaggccacctagtgaagattgatgttgacagcctcaacacattcttagagacacctgtggtgttggcagatggtgagactttgcccacatactccaaatattgcaggctgcctatagattacagagagattgaggctgccttatgcataccaggccgagggttcatcttgaacattgaaggccatcctgggaagattcttaggaagtatttgactactctagctcaggtgtggagtgttctctcatactcaaacctggcccccacatcacatatctctgatctgacagtggacagagctaggctaatctttggcctagtctctcgcatggacatgaatagtttacaggtggtggcacctccaggatctattcctttagttgagcagttcagggagatggtagcctggcctaggactcaaccttctcttcacagggaagatgaaggtcccacagcccaggggaggaggcaggtgagacaggtagttgttgccacttctgagagatcttttgaagccacttcagagcctcctgcactagtggaggacctatcatcgcctcagtatgcagcagacccctccactcctattctagacatacctgaggactcgaatacactagtcctaactctgaacacttctcctccaactactccaatgcttcatctgaaagatgaggaggatgtttag

SEQ ID NO: 79940 - DNA, 222 bp, Glycine max
  Peptide Sequence Number=SeqID_171625
atgattgatgctaccaatggtggagctcttggtgatatgacccctgctgagactaggaatttgattgagaagatggcttccaactcccaacaattcagtgcaagaaatgatgttattgttcttagaggagtccatgaggtgccacagattcattttcatctactgaaaataaagcttgaaggattcaatatccttgaggtgtccatatggtctcaagactga

SEQ ID NO: 79941 - DNA, 180 bp, Glycine max
  Peptide Sequence Number=SeqID_171626
atgggtcgtaggcaacgcactaacttttttgtggatgagctgaggggctttggaggtggcaacggtgcgtctgttgcccgctgccagccatccccaggttactgtggtgtcttgccctacgcctgcctgggggcgcagtacttcttgatgaaagcccggcgcgatccctgcaaacaatag

SEQ ID NO: 79942 - DNA, 431 bp, Glycine max
  Peptide Sequence Number=SeqID_171627
ttcttgggccaccccctaagattcgagggcgaccaactgtgcgaccacaaccagagagggaggctatcgtgcaactactatgcctactggggcaagatttcaaccagccgctgcaaggagacaagtgtggatcatgcacaccaccacaacttcgatctccccctgccgaagtgtcagttggtctgtgccatcatgacataggcctctgtcagtcctatagggtgcccgtccccccagcaaggtcatgccatcgtgacatagggatcgcacccgcaagacacctagtggacccgaagaagtccaacaaggtcctggggtttctagctctgattacgggcctatgtcagttctacggagtgcccgtcgcccccaacaaggtcattaggccccctattaaccacgatttcatcaagaagtattgtgccccttag

SEQ ID NO: 79943 - DNA, 216 bp, Glycine max
  Peptide Sequence Number=SeqID_171628
atggaagcaacaggcaaccaaatatttgaattgtggtttgttggcttttcctttagtttacctaggaatacctataggggccaacctgaggcgacgtcagatgtgggatcccattatccagaaatggtgcctaaatcaatggtggataagctggtgagattacaacgtagattcctatggggaggtggacctgaccaaacagattgcatggattag

SEQ ID NO: 79944 - DNA, 1032 bp, Glycine max
  Peptide Sequence Number=SeqID_171629
atggtggaagaattcgaagaaatcctaggatgtcctctagggggaaggaaaccatacctcttctcagggttctatccctcattagctagaattcctaaaatagtccaaatcttggcgcatgaattagaccgccaaaaacaagtcgaaaatggggtggtcgggataccgagaaaatgtttggaggtaaaagcaagaatcttggcaggtagtagcgaatgggccccgttcatagacattctcgcactgttgatctttggaggaaccctctttccaaatatggatgggttggtggacctagcaacgattaacgctttccttgcctatcataaccacaaggaaagcccggtcgtcactatgctagccgacctatatgacacctttgaccgaagatgtgagaaaagcagttcgaggattgtctgttgtactcccgctctttatgtaaggcatgcttgcccgttagaaggtcaccgttcatgcacagagaaaggaggcgcaaattgggaccaactcttatcaaacaaagaaggagcgtctgtcaactggttccctcgatggaaagaaggaagaaccggagttcttgtctcgttcggaggatttccgaatgttcccttgatggggacaaggggttgcatcagttacaatcccgttcttactataagacaacttggctaccctatgagaggggcagcactagaggaagtgctcgcacctgtcatttcacgagggttcagtgagaccaacatggagacacttgaaaggtccgcaaagcatgggaagtggtacaaaagaaggacaaagagctcagaggcagcaacaatgggcccattggtggctaccgaagacgaagaggtgcaggcccttaggacaggactcgagcaagctcaaacagtcaaagaaaggttcaaatcagtggctcttaggatccgaaaggagaatatcgaactgagggatgtaaatatagctaccaccaaggccttggaacaagagaccaagagggctcatagggaagagcacggccgaaacaagttctga

SEQ ID NO: 79945 - DNA, 471 bp, Glycine max
  Peptide Sequence Number=SeqID_171630
atggcgagggcgtgcagccctcagaaggctatgacgtgtagtcctctgaaggtgagagcgtgcagccctctgaaggcgagggcatgtagccctctgaaggtgaggacttgtagtcctctgaaggcgagggtgtgtagccctctgaaggcgaggacgtgtatgcctctaaaggcgagggcttatagccctttcaaggcgaggacatgtagtcctctgaaggtgagggcgtgtagccctatgaaagcgagggcgtgcagccctctaaaggtgaagacgtgtagtcttgtaaaggcgagggcgtgcagccctctgaaggtaaggacgtttagtcctctaaaggtgagggcatgttgccctctgaaggagaagacgtgtagtcctctgaaggcgagggcgtgcaaccctctgaaggtgaggacctgtagtcctctgaaggggagggtactagtatccaagggtccacccttttga

SEQ ID NO: 79946 - DNA, 127 bp, Glycine max
  Peptide Sequence Number=SeqID_171631
ggtggaggataggcgaacagcattaggcagtcaattcgcgggctccagactcgatggtggaggacacatgaacaacgctagcaatcaattcatgggtctccgaataagatttgagggtggaggatag

SEQ ID NO: 79947 - DNA, 1368 bp, Glycine max
  Peptide Sequence Number=SeqID_171632
atggaatcacatagagctgaagatttagtatttgttcatagcaacctacgacttctctcaaggaatactccacaatatcatcaagaggaaactaaaatgtgggatgtagccggagatgattttggatcacttgatgattgtggtattcttgaaattgctagtttgtctttagatgaaccagagttagaggccgtgtctgtgtcctacattttgaacattacaggtttcttcctgcccaatgactttgttcggcgcatcaaagctattgtgcgaccttcccaggcagcaggagaatatataaaagaatgtggccgggtgataggttggattcgacgattcccgaagtgccttcctcctcctcctccttcttcccctctaatcggatccaaatccaaatccaaatccagttcaaagaagatgcaatacaagaacctggggcgatctggcctgaaggtgagccagctctcctacggcgcgtgggtgagcttcgggaaccagctggacgtgaaggaggcgaaggccctcctacagtgctgccgcgaccacggcgtcaacttcttcgacaacgccgaggtctacgccaacggccgcgccgaggaaatcatgggccaggccatccgggagctcggctggaagcgctccgacatcgtcgtctccaccaagatcttctggggcgggcagggccccaacgacaagggcctctcgcgcaagcacgtcgttgaggggaccaaggcctcactgaaacgcctcgaaatggaatatgtcgatgttctctactgccaccggccggatacctctactccgatcgaggaaaccgtgagggccatgaatcatgttattgataggggctgggccttctactggggcactagcgagtggtctgctcagcagatcaccgaggcctgggctgtggcacagagattggaccttgttggtcctattgttgaacagcctgagtataacctcttgtccaggcacaaggttgagtctgagtttcttcctctgtacaccaactatggcacaggcctcactacatggagtcctcttgcctctggagtgctcactgggaaatataagaaaggagttataccaccggatagcagattcgctttggaaaattacaaaaatctggcgtcaaggtcgcttgttgatgatgtgcttaggaaggttgatggattgaagccgattgcggatgagcttggtgtgccattgtctcagcttgcgattgcgtggtgtgctgctaatcctaatgtttcctcggttatctgtggtgctacaaaggagtctcaggcttttggttatgaacctttgcgtaggatcaattcacatgcctggacacggaagactccttcttctgatattctatag

SEQ ID NO: 79948 - DNA, 570 bp, Glycine max
  Peptide Sequence Number=SeqID_171633
atggcttgtgaggtccttattgagccgcgtgcactgcttcggtttaggtctgagttgcagcttgacaagttctttgatgaccctttgtccatgctcatgactcgagtgcctttagtcattgttagggtagggaatttcattttcaaatggggcgtggagactatggcttcaagctcgttaagtgtgctcctacgggttaaagcaaaagagcttgccttgactgaaggtggtcatcaagtccatgtagcctctagtctctactatctcgcctgcaaatccgaggagtggaccggcgtgagggtggacagtgttgggggagactttgagtctttgaaaagtcttccaatgctggatatcagtggaattttcctagtcgataagaaccctgggcaccatgaagtttgcaatgatgatggagacaacaacgaggtcatcatggttgacagggttggtacccttgaagttcctattcataaaggtgataggaaagagactcagttctatcgcttaacaaattggacaaagtaccgagcctatataggttcttctatcttatcctttaaggcctag

SEQ ID NO: 79949 - DNA, 204 bp, Glycine max
  Peptide Sequence Number=SeqID_171634
atgggtgtcaagtgtctcaaagtgatcaaccaaggtctgtttccggaactcgtggttaacccgaggaccttttttggtttctgctgcaaggattggggaactcgtggtgacctaaggtttgttcctgtaacacatattcaagtatctaatcctagaaaccaaattgagcttcctggaagaaagttagctgttgatcccaggtga

SEQ ID NO: 79950 - DNA, 153 bp, Glycine max
  Peptide Sequence Number=SeqID_171635
atggctgatggaaaactgatagagatgaagggtagagttaacctagggttagaaaagttttctgcctctgccctattttccttggttttgatagttcatgaggtttgggatgttgaattgcttggatgttgtggaagcttggggatcctctag

SEQ ID NO: 79951 - DNA, 231 bp, Glycine max
  Peptide Sequence Number=SeqID_171636
atgaaagattgcagaaatacaagtagtggggatgtctcctccacctctaggacctcacaatcacttacaaactcatctcaagctctcaggacggcttcctcttcaagctctggtggctttgttcgtgctcgtgcgcttagcacaactctgatccgctcagcgcacattagtgaatatcagcttagcgcgtgcttttctcgctcagcagatggactgaagcggtgcacttag

SEQ ID NO: 79952 - DNA, 126 bp, Glycine max
  Peptide Sequence Number=SeqID_171637
atgaagacattaaagactactttggatggtaaaattgatcaacctacgtctcaggggattgaagtaaagagttatgttcaaagcagaaattatgagtgtggttattatgtcatgcgttggatgtga

SEQ ID NO: 79953 - DNA, 255 bp, Glycine max
  Peptide Sequence Number=SeqID_171638
atggggtggggggggatcagtcatcctatggtatcatgggaagagcttcagagggcccagaaagggaagagttccaaaccaaaattgcccatcaagaataagtatatccaaattttaagcaatctcaaggttcaatataggctgtgtttggtgactaataatgagggaagaaagatgcagcaaaagcgtattaagtgtgattttgaatataaacctcaaaactatctgagtaactcaattggaagggatgagtaa

SEQ ID NO: 79954 - DNA, 222 bp, Glycine max
  Peptide Sequence Number=SeqID_171639
atgcggataacaaaagatgatgacaaaggtgatgataaaaagctcaaagttcaatcaaagaacaactcaaagttcaagataagaatcaagaagaattcaagactcaagaagaaagttaagagtcaagaatcaagattcaaggttcaagatctcaaaaatcaagatcaagattcaagaatcaagattcaagactcaagattcaagaatcaagagaaggcttaa

SEQ ID NO: 79955 - DNA, 657 bp, Glycine max
  Peptide Sequence Number=SeqID_171640
atgaaaaatatagaagctagtaacttccaactgggatggagctgctcttggactatgaaagctatttttaagcataaaaaccttctgactcagtctgcggcttggggggaaatgcatgatgctggaaagtatagtatgaggaaaatgtatcaagtgattagaggtgttaaaccgcaggtagagtggagaaaacttttgatcgggaaccatgctagacctcgtgcaatcttcaccttgtggatggcttgtaataatcacctattaactaaagatagaatgaaaagatttggtatggcaactgatgggctatgtgttttttgcaaaatgccagaaacttgtcaacacttgtttaactgcagtgatattaaaccagtttgggagaaaatattgaattggattggttttaaccatactcctgctatgtgggatgaggagctgaagtggattgtgcaaaacacgaaaggtaaaggctgtaaaagaagtttgttgaagatggcagtggctgaaacgacgtatatgatatggtgtgtgagaaaccggatcatatttcaagatggtaggaaagaggagcttcaatatgacaccataaaaaatgtgattcttagaagagtagaaaccaatacaaaactcatgatatactgtagtatgaatatttag

SEQ ID NO: 79956 - DNA, 642 bp, Glycine max
  Peptide Sequence Number=SeqID_171641
atgaagaagggaaaaatgcaggtgtcaacaaatgaagaaggaaaaaatgcatgtcccatcacattgacagacaacgtcagaccatatatcaagccacagagtcctgagaagctgaatgaaaagttaaagactcagcttgccttttattattcttcatttctacattcaatcgatgacacgttaaacaaatatttgatgcaatcgagcatcacaacacatgcaagggtcacaaaaaggtttctggttcgagacaaagggaacggcgttaactttgtcgggtttggttttggggagcaaagtgtggctgtggtggctaagacagagatggagaagaagggagaagaagaagagtattttctggaagcacagcagtctgatattttagttgagcgatactgtagcaacccaagaagttctgtaacatatagccttatgaaaatatttctatggaaccaaatgaaggcaaagacattagagaatgttataatcatgtctagactattgcgctctttttcccgtatctcttttcgatcaaattcctcctcatcatcttcttcaagaaattccaacttattaagtgatcaagataacctgacccaagaggtcgcccccaaacacaatctcttcgatgaggaagtctga

SEQ ID NO: 79957 - DNA, 711 bp, Glycine max
  Peptide Sequence Number=SeqID_171642
atgtcctcgccatcagagggattcacgccctcaccttcagagggctgcacatctttgccttcaaaggactacacgtcctcgactttagaggactgcacatcctcaccttcagaggactacatgccctcgccggcttcacgtcctcaccatcaaagggctgtaggtcctcgccacagagggttgcatgtcctcgccttcagagggctacacatcctcaccttcagagggatgtacgtcctcgcctttagagggttacacgtcctcacctttaaagggtttcacgtcctccccttcagagactacaggtcctcaccttcagaggtgcaggtcctcgtcttcagagggatgcacgtcctcgcctacagagggctacacgtcctcgccttcagagggcagtacgtcctcgccttcagaggactgcacgtcctcaccttcagagggcttcacgtactcgccttcagagggctacacatccttacctttagagggctgtacgtcctcgccttcagagggcttcacgtcctcgccttcagagggctacacatcctcaccttcagagggttgtacgtcctcgccttcacagggttacacgtccctggctttagagagctgtacgtcctcaccttcagagggctgcacacccttgccttcagaggattgcacacgtcctcgccttcaaagggcttcacgtcctcgccttcagaggactga

SEQ ID NO: 79958 - DNA, 1041 bp, Glycine max
  Peptide Sequence Number=SeqID_171643
atgaagcacgaacatgccgctgaagtgccgcgtcccgcgtcggaggcgcaccgaacacgcaaacgggtacaacttcgatgcgacgcggtgttcgttgcctccgccgtcaccggacacggttggatgcaggaagcgcgggattggatgcggcccaccaagtggacacgcgcaattggacgcggcccaacaagctattttattatttatttaaaaaaggcttaccaaatacgaaaatggtttctgcacgtcttctccttgtcgttttccgcaagcgaacctccattgttgcatgtcgctgcctccatttccccctttgcaaagatgagtacttctagtcctaatcaagctaaagaacaagatcatgataccaaacctttatggaactatgttacaaagataaaaagtgtaggtggtggtggaaattatgaaataaaatgcaatatttatgattttacctttaatggatcttacactagagtgagggcacacttgttgaagatgactggaaagggagttagagtttgtcaaaaagtaacaattgccaaacttatagatttgaagaagatagacaatgaggctagattgagggtggagaagtcaaaaacaaaatttgtgtcattgccttcggtttctactcaacaccaaatggatacaaacactcttggtgttgatccaaaaaagagaaagacatcaactgtagaaaatgcctttaatttgcaagctagagagacacttgatcatgaaattgctaggatgttttactcttcggggctgccatttcatttagcaagaaatcctcattataggaaggcgtttgcctatgctgcaaacaatcagatcagtggttaccaacctccaggttattataaattaaggacaacattacttcaaaatgagaggagacatgtggagaacttgttacaaccaattaaaaaagcatcgagccagaagggtgtgagcattgttagtgatggatggagtgacccgcaaagaagatctcttattaatttcatggctatcacagagagtggacctatgttt

SEQ ID NO: 79959 - DNA, 396 bp, Glycine max
  Peptide Sequence Number=SeqID_171644
atgatgacattcaagaatgagttcaagattgagtcaagaacacttcaaagatcaagaggaaatttgatttcaagattcaagaatcaagattcaagaataatcaagatcaagattcaagactcaaagattcaagaatcaagagaagacttaatcaagatgagtattaaaaagtttttcaaaacattgagtagcacaagaagttttcacaaaatcattaccaaagagtttcactctctgagggtacatctacttgggttgttgactgagaacaagagagggtacatctcttgtggatcagttctaatggatgatacatccactaggttgttcaaagagaacaagggagggtacatcccttgtggatctttgcttgtaaaaggatttttacaaggttga

SEQ ID NO: 79960 - DNA, 174 bp, Glycine max
  Peptide Sequence Number=SeqID_171645
atgacgcatgcaaatcataattgggaagggtacacttgtccatgtgcatttgttgcaatcctcactaggaagggaccattcactagagccatgagcaagaggctccaagaggattgggctagagttgctgaagaaggccctagggttctcatgaacctcagggtggatttctga

SEQ ID NO: 79961 - DNA, 600 bp, Glycine max
  Peptide Sequence Number=SeqID_171646
atgtcgcgggggtcaggagaccttggggacatcaggcgagctcctggcagtcaaccaataaaagaacaaaaaccacaaagcaaggaggcttgtgtggtggctggccagctatggaacttgagtgatatttggaatatggcctctggtaatcgattacaaaggatcgcgatggcagtgcaattaatccatgaccaagtggagatggagtgcctagagggagtttgggagaccctcgaaggcaatgcaaggtgccgatttcggggcacaattcgattcacggctacttcattggtacatccagaggaaccagcacgcacgcttcagcgcactgtggagtggatattacctacacctactccatatcgactagtggagccagtccaagtgatagaggtgacgtcatctgaggaagaccctgaggaggacccagaggagctacctcctgagcctgttgtggatgctcttgactttccagagggtgatgaggacccactccctgaggtggattctcccgaggacgtcatgtcagcatctgaggcagactctacggaggagagtggccctggagggatagcgactagtggaggctcttcatcataa

SEQ ID NO: 79962 - DNA, 252 bp, Glycine max
  Peptide Sequence Number=SeqID_171647
atggaggaaccccctgatgcaattttggccaaaacaaagttgaagttacaagattggaccttagcccaaagtgcaacaaagatttcaagtttaggcattgtactactcaaatttggcataccttcatacgcagtgctcgaccgtgtagtctactttgattggcaaaatctgatggatctaattgaggagatgcctgtcatggatgcctctgaaaaggggaacccaacaaacgtggtgagtcccttgcgttga

SEQ ID NO: 79963 - DNA, 782 bp, Glycine max
  Peptide Sequence Number=SeqID_171648
aggactgcacgccctcacctatagaggactacacgtactcgccatccgagggcacctttagaggacaacacgtcctcgccattagagcgctgcacgccctcagcttcagaggactacacgtcctcgccattagagggctgcacaccctcgcctttagaggacttcacgtcctcaccatcagagggttgcacgccctcaccaccaaaggacaacacgtcctcaccatgagagggctgcaagccctcagcttcagaggactacacgtccttggcatcggagggctgcatgccctcaccttcagaggactacacatcctcaccttcagagggttgcatgcccccacttgcagaggactacacgtccttaccatcaaagggctgcacgccctcatttgcagagaactacatgtcctcgccatcatattgttgcacgccctcaccttcagaagactacacgtcatcgccatcagagggctacacgccctcgccatcagaaggctgaacgccctcccctttagaggactacacgtcctcgccatcagagggctggacaccctcaccttcagtggactacatgtcctcaccatcagagggcagaacaccctcaccttcagaggactacacgtcctcgccatcagagggcagcacgccctcaccttcagaggacttcacgacctcaacatcaaagggttgcacgccctcacttgcagaggactacacgtcctcaccaccaaagggctacgcgccttcacttgcagaggactacacatcctcgccatctga

SEQ ID NO: 79964 - DNA, 123 bp, Glycine max
  Peptide Sequence Number=SeqID_171649
atgggtcatgccttagacaaagccagactcagaactgtgcgaatagttgctgcccgaggaggtgggctgggacgtgaagaaggggctggactaggaggaagggaagcagtcgctggacaattt

SEQ ID NO: 79965 - DNA, 288 bp, Glycine max
  Peptide Sequence Number=SeqID_171650
atgactcaaactaatgaacatgattacctgacagtttccggaaaaaattctgctggaagaagcagtgtgcactactggaagaaactcttctggaaacttcttccggaagctggtacaccttattacggaagaacttcttccagaataagtagcatcacctttcagaagaacttcttccggaagaagtttttactggataaccttcctcaacattttactgcttctgtaacagatgaacacaaaaaaaaaccaaaaaagaccataaaatgcataccttcgacagaataa

SEQ ID NO: 79966 - DNA, 396 bp, Glycine max
  Peptide Sequence Number=SeqID_171651
cttgagaggattgatggggacccggcgttgagaggaacgaggataagggctacgtgggagtacgtgagctcagttggaggtgggcaacatgggatggtgggttcatacgtgatttgtggatgtggagaattgtcttgcaccatcgcccgaccgccacctagtaccacatgtgatggtggtacctggagatatgtcgcgggggttaggagaccttggggacgtcaggcaagctcctggcagtcaacagataaaagaacaaagaccacaaagcaaggaggcttgtgtggtggctggccagctgtgaactttgagtgttacatgggatatggcctctggcttaaaaacgagatcaggaagctaagagggcttctggtaatcgattaccaaggggtgtaa

SEQ ID NO: 79967 - DNA, 90 bp, Glycine max
  Peptide Sequence Number=SeqID_171652
gttttactctcgtcgtctggaaacactcaagcccgacgacgcgcgagattcttcgctgctgggcagggacgatcaagtgcaatggcgtag

SEQ ID NO: 79968 - DNA, 435 bp, Glycine max
  Peptide Sequence Number=SeqID_171653
atgtcacaaaatcttacggattacgcaatcgtcccctctttggcttctggattgttacggaactttacggattgcgcattaacacttccttccaactctcgacatgtcgcggaacttcacagattgcctaacgatgggtgtcaagtacctcgaagtggtcaagcgagggtcgcatcccaacaaacagatggtccctggatgaaattaggcgactctcctcctcaaatctcagccaacctgcatcgatcagactttgcaccttatgtttcaaggtcatacaatgctcaatggaatgccccggggtggtgtttggtcttggatgtgcagcaagtagattttgtggccgatttaggggtggccattgtggatgattgggcattccttgttggtagggtggtggttcggaagatggaaatagtgaaaaacattctttga

SEQ ID NO: 79969 - DNA, 802 bp, Glycine max
  Peptide Sequence Number=SeqID_171654
agggttacacgtcctcgccttcacaggagtagatgccctcacttcagagtactacacgtcctcgctttccgagtactccacgtcctcgctttcgtggggctacacgccctccccttcagaggacaacatgccctcaccttcagaggactacacgtccccgccttcagagggctacacatggctacacgcccccgccttcacagggcttgatgccctcaccctcaggggactacatgtcctcgctttcgtggggctagacgccctccccttcagaggactacacgtcctcaccttgaaagggctacacgccctcacctttagaggaccgcaccccctcgccttcagagggctacacgtcctcgccttcagagggctacaccctcttgccttcagaggagtacacgtcgttgccttcagaggactacatgtcctcacctttagaggattacacgtgctcaccttaagaggactacatattctcgctttcagagggctacacaccgtcaccttcagagaactacacgtcctcaccttaagggctacacgtgctcaccttcagaggactacacggccttgccttcagagggctacatgccctcaccttaaaggacttcaggtcctcgcctttagaggcctacacaccctcgccgttagaggtgtacacgccctcgccttaagaggacttacatgtcctcaccttcagaggactaacgttcctgaccttcagagggcaacacgccctcaccttaaaaggcccacacgccctcgccttcagagggctacacaccctcaccttcagtag

SEQ ID NO: 79970 - DNA, 240 bp, Glycine max
  Peptide Sequence Number=SeqID_171655
gccgcgatagacttgcattttgtcggagttgatgatttcggaggaggggaagagggttgcaaggtcgatggagagacgggacttgccagagccggtggcgcccatgatcaccaccaccttgtccttgcggcggtggaaggacgacgcgtcgatgcggggccagcgctttatccggtgggggtgggggtggggttgcagaatggaaagtctcataataatagaaagaagaagaaaaaataa

SEQ ID NO: 79971 - DNA, 345 bp, Glycine max
  Peptide Sequence Number=SeqID_171656
atgttaggtggctccatccttcagtctaaatctagtcatcatcattgttattgtggcggttgtattgctagtctgctattgctactattagtactactacttactgatttagcctataaaggccccacaaaagaatggccaaatatcagaatcctggttggttttgtaaaaccaccaccgccactaggttttttgggtcttatagttttgacttttgacaagttcatactgctcgaaagacatttaaaccttgtaatagtgcatgggttaactgcaccacaattcaagccaggtgttgttcaaccagcccaagagttcaggtcaagcggaaagttaaaacagtga

SEQ ID NO: 79972 - DNA, 354 bp, Glycine max
  Peptide Sequence Number=SeqID_171657
atgggctacgtgggagtacgtgagctcagttggaggtgggctacaggggatggtgggtttatgcgcgcattgtggatttggaaaacttgttgtgcaccatcgcccgaccgccacctagtaccacatgtgatggagtggtacctggagatatgtcgcgggggtcaggagaccttggggacgtcaggtggggtgctattgcccaaaaccaagcttgaccaatcccgacccaacccgggcatagtcgctcagctcagaacctgtgatgtacctaaacaggcgagctcctggcagtcaacagataaaaggaacaaagaccacaaatcaaggaggcttgtggtagctggccagctgtga

SEQ ID NO: 79973 - DNA, 166 bp, Glycine max
  Peptide Sequence Number=SeqID_171658
gtgttttgatgataacaaagatgatgacaaaaagcccaagagaatgatttcaagagaaagtttcatcaagaagattcaagattcaaggttcaagaataatcaagatcaagattcaagactcaaagattcaagaatcaagagaatacttaatcaagataagtattaa

SEQ ID NO: 79974 - DNA, 573 bp, Glycine max
  Peptide Sequence Number=SeqID_171659
atgcaaagaagatctattgcaggtgatttgatttccattgatttagaggaaagtagagctgatcagaaggtggaaggatttaaacaacagctggctgatgaaccaacgttggaatcggttgatgatttagttcaacttgtagaaattgttgaggaagcagaagagaaggtcattgagactgagaagaagaagggtaagagtgaggctaacatagaaaagaagaaagaggctcctcctattgaatgcaaggagaaactggaaattaccttgccttttggagaagcacttcagcaaatgcccttctatgccaaatttttgaaggatatgttaaccaagaagaacttgtacatccatagtgacataattgttgtggaaggtaactatagtgctattattcaacgcattcttccaccttgttataagttaattaggcaagctttgaaaagtactatttttcaccttcacgctaagcgcaccactcatgggctaagcgcgaggaagactctagaagaagatgagttgtacaagcacaccgcttcagttcatccgctaagcgagaaaggcatgcgctaa

SEQ ID NO: 79975 - DNA, 186 bp, Glycine max
  Peptide Sequence Number=SeqID_171660
atggagaatggagaattggcgaacagcgctacgcaacaacttcgccggtctctagactcgttggcaataaattcatggggctccgaaaaaagtggagaatggagagttggcgaacagcgctacgcaataacttcgcgggactccagactcgttggtggaggatgcatgaacaaggctaggcaataa

SEQ ID NO: 79976 - DNA, 965 bp, Glycine max
  Peptide Sequence Number=SeqID_171661
acgctggggatcgcggctgggtggagctgtgtgaccaacgcgtgacgcagcgcgtcgatcgtcagctcaggcgaagcgggttgtacgaaggcggcgagaattttgcccgagggctggctgcgagccaccacgcaggcgctgtcaaccagggggtgactgcggacggcgctttccacttcgcccatttcgatgcgtacaccgcgtatcttcacctggtgatcacggcggccgacgaaaataatgttgccctgttcgtcccatttggcgatgtcaccggtaatgaacttctctgcgctcagcgcctcttgatgcaggtaaccgtgcgccaggccgctgccggcgatgcacagttcgccctcaaaaccgaccggcagtggattgtggtggggatcaaggatgtgacaacggtagtttttcagcggtttgccaatacagttccagggaacacctggacgatactcgcacagcgaagtggcaatagaagcctcggtcggcccgtaaccgttgcacaatcgggtgcgctcggcccaccaggtgacgacgtccgctggcggtgcgtctcccatgacgatcattgtccgcagtcccggccacatttcgcggggcaacaattccagaattgccggtgtaatagtgatatggccgatatcgtgtcgagtcagataatcgtgcagcgcgccgacatcggtatgcagctccgagggcgccagataaagcgtcgcaccgctgaccaacgcgccatagacgtcccagccgaaggcgtcgaaacccaacgaggcgatggccagcacgcgactgccttgcgccaggccaatgaaatcgcggtggttttgcgccacgttgctcaggccctcacgccctatcatgacgcctttgggtttgccggtcgtcccggaggtatagcagacgtaggccagtgcgtctcgcgattgagggagttgctccgcatggatgttcagcgaacg

SEQ ID NO: 79977 - DNA, 833 bp, Glycine max
  Peptide Sequence Number=SeqID_171662
gcaatccatctgacttacaaccctttgatcctgagatagataggacatttcatagattagttaggcatcattttataccttttgatcattctgagcattccataactggtgaatctgtgcattctgttattggtgattttgaacatcctgatcttgagcattataattttgagcattctgattctgagcattctgattttgcacattctgagaacatggcacaacctccaccccgtgagaggactctaagggaaatggttgcacctgatttcacctatgaaagcttgtgcatccaataccctgatgaggatgtcccatatgttcttaaaactggactgattcatttgcttccaaagtttcatggccttgcaggcttttcctcattcattagaggagtggcaaacgactggctgtattaccttgctccaaggtccatctcgagctgggatgaccttaagagagtattcttagaaaaattttccctgcttccaggaccacagccatcaggaaggatatctcaggtattagacaactcagtggagagagcctgtatgagactcagtaatatggagagaagtatgatagatgatgccagtggtggagcccttggagacatgactcctgctgaagctagaaatttaattgagaagatggcttccaactcccagcagtttagcgccagaaatgatgccatagtcattagaggagtgcatgaggtagctacaaacccatctgcatcatctgaaactaagaagcttgaaggcaaactggatgcattggttaacttggtaacccagctggccttgaatcagaaatctgtacctgttgcaagg

SEQ ID NO: 79978 - DNA, 462 bp, Glycine max
  Peptide Sequence Number=SeqID_171663
tgccggaaggtcaaggaagttggtgacctgatgacaggggagccgacgaccgaagccccggtgaacggcggccgtaactataacggtcctaaggtagcgaaattccttcggggcaaagaaggcctccttctgggggggccagagccatcagtgagataccactctggaagagctagaattctaaccttgtgccaggacctacgggccgagggacagtctcaggcagaagggagcttgactgcaagacccacccgtcgagcagggacgaaagtcggccttagtgatccgacggtgccgagtggaagggccgtcgctcaacggataaaaggttgggctgttcgcccattaaagcggtacgtgagctgggttcagaacgtcgtgagacagttcggtccatatccggaccgggaaggacgcacctctggtgtgccagttatcgtgcccacggtggggatcctctag

SEQ ID NO: 79979 - DNA, 192 bp, Glycine max
  Peptide Sequence Number=SeqID_171664
atggagatttctgcctccactctatttttttttccaaggcttggaggggttgatggggacccggttgatcgagggagaactgccaggaaaccacattacaagcgaaacctcaagagagttgggcttcatcctcaaaaggaaacaacaccagaaaatctagccttccatggattcaaacagaaacgcaattga

SEQ ID NO: 79980 - DNA, 408 bp, Glycine max
  Peptide Sequence Number=SeqID_171665
atgtttatagatgggctgagaccacaaaccaagcaattgttagatgcttcagcagggggggaaataaagttgaagacccctgaagaggaaattgagctaattaagaatatgtcagccagcaatcatgccattttgcgcaacagagttcatcaacccacaaagaaaagcttgttagaactatcatcacatgatgctttattggcacaaaataagttgctttctaggcaacttgagattttaacagaaacacttggtgatgttgtcgcaacctacccttcggcgggagggcgacgcgtgacttgtgggtgcgtcttccaagaaaggaatacgtgcggagtcgccaccaacgtttatttgaggaaaacgtcggaaaaaccagaaaagacgtggtctacgaactttaagtga

SEQ ID NO: 79981 - DNA, 171 bp, Glycine max
  Peptide Sequence Number=SeqID_171666
atggattgtaagtcagatggattgcctctagtcatacactatattcagcatgcacaactagttgccttcttatgcaaatcagcaaaactggtcgctaaatccgtcgcaaagcactattcacagcaaaacacaaaaactgaaacaggggaagcgctgaacagaaaaaactaa

SEQ ID NO: 79982 - DNA, 1067 bp, Glycine max
  Peptide Sequence Number=SeqID_171667
tagtcaccgtcgatccgggagttatatccgcttttgtcgagaggtggcacaagaagactagaaacttctatcttccagtaggagagctgaccatcacactggatgatgtggcgtcactcctctatctacaatcacaagtgccttccacagcttcgagcctctgcatgtggacgttcatcatgttggtggagttgcttgaggtctcgggaaaggaggctagagatgagactgtacagtatcatggggcttatagtgcaacacatgttcatgtagtgcatttggacacttttcgagacttggcccagagtgggagctatgcttggggagctgtcgtgctagtgcatatgtatgaccaattaaatgaagcttctcagagcactacacgacagattggtgggtaccttactttattacaatgttggatatatgagcactttcccagtgagcatgactgcgtcactgatgatggctacgataagacgtctccacatgcctgccggtggcttactatgaagggattaaccgcatcgccataccggacacgtatagatgctttgacgatcactgacatgtgttggatgccttatggtgaccatcgaggagttagggcgtttgacctcatttcatgcttcctgggtcagcttagatggggtcctattgtggtcacacttcgaccagagagggtggtgcgacagttcagctacgttcagaccatccctccaccacctattagtgccaccttgtcatatgatgatattgacaacaggtggatacactactcgaaccatctagcaattgcgggtcagatttgtcttgtgcctgggcaggtttcaggagattacatggagtggttcttcctgatatctcatccattcataacacccacacaagcaggtgatcagcctagacatccacttgtcccacaacatgaggcatatgtggagctagatatcctagaggtcccaatggcagtagaaggtggaccatcacaggcacctgatcccccagacatgcagtggatgcttgtgaagcgatcgcagaaaggttggagcttgtgctcaacctaa

SEQ ID NO: 79983 - DNA, 309 bp, Glycine max
  Peptide Sequence Number=SeqID_171668
acttatcaaggtaatccttgtggcgtctaccctgacttatcttccttcaccagaagtggcgtctacccagacttatcttccttcaccggaagtggcgtctacccagacttatcttccttaaccggaagtggcgtctacccagacttatcttccttcattggaagtggcgtctaccctgacttatcttccttcaccggaagtggcgtctaccctaacttatcttccttcaccggaagtggcgtcatccaaaaactctacagcctgtatcaagcgatccgccccgtaagattcacatcaaatactcactaa

SEQ ID NO: 79984 - DNA, 288 bp, Glycine max
  Peptide Sequence Number=SeqID_171669
atgagaggaagacataagtcacatcttagaccttcccataggagagaaaaggaacgaaagcctcaaaaggctaacattaacctcccatacttccatgggaaagacaatgtaaagacttacttagattgggaaataagggtagagcaacaacttaaaaggaagcctacttcaaaatcttatggctctcactcttatccaaagaaagaccaaggtcaaggcatcttaggggcgacaccttctatgcccaaagatgagaaaggggaagacaatagaaaagtaaccctctaa

SEQ ID NO: 79985 - DNA, 483 bp, Glycine max
  Peptide Sequence Number=SeqID_171670
atggagggagaagaagtagcaagagtcaaagtagagttgttcgacgacagcgaaagcaatcgcaacgacgacgatgttttgagcgagagcaaggactcgagagtgacaatggaagaagtaacgatgaggacgatggctcatgcagtgaaagaagagatggatgacgacattgttaactggtctttgtcttcattaacgtcgccgaaaccaatggaagggttgcacaaggtggggccccctccattcctgaagaagacgtttgaaatggtggaggaccctcacaccaaccccattgtgtcgtggagccaaactcgcaatagtttcatcgtttgggactcacacgacttctccaaaacccttttcccaaagtacttcaagcacaacaatttctcaagcttcgttcaccagctcaaaacctatgtcagtcaattttcctacatccttgccttttcttctttgcctcattatttttcgttgtcctga

SEQ ID NO: 79986 - DNA, 195 bp, Glycine max
  Peptide Sequence Number=SeqID_171671
atggtggcccaacacgagtttatgtttggtaaaggccttcatcagggtgacctgttatcaccttttctttttttgatagccacaaagggtcttaatagccttaggaaacaaatggtggataaggacttgtttaaaggggtgaagttgagagcgttgttaactcaggggaagcagggcgaaagtcttgaattgtaa

SEQ ID NO: 79987 - DNA, 1539 bp, Glycine max
  Peptide Sequence Number=SeqID_171672
atgaaaacttccatttccgttataaataaacaaccaaaaaccaaaaaaacttcgtcaaaaccatcccatcaccttcacactcgaaggcgtttttgcgttttttctttccctcaaaatgcttcttcctcacattattctctccctcttctctttcctctccatcatattactattcaccaccattacttcatccacccccacccccaacaccatcatcaccctcccttattcacccaccacccctcttcaagtaattcacacccattccacaccctccaactcgccgtctccacatccatcacaagagcccaccacctcaaaaaccacaacaaccctagttcactcaaaaccctagttcaccccaaaacctacggaggctactcaatagacctcaaattcggaaccccaccacaaacgttccccttcgttctcgacactggaagcagcctcgtctggctcccatgctactcccactacctctgctccaaatgcaactctttctcaaacaacaacacaccaaaattcatcccaaaagactcattttcttcaaagtttgttggctgcagaaaccctaaatgcgcttgggtctttggctccgacgttacgtctcattgttgcaagctagccaaagccgcttttagtaataacaataactgttcccaaacatgccctgcatacaccgtccaatacggtctcggctccaccgcgggttttctcttatcagaaaatctcaattttcccgcaaaaaatgtttctgattttctcgtcggctgctccgtcgtctctgtctaccagcctggcggaatcgccgggttcggccggggagaagagtccttaccggcgcagatgaacctcacgagattctcttattgcctactctctcaccaattcgacgaatcgccggaaaacagcgacctcgtcatggaagctaccaactccggcgagggaaaaaaaaccaacggcgtcagctacacggcgtttctgaaaaatccgtcaacaaaaaagcccgcgttcggcgcgtactattatatcactcttagaaaaattgttgttggtgaaaagcgcgtgagggttccgaggaggatgttggagcccgacgttaacggcgacggcgggttcatcgttgactcggggtcaacgttaacattcatggagaggccgattttcgatctggtagcggaggagtttgtaaagcaggtgaactacacgcgcgcgagggagcttgaaaaacagtttgggctgagtccgtgttttgttttggcgggtggcgctgaaacggcgtcgtttcccgagatgaggtttgagttcaggggtggcgcgaagatgaggctgccggtggcgaattatttctcgcgggtggggaaaggtgacgtggcgtgcttgacgattgtttctgatgacgtggcgggtcagggtggggcggtggggcccgcagtgatattggggaactatcagcaacagaatttctacgtggagtgtgacttggagaatgaaaggtttgggtttcggagtcagagttgccaaaagagggtttattaa

SEQ ID NO: 79988 - DNA, 609 bp, Glycine max
  Peptide Sequence Number=SeqID_171673
atggagaatgggggaatcatagagacaaggagttgcacgagcaaaaggaaaatggaagcaaacaattggaagaaattaggggaacgtatccacgattttcttttcaagatttctagaggatttcaaggcatcagatttatggggaacctttcgacaatagggaaaaaaatatgtgatttggtgattgtggagagaagaaatagatgggatcacatgtttggctttctaagatttaaaggtgtggaaaatgctttgaaattggaaaggcaactggaacaaactgttattcgtaatgttaagatgcatgtgaatctccaagagtacaaaaggaggaaatatgatgatttgggattctatatgaaggggaagcagtacggaggtgcatatgaaggaccacaacaaagaagtgatgaacaaggagaacaaaaagaaggagatgatatggttcttgttgggggtgtagatgatggtatgagggaaaagattaataaaggcaaaattcatggaatttggtctttgtttctatcattggaaaaaaggaatcccaccatagttccagggaatagaatggcatggatcatatgcatgggtatcccattaatggtgtga

SEQ ID NO: 79989 - DNA, 2289 bp, Glycine max
  Peptide Sequence Number=SeqID_171674
atgagagagagtgagagagagagagagactgagagagagcaagagagtgggagagaccaagagagctcgagagaaggtgagaatgggtgggtaagagttaagcataggacccaaaccaaagagcgtaacagtgagaaggtgagagaggatcctcatcgtagacatgccgggaacaggcaagggcaaggacagagctatggtagagctaattggaggagcagaaaaaacataacatcgttctactttacccgattccctgacgacacgacggaggaagaactatggtaccacttcaaagtgtttggtgccgtaagggaaatctttattgctaagaacataaacaagcatggtaggaggttcggttttgttagatttgaaggtgtcgagaacgcacagaagttggagtggacactagataacatcgtgtttggcggtctcaagatgcacgtaaatattccaaaatttggaagaaacaaagttgtgaagccaatctcggtcacgaacaaggtgaggcaggacgtgcacaaagaagaagcaatacctcgctatgtacagcctatatcgaccacacaccatgggtcgtatgtggaggtagtagcgagaaataacactggtccaggattaaggagaatcgcaggtaatgccagcggccataatggtacatcgtggtcttcagtgtacctagatatcccagaaccgttgatgaagagggccaaagaggcgtgggtgggaagattgaaaaatctggctatgtttgacagggtagaagatgacctatactgggatatcagtgccgacatatcgccaaaatacatgggtgccgacatggtcttgttgcagggcctctccgacgaaggtgcagagctgatgatgcaggaggaaacagagggaggatctactcctttccattctttggagaaatggagccctaagctgcgcataggatacaggctgacatgggtttactgctggggattaccactcacggcttgggacccgcaccagatcagaaagatagtggccgcaataggagacatggtggacgtcgacgacgccgtcgagttggttagaaggatggatagggttcgggttctcgtcaaaacaccgcggcagccatacatacaacatgcagtcaacgtgcatatacatggggaggtgtatattgtgcatgttgtggaagaaaatggtaacagctttgacaattgctatggccggaagggaagtgtctacagctcatctgaagaagtagaatctgacgacagtgaagtcggaacgctaaacgggatcagcaacattgagtggatggccggcaaagaggtggaggtcacggcggtagagccaaacgccgaggggcagaacccatatagctttacctcgacggcgagccctgactttcgcatgcaagggcagggtctccatgaagacatgatggacggagctcccactgcggtcacgacgacggtcggcgatcaagcttcccttcctggaacccagaatcccgtcggagcttctttatccagcagacaaaaaaagaacgtccccccaaaggataaagctattatccgctgtgcaaactctccaacggtcaacgggcagccatcaaacagcggtacttgcccattggattctgtcgttacctaccttgcatgtgagcgacaaggagactttcatgaaaagggcactgcaggcacaattgggattccaacctctgacgcaaaggatgttttggagtctggaagaggaaagcttgaagaggaagggcagcatgagactttggagactcatatttcaaattcaaatgggtcacgtgatcaggaaggggattttgctgatgggctggatcacgctatccacaccccccatgttactcacccaaaacagaacctaagcccaccagcaaccaaatggcaagtctattcacgtaaaaggagttccaaaaggaaatctatttcgggccttacacatggattgaatttaattgatgaaatggatccagagccaaataatcaaacctcatctcagccagtggagggtgttgaagacaaccatgggcccgaacaacttgtaagcaccaagaacaacgacattagaccaacacaaattcaacatgcagagacaaattttcttccctctaacatgcaggaggcagcagatatgtgggagttggtaaagtcattgggggttaccagtgggtcttcgcaaggggatcctgcaacaaaaataatggacatggagacaagagatcgagaagaagcacacagattgggatgcaggagagtttcacaatga

SEQ ID NO: 79990 - DNA, 381 bp, Glycine max
  Peptide Sequence Number=SeqID_171675
atggaaaagcctgacaagaaaaatttcaaagataagaaaggaaagaaagcgtacatcacttgggaagataatgatatggattcatcaagtgatttagaaaacaaaattgtaaatctaggcctcatggccaaagactatgaaagcgaagaagaggttggattaggatataatcctgaaaatcaacaaaagatgtataaaaatatctttacctccactcaaaagactagttctcccttcttaacatgcttttactgtggtaagaaaggtcatagtgcatcaacatgttatattagaaagaatggtaatagcattagaaaaatggtatgggttccaaaaggatctttagtcaaaactaacattcaagaacccaagaaaatttag

SEQ ID NO: 79991 - DNA, 171 bp, Glycine max
  Peptide Sequence Number=SeqID_171676
atggcgaaaatcaaaaggaagcattgttacacaatctgtgaggagggtgcaaatagcaaccaggcccacttgggccttccaggaagttcctccagaaggcaccaaggtggtgccttctcgaggaagcaacctagctcgcctgggcgagctgagctcgcctgggcgcgctag

SEQ ID NO: 79992 - DNA, 447 bp, Glycine max
  Peptide Sequence Number=SeqID_171677
atgttgggggttttcattaatcgaatccttattctcgttctggggtatgcataccctggattcgaatgctataaaacagtggagaaaaatagggttgatattgaggaacttcgcttctggtgtaaatactggatcattgtggcacttttcactgtacttgaaaagttcacagatatatttgttggatggaagggcacgggatatgtttacgagactctattgaggccttacgtatcaaagcatgaaaatgagattgacagaacaatacttgagtggaaggctagaggatgggattacgtcatattttactggcagtattgtgccaaatttggacaaactgcatttgttcaggctcttcagcacttggcttctcaatctactagattttctgccaacccgactacacagagggggctggagattccacaccaattaataatatggtga

SEQ ID NO: 79993 - DNA, 876 bp, Glycine max
  Peptide Sequence Number=SeqID_171678
atggttagaaccagaggtttaggttgtgcattaagtagggttataggcagagccctgggtagacaggatgatcatcatgcagatgatgttcctcaacagcgtaggcctatcgcatccgcacgtaggcaacgggtagctgcccctgttgctgaggatgttcctaagatgactgaggatgttcctgagatgagtgcggacgtacttgcacctggtgcagagggcttaactggtgacggtgttaagggatcagctactgatgatgctgagcaattcccaggtggtcacgaacgtcttgaattgaagttggtctcccacagaaggaaggttgagaaatttgggaggctagcgcctgagattgaagggctagtcgttgccacaggattaactcctttgatcgcgtgttcagtattcactggcgatccaggagttatattctcttttgtcgagaggcgccttccacaacttcgagcctctacttgtggacgaggcggtcatcatgttggggagttgcttgaggtctcgggtgaggaggctagagctgagactgtacggtgtcatggggcatatgtacgcctgccgtggctacgggatatcaatcagacgaaatgcgaggcccgacagtggattgttgcagctcgtgcttatttgctacacttgagtgggagctatgcctggggagctgatgaggacatgaccaagagcaagggcaaggatccacttgaaggacttggaggacctatgacaagggctagagcaaggaaagccaaggaagctcttcaacaagtgttgtccatactatttgaatacaagcccaagtttcaaggagaaaagtccaaggttgtgagttgtatcatggcccaaatggaggaggactaa

SEQ ID NO: 79994 - DNA, 294 bp, Glycine max
  Peptide Sequence Number=SeqID_171679
atggagcattatctacagcacttggttctccagcaggcggccaaccaccaggggcaggtacagatacatgagtgtctctaccggtttagcctcagtcagcaggggcagggtttcgctccttttgtgtgccctactccagagcagtttagggctgaggtcgcatgtcccggagattggcctgaggcccaggcaggggaggcgcctgcaggatctcccgacgatgcagaggaggcccgtatggatgaggagatgacgaacttgctcgatttcttaggaggaagcggagccacgtga

SEQ ID NO: 79995 - DNA, 363 bp, Glycine max
  Peptide Sequence Number=SeqID_171680
atgagactcttcattttgaattttgaaaatcttaacgttttaaaaacactggtaatcgattactgcattctggtaatcgattaccagagagtaaaactctttggtaatgattttgtgaaaacttcttgtgctacttgtcgcaacgtgcccttttgcgggctagcgaggcgaggctcacgggtgcgctttccaaaggaggaaagatgcgcggagtcgccaccaacgtttatttgtggaaaacgtcggaaaaaccggaggaaaccggtcaaaatgaaaattctaagttcgggaggtttatttacgcttgaggaaggtattagcacctctcacgtttgtctcaaaggacaacagcctaatttttag

SEQ ID NO: 79996 - DNA, 612 bp, Glycine max
  Peptide Sequence Number=SeqID_171681
atgtctcccaccgacagcttcaatggagttgagcccaatgcttatgagttgcaagattttgttgattgttgttctgacctggggctggggagcatcaactctcatggccccttgtacacgtggactaatgacagggcctggttcaattcctttggaaattctgcttgtgaagttatggagtttatttctatttcagaccatactcctctatttgtcaccactgagttggtagtgcctagaggtaattctccatttaaattcaacaatgctattgtggatcatccaaatttctcaagaattgttgcagatggctggaagcaaaatattcatggctgtagcatgttcaaggctgataaatgctccaaattttttcatgctttaatcaagcgcaacagacacaaccggtttattgttgccataaggctagatgatgggcataacacttcctcccaagataaaattgcccttgcttttgtgaatcactttaggaatttgtttagtactcatgagctgacccaaactccttccatttcggtctgcaacaggggtcctaaggttcccatcgattgctttgcggccttactttgtcctacttctaagcaagaggtttag

SEQ ID NO: 79997 - DNA, 117 bp, Glycine max
  Peptide Sequence Number=SeqID_171682
atgcccccccacaggatactgggctgctttgcagcgacgtttttcgcttgtccagcactgggaagggacgacgatctgtcggtcgtgaccctatcctccatttgcatccgtccctaa

SEQ ID NO: 79998 - DNA, 243 bp, Glycine max
  Peptide Sequence Number=SeqID_171683
gacaacaacccaagtagatgtaccctctacttgtacctcaaaggatgtaccctccaatgtgttaaggcaaagaattctcaggcggttagtcctttgaatctttgtaaggggaaacaaaagatatctcaggcggttagtcctttgaattctcttggaaagagagaagggagacacaaaacaatttgggcggttagtccttctattcttttgacaaagggagaagtgaatgaagaagaagaatag

SEQ ID NO: 79999 - DNA, 282 bp, Glycine max
  Peptide Sequence Number=SeqID_171684
atgtgtcagaaatcaaaaggaagcaggcttacgcgatccgtgaaattccgtaatgtggcggaaatcgaaaagagatccttcctccagaaggctgttgcttctggaggaagcaaccttgctcgcctgggcgagctgggtggcaagctcctcccctattttgctataaatagggggaggagtgaagaagaaaagggttcagccttcttggcatttcgtattctcttaaatttgcttaggaaaattgtttccgtaaagaaaatccaagccgaggcgcttccgtaa

SEQ ID NO: 80000 - DNA, 432 bp, Glycine max
  Peptide Sequence Number=SeqID_171685
attttcagtgaagttggtaaggtatatgctgtcaagtggaatgatgtactggacaatgtatggcatttggttgacaaagaagaaaattatcataacgttgtgtacaacaaagatttggaccaaccagccattgtagcaggaaggacaacactacaagatttttaccagctgaccgaagattatccagtctccttaactcattatgttccctgcccaagtcattcccaagatgacactctgtataccatcaagtgccagattctatcatcttcaaggacgtttcaagtagcatgtattattttcttaaagacaaaggttgaactcatttgcacttggaggatgttgcagaatgccggctcgtgttcaatcattggaggaagacacttaaaattggagccggatggaaacatttctgcgagatcttgttgttaa

SEQ ID NO: 80001 - DNA, 892 bp, Glycine max
  Peptide Sequence Number=SeqID_171686
cttctgggaaggcgttgacgtgcgcggtgatgcgctgtcgctggtgatcatcgacaagctgccgtttacctcgccggaagatccgctgctgaaggcgcgcatggaggattgccgtctgcgcggcggcgatccgttcaacgatgtgcagctgccggacgcggtgatcaccctcaagcagggcgtgggccgtctgattcgcgataccgacgatcgcggtgtgctggtgatttgtgaccagcggctggtgtcgcgtccgtatggcggtctgttccttaatagcctgccgccgacaccgcgcacccgcgatttacagcgttgttatgtccgcccgaattttagccctggacaccgcgacagaagcctgttctgccgcgctgctgaatcagcagcagatcgatgcccgcttcgaaatcgccccccgcgatcatactcaacgtattctgccgctggtgcaggaagtgctgcaggcgcagtcgctggcgctgagcgcgctggacgcgctggcggcctggcgctgggcgcaaatctgccgatgattggcgtatcctcgctggcaaccatggcgcagggcgcctggcgtttgaccggggcaacgcgcgtgctggcggcgattgatgcgcgcatgggtgaagtctactgggcagagtatcagcgtgatgagcagggcgagtggcagggcgctgagagcgaagccgtactcaagccggaagcggcacaggcgcgcattgcacagctgagcggcgagtgggccaccgtcggcaccggctggcaggcttatccgcagctgctggctggcgcgagctggggcacaactgctgaccaccacggtcacgctgccagctgcagaagatatgctgccgctggcgctcagcgcctggcagcgcggcgatag

SEQ ID NO: 80002 - DNA, 468 bp, Glycine max
  Peptide Sequence Number=SeqID_171687
atggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctgccaatccctggggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaa

SEQ ID NO: 80003 - DNA, 240 bp, Glycine max
  Peptide Sequence Number=SeqID_171688
atgggtagcgtaaaagtgtttttcaaaatatgtgtatttgaaatgccaccaaggaagctctccgcaatgaaatctaggagggacaccgcagtcgaaggaaccagcgccgctcctgagtttgaaagccatcgttttaggagcgccagcagcgtttcgaggccatcaaaggatggtcattccaccgagagagacgcgtccagctcagggatgatgagcacacagattttcaggaagagatag

SEQ ID NO: 80004 - DNA, 195 bp, Glycine max
  Peptide Sequence Number=SeqID_171689
atggccgaccagcaagcgaccaagtccaaagccaaagtcatcacgcgtccggctcaagacattaaagaagtgctactaggaggcaacctagaattggctatgaagaagctccccgtgaagcggtccaagaagggcatcattgaagagggtttcggtgcggccccacaagccgacataggctttgacaaacactga

SEQ ID NO: 80005 - DNA, 789 bp, Glycine max
  Peptide Sequence Number=SeqID_171690
atggcgcagaagatgacgttagtctatgcgtgctataaggcttttcgtttacagatatcaaaaaagaatgtttgtacggataaccactcgggtatttccgccggtcagcgtgactcaaatgtgagtatgacagatcttgtgagcacggaagatgacttaaatcttcaggtgtcaacgggcttatcggccgcgattgacgaagggcgcagaagacgacgtttgtctccgcgtgctatcaggctttttgtcttacagacagcaaaaaagaatgtttatacggataaccactcgggtatttccgcccgtcagcatgactcaaatgtcagtatgacagatcttatgagcgcggaagatgacgtaattctccgcgtgtcaacgggcttgtcagccgcgattgacgaagggcttgtcatcttacagatagcaaaaaagaatgtttatacggataaccactcgggtatttccgcccgtcagcatgactcaaatgtcagtatgacagatcttgtgagcgcggaagatgacgtaaatttctgcgtgtcaacgggcttctcagccgcggttgacgaagggcgcagaagacgacgtttgtctccgcgtgctatcaggctttttgtcatacagacagcaaaaaagaatgtttatacggataaccactcgggtatttccgatcgtcaacgtgactcaaatgtgagtatgacagatcttgtgagcgcggaagatgacgtaaatctccgcgtgcaaacgggcttgtcggccacgattgacgaaaagcgtagaagactgcgttag

SEQ ID NO: 80006 - DNA, 527 bp, Glycine max
  Peptide Sequence Number=SeqID_171691
atggggacaaatcaaaacggcaaaaggtttgatcaagtcaaggttaaaagtctagatgtcactagcctcaaggaattgggtcgattgatgggacctctcaaaaggcaagctttccacaaagtttacgggaagattctagatttgaccgcagcggaggtatttacggaagctatcgtatccctcgcccgatactatgaccagctgttgaggtgcttcacgtttggggacttccaaatggtaccgactattgaagagtttgaggaaatactaggatgccctcttggaggaagaagaccgtatcttttctccgggtttcttccctccttgagcaagattgcagctgtggttggggattcgacaaaagagttggatcgcatgaagcaaactcgcaatggcgtagtaggcctgccacggaaaatacttggaaggcaaagcaagggatatggcgagccaagagaagtggggcccgtttgcggatatattagctttgttgatttttggggttgtcctctttctgaacgtggacg

SEQ ID NO: 80007 - DNA, 474 bp, Glycine max
  Peptide Sequence Number=SeqID_171692
gatgagagagacaaggatgtcaaattcattcattttagcattgtaactgtggtttacaataatggcataaactttggaaatcctgatgagtcattagagacacctaacaacagccttcaaaatcgccccatgtgtggtgtcgcttggtcatacagtgctcaatggaatgccccagggctcctccacgatatgcacatgttgcgttcgagtcgtatcctcagaaaaatggaggcttttcgctgcaaaattcatttcttggttggtgttttggtttgtgccaaagggatggcctttgtggataaatgggcagtaggatggcagtcacagcatgggtttctcctcatcctcaccctcttcatttgccccattttctcatcgtccaagcaggatgatctaaattttcctcttttcagacccacttcgatcctttcgtcggcgaagaccaaatccgcaaagcttgaaggtgccacttga

SEQ ID NO: 80008 - DNA, 2244 bp, Glycine max
  Peptide Sequence Number=SeqID_171693
atgagaggtagagagagagtgagtggagagagaaacacggggtgggggagtgacagacttagaggtaggacagtagggagagatagagcgagtctcggagaggtatctcgacggcgctttgccggaaacattggaaggactaagctttcaagtacggtgattaactggagagatcaaaaggatatcacatccttctacttctctcgcttcgccgacgatatcacagagcaagaactttggcaccatttcaaaaaatggggggatgttagagaaatctttatcccgaatagaagaaacgcctcggggagaagatacggtttcgttaggttcaaaggggtccaagacatcccttacctggcgaaacagcttgacgaaattgtcataggggggttgaaattgttcgtcaacctcccaaagtacggcagggtgacgcagaggaagacaatggtgacattccaatcacggcgaaacacagacagaaagaatgaagaggtatttcgatatcaccacaccaaacccacatcatatgctgatgcgttgacaagaaacataagaagaccagtatatcagaggacagcaaacaccatcgccaactacagatcttcatcttcatcggttcatatcgaagtggcgccagaagatacgctttggctgaaggatgcatgggtaggccgccttaaaaaccaggctctgtttgaacgtttggaggacgagtttcgttgggggatgggactggagatagtccctagatatatgggtgatgatcaagtgttattattgggtctcaccgacgctgacgccgacaaactcatcaatggtggaaccacaggggagtcaatgatgttttcctacattgaaagatggaatccaagtctgcgtgcaggtaatagacttacatggattcactgttgggggattcctattcaagcctggaatcagaaatatatcagtcagattgttgccgtcatgggtgaactgatggatctagatgattcagcggaggagaagaggagaatggatagagcaagggtcctcattaagaccccatggaagcctataattcaacacacggtggaagtgacgattggagaagacaagttcatgattcagattgtcgaggagtgctgtggaggctgtcaagatggtttccggagtggaagaaatgaacgagggtcatcggaggacattaactccgatgacagcttcctcgatagctcttcttttgctaactggggcttcggggacgacgcgtcaatcgtgccggaatcggactttcgcagtgctcatactagcacagctgcgacgaccgccaacggcgcaggaaaccacggggagcagcaaccgccactcctccacgcttcggaattacatatcgcgtctcctggcgccgtcgcggagaatgatgtcggagttgaagaccagcagtctcccactgcatccaacggtccaagtgataacggttaccctttggacaatgtgaacaaccatcgggtcgatagcggaaaccagtgggtaaacacgcatggaccaaattcgaattttatgcaggctacggtcacccataacccagaagacagcgcaaaaaggagggctatgaagtgggaaccagtgcctaacatagatgatactttacagagttacaccaactcgatggatattgcagtagggggtgacgtggagaggatcaacgatagcctcatgacacgaggcacaggagaatataaggaggtggaggccattattgttgatacagaagcacgggcaattttaacggaccagaattccaattctacccccagtgacaaaagatctaagttgggcctgaacccattaacaggaggaggtgcaactagttgccaagtatactcccgacaacgtaggtgcaagaagaaaataacctcgggcttaattccattgggctctggtgatgaaacacataagggactctcacaacctccaaacacacagccttcttcacttcataacgaaccatacaacgacaaactggaaactccattccagctgcaggtttacaatggtaacatggaggcaaccagtgactctgacaaaacatttaatcctgatgcacttcagatgtggagcatggccaaacaattgggcctcacaggagaggggagcaaggaatcagttattcaaaagtttcaaaatatggaggagagggacagggcagaagcaactagaagggtgtctgcaacagccatcaatgaaaataatctcttataa

SEQ ID NO: 80009 - DNA, 440 bp, Glycine max
  Peptide Sequence Number=SeqID_171694
aaggacttacaggattaatgaggacagctatatccaagaacttatacagtagttatcaagtgggaagtttgaaggaagatataaatatcctgcaatatgcagatgacactctattctttggcaatgctctttcggccaatgtcagagttctaaaacagatggatattcctttcatgtatctaggaattccagtggggtctaatccaaaaagtgggactgtgtggcagcctatcatcaacaaatttcagaccaaaattcccaaaaaagttactcagaaaatagttgctattcaaagaaattttctttggggtggtgataatggcacatctaagatcccttgggtaaaatgggatacggtttgtttacctaaagctagaggtggattgggcattaaagatctgaacaagtttaatgaactcggtctcttggggatttcttga

SEQ ID NO: 80010 - DNA, 589 bp, Glycine max
  Peptide Sequence Number=SeqID_171695
atgacgggaaggcgggtgtggatcatgcgcactagcatgaccactttgacacagatctggatgacacttctcctcagcaacatccttcccagtgaccataattctaatctcccgctgcctaaatgccagctagtctacgctatcctgacccaaatcagtgttcatgtagcccagcttatctcagatgccatttaccagtttgtaggtatcatacctccaagacacccaatggacccaaaaaagtcctacagagcactaggattttcagctttgatcacagacgcaccaccaccacctctacagcagccaccatctctagagtccatctcggctcacatgcagaggatggatctctgcatgcagcatttggctgaccagcaggcggccaaccataggggccaggtgcagttgaatgacagcttctaccaatataccctacaccagcagcgccaggaccctagcccttacccatggcctactctcgagcagttcagggcaaatgttgcatggcttagggacaggcctaattttcaggcgggggcaggtcccatagaggccccaggagatgaagacgaagctgaggaagacg

SEQ ID NO: 80011 - DNA, 165 bp, Glycine max
  Peptide Sequence Number=SeqID_171696
atggtttttcacttaaggcttgtaatgagcatcaaaacaaagaaaggggaacataggctcaaaggggctatcaaaggaattaattcaagcaagaagtatcaacaagagtcaagccaaggctattgtgcaagcaatcaatggggcaaaacacaccgaataaaataa

SEQ ID NO: 80012 - DNA, 159 bp, Glycine max
  Peptide Sequence Number=SeqID_171697
atgggattgaggggcagaatcgtcttaggcaatggtcgaatgccaggccagatcgataggcaaagactaatcaaggtaaacggtaatgcggccacagtttgctgcgcaatgtcgtttcctgcttttaggtacttagggacggacgcaactagaggctag

SEQ ID NO: 80013 - DNA, 138 bp, Glycine max
  Peptide Sequence Number=SeqID_171698
atgtggatgaccgaggagatgaaaaagagggaggaactggtgctggtgggtctccggaggttccatggcggcggtggagtaacctgtaactattggagcctactagtaatcgattacaaccttgctgttctaaggtaa

SEQ ID NO: 80014 - DNA, 582 bp, Glycine max
  Peptide Sequence Number=SeqID_171699
atgcaacgtttgttgaaccgtaacaaagaaaagccctacagacgaatagccaaatcttcctcatttactcttaaacctctatcccctagagaagtgtgtgatgaccaaatcagaatgggagaaaagagagaacaagagaaagaaaataaggcgagtgaagtgaggaaagtgttacttgctcatgaaccactcaatctacagtattgcaaagacagcatagaacatcaagttgatctcctccccggagcttcattgcctaacaggccaacttacaaaagcaatccccaagagactcaacgtaaggatgcacatgccaaagttgagtatgtgaaaagattgtatgaccaagtgaaggtgcaaattgcaaagaagaatgaaagctatgtcaagcaagcccacaagaaaaggaaggaagtggtacttgagcccggtgatgatcctgaacatttgaggacaaatgttttccaagaaggagggaatgatgagaatcatgaaactggccaaatacaggctaaaggcccaagtggagaaggacgaaggcccaagtggagaaggacaaagcccccgagtggagaaggatga

SEQ ID NO: 80015 - DNA, 345 bp, Glycine max
  Peptide Sequence Number=SeqID_171700
atgcatagtagctacatgatagcctcctcctctagttgtgctcgcacagttgaccctcgtccgggatcagggggtggcccaggaactgataaaaggaaactactggcccctcaccctggagcacaagtctcgccctctgaagtcgaggacttgtcgccctttgaaggcgagggcgtgcaaccctctgaaggcgagggcatgcagccctctgaggtgagggcgtgcagccctctgaaggcgagggcgtgtaacactcttaaggtgaggacgtgtagccctcggaaggcaaggacgtgtagtcctctgaaggcgagggcgtgcagccctcttaagccgagggcgtga

SEQ ID NO: 80016 - DNA, 150 bp, Glycine max
  Peptide Sequence Number=SeqID_171701
atggtcaaatgccaggatgggtctaaaggcagaaaccaatcaagggacggacgcaagtggaggctaggatcacgatcgatagatcatcatctcatgcccaacactggacaagcgggaagcgcagctgggggacagcctagtatcctttaa

SEQ ID NO: 80017 - DNA, 1043 bp, Glycine max
  Peptide Sequence Number=SeqID_171702
atggctccgaaaaagctttccacgaagagatctaggagagacgtcacggcagaagggtccagtgccgcccccgagtttgatagccaccatttccggagcgccgtgcaccagcagcgcttcgaggccatcaaaggatggtcgttccacagagagaggcgcgaggagatagctcgcagacattggacgtcactggtgactcccatggctaagtttgaccctgaggtagtcctggatttttatgctaatgcttggcccacagaggagggagtgcgagacatgcgttcatggtgcgagttcagccagaggaggaacagggccgacgggttcgacgaggaggccattgcccaactgctatgcacaccggggcaggatttcacccggacccctgcagggaggccggtgcggatcatgcgcaccagcatgaccaccttgacccagacgtggatgacattgctgctcagcaatgtcttgcctagcgatcataactccgatctccctctgccgaagtgtcagttggtgtatgccatcctgacacggatgagtgtccacgtggcccaggtgattgctgacgccatctatttgtttgcaggtatgccacccaccaggcaccctctagacccggataagtctaacagggccctgggattttcgacattgatcacgggcctctgccagtcgttcggggttctcgtcacccccactaaggtgatccgaccgccgatcacccgggccttcattgagaagtattccacgcctaggcaggcgcagggtgatgcacatcaggctgcagacgctcagccaccacctcatcaggccgatcccgctggatcactaggtatggagcgttatctacagcacttggttcgccagcaggcggccaaccaccgagggcaggtgcagatacatgagtgtttctaccggttcagcctcagtcagcatgggcagggggaggagcccacagaatcccccggtgaggcagaggaggcccgtatggatgaagaaatgactgacttgctcggtttcttgggaggaagcggagccac

SEQ ID NO: 80018 - DNA, 297 bp, Glycine max
  Peptide Sequence Number=SeqID_171703
atggagcgtcaaaaaatgagtgtgtggaggtgcatggatgaccgaatggagccatcggtgccaaatctgaacagatcggcactatctgtcccaagtgccggcagttcacctagattagaagtggacgacgttgacaccgagtttgtacctccgtatgagccacgaaaccccttccacctggtgcggcttgagggtcaccctcagcccaagctcctcctgaatgagtctggcgacaacctggagcctctgctcatagctaagattcatggcgtcgatggtgagagcgagtccgagtga

SEQ ID NO: 80019 - DNA, 264 bp, Glycine max
  Peptide Sequence Number=SeqID_171704
agaattcaagggactaaccgcctaagaattctttgtcctaacacattggagggtacatcctttgtggcacaagtagagggtacatctacttgggttgttatattaagaacaagagagggtacatctcttgtggagggtacatccacttggttgttcaaagagaataaaggagggtacatcccttgtggatctttggcttgtaaaggattttacaaggtcgaaagaaatctcaagaaccattggttgcttagggactggatgtag

SEQ ID NO: 80020 - DNA, 90 bp, Glycine max
  Peptide Sequence Number=SeqID_171705
atggcgctgagtgcccagaggtgcgctaagcgtgatttgcagcattcactgaaccccggtcacattggcgtgatcggaatttcaaaatga

SEQ ID NO: 80021 - DNA, 177 bp, Glycine max
  Peptide Sequence Number=SeqID_171706
atgagcaatggcccaaagacaaatccttctgatgaggaacctccgggattggaattgaaacccctcccttctagcctcaagattccaacaagtgcaagacattgtgcacctcttcaacctttgggcaacttaaccatcacatgtcaggctcgtgatgttaagcaagctctatcttag

SEQ ID NO: 80022 - DNA, 213 bp, Glycine max
  Peptide Sequence Number=SeqID_171707
atgtggttcgccagtaggcggccaaccaccacggacaggtgcagttgcatgagtgcctctaccgattcagcctcagccaagcagttcggagctgcggtcgcatggcttggagactgccccgatgctcagacaggggcaggacctgcaggggcccccggagccgaggatgaagcccaagaagatgaagacatggctgacctattcgacttctag

SEQ ID NO: 80023 - DNA, 225 bp, Glycine max
  Peptide Sequence Number=SeqID_171708
atggttagggaacaagagctagatgtcttcctgcaagggtctataaaggcttgtagacgttccaatgacgacgacggaaggtggctgacggcggaggatggcatcgaacgcaatgaaggctacctggaagaatgcagaagcagagccccttcaatcggaggctttgataccaacttgaaagataataatctgaatattattgtaattttgtctttcaaagagtga

SEQ ID NO: 80024 - DNA, 222 bp, Glycine max
  Peptide Sequence Number=SeqID_171709
atgcagatcgccacgaagatcgatggcgacgtctggttcaaggaaatgcagatctgctatggactgttgaagggcttggaggaaggcattggactggtggaggttgaagcgtttagaacggcacacatgatggagccaggactcgaggatctcgagggtgggagcattttgatcggggcgtttaagacctcaaaagagagagtatttgggcgcacacgatga

SEQ ID NO: 80025 - DNA, 171 bp, Glycine max
  Peptide Sequence Number=SeqID_171710
atggttggtgagagggtcatgtcactagtactggacataggtcatcctatcccattgtattgtcgtcatgcagcacttgtggatatcatagaggtctcatcttcatcttcatcattgtctaacagacccatctcttatcctacaaactcaaaggctactccttctacctag

SEQ ID NO: 80026 - DNA, 300 bp, Glycine max
  Peptide Sequence Number=SeqID_171711
atggagttgcaacgaaagataaaggagaagagatgccacgagcatgaaaggtgtgactctagcacatgggaagcttccttgagaagcttgggaagcagggaagaaaacttccttgagaagctagagaaaaatggatccaaccttggcccatgggctcataaatctaccctgaggttcatgagaaccctaaggccttcttcagcagctctagtccaatgccaaaataggcttggcttcttgggaaaggaggtggctggcattcatctggcttggggaggcccaagccttgatgaatcttag

SEQ ID NO: 80027 - DNA, 177 bp, Glycine max
  Peptide Sequence Number=SeqID_171712
atggcacaagttggtacacaatttgatgtttttgtttttaaaaatggattcttcaaggttgaaaatgtggggaagggaccagtcactagagccatgagcaagaggctccaagaggattgggctagagctgctgaagaaggccctagggttctcatgaacctcagggtagatttctga

SEQ ID NO: 80028 - DNA, 264 bp, Glycine max
  Peptide Sequence Number=SeqID_171713
atgtcatcaatagtaacatcaacgggttcagtgaagtgtggaagcaatgccttccaaggttattttgatgatgccaaagaatcaagagttaagcaaattccaaagattcaagaatcaagtttcaagaatcaagattcaagattcaagaatttccaaagattccaaaatcaagtttcaagaatcaagaatcgagattcaagaataatcaagatcaagattcaagactcaagattcaagaatcaagagaagactcaatcaagataa

SEQ ID NO: 80029 - DNA, 348 bp, Glycine max
  Peptide Sequence Number=SeqID_171714
atgaagaacataaaaaaggaacatggagaacataaaaatacagcaagtagaacacttatcgcccaattccaacatctccaaaaatgtcttccgagattgtcgatgctccttgaagtcaacaacaacatgggtagtttgcagggcacttgtcatttgtcacagatgaagatgccgacgaacttggagcaccccattgcctacgggttcaagatctgtccattggcgggtcgtaggtggcaggtgaaagttgcagtttggaggtggaagagaaaggttgaagttaggagaaagaagatgaaggtgaaggtcaaagaagatgaaccagaaggcaaagcctttctcaaataa

SEQ ID NO: 80030 - DNA, 327 bp, Glycine max
  Peptide Sequence Number=SeqID_171715
atggacgatttccatggcctcagcagtgtgcaaatcgccattggaatgggcgatttccatggcctaagtcgtcagaccaaatggcaactctcccctaagcccaaaaagtcaacaaaatcagctgcactgcatcctgcacgtcctgcaaaccatgaagtcgccaacactgctggcgggacaagcttccacgtgaagtcgccagcagcagtggcggaccacgtagaaaacaacaccatggcagaaattgttcaaaaacgaccccatttggggaataagtttgcaaaaggacctcaaatggggaaatttgccactatattcagtgaatag

SEQ ID NO: 80031 - DNA, 483 bp, Glycine max
  Peptide Sequence Number=SeqID_171716
atggcttcttcgaacaatttgtcacctcctcttccgcatttccaaactccattgttgagaagctcgaagattccaattttttatgcggcaacaacaggtggaaccagtgatcaaatctcatcgtcttcaacgatagtgcaatcggacatgaaaatcctgcgtatgaagctaggagaagcaggatcaggtgctgctcacatggctgcagtcgactcgttcaaagtcaatcctttctcgagtgcttggaagcattcactcttatcaaacaagcctatgcatgaatttctactcaaaatcaaggctatttctgattctctagcctctattggaagtccgatcttcgaaggtcttcttcaagattattactctgtgaaagcaagtcgtcttcaaaggtttcagaagcatgctttctctgactcaccggcagtcaacaacacacaggctaatcctagttttccgtctgcacatggatatgaaggctaa

SEQ ID NO: 80032 - DNA, 1179 bp, Glycine max
  Peptide Sequence Number=SeqID_171717
atgaagcttggtggtgagttgctgaaccagaacattggaggtattgagtccgaaccgtatgaagaaggtgaacatctggttcaggccagtggtaaactgcttattctggaccaacttcttcagaagttgcattactctggacaccgggttctcctttttgctcaaatgacccatacacttgacattttgcaagattttctggagttgcgaaagtattcttatgaacgtcttgatggatcgattagggctgaggagcgctttgctgctataagaagtttcagtagctcatcagctaatatgggcttgaattctgaagctgaccaaaatgaagcatttgtttttataatctcaacaagagcagggggagttggtttgaatcttgtggctgctgatactgttatattctacgagcaagattggaaccctcaggtggacaagcaagctttgcagagagcacacagaattggccagatgaaccatgtattgtgtataaaccttgttacagagcggacagtggaggaagtaattatgcgcagggcagagagaaaattgctgctgagcctcaatgttataggtgataacattctcaaagatgacaataaagaaccatctgaagttggaagtggtgatttgaaatccatcatatttgggttacatatgtttgatcccactgagatcaatgatggaaatcataggaatatgaacataccagaaatttgtgctatggctgacagggtgcttgctatgcgtgatgaacaaatacttgataatgatgaaaggaaatttgaggtcaatccaacaaacattttaaaaggggatgctgttaaggaaagagattctgcttctctctcttgtgatcttggtcttgatgaggcttcatatctttcttgggttaaaaaatttgaggaagtgtctaaatcaagttgtgactcaatcacagacttgaggagcagaagaaatgtagatgaggaaaagagtctaaaaattgagtctgcaaggaagaaggcagaggaaaagaagctagctaggtgggaagctcttggatatcaatcattgaatgtaaaagacgctatcagcccaacgggcaatgacatcgcttcagcttctgggtctgttcattttgtgtatggagattcttttgctctgatgcaccaagcttttgctcatctgaaccaatga

SEQ ID NO: 80033 - DNA, 548 bp, Glycine max
  Peptide Sequence Number=SeqID_171718
atcgtcctgaattgaagttatcctcccatggaaggaacgtgcagaaattaggtaggccttctcctaaaattgagggcctagttgctagcacaggactaagtcatttgatcgcatgttcagtagacactggcaatcggggacttatatcctcgtttgtgaagaggtggcatacggagactagcagtttccatcttcccgtgggggagtttagcatcaccctggacgacgtggcatcttttcttcatcttcgcattgttggtgccttccataccttccagcctctgcacgtcaacgaggcgatgttgatgttggttgagttactagaggtctcaggagaggcagccagggccgagacaacatattgtcatggaccatacgtacgtttatcttggctaccagatatatatcagagcagatgtcaggccggacattggacagctgcagctcgtgtttatcttcttcatcttctaggttgcactctttttgctaacaagagtgcaacccatgttcatgttgtcttcttagacgctctggatgacctgagttag

SEQ ID NO: 80034 - DNA, 258 bp, Glycine max
  Peptide Sequence Number=SeqID_171719
atgttggctactggtaatcgattactgccttctgatactcaattaccagaaagattttacaaggatagtggaaatctcaagcgagttgcttggggactggacgtaggcatgggttgtggccaaaccagcctaggatcttcttcatcaatgcattcatttgcttctcggaagatgaatggcagtggaatagagaaggaagagagagaggagatgccacttcaaggagaagatgagtctagaagaagctcaccaccatag

SEQ ID NO: 80035 - DNA, 129 bp, Glycine max
  Peptide Sequence Number=SeqID_171720
atggggttgaatcaatttagatttttcaacatggttcatgacattttggtcaaggtgaaactggaagtttatgatcccaacatggttggctcatggtaccgaatatatgcaactaagaatgcatcgtga

SEQ ID NO: 80036 - DNA, 465 bp, Glycine max
  Peptide Sequence Number=SeqID_171721
atggcctctggtaatcgattaccaaggatcacgatggtagtgcagttaatccatgatcgcgtggtgatggagtgcctagaaggagtttgggagaccctcgaaggcaatgagaggtgccgatttcgtggcacgattcgactcactgctacttcattagtacatccagaggaacccgcacgcacgcttcagcagcttgtggagtggatactacctacacctactccatatcgactagtggagccagttcaagtaatagaggtgtcatcctctaaagtggatcctgaagaggacccagaggagttacctcctgaacctgctatggatgaccttgacttacctgaggatgatgaagacccactccctgatgtggattctccagaggatatcatgtcagcatctgaggcagactctacagaggagagcggccctggagggacagcgaattgtgaagactcttcatcatag

SEQ ID NO: 80037 - DNA, 1016 bp, Glycine max
  Peptide Sequence Number=SeqID_171722
gatgttctggtcactgctattggacgtccagagcaccctggacttgtccgtgctgctggagccggtgtcaccatcaagcaatactttggatcgactccacggacgtcccgtaacgcttcctccctgcctcctgacgaattacaacagctgacccaacagatcagggaccaactagaggagtccatcacagagaaagtgacgaggcagggacttgcagtgcctcctgagcctctggttggtcctggtccctccggtcctcgagtaagcacaaaggggagttgtgttgatccctcaggaaacgatcctgagacgggtgactctgacaggtgcggcttgtacaaagaagcagatcctgcccgcctggttgccatggggagagtttatgagggatccactgttgttcataacactcctttgttgcctggccaagtaaaggtgagtgtggaagaggttgcagatgcagatgctccagttcctgtacccactgatgaggtagctgtgtctccgccaaaaccacctccgaagcccgatccggaggtcaatgatccgctttatctgatgacattgaccatcccagagcttttcttgaggccttatcaggttagatgggatgccaccgtgttcggggtcgttaatccagatttccccctgtacataaagcacaaagacctctccgaaatcgcacacagtggtcaatgtctcagcatatcagtgttacagttgtggattctacatctcactgaaacatgtatgcgagtggggaattctgatatctatggattcctcgagccacagtccattcagaggtctgggcaatcgcagtttgaatctgaaagttacataaagagttggatgcagagttcacaacacgatgtctatcttggagcctacctaaatgggttccactgcagcggacactggcagatggtggtcatcctgcccaaggaacacctagttgtctggttttgttcattgcataataggccagacaactaccttaaggggattattaatag

SEQ ID NO: 80038 - DNA, 459 bp, Glycine max
  Peptide Sequence Number=SeqID_171723
gaacatgagatggaactccaacgtcttaatcaaaatgaagaaaccgacaaaaagaagagaagtatagcccttaaagcctcatcatcaatgcaagaagcaaatgaagaagaagactcagatgatgaagaagacttctcactctttgtcaagaagtttcagaaatttgtcaagagaacaagaatagaaaggcgtcagaactttaacaatggaaaaagatcacaagaagactctcaagttcttagatgttacaaatgcaatcaacttggtctcatcaaagctaattttccttcaaatgaagaatggcctgagaaaagtgataaggaaaggtataatgaaagaagaaccaagaaggcctacattgcatgggacgacaatgattcatccgatgattcagaaaaggagatcaatcttctaaccaaggattatgagagtgatgaaaacatctctcaagaaggttaa

SEQ ID NO: 80039 - DNA, 405 bp, Glycine max
  Peptide Sequence Number=SeqID_171724
atgctccattggccatatccacacctagtcaccctcttccttcaacacttcaacatccctcttgattctgaaccctatgttccaatcaagagatcctttctaataggcgcttttgtcattgcatcttttggttatcaaaaagagcatgatggctcttgggtgaaaaagggtgctcgacatgttggtgaagaaggacatgatggagaagattcatctcttctttcaaagattttggatatgtttgatggtcttcaaacctttgttggtgaaaggtttgatactctggaattacaagtggacatgcacttcaacgagatggagtcaagaatcaccaaggtcgaagaagatgtctcttatattcgttcaagctttgatcttccaccaccgccaccaccatcgtcttag

SEQ ID NO: 80040 - DNA, 612 bp, Glycine max
  Peptide Sequence Number=SeqID_171725
atgactgaagcacgtcaaaagggggtacagaaattgaagaccgaagaaaacgaagaacgaacgatggatgtcgaagaacggttgaaaaccttcgtcaaaataggggaggagcttgccacccagctcgcccaggcgagcatggttgcttcctccagaagtaacagccttttggaggaagaatctggaaggcccaattttcgaagaagttacggaaactcacggattgcacaacaacacctccttttggtttccgccgcattacggaatttcacggatcgcataaccctgcttccttttaaaatgacttccggcgcgtctcgagacttacatattgtgcaacaaagggtgccaagtatcttgaaacgaccaatcaaaggttgcatgtcatcaagtaataatccccggatgaaattaggctattctttagaaatccccaacaagggtgtgtggaagcaaagcttacaagcttattttgatgatgccaaagactcaagtcaagaatcaagattcaagcaagtttcaagaaccaaaaagtcattcaatcaagattcaagtgaagattcaagagaagactcaagatatgcaagaacctcaagaaaagcatcaagataa

SEQ ID NO: 80041 - DNA, 81 bp, Glycine max
  Peptide Sequence Number=SeqID_171726
atgatgttgggatttggtgtgtcgattgtaggaggagttgaaggatttgggaaaagtgatggtgtggatggggtaaattga

SEQ ID NO: 80042 - DNA, 643 bp, Glycine max
  Peptide Sequence Number=SeqID_171727
atgggtgatcaagaggagacacaggaacagatgaaagccgacatgtcggctctgaaagaacaaatggcttccatgatggaagccatgttagggatgaggcagctcatggaaaagaatgtggccaccgctgccgctgtcagttcggctgccgaagcagacccaactctcttggcaactgcgcaccatcctccctcaaacatagtaggacggggaagggacacactggggcacgatggcagccctcacctgggatacaaccgagcggcttacccttatggattaccgcccaactactcaccacccgtcttgcaagacgatgcgggccatattgcttctcccgtccttgaaagagagcctcctcaacagcccgaagaagtccacaaagaccctcaagactatgctcgaagggaggtcgagctctatcccccgatccctgaaggaccggcacccagcacgttgcctcagcccaacatcgccacacaaccaatagtttcatccacggaaggaccgtccccggcaactgaagaaaggaggaagctcgatctccttgaggaaagattgagggccgtggaaggatttggggactatccgttcgcagacatgacggatctttgcttagtacccgatgttgttatcccccgaa

SEQ ID NO: 80043 - DNA, 522 bp, Glycine max
  Peptide Sequence Number=SeqID_171728
atggataacaaagagggagtgcaagaacagatgaaggccgacctattagccttaaaagatcaaatggcttctatcacggaggccatgctaaagcttcaaaaaactatagaagataatgctacggcggccgcttccaatacagctagggaagcggaactggtgctacagcccgcaataaacttgggccgagacaaaaacgcgacgggttttaatcggaggtatagtcctcaagcctacccttatggtttgcctccagacttcactccccgtaccgctccagatgatttgagccaagcccctaccttcgaggggcagctccctcctcatgccgactatcctctgcaagaagatgatgaaggagatgcccatttaggccctctacttcccctcaaggaaccatccccccatgagttgccccaaccaaacatagtctaccacttcccgttccatccgcacccgttaaggaactcgttccctttgcaaaagacaagggaaagtttgatctacttgaagagaggatga

SEQ ID NO: 80044 - DNA, 156 bp, Glycine max
  Peptide Sequence Number=SeqID_171729
atggcaaaaatcaaccaagggacggatgcaagtggggctagggtcacgaccgaccgatcattgccccttcccggcgctaaacaagtagagaacgtcgctgcaaggcagcccagtatcctttgtgttcgcagtttcttttactattgtttgttttaa

SEQ ID NO: 80045 - DNA, 246 bp, Glycine max
  Peptide Sequence Number=SeqID_171730
atgccgaaaaaccaaaaaaatgttgatgcacaatccgtaagtttccgtgacacaccggaaatcaaatggaagcatcgttgcataattaagcgaggttccgtaacattcccacccaggcccgtttgggccctccagaagattcctccagaaggcggttgcttctggaggaagcaaccctgctcgcctgggcgagctgagctcgcctgggcgagctgggcggcaaccacctcccctattttgctataa

SEQ ID NO: 80046 - DNA, 486 bp, Glycine max
  Peptide Sequence Number=SeqID_171731
atggatgctcatccgtgtcaggatggcgtacaccagctggcacttaggcatggggaggtcggaattatgatcggtgggcaggatgttgctgaggagcaacgtcatccatatctgggtcagggtggtcatattggtgcgcatgattcgcactcgctccctgcagcagtccgggcaaaatcctgccccggtatacatagcagctgggcgatggcctcctcatcgaacccatcagaccgcgtcggcatcgaacgggatccactgacccctaacccaggatctcatgtcacgcacgccctcctctgttggccaagcattggcataaaactcaaggactatttctggatcaaacttggccatcggagtaaccagtggtgcccaccgccggcgccctatttcctcctggaaatcagtatactcgtcgtccctgagctggacgcgtcgctcccggagaaacgaccatcccttgatggtttcgaagcgctgctg

SEQ ID NO: 80047 - DNA, 599 bp, Glycine max
  Peptide Sequence Number=SeqID_171732
atgaactcgctatgcgcacctaccgtgctaagcgagttcatcttgtgaggatgaacactcatcctcctgttgagatacatatgtcatcaagaaaaagggctagagcaaaagacatcccttcatcatccactccagctcctccgtcagcaaccataggaccggatgcccaaagctctcaaaccttagtccctatgctacaaagcttattccgaggacagtttattatcatgcacagcctgcgacaattggctcaccacaggccaattataactatggagcatttccttgagcgagtagcctggcctgaagctcaacctccattggtgagacccaacgaggctactccacctgagcccacacctgcacgggttgaaccagtgccaactgatccacaatctccagtggtgaatccaccttcttctcctaagcttgaagtagttcccccatctccacctttgattatcatctccgattccccatctggagaagctgctgctccccctgaatccccatctggagaagctgctaatcttttttattccttatctggagaagctgttgctctctttgattcccctatttttccatctgatagatga

SEQ ID NO: 80048 - DNA, 198 bp, Glycine max
  Peptide Sequence Number=SeqID_171733
atggcctgcttggaccaacaacattttggaaaggagggacaggctgttgttgttatggagggcttgcccatctcagatttggatgattcttccaacctggattgtatctattgcttgaaagatcataattattctgttgttgttggttttgctactgaggaggtgcagatgcagatttctgattcatggcaagcttag

SEQ ID NO: 80049 - DNA, 210 bp, Glycine max
  Peptide Sequence Number=SeqID_171734
atggattataaacaagacaacaatgaggttctccctcaaatacctatacaacaacctcaaaaagtgtcattaaggagatctattagagagaagagaagttcaatcccagatgattatattatctttttccaagaacatgaggatgacattggtttaacggaggatgatctaatcaacttctgtcaagctatgcatagttctaactcttaa

SEQ ID NO: 80050 - DNA, 1002 bp, Glycine max
  Peptide Sequence Number=SeqID_171735
atggcggtgattgaattcacgccggacggtcacatcattaccgccaacgccaacttcctcactcacatgggctataccctgccagccatcgccggccagcatcatcgcctgttctgcttcgacaatttttaccgcgagaatccggacttctggcgcaaaatcggcaacggtcagcattttgtcggtcgctttgagcgtaagaccgccagcggcgagcgcatctggctggaggcgagctacaacccggtgtttgacggcgacggtaaggtctacaaagtgattaagatcgcctcggatatcaccgcgcgcgttgaagcggcgaagcgcgtggcggatatcgcactgaccacctctgagcagacctcacaaattaccgataacgccaatgaagtgctggatgaaacggtgcgtaactccggactggtggcgcagcaggtgaatgccgccgccgaaattggcgcgcagctcaccgcctcggccaggagcatcagcgacgtggtggaaaccatcaacctgattgcctcgcagaccaacattctggcactgaatgccgccatcgaatccgcgcgtgccggcgaggccggacgtggcttcagcgtggtggcaggtgaagtacgccgcctggcggcctcgaccgccagcgccaccaaacagatttccgtggtcgtggaacaaaatgccgacctgatccagcagatgtatcagcagctggatgaggtcaggcaatttgtggtgaccgaacaggagaagatcagcgtgctgtcgcgcagcctgcgggaaatcaacagtggcgtacacgacgtacgcgggagcgctggctcccgcgcgattacagcccgctgcccgcctgcggcgcgggctgccgcttccacttcagcgcattacgcagcgccgatacagggcgtaactgacaaatccgatggcggtgaaaaagcgcagggaaagccagcgctcaatctgtctggaataaaagctggcgataaaaaacagcatcaccagtag

SEQ ID NO: 80051 - DNA, 327 bp, Glycine max
  Peptide Sequence Number=SeqID_171736
atgggggtacaaatagtaattttcgaatctggccctactagaggtttctgggcaatttcttgcttaaggtggaagcaacccagctcgcctgggcgagctagctggattgcttctgaaggaagcaacccagctcgtctgggcgggctgggcggcaacctcctccctctttttcctaaaaataggctgaagggggctgttctaaggatcccggatgcccctggtgaggtttttcctccgttattcaccgttcttcatccgttcttcgttcttcaacggaatccgttaatttctgttaaaatgaattccgaccgttcggtcgtgccgtaa

SEQ ID NO: 80052 - DNA, 732 bp, Glycine max
  Peptide Sequence Number=SeqID_171737
atggatagggattcagtgatacacactgtggcttatgcagatgatgttgtaagggtaagtgtggatacagttatcgatcctgacgctaagatcccctatgccacctcagaaattaagtatgtgaagcaggcccttcatacatttgtagcttggcccacagaccttgttaaacttgtattcgatgagacattcatacattacacatcaaacactgacccacattcatttgccatgttggatgaagaaattattctgcacaaagtggatgcacatggagataagccagctaatgtggacacagatgatccaatgtgtgggctgataaagtacagctttgatatttacgacaagccagtggaatgcaaatttgatgggaccaaatttggaatcgcagatgcacctccatcgatattcctaacatattctgatgttagtgaaataatagcaggagacaaaagtttgaacatatctgtacaacaattatggttgatgtatatgcatgagtggactgaaaccttggagcaaggttcccactatgcattccttgagccacagtcattggtggtatcaaaggagacacgtggcgaatgcgaaggatatcttgaaagatggctgaaggaatctgatcgagaggtgtacgttggaccttacttccatcatgtaatgaccaaattaaaaatgagtttgtctcctgaaagtaaggcagctgcacctaagtggattgaagttaag

SEQ ID NO: 80053 - DNA, 621 bp, Glycine max
  Peptide Sequence Number=SeqID_171738
atggcctctaggaaatgtaagagcatgggggcaaggccaactgctcagtatgatactagacggttccattcgcttgatgcttggaaccgttatacagataatgtcttggggaggagtattttgccagagaggaaggttgatatataccacacagagttcgatgacttcaagacagagttggagaggcgtaatcttcacaaacgcctcaccaacttggctgatgggactatttatcttgctttggcgaaggaattttatgctaacctctacaactctaaagacccttcaccaaagcaagccagagttagaggccacttggtgaaaatagacattgacagcctcaacacatttctagagactcttgtagtcctagaggagggggagacattacctacctactccaggtattgcaggttgcccttagactacagagagattgaggctgctctttgcataccagttgctttccggggggctaggagggcgagggcgaggccagctgatattccatcttcttctgcagctccagcacctactccaacatctacttctgcagctccttcagttccagctcatgttgactcgcagcgctttgaagctatgcctcaaagtatccattag

SEQ ID NO: 80054 - DNA, 531 bp, Glycine max
  Peptide Sequence Number=SeqID_171739
atggggacaaatccaaacgaaaaaaggttttatcaagtcaaggttaaaggtctagatgtcactagcctcaaggaattgggacgattgatgggacccctccaaaggcaagccttccgcaaagtctatgggaagattctagatttgaccgcagcggaggtatttacggaatctgtcgtatccctcgcccaatactatgaccagtcgttgaggtgtttcatgttaggggacttccaaatggtaccaactattgaagagtttaaggagatattaggatgccctcttggggggagaaaaccgtatcttttctccggctttcttccttccttgagcaagattgcagctgcgattggagattcagcaaaagagttggatcgcatgaaacaaactcgcaatagcgtagtgggcctgccacggaaatacttggaaggcaaggcaagggatatggcaagccaagagaggtggggcccgtttgcagatattttagctttgctgatttttggggttgtcctctttccgaatgttgacagtttg

SEQ ID NO: 80055 - DNA, 309 bp, Glycine max
  Peptide Sequence Number=SeqID_171740
atgaacacagcaagggaaagttttagcagtggggctgaacttagaactgcggtccaggcagaagtagctaatccaaaaagtcctcaaagggggacaacaaacaaaaccacacaattggataactctgccaccactgatcatctgagcaaagacacaagcaacaataaaggtcatggcaatgccaatcatgccacagaatccacacaaaaaattgtgtgtgtgagagagaagcagggaaatcttgttgaggcatgttggcttaataccagggttgctgttttaatggtggtgcaggtaggagaattatag

SEQ ID NO: 80056 - DNA, 1404 bp, Glycine max
  Peptide Sequence Number=SeqID_171741
atggctttgctcaagataaagtgcaaaatggacgttgctttcaaagacgcaaaccctaaagcctttctctgggaacaagtatcaaggagtgtgaagaagtgcaaggagaaatttgagaacatttacaagtaccataggagaacccaagaaggtagtaaactcagctgctttctggaatgggttgcgggtgtagaagctgaagaaattgtgagaggtgagaacaaggaggattacaacaagttctatgaggctttctctaagaacttgaagcttggtatccatgaggattcatataacaagggaaagattgttgaattgctcaagtactactccaccaagagtggtgataagatgaggaaggtcagagtgaaatctactacatcacaggaggttctttatatggttgatgccattgatgaatatgttgttgatcagctcaaggaatttgagagcaagaagtttgtctctgccaccaaggaagggctcaagcttgacaagaatgaagatgagaagaagaagcaagaagagttgaaggagaagtttgacaacccctgcaaagtgatcaaggatgacaaatctatgaaggatcttattctgtttctgtttgagactgctcttctcacttctagtttcagccgtgaagttgttgctgacatgcccccactagaggaggccgaagccgatgctgagggcagcaagatggagaaggagatcgcaggcttcggtccatgtgatgaattccactaccacaccacatcaatggatttcttggctaaagagctcttaaagaagtttgagagaagagacaaggcactggaaatggcagcattctccccaggagtcacaaagcatgaaaataaggagtataaggtgattgcgaaagaagcaagtaaaataggaagagaaatgtgtaataagataggaattgcgttcaccaattttgttcctaagggcacttacgatgtcattatactggatgtttttcaaccaatgggatctattgcggaagttcttgctgataactgcttcttagaactcagtagcaaaggctcttcgactcgatggagtcactgtaaaagacgacttaagatatttgttactggagtacccaaaactatagacaatgatattcttttgattgacaaaacttttggctttgatactgcggttgaggaagcacaaagagccataaattctgcataccttgaggcacatagtgcatatcatggtgaccgtggattcatagcaatgcatgcttccttagctagtgggcagattgacatatgtctgactccaaaggctcctttcaatttacatggaccttgtggagttttgagttatctcaagtaccttatagaaacaaaaggatcagttgtagtttatgtggcaaagagagctagacag

SEQ ID NO: 80057 - DNA, 387 bp, Glycine max
  Peptide Sequence Number=SeqID_171742
atgttcagatcgaaggtgtgggaggtagcagcgagggtagctgcggaggaattaggagaaggcagggtaccgttatccctcctgaagaaccacaggcgtctccaggaaggtgttcaatgtctaagtacgaaacttgatgaccttccctcggaccttgcattgtttacgcgagtcgtcctcaagatcatatatgttgtagtagaactccctcaacaaagctacatgaatatttttgtctggaagcctggtgagctttttgtcccaacgtctcagctcgagctcctccaggaactcatcatagtttatgtaggccagctgggtgttcctcttcagaaagatgttccatatacgaatgttctcttgatatatgtgccaagccacttctga

SEQ ID NO: 80058 - DNA, 468 bp, Glycine max
  Peptide Sequence Number=SeqID_171743
atggtgcaactaaagctcatagccttaaccttgtcggtgttgtggtcatggtggagttttgagggtgcagttggagaccctcaactctttctactcaaatgggagtgcggcgtagtctcggttcatgacttgtccaacttcaaccaaaatcgtaacgcaagtttggcagacctgagattgcagctagtgagcaaccaaagcaagcactttgtcacggctcaatcaaccactggagcagaccctgtctatgctatgttccaatgccggaactacctctccaacactgactgcaccgcctgcttagctgccgccaccaccaatatccgcaactgctccacgggaaatactgcccgtatcgtttatgacggctgtatccttaggtacacatccaaaaaactcttatattgtgtgcaattgtgggaaaatacgactgaacggaccgcaattgcagttgtgatgcgattgtag

SEQ ID NO: 80059 - DNA, 582 bp, Glycine max
  Peptide Sequence Number=SeqID_171744
atggttgctcacatcccagatccaagggttgatccttctcaatatcgtgatttagtatattattggtgctctgagaaaggacagaaaataaacaacatcaacaaaaggagccgcttaaaatatgaagacttgcattgcatgggaaccaataatcttccaagacggattcatgagatgacaacaaaggctaagggagtgcaaccttctagggcaaaaatttatattgacagtcgaactcgaaaagatggaagcattgttactgaaaaggctgctattataattgatgaactaaaaaagaaaatggttgaagcagagagttcgcaaaatttacaaagcacccaagattctactaattggacaaatgatatatattcaaaagtcaaaggacctaaaaaaagaggacgtgtgcattgtcttggcaagcttccacatcaagcaagttcatctcaaagctcttatgcaaacaataaaattcaaaagttggagaatttgcttggaaaccttgtagctgtgcttaaagtacgatttgcagaagatccacaaattaatcaagtcttagaagctatagatcaagaggtatga

SEQ ID NO: 80060 - DNA, 348 bp, Glycine max
  Peptide Sequence Number=SeqID_171745
atggccattattgtcaatgcggaagcttgtggttatgtgagcatgaactactaccaatatatagatgttgtttacaccaatgaacacatcttaaaagcatactccgcacagtggtggcctcttgggaatgaagcggcaattcctccttctgatgaggcatggacactaatccctgacccaactacaattcgtgcgaaaggtcggccaaaatcaacaaggataaggaatgagatggattgggtcgaaccatctgaccaccgacaaaaatgtagtagatgtggagctgaagggcacaataggcgtcgatgtccaatgcaatatgaccgtgggagtaattcatttaattga

SEQ ID NO: 80061 - DNA, 201 bp, Glycine max
  Peptide Sequence Number=SeqID_171746
atggcagctcaccaaggcgagctgatgcttcatcctgaagtaacgagctcgcctaggagagctggttccttcagccctaggcaatttggaggcccaggcaagtcaaaggctagcctgggtgagctggggtccagaaaaatccctgaaaagactcttttgcccctccccttttgttggatcaagtggcctcagaataattaa

SEQ ID NO: 80062 - DNA, 396 bp, Glycine max
  Peptide Sequence Number=SeqID_171747
atgcaattcaagttcgtagccttaacctttttggtgttttggtcacgctggagctttgagggtgcagtaggagaccctcaactctttttactagtatcagagtgcagtggattcggggtacccaacttgtccaacttctaccaaaatctaaacgcaagttttgcagacctgagagcacaggtgagcaacaatagcaagcactttgccacggctcaatcagtcaccggaacaagccccgtctatgctatgtttcaatgcgtcaactacctctccatcactgattgcgccacctgcttagctgccgccgccgccgaaatccgcaactgctatactggaaccaacaacggtgcccgtgtcgtttatgacggctgcttcctcagaaaagtgatattctaa

SEQ ID NO: 80063 - DNA, 294 bp, Glycine max
  Peptide Sequence Number=SeqID_171748
atgatggtgtcactaacgtttttcctcaagtctgaactttgctggcggtgcatgtatgattttaaggccacaggactacctgatacaacagagttctattgttcaccaatgttgtggcactgttatttattaggaaaagatgttggatttaatagatgtaatatatccagacttataaagacactaattgggtctggtggaacagtatccacctttttgggatctatcaaaggcacaacactgatttgcttagatacactttgcctaactgaaggcttcgtttgtgaaaattga

SEQ ID NO: 80064 - DNA, 476 bp, Glycine max
  Peptide Sequence Number=SeqID_171749
ccttcagcaaggcatatgggaagatctgggatttggcaatgattgaagtgttcgcagaagccatcacatccctcactcaatactacgaccaatcactcagatgctttacttttggggactttcagttggcaccaaccatagaagagtttgaggagatcttaggatgcccattaggggggaaggaagacatacctctttggataccatggaagcgcttggaggagaaggtagaagctttggcaaatcaaggggagtggacctcattcattaacatgttagcactattggtgtttgggactatactatttccgaatgtggacgggctagtggatctagcagcgatggacgcctttcttgcttatcaccacgacaaggaaagcctcgtcatcgctgttttggcagatgcatatgatacattcgacttgaggtgcaagaagagcagtgcgagaattgtctgttgtactcctgctctttat

SEQ ID NO: 80065 - DNA, 306 bp, Glycine max
  Peptide Sequence Number=SeqID_171750
atggccattattgtcaatgcggaagcttgtggttacgtaagcatgaactactaccaatatatagatgttgtttacacaaatgagcacatcttaaaagcatactccgcacagtggtggcctcttgggaatgaagcggcaattcctccttctgatgatgcatggacacttatccctgacccaactacaatttgtgcgaaaggtaggccaaaatcaacaaggaaaaggaatgagatggattggctcgaaccatctgacaaccgacaaaaatgtagtagatgtggagcagaagggcacaataggcgctga

SEQ ID NO: 80066 - DNA, 423 bp, Glycine max
  Peptide Sequence Number=SeqID_171751
atggtgcaactcaagctcgtggcattaactttgttggtgttgtggtcatggtggaactttgagggtgcagttggagaccctcaaacccttatactcaaatttgagtgcagtgtagtctcggtacacgactcggccaacttcttccaaaatctaaacgctagtttggcaaacctgaaatcgcagctggtgagcaaccaaagcaagcactttgtcacggctcaatcaaccaccggaacggatcctgtctatgcaatgttccaatgcaggaactacctctccaacactgactgcgtcacctgtttcgctgtggccgcagccacagtccgcaactgctccaccatgaatactgcccgtgccatttatgatggctgcatcctcagaaaaaagagagaattttacgcgacacttagagggctaagatga

SEQ ID NO: 80067 - DNA, 677 bp, Glycine max
  Peptide Sequence Number=SeqID_171752
gtcactgctcgtgcgtcgagaaaggaaaggcgaattgggaccagctcttggctagcatggagggagcatccgttaactggttccctcgctggaaggaaggaagaaacgtgattctttccttgtgcgaaggatttccaaatgttcccttgataggaacaaggggttgtattaattataatcccatcctcgccataagacagcttggctaccccatgagaggagcgccatcagaggaaagcatcacgcctttcatcgcacggggtttcagtgaccccaacgtgagggtacttcaaggagttcgcaaggcatgggatgtggtgcgaaggaaggacaaaaaggttaggggaagtagtaatgggaccatcggtggctatcaaaaatggctgagagtccggacacaaggattggattggctcccaaagctaagggttgcgagagatgaagaggctgaagctccagaagaaagtgatgaggtcgaaggcatgatcttgaaagatgagttaaaggcttgccttaggtcgaaaagaaatttgtctcaacagttaagcaagactgaagggaatatgtgggccgccatcgatgagtgcaaaaagaagctaaacctagcgacgactcacgagcaaaggctagaggatgagtacaccaagatatcagtggaaagggaagcaagggaaagg

SEQ ID NO: 80068 - DNA, 231 bp, Glycine max
  Peptide Sequence Number=SeqID_171753
atgggtgctatgtggatgatttttttaaaatcatgtatgtcttacgcactttggctttttgttgatgccaaagggggagagaaaatagggattaaatcaagaactcatataattaagtttgtcatcatcaaaaaaggggagattgtagaagcaagcttcatgatgatgaatcaagttgattcaagtagttttgatgatgacaaagatgatgacaaaaagcccaaagaatga

SEQ ID NO: 80069 - DNA, 264 bp, Glycine max
  Peptide Sequence Number=SeqID_171754
atgaggactcttttgataggtcaaggtgtcggtctcgggctgatcttccaaattattccacaaggcacgcacgaaaatgatgatttggaaacaacgtgcaaaattagtcatggccacagccaggtgggcactcaagcatcccatttacggcattgtgatactacggtcaggaatttacacaaacagacccaacgtttcccaattatgttctttcatcagttcaatgaattcatccattcttatctcggttattcaggaaaataa

SEQ ID NO: 80070 - DNA, 288 bp, Glycine max
  Peptide Sequence Number=SeqID_171755
atggtacacgcaagttgtgtcaaggtcataccactttgggaaaggatgttgttagatcttcccgggagttattacagccatttggttggcgatgagggagggcaagaggtcttcgtacgtcattgggatcggggtgaattctggaattggcctcgggggaaagtttttcatcgcgttggaaccggcaccaaagtgggcattgccggctgggcgagtcgtggttggagccggagcttagggggcctccctctagatgggggcgggcgctctaggctattcgcgagttga

SEQ ID NO: 80071 - DNA, 1457 bp, Glycine max
  Peptide Sequence Number=SeqID_171756
tggccctctggccttccatcccctggttcggtaaagccgaaaaccgtatcgccgccattcaggagcggggggaactccgcgtcagtaccctcaactctccgctgatttacagcgacatcaacggcaaaatcattggtctggattacgaactggcgcaacagttcgccgattatcttggcgtgaagcttaaaatcaccgtccgtcagaatatcaaccagctgtttgatgacctcgacaacgacgatgccgacatcctcgccgccgggctggtgtataacagcgagcgcagcaagaactatcagccgggcccgacctactactccgtttcgcaacaacttgtctatcgtgtcgggagccagcgtccgcgctcgctggcgtcgattaacgatcgacagctgacaattgccccgggccatgtggtgattgacgatctgcgcgaactcaaggagaagaaatacccggacctgagctggacggtggaggcgaaactcggcacgacggagctgctggagcaggttaaagatcagaaagtgccgtacaccatcgccgattcggtcgcgatcagccttttccagcgcgtgcatcctgaaatcgccgtggcgctggacctcgacaacgaccagaccctctctgccgcgatgctcgatttcttcaacaccatcaatgaagacggtaccctggcgcgtctcgaagagaagtacctcggccatggtgatgactttgactacgttgacacccgcagtttcctgcgcgcggtagacagcgtcctgccggacctgcagccgctgttcgaaaaatacgcccaggaaattgactggaaactgctggcggctatttcgtatcaggaatcccactgggatacccaggccacgtctccgactggcgtacgtggtttgatgatgttaaccaaaaataccgcgctgagcctgggcgtgaatgaccgtaccgatgccgagcagagcatcagcggcggcgcgcgctacctgcaggatatgatggctaaagtaccggaaacggtgccggaagaagagcggatctggtttgcgctggcggcttacaatatgggttacgcgcatatgctggatgcacgcacgttgacggcgaaaaccaaaggtaaccccgacagctggtcagacgtaaaacagcgcctgccgctgctgagccagaagccctggtataacaagctgacatacggctacgcgcgcggccatgaagcgtacgcctacgtggaaaatatccgtaaatatcagattagcctggtcggatatctgctggagaaagagaaagaggcaacagaggcaaaacagctggcagaaagttacccggtcgtggcaccggacgagcttaatcgtccgagcgcttcaattctgccttttgttgctttttctgctgacggcgcattcgaaagaaatcgcttaatagcgccgaacacgctggtgcaagtaccccaccgatag

SEQ ID NO: 80072 - DNA, 474 bp, Glycine max
  Peptide Sequence Number=SeqID_171757
atggtgaaagttggaacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgataacgaacgaagaacggatgaagaacggtgaagaacgacgaagaacgatgaagaatttccacataatcgcttccgtaacgcttccgagatgtttccataagcaaaaccgtgaaggttttcctccgttattcaccgttcttcatccgttcttcgttcttcaacgg

SEQ ID NO: 80073 - DNA, 263 bp, Glycine max
  Peptide Sequence Number=SeqID_171758
gaacaacaagttgggtggtaaacacacagagacagattctacgccctttaccattcaggagcagcgagttgagtcgaacaacaagttgggtggtaaacgcgcagagatagattatgcgccctttatcattcaggagcagcgagtcgagtggctcgatcgtgtccaacaaaatgcagagacaactatggccattctgcgtcttgtatcaaccaagaggaacaaattcgacagttccgctggcagggaggttcactggccgaatg

SEQ ID NO: 80074 - DNA, 267 bp, Glycine max
  Peptide Sequence Number=SeqID_171759
gccccctttgagaaattggttgataaattcttctgtcctatgttactgtcgcaacctacccttttgcgggcgagtggggcgaggctcacgggtgcatcttccaaaggaggaaaatgcgcggagtcgccaccaacgtttatttgtagaaaacgttggaaaaaccgaaggaaaccggtcatgaagaatattccagattcaggagttgtatttacgtttgagaaatgtattagcacctctcacgtttgtctcaaaggacaacagccttaa

SEQ ID NO: 80075 - DNA, 138 bp, Glycine max
  Peptide Sequence Number=SeqID_171760
atgtgggggtcgagggagtggtttccgacagttttcaggcgggaggagaaagagaagagtgatttcacggtgacaaagagaatagggagggcaaggttaaattcaaagacttatacttacagttttttgtataggtaa

SEQ ID NO: 80076 - DNA, 165 bp, Glycine max
  Peptide Sequence Number=SeqID_171761
atcacgatggcagcgcagttgatccatgatcgcgttgtgatggagtacctagagggtgtttgggagaccctcgaaggcaatgagaggtgccgatttcgtggtacaattcaactcactgctacctcattagtacatccggagaaaccctggagggacaacgaatag

SEQ ID NO: 80077 - DNA, 495 bp, Glycine max
  misc_feature (486)..(486): n is a, c, g, or t
  Peptide Sequence Number=SeqID_171762
atggccgtcgagttcgattcctcctcccccaagttcgccgactacgcggagcccggtcgcctggtcagcacccagtggctcgccgaacgactcggggaaccaggactcgtcgtcgtggagtccgacgaggacgtgcttctgtacgagaccggccacatccccggcgccgtgaaggtggactggcacaccgagctcaacgatcccgtcgtccgcgactacgtcgacggggagggtttcgccgagctgctcagccgtaaggggatcgcccgtgacgacacggtcgtcatctacggagacaagaacaactggtgggccgcgtacgcactatgggtcttctccctgttcggccacgaggacgtgcggctgctcgacggcggccgcgaccgctcgatcgccgagggccgtgagctcacccgtgaggccaccgtccgtccggcgacggagtacccggtgatcgaccgtgacgattccgtcatccgtgcctancaggaggac

SEQ ID NO: 80078 - DNA, 354 bp, Glycine max
  Peptide Sequence Number=SeqID_171763
atggcagcgcgcgcccttggcgtgcctcggcacctgcgcgctcctggcgtcggcctgtgggctccccattcggcccgtcttgaaacacggaccaaggagtctgacatgtgtgcgagtcaacgggcgagtaaacccgtaaggcgcaaggaagctgattggtgggatccccctaactggcgatgcgggatgaaccggaagctgggttacggtgcccaactgcgcgctaacctagaccccacaaagggtgttggtcgattaagacagcaggacggtggtcatggaagtcgaaatccgctaagagtgtgtaacaactcacctgccgaatcaactagccccgaaaatggatggcgctaa

SEQ ID NO: 80079 - DNA, 567 bp, Glycine max
  Peptide Sequence Number=SeqID_171764
atggcatccaggaagaggaagagcactgcttctaggcccacaactcagtatgataccaggcaattccaatctttggaagcttggaatagatacactgacaacattcttggctggaatatcctttcgaagagaaatgtaaagctttatcatactgagttcaacgagttccaggtggagttggagaggcgtaatctacacaaatgcctcgccaacctccaggatggaagcatagacgtggctgtggttaaggaattctatgttgatttatacaccacagaggaccaagctccaaagttgaggactaaccaccaggagattgaagccatgctttgtattccccgcaaggggtttgttttgaatgctgagggccagccatggaaacttctcagaaaagatctggcgacattggcccagacatggagtgtcttttcttactccaacctagctcccacatcccacacctcagatttgaatatagatagagttaggttggtctatggcttcatgactaacacggacatgaacatcaggacctcaccacactctactcacgtgtttaactcttaa

SEQ ID NO: 80080 - DNA, 168 bp, Glycine max
  misc_feature (159)..(159): n is a, c, g, or t
  Peptide Sequence Number=SeqID_171765
atgtgcacgtatgcaatttttgatagccaaagtgctttgagtatgcatgtatgtaaatttagcaaaggaaatgcgtgtgatgtaggaatggccccgaggaagcttgcctcaaagaggtccaggaaggacaaggcggccgaaggaactagttccgctccnggagtatga

SEQ ID NO: 80081 - DNA, 331 bp, Glycine max
  Peptide Sequence Number=SeqID_171766
atggctaacgatggaaacaaatctgattccaatagctcttactctcttcaccattccaatcatcctggaatggtcccattagcacatgttcagccccttgtgaatggattgactgaattacaattacaacaaattttgtctattatgcaggcaatggagcatctcaatcagctgctcccaaggcaaataatgccaatttttcttcaggatttgatgacagggatgacgattggtttgggtgaacaacgagatggactctattacttggtttcaatgaataagacacacaaagtatataccatcaaagctgcctccacttcaaacacctcaa

SEQ ID NO: 80082 - DNA, 699 bp, Glycine max
  Peptide Sequence Number=SeqID_171767
atggacggtttggtggacctagtcgcgattgatgctttccttgcatatcaccatagcaaagagagcccggtggtagctatcttggcggatttatttgatacatttgaccgaaggtgcgagaagagtagcgcacagatcatctgctgcttacccgctctttgtgtatggttggtttcgcacctattccaacaagacataaggcacccatgtccgctccgaagccatcactcgtgtgtcgagaagagaagagtagattgggaccaatacttggctgggataggaggcagaacaatcaactggtttcctcgatggaaggaaggaaaagagggagttctcttctcatgtggggactacccaaacatcctgttgatagggacgatgggttgtattaactacaatcccgcacttgctataagacagttagggtaccctatgaggggagcactggcggaagagagcctctctcctttccttgtgagagatttcggcacgcaaagtttcaagattatacaaagagtccacaaggcatgggaaagcccgttaaggaaagataaagaacttaggggtatccgtaatggcatcatcggtggttatcatgaatggctgaaagttcatacacaagggttagattggctctccaaattgaaagttatcaacgaggagaactttgaagctctggaagaggatgaagaagtctga

SEQ ID NO: 80083 - DNA, 216 bp, Glycine max
  Peptide Sequence Number=SeqID_171768
atgcccttttggcgggcgagcgaggcgaggctcacgggtgcgctttccaaaggaggaaagatgcgcggagtcgccaccaacgtttatttgtggagaacatcggaaaaaccgaaggaaaccggtcaaaacgaaaattctaagttcgggagttgtcgacaaaagcggggcttttgctcctacgtaccctccatcgaagaggaaatcagacctacgtag

SEQ ID NO: 80084 - DNA, 363 bp, Glycine max
  Peptide Sequence Number=SeqID_171769
atgattatgaggggccaagacatttgtagtagccaagatgagactactacttcaccttcctctagtgaaagtgaagaagcaaaaggggaaaaatctagtgaagaaatctacccccaacaagaaggacaaccattaatggttaaggaggagtgtaaggaggtaagtgtctcctccaagagtgatcaaggggttcccatgaaccctaagagaataaaggtcatttttgagtggcctactccaccaagtataagaaaaatttggcgcttctatgacttaacaaacttttacaaaaggtttgtcccatatttttctatacttgtagcaccactcactgagttgctgaggaaccatgttccttcatag

SEQ ID NO: 80085 - DNA, 530 bp, Glycine max
  Peptide Sequence Number=SeqID_171770
cgtacatctacttgggttgtaatactgagaacaagagagggtacatctcttgtggatcagttcaagtggagcgtacatccacttggttgttcaaagagaacaaggaagggtacatcccttgtggatctttgcttgtaaaggattttacaaggttattggaaatctctagaaccggtggtgcttggggactggacgaaggcacgtgttgtggccgaaccatggtgagcaatgatggtagctcaggtgatgttgggacatggatacgagcccgaaatgggtttaggctgaaacggcaatggcgtggcaagtttggtaaaattcacagggaaccgcaagaaggggttcccttgtgtcacatcgacgagagctttgtcagcgtgaattggatgtgtgagggatggatcgccatgatacacgaagaaacccctcaaaagcaaccaaattgggtatggctatgtcctctggagtttgaattggggaactggaaaatcgtcaaacaacctggaatttccgtggcaaatgcaatgtaa

SEQ ID NO: 80086 - DNA, 371 bp, Glycine max
  Peptide Sequence Number=SeqID_171771
gacatgggtataagcctagaatgggtttaggatggaacaacgatggaatggccagcttgatagaattcaaggaaaaccgcgggaggtttggactaggctataggcccatgcgtgctgatgtgagaagaagcgccctagagaggagaagcaggggcatgggccaacagcaaaggccacaagtgaaagaggcccatccatgtcacatcagcaagagtttcatgagtgcatccgacgacgagtccggtgaaggtactaatacagaggaccctgacgtcgattttgaacgaatagcaagccaagccgaggatggagaagataacgatatggggttttccccagagctagaaaggatggtcgctcaggaagactga

SEQ ID NO: 80087 - DNA, 228 bp, Glycine max
  Peptide Sequence Number=SeqID_171772
atgaagtggggtgacatacagggttaccttatggttacccacaccgttcatcaaccatgggcaaacgagccaaatgatgcccagagactaacatcatcttctccaccttttgtcgtcctgacctgtgaagtcagctcacatgcggggttaccttatggggaaaacgagcccgttgacgcgcgaagactaacatcgtcttactgcaccttttgtcgtcctgacccgtga

SEQ ID NO: 80088 - DNA, 1515 bp, Glycine max
  Peptide Sequence Number=SeqID_171773
atgcccatatacagtcttcctgacaccatttcaatgattgcacaaactaaggtttcccttgaaaggattgcatcatttcttcgtctagatgagtggaagactgatgtagtagagaagcttccacagggtagttctgataaggcaattgaattagtagatggaaatttctcttggtatttatcttccccttatccaacattgaaaaacgtaaatctcacagtttttcatggtatgagggttgttgtatgtggtaatgttgggtcaggcaagtccagtttactttcttgtataataggggaagtaccaaagatatctgggaccctgaagatatgtggtacaaaggcttatgtttatgaatcaccatggatacagagtggcaagatagaagacaacatattatttggtaaagagatggatagggaaaagtatgatgaggtgctagaagcatgttccttgacaaaagaccttgaggttctaccatttggtgatcagaccactatcggagagaagcgaatcaatttgagtggtggacagaagcaaagagtgcaaatagcccgtgctctataccaagattctgatatatatctgtttgatgatcccttcagtgcattggatgctcatacaggatcccatctctttaaggagtgcttgcttgaccttttaaaatcaaaatttgtgatttatataactcatcaagtagagttcttatccgatgttgatctaatagtggtcatgagagaaggaagaataactcaatcaggaaaatacaatgacattctcaggtcaggcactgattttatggaacttgtaggtgcacacaaagcagctttgtctttaatcaagtccttggagagaaggccaacatttaaaacatcaactaccaccaaggaggacacaagttcagtaagttgttttgaacttgacaaaaatgtggtaagatcaaatgatacgtcagatgacatagttaaacccaaagggaaactagttcaagaagaagaatgggaaaagggtagagtagggtttaatgtctactggaaatacatcacaacagcttatggaggagctcttattgctagcaattattggatgattttggctactcttatgtctgcaactgcagaacctgatattggaagctttaaacttatggttgtctatgttgctttgtcaattggaagttccattttcacctttgccagagcatttcttgctgtgatagctggatacaagacagccattacttctgttcgacagggcttagtgatgatgggtcacaaacttctcgtcgtgggtgaagagtgggtgaagagtggaaagggatgctggatgaaatttgtgccaaaattggacgagagatcggaactgagtaatgaatctgatgataatgatcaccatcaaatccctcgaaaggagtatggaaaacctggatctggccaacgtgaagtggatgaggggtttcgtcacgtctacaccgctggcaatgactatggcacacctggccagggaggaaattaa

SEQ ID NO: 80089 - DNA, 207 bp, Glycine max
  Peptide Sequence Number=SeqID_171774
atgagcattaaggtgatgacggtctctgatgaggacatgaccaagagcaagggcaaggatccacttgaaggacttggaggacctatgacaagggctagagcaaggaaagccaaggaagctcttcaacaagtgttgtccatactatttgaatacaagcccaagtttcaaggagaaaagtccaaggttgtgagttgtatcatggcctaa

SEQ ID NO: 80090 - DNA, 4317 bp, Glycine max
  Peptide Sequence Number=SeqID_171775
atgacagacccagagatacctcaagggaacactgttgaaacagagaaaatacgaaaacagcagaggagcttacatcttttactgaagccagagatagcaaatctttgtgaaattctgcatctgcctgaaaatgtcaagagtatggttgaaaattgtcttgaatatactatgaacaattatcagatctgtacagaaccagtgtcaatattacaggcttttcaactatctctgtgttggactgctgctgctttgctaaatcacaaacttgactttgaagagtccctcatgcttgctaagcagaacttgaattttgactgcaagaaggaagtggtggatgaaattaattcaagactctgggatctgaaggaattttttttaaaactcacaggaaactctaatgttgccagctatccaaaagcttctgagtcatcaaatggggtttattcatttattgaagagacaccagaggttgaattagtaaaaaatgacaattctaaaaatattaaaaacgttcagaagagtaaaagccagtggaataagctacttctgacacaacaagaagagaagcaaaagttgaaaaaagatattgaaaatgaaaatggtgaattttggagaaggtaccgaatacacagggcagctattcaatcatgttctcccaatgatgtaaccaaagagcaaaagctcaaggttttcaacagtgaatacatgaaaataattagagaattggaaaggcagcatgagatatgtctcaaggatcttgaggacaagcaattaaaaacaaggctgacattccaagagatttcagcacctgatgaattgataaacccagttacttcaaacaaatctgggactaaggttgaccagacttgtgatcaagcccagcattctaatgctccgaaagaccttgtgtctgatcatgttgtcgaaggagagggtttcaatgatatagttgaaatcatgacaaggactggaactgggattggattatctgaagctcctgatgccaatgcctctgtagttgtaccatgcagtagcacagttgaactgcaaactcctctggtcaaacatgcttatgctaatgagatggacatagtggcttcaaaagatggaccagtatctggaaataagtgctataatgttgctgaaaatgaatatgatagtcaaggaaatattttctctaagcattacaattccagagaacaatgttctgatggagctattagctcgccagaggagggggagtttgtaaattatagttgtgaatctcatgatttttggaaggatgctataacacaagttctgccttcatctaatgaagagatatgtgatgggataacattagatattcaatgttctgatggagctattagctcgccagaggatggggagtttgtaaattatagttctgaatctcatgattttgggcaggatgctatgacacgggttctgctttcatctaatgaagagatgtgtgattggaaaacattagatgttcagcgttctgatggagctattagcttgccagaggagggggagtgtataaattatagttgtgaatctcatgattttgggcaggatgctatagcccaagttctgccttcatctaatgaagagatatgtgatgggaaaacattagatgttccctgtggagaggtgtctcctacagggtgtaacaccagcagttcaaatggtgatcatgttgaaattccttcttctaggcaaggggaacttgatgggactatactgagcaatcctgtttgtggttcatcaatagaagttggggctaatggttccaatgatggtgcaaagaatatggcacccttgaattctcaatcatctgaagaacatatcccatgtgtaaataccatatccacaccaaattgtgtgaatgctgcacaaatccatgaggctgatgacaataatggttcaaaaaatgctgaaactctgaactcatctttgtctgatgaaagaatttcctccttgaattcaaaatcacctcaagaccatgtccgtaatgaaaatgccatgtgcatgcaaaattgtgagaattttgcaccgagccttgaggatgatgacggtgatggttcaactattgtcattccaaatccacctttgattgatgagagaaatgctgataggaccatagtattaaatagagatgcacatgtgggaatgcttgagactgtcaatctcactccatccacagagcaaatatctggaggtgcagtagatgaagatggtctccccaaccacattcccaagtcatcagttttagatagtgtattgtccagaccacgcgaagctgatagtcctagtaatagctcggatgctgattgtattattctttcaaatcaaccttctttagagaaacaaaatcatgaagtcttatcaaacatacctgttggacaaattccagttgaagtgtcagacacttgtcatgagaggattactgtaaatgtattagatggggaggaagctgtgggaaggcctgccacagtcaattgtactgattatcctgagaatataattcctctgaattcttcatccatggatcaaatatctaatggaggtccattattagatggagatttatcatcagggccttgtgctactagcccaggcaatggtctgaccctacctgatgaacaaattcctgtcttagtgccagaaaatagcgataaagtggctcgatgtcaattaacagacagtgcagtggtgaagaaaaatgccatatctgaccagcaggaaggagtatgtagaaccatgacagaaaacagtttatcccaggagactccagtatcgagaacagttcatgatctcatggagcctctagaaccactgcaatcattatcatctgtagagtctccacctgacccggatactgctagagaaatgccgaacactttgatatctagtcctgttgattttgtaccagacaatcaatccattaatgattcactggtcatggagcctccagagcaggaggggcaattaccttctgccggtatcctttcttccaaccaggacctagctaacttgcctttggtgactcgaactgaagaccagccatccaatgaagatggtattcccaaccacattcccgagacatcaattgagattcaaaaccaagctgttgggcaatgtgcctcaaatgtggaacttgactcatgttctcgtcaagttgtacatccagcctcaaatatggaccttgattcacttcttcctggtggattcagacggcagtcttcagacacaagaaatttgtcaactctcacagagaataatagccatcctgtacaacctgctagccaatcagcttccaggattattcgacatttgtgccttgatccacttaccaatgaattagaaagactgcgtatactgacagaccaaaatatgaaagaatatgaaaacaagaaattgcagttgaaatgtgattttgagaaggaactcgaggaactttacaggaagtatgacattaaacgtaaggagattgaggttgaatttcagaatataaggaagaacctggatacacgaaataaaatagtttttgtaaataagatattggctgaggctttcagggctaaatccatggatcttaaagtatctggtgcatcaagaatgcagcaagatgcaagtgttccaatgcaattatttcagcttgcaagtcagcaaaatgccactcagccctgtctggttggtgcatcatcttgtgggcctcctgcagccagcgtgcagagttcctacgccacaactaccactcagactatggtatcaccaatacaggccacttacagtacaccaggaactttctccagtgtttctccaagactacctcatatcaactccctctcttcacccttgggaaatgttcaaactgctggggagatacgtgcccctgcaccacatctccagccttatagacccccaacatccatcccagcctccagtccatgtacagttccgcatgggaggccaggtcagcctacacccggtaatattccggtaacttctcccccattttctcaccggacaccccggccaatgccggcaaactttcagtctgttcctcatagggggcattggcccgtaagtacaggtgggttatccacacctaatttatctgctgccatgaattctcgtggtgatgctaatagtcaacctggtataaatctggcaaatgttcggccacatatgccagatttgcctacattgatgaacttgaacctatccaaatttggctgtaatagctcgccggctaactcagcacatcaagctacatcacctgatgtagtctgtttatcagatgatgaatga

SEQ ID NO: 80091 - DNA, 180 bp, Glycine max
  Peptide Sequence Number=SeqID_171776
atgaggaaaaacccttaccttacaacctatactagatccattgttgggctaccttcatttggcatgcttcaggcggagggaggtgagggtgggggtggggggttatggaaggaacagatggtggtggtcgagtttgcaaagggagtgaagggtggggttgggtggcatgacagagggtga

SEQ ID NO: 80092 - DNA, 171 bp, Glycine max
  Peptide Sequence Number=SeqID_171777
atggaaactgattggctatataagaaaaaacaatatctcttctcaacatcctcttggaaaaacaaaagaagtggttgttccagataccgaaggtgtcggtggcatcctggtctggaaggcagactccgtggatgctatttctttagtttctactttcaagaggtctcctaa

SEQ ID NO: 80093 - DNA, 1002 bp, Glycine max
  Peptide Sequence Number=SeqID_171778
atggtcaagttaggctacgcgcctactggcgctaagcctgtatacgagggtgtctcgcttagccagagtctctatttttctgtagtcgcgctaagcgcgccctgcccgctaagcgtatcatgttattttctaaagatggcctctaggaagagaaaatcaaccgcctctcgacctcaagaaccatatgacacgaccagattcatttcagaggtcgcctgggaaacatatgagcagaacgttcactcccagaacatccgtccggagaggaacgttaacctatatgtcacagagtacgatgagttatgccgggaactcgagaggaggcggtggcataaagccttgaccaggcagcctgatggtcgcattgatgtggccttggtcaaggagttttatgccaatttatatgattcagaggacaagtccccaagggcgaggttagtttacagactcgttcatctcaggccagatttctcagatggcccagtccaactcctcctagcttggcttcccgacccttatcactgctttatgcattgccaggggagttgttctagactcgttgaccttcgaaacccggatgatcccacgatcacattttcggggacccgcaagacccgggctaggggacctgacgcttctgctccacctgctccagctccaccagttcctctcccagcatcctctagcacctccgctcagagcatcgagatcttagtgccaatgctgcagagcctccaccatggcttatgcctggtgatgaagagtattcacgacttggctcaacatcagcccattatgagcatggagtatttcatgactcaggtgccctggccaggagtccagccttctcctgtggggggaggtgaggctcctacaacccaggagtcgcaaccagagccggaggcgacgcccgaggccacatcggaggagactccagaggtcatgcctgctgccacacccaccgaggacacaaattatgcagcagacatggcggcggcttag

SEQ ID NO: 80094 - DNA, 441 bp, Glycine max
  Peptide Sequence Number=SeqID_171779
atgactatcaccttggatgatgtggcgtcgttgctacatttgcctatcgtaagggcatttcatatcttcgagcaacttcatgtcaacgacgttgtcgatatgttggtggaattacttgagagtgtcacacacgtgcacgcaatattcttggatgcactacgtgacttgacacaaagtgggacttatgcttggggcgctgctgcacttatgcatatgtatgataatttaaatgagacgtcaaagagcacggtgaggcagcttgcaggatatattgctctgttacagtttatagcattcgggaatacatttttcacagcattcatcaaagacaaatctctgtcagtaacaataacgccagggaatgcatcaaattccatgaaaagaccccaaaatcaatgtagagcccaaacaacattattaagacgttctccttccaagtaa

SEQ ID NO: 80095 - DNA, 273 bp, Glycine max
  Peptide Sequence Number=SeqID_171780
atgacattctccgccacttttgcttacttggaaggagaaccggttcaaggtcttttcatgagagttgatgcactccccggggttattgtcaccgatagggatttatctttgatgaatgcagtgaaaaatgtattctcggatgctaagaacttgttgtgtcagttccacattgacaaaaatgtgaaggcaaagtgcaaaacccaggttgctcaaaagaatgcatgggattatatgatagagctcgagggagtttggttgactgtccatggttga

SEQ ID NO: 80096 - DNA, 542 bp, Glycine max
  Peptide Sequence Number=SeqID_171781
gtatgccgcctaccaggcacactctagacccagataagtctaacagggccctgcattttccggcattgatcacgggtctctgccagtcgttcggggttcctgtcacacctagcaaggtgattcgaccgtcgatcacccgggctttcatagaaaattattgcacgcctagaaatgtgcagggtggcgacccgcaggcccctgacgcaccgctgccacctcatcaggcttatccagctgggtcatttgacacagagcggtatttatggcatttggttcgccagcaggcagccaaccacagggcgcacatgcagacccatgactgtctctaccagctcagcctcagcttgcagagccagggttttgcttcttttccatgccctactccagatcagtttagggcagaggtcgcatggcccggagattggcctgaggcccaggcaagggaggcgcccgcagaggctcccggggatgcagatgaggcccgcatggacgaggagatgacagatctgctcgattttttaggaggtagcggaaccacatga

SEQ ID NO: 80097 - DNA, 228 bp, Glycine max
  Peptide Sequence Number=SeqID_171782
atggtgctggtagcggctattgcagctgcattgacctccattatctcctttatgctcatcatggcctccatcattgtggccatttgctctttcaaggcctctgtgtcggccttcatctgctcttgcacctcctctacttcacccattactctagccctaaaacgcatttggcttataatcctaacatggttggctcatgaggagaattcaaggatcatgcatgagtaa

SEQ ID NO: 80098 - DNA, 144 bp, Glycine max
  Peptide Sequence Number=SeqID_171783
atggaaaaatccgacaagaggaatttcaaagaaaagaaagcatacatcacttgggaagatagtaacatggattcttcaagtgattcagaaaatgaaatcataaatctaggtctcatggccaaagactatgaaagcagagaagtg

SEQ ID NO: 80099 - DNA, 192 bp, Glycine max
  Peptide Sequence Number=SeqID_171784
atggctaccccccataatgatgccaagactgtggtgaagtttttgaagaacattttctcaagatttggggtgcctaggattctgatttgcaatggaggcatacagaacaacattcaagactccaataggcttatctccatttcaaatggtgtatggcgagtcttgtcatctaccagtggaaatggaatataa

SEQ ID NO: 80100 - DNA, 99 bp, Glycine max
  Peptide Sequence Number=SeqID_171785
atggcgtgtagctctctaaaggcgaggacgtgtcgtcctctaaaggcgaggatgtgcagtcatctgaaggcaagggcgtgtagccctctgaaggtgaag

SEQ ID NO: 80101 - DNA, 1057 bp, Glycine max
  Peptide Sequence Number=SeqID_171786
atggcggcagcatgtaccagcgttccaagggcgatggcgaggccgccatccggcaggagctggccgattggcgcgaagggggccggtgtacgtgggcgacgtggtgtcggcgatgctgtcggcgttggccaacacgcatgcctgcggcaagacctacgagctgggcgggccgcaggtctacaccctgggcgagatcgcgcgcctgtgcgcgggctggagcggccatccgcgtccggtgatgagcgtgccgatgggcgtgggccggatgcaggcgttgctgttcgaatgcttgccggggcggccgctgatgtcgcgcgacaacctcgattccctgcgcagcgacaacatctgcggggcgccgatggcgcccgaactgaatgtggtgccgacgggcctggaggcggtggcgcccggctacctggcgccggcgcgctagtgcgcgagcctgcgtcgacgggggcagccctggggcgtatcgcgcctgttgccgcgaccagccctggtcgcaatgatctgcgggcggcgcggcccagggccgacagcgattccttctcggagtatcccagcgccagcaacgcgttcaggatgtcggactggttgtcgtgcaccgcgtgcgcgcgtgatggcctgcgccaggtcggccaccgacaggcccgacagcaccgacagggcggtgcgcgcgccgatgccgctgaccttgatcagttcgcggaaggcgctgcgttcgccggcggtggcgaaaccgtagaggatgtgggcgtcttcgcgcacggtcaggtgcgtgtacagcgtgacgcgggcgccggtttccggcagcgagtacagcgtgctcatgggcacgtcgatgtcatagcccagaccgttgacgtccacgcagacggtgggcggcagtttctcgatcagggttccggtgatgcgtccgatcatggtggcagtggcctggcagaagaagaggccgcgtcagtcgcggcgaatgcggggattctatacgggtccgcgcgccgcgtggcgcgggccgcggcgttttcagcccagcaggcggccgttgcggatgcgg

SEQ ID NO: 80102 - DNA, 369 bp, Glycine max
  Peptide Sequence Number=SeqID_171787
atgtcattgcctagcgctgttcatgtgtcatccaccttcgagtctggagccttgcgaatgtcattgcctagcgctgttcgccaattgtctattctccattgtttttcggagccccatgaatgtcattgcctagcggttttcatgtgtcatccaccttcgagtctggagccgcgaatgtcattgcctagcgctgttcgccaattctccattctccactttttttcggagccccatgaatgtcattgtctagcgctgttcatgcatcatccaccaacgagtctggagccccgtgaatgtcattgcctagtgctgttcgccaattctccattctccactgtttttcggagccccatgaatgtcattgcctag

SEQ ID NO: 80103 - DNA, 897 bp, Glycine max
  Peptide Sequence Number=SeqID_171788
atggccccgaggaagcttgcctcaaagaggtccaggaaggataaggcggccgaaggaactagttccgctcctgagtatgacagtcaccgttttaggagcgcggtacaccagcagcgcttcgaggccatcaagggatggtcgccggcggtggacatctctggttacccccatggccaatggatcccgtttgatgccgatgctatcggccagctcctaggatatccgttggtgttggaagaggccaggagtgcgagtatggccagaggaggaaccggattttgcccggactgctgccggaagacgggtgcggatcatgcgcaccaacatgaccaccctgactcaaatatggatgacttgctgctcagcaacatcctgcccaccgatcataattccgacctccccatgccgaagtgccagctggtgtacgccatcctgacacggatgagcatccatgtggctcagttgatcgctgatgccatctatatttttgcaggtatggcgcccactaggcaccctttggacccagataagtccaacagggccctgggattccccgcactgatcacaggactctgccagtcgttcggagtccccgttgcacctaccaaggtgattcggccgcccatcacccgggcttttatcgagaagtactgtacccagagacaggctcagggtgatgctccacaggccgcaggcgcgcccccaccacctcatcaggctggccaggctggggcatttgacatggagcagtatttacggcatttggttcgccagcaggcggccaaccaccgagcacatgtacggacccatgattgtctgtaccagatgagccttagcatgcagagccagggcttcgctcctttttcatgccctactccagaccagttcagggcagag

SEQ ID NO: 80104 - DNA, 224 bp, Glycine max
  Peptide Sequence Number=SeqID_171789
acttatcttccttcattggaagtggcgtctacccagacttatcttccttcactggaagtggcgtctacccagacttatcttcattcattggaagtggcgtctatcctgacttatcttccttcactggaagtggcgtcatccaaatctctgtaacctgtatcaaacgatccgctcctactcaggttcacatcaaaacgaaaaaacctagccgacctacattgtaa

SEQ ID NO: 80105 - DNA, 162 bp, Glycine max
  Peptide Sequence Number=SeqID_171790
atggcagatatcaagctcaaactgggtgcaagggataaatcatccaagcacaaggtcagctttttggctaaagtagctaccacaatcaaaacatggccttcatcatcctcaattcatgcatttagtccatacttcagagaatcatgcaaaaatcagtactaa

SEQ ID NO: 80106 - DNA, 267 bp, Glycine max
  Peptide Sequence Number=SeqID_171791
atgagaattcaagggactaaccgcctaagaattctttgtcctaacacattggagggtacatcctttgtggcacaagtagagggtacatctacttgggttgttatattaagaacaagagagggtacatctcttgtggagggtacatccacttggttgttcaaagagaataaaggagggtacatcccttgtggatctttggcttgtaaaggattttacaaggtcgaaagaaatctcaagaaccattggttgcttagggactggatgtag

SEQ ID NO: 80107 - DNA, 375 bp, Glycine max
  Peptide Sequence Number=SeqID_171792
atgatagcacgttgggtggtaaacgcgcagagacagattctgcgccctttatcattcaggaacaacaagttgggtgagatagattttgcaccctttatcattcaggaacaacaagctgagtgggtaaatgcgcagagacagattctacgccctttatcatttaggaacaacaagttgggtggtaaacgcgcagagacagattctgcaccctttatcattcaggaacaacaagctgagtgggaacaacaagctgagtgggtaaacgcgcagagacagattatgtgccctttatcattcacgagcagcgaggcgggtgataaacgcgccgagacaaattctacgccctttgccattcagatttcgcaagttgggtga

SEQ ID NO: 80108 - DNA, 222 bp, Glycine max
  Peptide Sequence Number=SeqID_171793
atgggctcaaaaatctaccctaatgttcatgagaaccctagggccttctttagtagctctagcctaagcctcttggagtcttctatccaatacccttgggggaaactcaatttttgtgacctaatgttgaatccaactcaatttcacgccaaagaagagaaggtaaaagttgttaatgactcgcttagcgaggcagattggctaagagatgcatccacttag

SEQ ID NO: 80109 - DNA, 207 bp, Glycine max
  Peptide Sequence Number=SeqID_171794
atgagtcatcattcatctagtgttaatggtgagggaaggcataagtcacatcctagacctcactcccataggagagaaaaggaaagaaaacctcaagaggccaacattaacgtcccatacttccatgggaaggacaatgtaggggcttacttagattgggaaattaaggttgagcaactcttttcttgccatcatacaagtgagtaa

SEQ ID NO: 80110 - DNA, 261 bp, Glycine max
  Peptide Sequence Number=SeqID_171795
atggcttattccctagtggatggcgccgcctcttatctcctctcctttgtcttcctgctgcatctccatggtggaaaatcaccattaaaggacctcattgaagctcaaagatccagcctccatagaagctccacaagcaagcttccatcaagtggtaatcaaagcacaagagcttcaaagtttccaccgattaaacttgctatagaagctagatttgattttctatggttcaaatttattgttcttgttcttgaaccatga

SEQ ID NO: 80111 - DNA, 348 bp, Glycine max
  Peptide Sequence Number=SeqID_171796
atggtcattattgtcaatgcggaagcttgtggttacgtgagcatgaactactaccaatatatagatgttttttacacaaatgagcgcatcttaaaagcttactctgcacaatggtggcctcttgggaatgaagcggatattccttcctctaatgacgcatggacacttatccctgacctaactacaattcgtgcgaaaggtcgaccaaaatcaacaaagataaggaatgagatggattgggtcgaaccatctgagcaccgacaacaatgtagtatatgtggagccaaagggcataacaggtgtcgctgttcaatgcaatatgagcgtgggagttgttcaaatcattga

SEQ ID NO: 80112 - DNA, 151 bp, Glycine max
  Peptide Sequence Number=SeqID_171797
atgttgcaagacagaacagttgcgtccattcttgaggaggagactcatttttctgatttattatcacctaattcaccatcatcaagggaattcgctaatcaaaattctgaagttgttactgtcgcaacatgcccttttgcgggcatgcgag

SEQ ID NO: 80113 - DNA, 113 bp, Glycine max
  Peptide Sequence Number=SeqID_171798
atgtgggtcatcatcaatgagtataaggaaaagctaaaccaagcggtgactcacgagcaaaggctagaggatgagtacaccaagatatcagcagaaagcgaagcaagggagag

SEQ ID NO: 80114 - DNA, 497 bp, Glycine max
  Peptide Sequence Number=SeqID_171799
gtatgccacctaccaggcaccctctagacccagataagtctaacagggccctgggatttccagcgttgatcacgggcctctgccagtcattcggggttcccgtcacacctagtaaggtgattcgaccgccgatcacccgggccttcattgagaagtattgcacgcctagacaggcgcagggtgatgcaccgcaggccacagacgcatcgccaccacctcatcaggctgatccacctgggtcatttggcatggagcggtatttacagcacttggttcgccagcaggcggccaaccacagggggcagagccagggtttcgctctttttccgtgccctactccagattcgtttagggctgaggtcgcatggcccggagattggcccgaggaccagacagaggaggcacctgcagaggctcccggcgatccagaggacgcccgcatggatgaggagatgacagatttactcggcttctttggaggaagcggagccacgtga

SEQ ID NO: 80115 - DNA, 477 bp, Glycine max
  Peptide Sequence Number=SeqID_171800
atgggaacaaatcaaaccggaaaaagattctatcaagtcaagattaagggccttgatgtcaccagccttaaggagttggggcggttgatgggacctctccaaatgcaagccttccgcaaggcgtacggaaagattttagatttgaccacagcggaaatattcacggaggccgttgtatcactcacccaatactatgaccagcctttgagatgcttcacgtttggagacttccaattagtaccgactattgaagaatttgggaagattctaggatgtcctcttgggggaagaaaaccgtatcttttctccgggtttcttccctccttaagcaaaattgcagttgtggtcaaggattcggcaagagagttggattgtgtaaagcaaactcgaaacggcgtagtgggtctaccacggaagtacttggaaggcaaggcaagggatattgcgaatcaagaggagtgggtcccatttgtggac

SEQ ID NO: 80116 - DNA, 828 bp, Glycine max
  Peptide Sequence Number=SeqID_171801
ttggaactcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatgttacacagcaggaaaagacgagttagttcaaacaacagtagttaaagacggacaagacggagctgcgggacgtaacggtaaagaagtattaaacggaaaagtaaatccacaaccagcagacggtaaagatggagatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 80117 - DNA, 387 bp, Glycine max
  Peptide Sequence Number=SeqID_171802
atgtcttccaaggttattttgatgatgccaaagaatcaagagtcaagaaaaatccaaagattcaagaatcaagtttcaagaattaagattcaagaatcaagtttcaagaatcaagattcaagaataatcaagatcaagattcaagaaacaagggaagactcaatcaagataaggtacatcctttgtggtacaagtagagggtacatctacttggggattgttatactgagaacaagagagggtacatctcttgtggatcagttcaagtggagggtatatccacttggttattcaaagagaacaagggagggtacatccctggtggatctttggcttgaaaaggattttacaaggttgaaagaaatctcaagaaccgcagttgcttag

SEQ ID NO: 80118 - DNA, 342 bp, Glycine max
  Peptide Sequence Number=SeqID_171803
atggtgggttacacaccttcaagctttgcggatttggtcttcactagtgaaaggatcgatgtgggtccgaaaagaggcaaatttagtcattctgcttggatgaatgagaaaactggggcaaatgaagagggtgagaataagggagaaacccatgttgtgactgccattcctatatggccaagtttcccaccaacccaacaatgtcattactcagccaataacaacccatttccttacccaccacccaatcattcacaaaggccatccctaaatcaaccacaaagcctgtctaccacacttccaatcacgaacaccacctttacctccccaccaaaacactga

SEQ ID NO: 80119 - DNA, 876 bp, Glycine max
  Peptide Sequence Number=SeqID_171804
atgaagaaatcgacgttattggatcaaaatgaagccacgacgctgctctcacaaatggtgcagcgcctgccgctttccgatacacattttcgtcgtatcagccagctgatctatcagcgcgcgggcatcgtgctggccgaccacaaacgcgagatggtgtacaaccgtctggtacgtcggctgcgcatgctgaatattgatgattttggtcgctatctggcgctgctggagcaggacccgaacagtgccgagtggcaggcgtttattaacgcactgaccaccaacctgacctcatttttccgtgaggcgcaccacttcccgattctggcagagcatgcgcgcaaacgcagcggcaactacagcgtgtggagcaccgccgcttcaaccggtgaagagccgtactcgattgccatgacgctggcggaaacgctgggcaccggaccggggaaattttccgtccacgccagtgatattgatacccaggtgctggaaaaagcggtggcgggcgtttatcgccaggaggagctgcgcaccttatcgcagtcgcagctgcagcgcttcttcctgcgcggcaccggcccacacgccggcatggtgcgcgtgcgcagcgagctggccaacatggtgaactatgcgcagctcaatttactggcgcacgactgggcattgccggggccgttcgacgcgattttctgtcgtaacgtgatgatctatttcgataaagagacgcaggaacaaattctgcgccgttttgtccccctgctgaagccgggcggtctgctgtttgccgggcattcggaaaacttcagtcagatcagtaaagagttctggctgcgtggacagactgtctatggactgaccaaggaaagacgatga

SEQ ID NO: 80120 - DNA, 1314 bp, Glycine max
  Peptide Sequence Number=SeqID_171805
atggaatatttcttgagagaaatagaaggaaagcaagcacacgacccgttgttcatgaacaacaacaagtcatcattgtcgtcatcgtcgtcatcatctttttccaccgtgtgggttcatgggcctgtgatagtaggagccgggccttcaggactcgcagcagcagcatgtctcagggagaaaagtgtcccaagcgtgatactagagcgatccaattgcatagcatctctatggcagctcaaaacctatgatcgcctacgccttcatcttccaaagcaattctgcgagcttcccttcatggggttcccttctcacttcccaacatacccttcaaagcaacagtttgtacagtacttggagaattacgcggagaggttcgggattaggccgaggttcaatgagacggtgcagcatgcggagtttgatgcgaaactcgggttgtggcgggtgaagagcgtcgacaaggcggagaagacgacggagtacgtgtgccggtggctgatcgtggccaccggagagaatgcggaggcggtggtgccggatatagaaggggtggaggaatttggcgctcctataaaacacacgagcttgtataagagtggggaagagttcagagggaagagggttttggttgtggggtgtgggaattcggggatggaagtgtgcttagatctttgcaaccataatgctactccttctcttgtggttagagacacagtacacgtcttaccacgagagatgctgggaaaatcaactttcgggttgtccatgtggttgcttaagtggttacccatccgacttgtggatcgattcttgctaatggtgtcatggcttctgctcggtgacacttctaaattaggattggataggccgcgtttgggtcccttagaactcaaaaacctttcaggaaaaacccctgtgctagatgtgggtacccttgccaagattaaaggtggagacattaaggtacgtccaggcattaagcggcttaaacgtcaaactgtggaatttgtggatggaaggacagagaattttgatgcaatcatattggcaactggttacaaaagcaatgtaccctattggcttaaggaagaagatatgttctctaagaaagatgggtaccctaggaggccatttccaaatgggtggaaaggtagaaatgggctctatgctgttggttttaccaaaaagggtctacttggtgcatccatggatgcaaagagaatagctgaagacattgaacagagttggaaagctggggcaaatcatagaactacttttgctcgttcacacttgccgcaaccaaattcataa

SEQ ID NO: 80121 - DNA, 3780 bp, Glycine max
  Peptide Sequence Number=SeqID_171806
atgtgcaaagggcatgagcagcactttttaaccttggatgacacgacagtcaaattatgctcgcgaggtagggaatcggagctcggagctgcgccacgtggcttctccctcgaatgcgctacccttggatgtggattcttcgcggagccgcttcgaatcggcgaggaggtgggaggggatcgtgtgtggtggtccgcagctgtggagaatcatttgcaaggtggttttaatactgtcactgagttcatggggtcttatattcacattgattcaatctctatcgatcttgccgattctattggcaagagagatgcaggcaaatgtgaacatttctcgatacgtggatatgtgtctgaaatgcgcaaaaaggactggaaaaattgttggccatttacagtacatgagtctgacaaacaaccatcatttctgccattagatgtaccaaaatatagatgtcggcattgtcagaactctgcacaagaaattgctgccaaggacatccagagagatgaccaaacaaactttgattgttgcagtactggatgcatatctggtagcaattgcaataatgcagctcttaagtctgttattcagcaagatccaatgcttgacactcttgagatgagagaaattgatcttaatactaccctgagctgtgtcaatgattacttaacaaataatgagaaaggcaagaaaggtggagtcgtacctagcagaataattgaccttgagtttggcttggaggataatctcaatcaccaagtaactagtattccatcacctaaaaactatacagacctcgcaccagaagtgcacactactaagaaaggtgaaggtaatgaagtttcttttcctgagcttgctagcaatttgaaatgcatggagaagaattctgctgagatgtgtaatggtggaacaccagcagataaccaatgccagaaagatttaataaaagcttgcacagttttggggaaaggaacaacagtaatggaggtggacaatacagacgatcacccaactggaccttctcttgaaccagttgcttgtaataatgctgcacctgcaggaagtgtggacaatacagttgaaaatgattttcaggatcatcattcagaaaagtccactggtttgtctcgtaggaggcctcggaaggtgcgcttgatggctgacttattaagtgacaatggtgaattgaagactgagcaaatttctatacaagaatctgtatcccttggtacttccaatgcctctgcagcttcccaggcacactcaatggtgccaggaaaggtggatattcaaagttgtttgactttgacaagcacaggtccaagtagaaaaaggaagtttcctctggatgaggtactgagacctgcaagcatgtgtaatgaagttctgaactcagagggaaatgaaaaaacagctgatactgttttggatactagatccaattttaaagatgtacccacaggattaggtttacaagatgttgcaaagggacactggagtaaaactgaaaccgaaagaagccatatcattggcaagaagaaatacaaaaagattcaagttgtagataattgcttgattcctgagcaaccacaaggacatcaaagagaaaatgaagacactgtggatactacagacaaggtatatgcatctaaaactaattcttctagattagctccctgtgcattcacagggaaagggatggataattttcctatccgccccctaagaatagaaaatgaattcaatttgtccaaagaaaaggggaaaatgctgcaaactgacagggagctggattctttatcctggcacaaaaataacatgcttgtacaagattcctgtgcatattcaggggaaaaagccaggtctaatatgcctgtaacaattccaattccttcagcccaaggggtgctaaaaggaagaggactggaagagggacttcatctttctctaaacaattatttggtggatgcacaagtttacaacaaaaaatctatccatcaaattggaaatcacctaccttactcaatgccttttgaagatggaacttcaaaagtaccactgcttaattggaaggacagtgacactaatgtttttggagggcaaaacattccttcgaagaacccaactggaaaaggagttcattgtgaagaaattaatggtgcaagaaccgtacaaaaaactattgaagctgtggaccaactaggttttatgaaaagatacagtgaacaaacagtcgaggtgtctgagcagggaacacttgatgatatacccatggaaattgtggaactcttggcgaagaatcagtatgagagatgtcttcctgatgtagaaaatagaagttccacattagaaaaacctactcttggaaggaaagcacagatgacaggtggttctactgtacacagaaaaggggagatgagcttgttaaaagacagccaaaaggagaaacctcagggaagacataagaaaaacatggtcacaagaggagagaatgtgaagcctagcaaaagaaagccagttaattatttttctccatttgatggaaacaatttgggcatgaataatatctgtccacctcaatccacctttggacttgaagtttcccagtcccaaaagaagccatcaagtggattccagttttcacctattggttctagccagcttggtagtgctcgaagtttcaggttgaatgggacttttgaagagcgtggatcccctaatgctacttttcaagcccctggaggatgtagcttacacaagaatatcctacatcaggatgatgaagcttctcgcatctgggcatccttgacttcaaattcccaaggatatgattttcccaaaaaggttgtttcttctcagcatcctagtagtagtgtggacataacttcactccaatctggttcatttcataagcaaaacatgaagagggatattgatctaaactacatgaatctgaatgctgctggactagaaaagcttagtaggaattcaagttctgaaaccttcaacaggatgaatggagaatattcatttccttgcaaacatagtggaatggagcctcatcaaaatttgaggggatctcttgatttgtattctaatgaaacaataccagccatgcatttactcagccttatggatgcaggcatgcagtcccgtacagcttttgatgtgggtgtcagttctcagatgcttaagaggccctcttatctgggtgattgcaatactaagttggagattggtacatctaagacccctggtaccctgaaaagaccatcatctgattattacagcagaagcttcttaccagataagcatggctgttttgctggctctccaacctttggtgcatcttcatcaaccccgcatgataagaaattaataagggctactgctttcaacggtcaaaatccaatgaagtctggaaggaaagagaagatgaagagctccaactctaccctgcagaataaagttagtaagcaaatttgctggcctcgtaatgaaaccgaaacatcactgcagcgcaaattggaagttaatggcaatcatgaaacccctgtgccatataaaatcatctctggaaacacatgtatggtgaacaggaatccagcagatctcaccataccagaaacagggaatatctatatgatcagaggagaagatctgaaattcgagaagaattttcccaaaaaaaggcctcgcttccccattccatatggatcaaagcagcagaagaatttgaagggaactaaaatgaaagaacattcaaaacattga

SEQ ID NO: 80122 - DNA, 507 bp, Glycine max
  Peptide Sequence Number=SeqID_171807
atgccatacatatacgacacgggatttcaatgggccatagacaacgataaatgccagggtcgtgttgatagtataaaacctctttttgaggtggctcgtgatcatttgggtaaagttgctattgacaaagaagtggcgaggaaggtgtgggaccgaattgctcctggtttagcttcccaatttaactcaccctattcaattccaactatcgcaccacatccgctgcttattcttaatggtgcggaagatcctcggtgtcctcttggaggcttggaaattccaagagcaaaggcaaccaaggcatacagaaagtttcattgtttagataatttcagggtgtatcctcttaagttggatgagataaaactcgatggtgtgtttggttgggaattctttttagaatatgtttggaatgaatttattgcagaagctggaatcggacaccaagtaacgagatttatgataaaagaatcagctgattggtttgataggttcttaaacccttag

SEQ ID NO: 80123 - DNA, 222 bp, Glycine max
  Peptide Sequence Number=SeqID_171808
atgaagaggactgatgctgcaataaaaaatttggaggtacaaataggccaactagctgagctagttgctgaaaagcccattgaaacctttgcggtatatgttgagatgaagcccaaagaggattgcaaggtgcttccagaatacacaagtttcatggcgactctagctaagaggcgaaaatgcaaggaagatgagttctttgtgaccttcatgccaccttga

SEQ ID NO: 80124 - DNA, 758 bp, Glycine max
  Peptide Sequence Number=SeqID_171809
atggagaattgcactaagccaatctataaacttgtcttcacactgggtggacggcgcatgaacgaaaacacaattcatggggctgccctaaaaaagggtagagaatggagaatttccctaagcaatctctacccggctccaaactcgtgggtggcggatgcatgcaagaaaaatcaattcatggggctccgaaaaaagcgtagagaatggagaattgctataagcaatcactacgcatggctccaaactcgacgcatgaacgaaaacgcaattcatggggcccgaaaaaagggtagagaatggagaattgcaataagcaatcactacgcatggctccaaactcgtgggtggggacgcatcgataccgtcgacctcgaaaaagggttgcgaacggagaattgcaatagggggggcccggtaccagcttttgttccctttactgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 80125 - DNA, 883 bp, Glycine max
  Peptide Sequence Number=SeqID_171810
atggggcgtggaaactatggctccaagctcgttgagtgccttcctatatctgatggtgaagctcttggagagcttgccctgactaacggtggtcatcaagtccacgtagcctctgtacatgatatcaacggaactgccctggtcaatgaagaccctagacaccatgaagttttctatgattatagagacaaccatggggtcatcttggttgacaggtttgatgcccttgaagtccttgtccgtaagggtgataggagggagacttcgttgttatcgctcacgccaccgttgctagtgtctttgtctagatcaatcttctattcttctttctgtttgcttcgtggttcttgtgctgctcctcttgatgtcctccagtatttggttgcgtttgaccctgaccggggaggtttcatctggggtagtcaaatgggtacctccaggttgaatgcttcctcaagaattatgcttgtgcatgttgttcgatttgtgcgagtcggccttggtgtgtgcttcgtgcttgttgcgcttctgctcggcttggcgaacttcattccggaatctggacatttcttccatctagatgtagcccttggctcaatgcaatgctaccttggggttgagattttggatctggacgaccatgcacccaaatctgtccatgaactttttgagggactcttcgtttacttgtcgcagactggccaaggcggccaatgtcatgcaatgagacctgctagttatgtactgcgcactgaatcatttgacgagggtgccgaagctgtctatggacgtaggtttgcctatatcaagaaggcatccagatgcttgtctggatatgttgtcccatcgtacttcatgaggttgagtggtttccaccccaagg

SEQ ID NO: 80126 - DNA, 338 bp, Glycine max
  Peptide Sequence Number=SeqID_171811
atgataacacgttttgaagtggactttgacgggggagatggggttcccgaccctgataggaaagatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 80127 - DNA, 498 bp, Glycine max
  Peptide Sequence Number=SeqID_171812
caagcaaagaaggagcatctgttaattggttccctcgctagaaggaaggaaaatcaggattctatcttcatgcgaaggatgtccaaatgttcccttgatgggaacaagggttgtattaattataatcccgtcctcgccataagaccacttggctaccccatgagaggagtgccatcagacaaaagcatcacgcctttcatcgcacggggtttcagtgaccacaacgcgaggtccgaacacaaggattggattggctcccaaaatctaaagactgtgagagacaatgaggttaaagcttcggaagaaagtgatgaggtacaagccttaaaggcaaagcttgaaagagcccgtccatggccatcaaaggcagcaatggtgagctcaaactccgaagaggtgaaaggaatcatcacgggtcaaaggcatgatcttgaaggacgagctaaaggcttgcctttggtcgaaaagaaatttgtcccaacagttaagcgagactga

SEQ ID NO: 80128 - DNA, 210 bp, Glycine max
  Peptide Sequence Number=SeqID_171813
atgtgtgcacaagaaatggctccgaaaaggctttccgcaaagagatctaggagggatgccgcggttgaagggaccagtgccactcccgagtttgatagccaccgttttaggagcgtcgagcaccagcaacgctttgaggccatcataggatggtcattccacagagagagacgcgtccagctcagagatgatgagtacacggatttttag

SEQ ID NO: 80129 - DNA, 228 bp, Glycine max
  Peptide Sequence Number=SeqID_171814
atggctccgagaaacctttccacaaaaagatctaggaaggacgccgcagccgaagggactagtgccgctcccgagtttgacagccattgtttcaggagcgttgagcaccagcagcgtttcgaggccatcaaaggatggtccttccaccgagagagacgtgtccagctcagggatgatgagtacacatatttccaggaggagatagctcgccggcgttggacgtcgctg

SEQ ID NO: 80130 - DNA, 513 bp, Glycine max
  Peptide Sequence Number=SeqID_171815
atgttcactattaatgcagaagtacgtaaagagcagggtaagggtgcgagccgccgcctgcgcgcagcgaacaaattcccggccatcatctatggcggtaaagacgctgcggtttctatcgaactggaccacgacgctgtgatgaacatgcaggctaagcctgagttctacagcgacgtgctgactctggttgttgacggtaaagaaaccaaagttaaagttcaggctgttcagcgtcacccgttcaagccaaaactgcaccacatcgacttcctgatcgcgcagattcggcggcgtgcctttgatggtcagcgtatcggtggccggatcccagaaaatgcgctcgcccagcagcatggcatcaaaggtgctgcggtcggccgggaaatgctcttccagctcataaccctgctcctgggtaaacgcctgaaaggttttttcgcccagcggcggcagctcgctggagagatcttccagcgcaatctcctcgcccgcctgcagctgttcattgca

SEQ ID NO: 80131 - DNA, 537 bp, Glycine max
  Peptide Sequence Number=SeqID_171816
atggccggccctctcgatgagtcgatctcttgctttctcataagggtggacctttgggtactagtacctatcacctttagagggctacacgtcctcgccattagaggactacatgtcctcaccatcagagggctgcacgccttcaccttcagaggactacacgtcctcaccatcagaggactacacgtccaagccttcagaggactacacgtcctcaccttcagagggctgcacgccttcaccttcagaggactgcacatcctcaccttcagagggctgcacgccctcgccttcaaaaggcgacacgtcctcaacttcagagggctgcacaccctcgcctttagaaggctatgtgtcctcgtttttagtgggctccatatccacaccttaagagaattaagggatcgcgcccacaagacacccagtggacccagaggagcccaacagggccctggggtttccagctctggttacgggcctctgtcagtcctacagggtgcccgttccccccaacaaggtcacgccatcatgacatag

SEQ ID NO: 80132 - DNA, 486 bp, Glycine max
  Peptide Sequence Number=SeqID_171817
gtggatgccacatacgagaattggaagcaagtccctacttctcagaaggatttgataagcgaggatattcagactgagtttgatatccctgaagcatctaatgtaaggacaaaaaagaaaatacttcagactgtgggggagcggtggagacagtttaagtctgatttgatgtccaaatgggaacttgcagccgacaaggacaatgtcgatgacactgtatgcgaaaagtacaacattagcaatgagaaatgggcccaattttgtcaaagctgcagagaccctttgtgggaggatgtgcgaaaaaaggcgcaagccatccagaagcaaaacactgtctctcatgtgttgtcttgtgggggttatgaatatttagaaaataagttgatggatgagaagagaaagaaaaaattggaggaagctgctcaatctggaagcactgacaccgtgattgatcctccctctcccatcagacgacacgtgaagtga

SEQ ID NO: 80133 - DNA, 296 bp, Glycine max
  Peptide Sequence Number=SeqID_171818
gtctgatttcctcatcacaattgaggaatacgtaggagcaaagggaaacacccttgtcgaccacgaaaagaggaaaaatataaaagggctgtcgtctcttatgacggacgtgtggggtgctaataccttccccgtgcgtaaatacaactcccgaaccttttcatttaaagttcgtagatcacgtcttttccggtttttccgacgttttccccaaataaacgttggtggcgactccgcgcgtattcctttcgtggaacacgcatcccgcgagtcacgcgtcgccctcctgccgaagg

SEQ ID NO: 80134 - DNA, 237 bp, Glycine max
  Peptide Sequence Number=SeqID_171819
atgattaacagggacagtcggggggcattcgtatttcatagtcagagacgatcagataccgtcctagtctcaaccataaacgatgccgaccagggatcagcggatgttgcttttaggactccgctggcaccttatgagaaatcaaagtctttgggttccggggggagtatggtcgcaaggctgaaacttaaaggaattgacggaagggcaccaccaggagtggagcctgcggcttaa

SEQ ID NO: 80135 - DNA, 198 bp, Glycine max
  Peptide Sequence Number=SeqID_171820
atgtttgctaaatttctcattttcttctgcaatgcttcaatttttagaatagctgtacgtcttccatggtggcaacgacgaatgattctaccagaaaatgtagaagaactgtcacttgcagacatggagaaatcaaagcccactaggaaaaaagatgaagtgaggagaggaaaaagatggagcgaggggaacaaataa

SEQ ID NO: 80136 - DNA, 518 bp, Glycine max
  Peptide Sequence Number=SeqID_171821
atggcggcgcaactaatccatgatcgagtggagatggagtgcctagagggagcttgggagaccctcaaaggcaacacgaggtgccgatttcggggcacgattcgatttacggctacttcattggtgcatccagatgaacccgtgcgcacgcttcagcgtactgtggagtggatactacccacgcctacaccataccgtctagtggagccagtccaagtgatcgaggtgacgtcatccgaggaagaccctgaggaggatcccgaggagctacctcctgagcctgctgtggatgctcttgactttctaaagggtgatgaggaccacttcctgaggtggattctcccgaggaagtcatgtcggcatctgaggcagactctacggaggatagtggcccgagagagatggcgaccagtggagactcttcatcatagtggacagttccatggactagaatttgatgattgtatacatgcggttgaagccatcactgtggacacctttgctctggatgacactat

SEQ ID NO: 80137 - DNA, 1179 bp, Glycine max
  Peptide Sequence Number=SeqID_171822
atgcggatgaaacagtttttgattgctccctcaattctgtcggccgattttgcccgcctgggtgaagacaccgctaaagctctcgcggctggcgcacatgttgtccatttcgacgtgatggataaccactacgttcccaatctgaccattggcccaatggtgcttaaggcgctgcgtaactacggcattaccgccccgattgacgtgcatctgatggtgaaaccggttgaccgtatcgtgccggatttcgccgcggcgggcgccagcatcatcaccttccatccggaagcctctgaacatctggacgtgatcctgctgatgtcggttaacccaggctttggcggccagtcctttattccgcacacccttgaaaaactgcgtcaggtgcgtcagcttatcgatcaatccggctacgacattcgccttgaagtcgatggcggcgtgaaagccagcaatattggtgaaattgccgccgccggtgcggatatgtttgtcgcgggttcggcgatcttcggccagccggactacaaaaaagttattgatcaaatgcgtagtgaattagcgaaggccatccgcggcgtggcattcgacctggacggtacgctggtcgatagcgcgccgggtttaaccgccgccgttgatagcgcgctttacgcgctggaactgccggtggcaggtgaagaacgcgtcgtgacctggattggcaacggcgcagacgtcctgatggagcgggcgctgacctgggctcgccaggagcgcgccacgttacgtgcggcgatggggaaaccttccgtcgacgatcatgatataccgcaagacgaacagctacgcgttttgcgtaaactgttcgaccgctattacgccgaagcggcggaagaaggcagtttcttgttcccggcggtggccgatacgctcggcgcgctgcatgccaaaggcctgccgctggcgctggtcaccaacaaaccaacgccgttcgtggcgcccttgctcgaggcgctggatatcgcgaaatactttagcgtggtgatcggcggcgacgatgtgcagaacaaaaagccgcatccggatccgctgctgctggtggcgcaaaagctctctctgacgcctgccgaactcttgttcgtcggggattcgcgcaatgatattcaggcggcgaaagcggcagttgccgctctatcg

SEQ ID NO: 80138 - DNA, 1140 bp, Glycine max
  Peptide Sequence Number=SeqID_171823
ataccggcaccgaagagaggtgagattgtgagacagattggtgaagcattgagggccaaattggatcctttgggtaggctggtgtctcttgagatgggaaaaattctcccagaaggaattggggaagttcaggaaattattgatatgtgtgattattgtgttgggctaagcagacaattgaatggatcaattataccatcagaacgtccagatcatatgatgtttgaggtatggaacccactaggaatagttggtgtaatcagtgctttcaactttccatgcgctgttctaggatggaatgcttgcattgctttagtctgtggtaactgtgttgtgtggaagggtgctccaacaactcctttgataactattgctgtgacaaagctagtagctgaagttcttgagaggaacaaattacctggtgcaatattcacctctttctgtggaggtgctgacattggtcaggcaatagcaaaagacactcgcattcccctggtttcatttactggaagttcaaaggttggcttgatggtccagcaaacagttaatgagagatttggcaaatgcttgcttgagttaagtggtaacaatgcaataattgtcatggatgatgcagacatcaaattggctgtacgctctattttgtttgctgctgtgggtactactggtcagcggtgtacaacttgtcgtagactgggagggaaaatcctaaccggtggatctgtattagagtcgggaggaaattttgtacaaccaacaattgttgagatttctccagatgctcctgtagttaaagaagaattgtttggtccagttctgtatgttatgaaatttcagactctagaagaagcaattgccttgaacaattctgtacctcaaggattaagtagttcaatctttacccaaagacctggaactatattcaaatggatcgggccacgaggtagtgattgtggtatagtgaatgcaaacatacctacaaatggagctgaaattggtggtgcctttggtggagaaaaggcgacaggtggtggccgtgaagcgggaagtgactcatggaagcaatacatgcggcgttctacatgtaccatcaattatggaagtgaactaccattagctcaggggataaactttggctag

SEQ ID NO: 80139 - DNA, 315 bp, Glycine max
  Peptide Sequence Number=SeqID_171824
atggagccttattgtatactagtggatttgtttctattgcattacatcataaaagaatggtcaaaaggcactggttttcttacatggattcccagaaatatatggtatacatggaggcaccagatgattgctatagcaaaagctggctactgggctattgcctttgatttcagaggctatggactttctcagcatcctgcggagccacaaaaagcaaacttacttgaccttgttgatgatgtcgtgggtttgttggcttcactaagcattaccaaggtatgcaacaacatgtgctatacaatacaatttgagtaa

SEQ ID NO: 80140 - DNA, 582 bp, Glycine max
  Peptide Sequence Number=SeqID_171825
atgaaagtggtcacatcaggtgaccacgatcaagttaaaaactgtatgaatgtatcttcactaaagcaacaacaagataacttccaatgcctctcaaaaagtattacctacaaccaatacatcgcaaaatgtgttttaagggagcaaataaagaaagcacgtctacttgctaatcctggttgttatccaacttctgttcaacttcctcttgtcccattcataaagctaagcaaagaattgcgtatggggcatgtatttgatggatggaaacaggggttgataaacttcccacccacttacaagtatgaaattaactgtgatagatatgttggtgagaggccgaaacaaggggaaaaaagaagatctccagcctggtgtgatcgtatattgtgcctaggcaaaggaataaaacaactacaatatggacgtgcagaaattaagctctcggatcatagaccagttagttcagccttgttggttgaagttgaagtattcgaccatcgcaagctaaagagagctctaaatttcactagggcagcagtacacctagagatcttccttgatgaagatggagaaatataa

SEQ ID NO: 80141 - DNA, 384 bp, Glycine max
  Peptide Sequence Number=SeqID_171826
atgtcgattattgttcctttctccactgagagtcatcccaaatttctttccatgaatgaggggtttgtttctctttgggtctcaatggacatgaactctattgctcgcttccaggccaggacttataagattgttgagttttgggatgacgaatttgagaaggctgatgctaaggctgaccaagctttggttaaagctactagggctttgaaggccaagatgaccatgactgaggactctaccaaacctctccaagaagaggttgaatgccttaataaggagtctactctctttaagccaaatgcgacgaaggttgaggagaaattaaagagtgatctcgacgagattgaggccgagatccttaagactcatgaagttgagtaa

SEQ ID NO: 80142 - DNA, 357 bp, Glycine max
  Peptide Sequence Number=SeqID_171827
atggcaacaaacgacaacgatgccaactccgtcaaccaaggaaaaggtccacacgagcatgaatccaccatgtcgaggatgcttgccatgggtgcctctgaaatgaggaacccaacaaacgttgcaagtccttcacgtcagaaggttgatgatcactcaatcatcattgccctgcaaagagagatggataccttgaaggaaaaaaacgcccaagagatgaatgaaattctgatacagaggtcagatgtcgtaccagatgtcacgacatcacgcttcagaacaaggagattatatttgactccttcatgtttatatagcagtgtgcatatctgggctgcaacagcttgcgctggatga

SEQ ID NO: 80143 - DNA, 168 bp, Glycine max
  Peptide Sequence Number=SeqID_171828
atgtcattgaccgtgaaagtgggtttaatgtcgttggtggcggagcccggcggttcggcgtgggcggagctgttttcgggcccgttggtgatggccggaatgtttgataaggagatgaagagaggtggaggagtggaaaaaggaaatcacatgagagggaaggggtga

SEQ ID NO: 80144 - DNA, 915 bp, Glycine max
  Peptide Sequence Number=SeqID_171829
atgggcatagttgctgatgtcaaacaagaagagcagatagatcaccatgaggatcaagcttcaatcaaatacagtaaagaggagggttctgagaaccaatggaccactagctggtgggagcaattcatggttcttcttaagaggggtttaacggaaaggaggcatgaatcttatttgggcttaaggattttccaagtcttgtctgtctcaattctctcaggacttctatggtggcattctgatccctcacatatacacgatcaggtaggcctgctattcttcttctccatcttctgggggttctaccctctcttcaatgccgtcttcgcttttccattggaacgaccaatgctgatgaaagaaagatcatcaggcatgtaccatctctcctcctactatgtagccaggatggtaggggacttaccaatggaatttgtgcttcccaccatctttgtagccatctcttattggatgggtggactcaagccatcgttggttacatttgtgttaaccctcttgatcatgcttttcaatgtgctggtctctcaaggaataggccttgcacttggtgccattctaatggatgtgaaacaggccacaaccttagcttcagtgactatgttggtgtttcttttggctggaggttactacattcggcatattccattctttatagcttggttgaagtacatttctttcagtcactattgttataagcttcttgtaggagtgcagtactcagtaaatgaggtctatcagtgtagacagggattgcattgtaggataagagatttccttgccattaagtgtctaaggcttgatagtttgtggggagatgtggctgttttggctgtaatgttgattggatacagagttgtggcttatttagctttgaggatggggctgcatcattga

SEQ ID NO: 80145 - DNA, 372 bp, Glycine max
  Peptide Sequence Number=SeqID_171830
atggcggattttcatggcggtttttcgaaaaaacgccaccgaatagcggtggcgtggcgggtttgggatggcggcgccatggcggtcgtggcggttatggcgggaacaaccttccatctaagagagaacccaaccgcgagcctcccctgcaccagccgcgtccctcccgcaccccacacgcgcacccagccgcgacacccgcagccgcacgcgcacgcagctgcgacgacctccggcagcgacgcaccggcacaaacggcggcgacgagctccggcagcgacgcacctgtcacgaacggcggcctgcagcgagaagttctcgcggagaagacgaagctgtcgcgaataagaagaagacgtaggttttcttaa

SEQ ID NO: 80146 - DNA, 738 bp, Glycine max
  Peptide Sequence Number=SeqID_171831
atggcagagtatattaaaaggagtgcattagaaaatgatgttgctagcctctgccacctccacctcactaagcggttctccgagaatccggttccgctcctcctcgaccctctcccggtccggttcaccctgaaccggagcggaaacaccggtccatttccggtcgatccggcccggcccaaagggggagaacttgggcgattcgcggaagctgatgggcccaacggaagggtcggactccgaataagagtatctgaagtcgaacggaagggttttggggaaggggagaacggcgggtcgtattggtggtcgggaatgaagtcttctgctactaaagctcctgattggctggaagctgcaatccgtgactccaaaatggattccatggaaacttcaactagttcttctagtgggagggctattagaattgtcagtgtaattctctgtgaacatgggaaaaagtatttggctcaaaaggtggtcatcatggatttgttcactttctgcggtggactttcactttattgttgccatattgtcactattgatatggaatttggatggcaaattgtcgtgggtacttttgttgggttttgtgtagccacgtttggaagcgttggtggtgttggtggaggtggcatattcgtccctatgcttagcctaatcgttggatttgatgaaaaatcatccacagctaaacataagatccgaaacgcgcatgctgaaattaaaacctga

SEQ ID NO: 80147 - DNA, 432 bp, Glycine max
  Peptide Sequence Number=SeqID_171832
atgtccatctttgaatttcattttcccatgatctatggatgccttggacatggatttaccataacacatcatatcacattggtctttcaggtagtttttgattatgatgacttggtgaagattccttactttaggtcggaaatagaaagcctcacagatgaggctatgcagttaagtgatgctggtggtgaggtggtaaatcagccagtgcatatgcctttgattttgcctaaagttcctggtcggttctactattattttggaaaaccattggaaatggaagggaggaaacgagaacttaaagacgacagacaaaaatctcatgagttatatttacaagtgaaatctgaggttgagagatgcattgcttatttaaaggagaaaagagaaagcgacccctgcagaggtatagggcctcgactattatactaa

SEQ ID NO: 80148 - DNA, 1446 bp, Glycine max
  Peptide Sequence Number=SeqID_171833
atggggtctcggacttcacatgtcagcttagagagcattcgcgctcctataacaggattgcttggaggattgacacgtgccatagagtgccatgttggatgccacgtgtgttttgtgggtcctggacagtacataagcccccaagctctgagtcggcttgcggacgaacaaattggtgacgagtttgtcgagcccccaagtgtggatgagtattgtctattgtcggttgtctgtgatggacatatatttggcgagtcagataaggcgtgtgcggcacacatgaaatactcttgcatgcgagtcactcacagagtaggcatgtactggagtcgtagtttgtgcgaagttccttgtttgaggatacccgccgaggtgcctctgacactgattcctcctcttcagagaggtcccggtcactgtgatcctcccctcttctacttttgggatgtgagaagagatagtgacggtggagatgtgagggtgtctccctatgtgcgacgcagtcaaagtgttgggtcaccatcatctaccccagttgttgctggctatgaatcggtgagggacgacgtactaaaatacaagagtggtgatttcccgtttttaaggatgacgcctggtcaaacacccttcttttttatgtatcgatgtctgtttgaggtcctgggtctcattctactcttaatcgcttttcagtgtgctctgttggagcacttgaatgtggccctttctcaactccacccaaaaagttggacaatggtgagggcctttgaaattttgtgccctttcttcaacattcggcctagtgtgtcagtcttcttgttcttctttcaaatgaaactgagtggcaaaattggatgggtttccttgaacagcgtatccaagaagctgtttgagtttgactcaaacatctttcgccgttttaaggaccatttctttaaggtcttggctactggcgtcgtgactgatggtatgccactgatgttcaacagggatagggtgtcccgcttcccgttctactggaagtctaaccctaccagattcaagtcgtatggcgaggacctactgacccttgcggagaaggtcgacaaagcaattttggagcagttgcctacctcgctggacatgcgggccattttgtctcttccttcgatgagcgatccactcatttccttggatggtaaagtgcctaaccttgcccttaggccacttgtgaagcaggtcagacctacaggtgggatcgtgccgtcgtctgccactgctctggatgttggagaagggggcccctataagccttcatgccctaaggcaggctgcaggattaatgtccggtgcaaccgcccttcaattgcgcaagatgtgcctcaggctccaccagccgtcgaggctcctgttgttgttgctactcatgctccttcgcctcttcttgtaaagagaagaatgacatga

SEQ ID NO: 80149 - DNA, 495 bp, Glycine max
  Peptide Sequence Number=SeqID_171834
atggtcaacacaatcaagattgagaaattcacagtgaagaatagttgcaacttttggtgcatcaagatgcaagccttgttgaaagaacaaggcatttgggcacctctctctgtttttgaagaactgtctgttgttgggctttggctgaaatttaagaaactcttcatgacaaaatcaatttccaacaagttgcttctaaaacaacgtttgtttggtctccaaatgagtgaagcctttttccctccctcctacgagaattttgtgagttttcttagtgtagacaatgactccattacacttgaagaagtcaagtctagtctctattctagagagtttctagtaaagacgtttgggaatggtgatgaagtctttgcatctggattatcaatgattgattctactaaaagacagaagatgaagaaagacaaaggtggcaagaagagcaaaattgatcctaaggacatatgtaactactgcaaaaagttgagtcactaa

SEQ ID NO: 80150 - DNA, 801 bp, Glycine max
  Peptide Sequence Number=SeqID_171835
atggaggaactacacactcaattaattaagccccgaaatgaaagcaactccagtggagggaatccacgagtttccaccgataaaaccagcaacagtgaacttaagagcttcttcagcctcaagaacacgaaacccaggccaatgcaccctcttgctagttccagcgccggcaccttcattcccatactcggcaaaatacaaagtcctcaacacagaccctccatacccaggccactcgatccagccactagcagcaacggcgtcgtctatgctgctctccatcaccacagccctagaatactccttccagggcctcccaagaaaagaaagataagagcccttcaccgaggagagttcggagctcggcgatatagtgcacttgtggacggagaagccggtgttctggcccgggtcggttcggccgttggccaggacggcgttgtagctggcgtggccgtgggggcggcggaggacgaggctgcagcgctggaagaccgcggcagcgtttccaaagatgaagtcgattgtgccatagatatcacattctcggtagaactggcggaggacgtgggcgtagagggtgtcctggtagcctgctatactgcatctgtaaaagcggagcggtcggaggctatgtttagggctacggcctgctggccctcggggcccgcattgttgtggaagccgatgtctcgcgcaatgaagccatcgcctgtgattgctgggaaaggaagcaaagttggtgttactcggttatcagcaatagtgaatatgacatgggggaagggttatgaaacatag

SEQ ID NO: 80151 - DNA, 231 bp, Glycine max
  Peptide Sequence Number=SeqID_171836
atggttgttgttgttgttgtttggttttgtggggtggaaatggtggtggtgattgagatttttatgttgtggttgttcaagacaacgaagtggagggctctggtagcaggggcggttgcagggtcgtcgatgctactaatagggttagaggatcagcacacgagtttggccatttacattctcatgcgtgcaactgttttggcatcccgttgtgggattaagagcaaatga

SEQ ID NO: 80152 - DNA, 318 bp, Glycine max
  Peptide Sequence Number=SeqID_171837
atgtgtcacccaactgtatatgtttatgtttactacaacggccaaatctctaacactaatgagggcaccaccttcgctagtaacaacacaaaaactttcatggtcaagaagaacataccacgccaaggtgggtttttgggttactccttcattgaaacaaatccaataagatttgacattcctttgggatgtagcatggccaaactcaaggatttaatcaagcaagttgcacctatgggagtccccccttatggaattcatgagtcacgaatggtcagacgattgttcattcgacaaccaggtcatgctaagtattga

SEQ ID NO: 80153 - DNA, 249 bp, Glycine max
  Peptide Sequence Number=SeqID_171838
atgtgtgttcaagaagaggaaagattaattatggaagagggcgaaagggtgaacttaactattcatggaaaggagaaagggaatcaacccaaaaacaagggcaagattcctgctcagtcagtcataaagaaagagtctaagtgtttcttttgcaagaagaaaaatcacatgaagaaagacttcttaaagtttaagagttggatggacaagaaagggtatggaaaacctaaggaggccagtgggaagtga

SEQ ID NO: 80154 - DNA, 1995 bp, Glycine max
  Peptide Sequence Number=SeqID_171839
atggcgttccaggatttcgacatgatcaccgaacggcggaggaacgaggagaggcttaagatgaagaagaagatcctcatcggtctcatctccgccgtcctcctcgcgtgcgtcataggcgccgcgacattcgtggttgtccaaagaacaggccctaataataatccaaagcacgccacgccattgccacagaactccgccgccacgtcacacgtggaccaaaactccaggctggtgaagatgatttgcggatccgctgaatacaaggaaaaatgcgaaaccaccctcggagaagccctaaagaaggaccccaaattggcgcagccaaaagacctaatgatggtgtccatgattctggccgagaaggaggttacaaaggccttcgacggaacggcaaagatgatggacaaggcctccgaggaggagaagggggcgtacgaggattgccagggcttgttcaaggacgccaaggaagagcttgaattgtcgatcaccgaggtgggtgataacgacgcggacaggctctccacaaagggtgctgaattgaacaactggcttagtgcggttatgtcttaccaacaaacctgcattgatggtttccccaaagggaagatcaaggatgagttaagcaacatgtttaatgagtccaaggagcttgtgagcaactccctcgccgttgtttcgcagttctcttcgttcttttcgatcttccaaggcgccggggagcttcatcttccttgggagattaccagtgatgatgcacctgcacctactactgcttctgcttctgctgttggtgctggttttgggtctatatttggttctggttcttcttcttttggttctgcttctgctcctggtgttgctcctactactacaggtgttgcttctgctcctggtgtttctcctactactgcaggtgctgctcttgctcctggtgttgctcctggcccagttccttcttgggctgcaggctccattcctgcatgggctggtccagttcctgtttgggccggccctgctgagtttatcggatcaaatgagaaacccacacctaatgtcaccgtggcaaaagatggcagcggaaacttcaaaaccatctctgaagctttggctgccatcccaccaaaatacgacggaaggtacgtggtttatgttaaagaaggagtgtacgatgagaccgtgacagtgacaaagaaaatgctaaacgtaaccatgtacggtgacggacagcaaaagagtatcatcactggcaacaaaaatttcgtggatggagtcaggactttccaaactgcatcattcgttgtacttggaggtggattcttggcgaaagacatgggattcagaaacacagccggtgcagagaagcaccaggcagtggccgcaagagtgcaagccgaccaagccatattcttcaactgcgccttcgagggctaccaagacactctttatgcccaaacccacaggcaattctatcgcgactgctacatctctggaacaatcgacttcatctttggtgacgcctctgccgttttccagaactgcaccatggtggtaagaaagccacttgacaaccaacagaacatcgtgacagcacaaggaaggctcgacaagcaagaaaacactggcttcgtcctccagaagtgcgttatcaaggccgacacagatttggttccggtgaaggacagaatcaagaattacctcggaaggccatggaaggagtattcaagaaccatcatcatggagactcagattgatgacctaattcaccctgatgggtttcttccctgggaagggaactttgccctaagcaccctttactacggagagtacaacaacaatggggctggttccatcaccactgctagggttaattggcctggccgtaaagtcatcaatagagatgaggctaccaggtacacagttgaggctttcttgcaagggacatggatcaatggcacaggtgtaccagctcaactaggcttgtacaattaa

SEQ ID NO: 80155 - DNA, 303 bp, Glycine max
  Peptide Sequence Number=SeqID_171840
atgatagggcaagctagaaaacttacttcttgtatgcgaggtaactctttagcagggaatttagctccattagatttggagatagaaggcagttgcagaagaaacaacgcaaagagaaggagaaaatttttgcaggaaaggacaacacaaccaagtttggaggaagctcaatcatctaaatcatcttcagcactcccagagttaagagactcggaagtaggtgcatccgaagctcatatcatgtctgaagatcaaccacatagggtgactcttgaagactattctagctcgaccgtgctgtaa

SEQ ID NO: 80156 - DNA, 1101 bp, Glycine max
  Peptide Sequence Number=SeqID_171841
atagcctctagaaagagaaaagcaattgcctcccaacctcaggagccctacgacacgacgagattcatctcggaggtcgcttgggagcgctatgagcagaacgttcactcccagaacatcattccagagaggaatgttaatttattcatcaccgagtacgacgagttcctccaggagcttgagaggcaggttcgagttcaggggaggttgattaagttcgatggggacatgctgaacgcattcctagagaccccagtagttttggagccaggggagaattacatcacctacaccaggttctgtagcacgcacccagaccctcaggagcttgcttccaagctctgtattccagggcacagttttgttctgaacgctgaaggagcatcttggaagctcctgaggaaggatcttattactctggcacagacttggagcgtcttgtcctattccaacctcgcccccacctcttatacgtccgatctgaatatggacagggcgaggttagtttatggactcatcacgaggatgggcatggacgtgggcttgttcatctcaggccagatttctcagatggcccagtccaactcctcccggcttagctttccagctcttatcactgctttatgcatccccaggggagttattccagactcgttgaccatcgagtcccttagccctaccattaatttggcttatattagaaagaacttttggaacctggatgatcccatgatcacatttacggggacctgtaagactagggctaggggacttgacgcttctgctccctcttcttctgctccacctgctccagctccaccagcacaaccagctcccacaccaacaccctccggcccctccgctcagagcacagaccttcttgctcctacagcccaagaaccgcagccaaagctggaggcgacactcgaggccacaccagaggagacaccgaaggatactccagctgccacacccgccgaggacatagattatgcagctgatatggcggtggcacaaagttcctgggatccctgcccactccagcattggatacatctttgccagcccaggatgctccctcctcacctcatgataagttga

SEQ ID NO: 80157 - DNA, 445 bp, Glycine max
  Peptide Sequence Number=SeqID_171842
atgggggatgttggccttaagccaattgcttttgcttatagacaaacagatggagaacaacttcaacaagaagaactgatcttgttaggactgataggtctcaaatgcactactagtctagaatccataaaatcagctttggaaaatgtcagaaatgatgcaaatacacagatgaaactggtcttggaggatgacatcatggaagtgaaagccatagcttctggactaggactagaacatggtattgttcttgaaggaagaaaagttaaagatttaaataaggaagctattagacgaagtggatcagcccatgtagctgaggtagctgatgtagtttacattcattggtcagattatggaatggtggctgcattgaacaataaatatacatgtctgccttgcattaataataccatgttctgttcatgggttttgtgtagaaggg

SEQ ID NO: 80158 - DNA, 225 bp, Glycine max
  Peptide Sequence Number=SeqID_171843
atgggttcgaatccggaaacagcctctttgcatatgcaagacagcaaggggtggatggaggctacaatgaaggtgacattcccacacgatgtggtaaatagtttggagttttactcgaaagttctagagccattgaatgcgttgaaggaggcgagtggacgaggaggatcaaaatgcttctacagaggtggacggtgcatggtggagttgagcaaatttgcataa

SEQ ID NO: 80159 - DNA, 327 bp, Glycine max
  Peptide Sequence Number=SeqID_171844
atggaggagatgattgtgttcagagaaaggatgtgtaaagaacccttgaagaagctagtggagcaagaggcgaagattgagagtggtcgaagccgtgatagatctagagctgacaggccatctcaatcgaagttcatccactacactccattgatgaagagtcgaggccgagcactaaaggaagcatgtagtgtatacctcaagtctgtcaactcgatcgaagatgagaaaaaggtccttagaagcatgccccctattattttcacaatcaaggatttcggggacattgaaagatgtcacaatgatccgatggtcatcaagatatag

SEQ ID NO: 80160 - DNA, 753 bp, Glycine max
  Peptide Sequence Number=SeqID_171845
atgtcggagccaatttggtccgatggtggtgattgcaatgtgctgctgtgtgtagctgtgcggctaggtcgcggcagagagtgggtcgcggttgcggcagagagtgggactgagaagcaagcactgaggcggcgatggagacacgaactcacggagaaggagcggtacctgaggcggaaagtggttgagtgggtcgatgagataaagaaagaagaattctctcttgaagagaaggatattacaattgaagtccatggagaaactcttaatggatttgcaaagccaccaaattctgatgaggagagagccatggaaggtgatttccttacaaaggggattcatattaatgttttcgatgatgagaaggatgatatcaaagggcttaggcacaaaaggaaggaaatattttcttcaggtgagcgtcgccgtaaagagggaaaaacttctaacaaagagatgttagacaaaattgtaagcatatggagtgattcaatgagccaaaggacaacaacttcaagagctagagaagagcgatataagggaaagacttctcaagcttctcaagctactagtccaataagtgatccttattcagcaaaggcatgcatggaactattggacaacatgcaagatgttcccacttcagcttactttaagttgatggagaagtttacaagtgagcattggaggcaaatgttcatagtgatggatgcagagcgaaggaagcaattgatagaatctcttaccgagtag

SEQ ID NO: 80161 - DNA, 355 bp, Glycine max
  Peptide Sequence Number=SeqID_171846
atggtgcggatacactctttgaccaatatgctcaacaactcagtggatatggatgaccaatggttaagtgtagagcaacaaggtgtcaacaaaaatcaagcagctgaaatgacacaagttgttgttctcactttcgtgctaggtctgtttctggaacccttggttaagctaaggagcttttttggtttctggtgcaaggattggcgaattggtggtcacctgaggtacatttcacctgaggtacaatctcgtcggcattgtcgctgttgtgttcgaggtagtgttgcttggaaagctgtgtatccattaggctctggtcactattttcctcagttgcttctccttgcatcaaaag

SEQ ID NO: 80162 - DNA, 279 bp, Glycine max
  Peptide Sequence Number=SeqID_171847
atggacgaagatcaatggatggataacagtataatgtctgaagaagttgatatgaatgaacaaaataaagatgaagttggtgtgaatgaagaacatgttggttgttctgatttgttcaatacttctcaggtatttgctacgcgagatgatgttctgcattgggctcgatctgttgcttatgaaattggatttgtggtgatgattacaaggtcagacacaaacactggtatgagaagaaggacttcatttgtcttaattggttgtgaaaggagtagttag

SEQ ID NO: 80163 - DNA, 171 bp, Glycine max
  Peptide Sequence Number=SeqID_171848
atgggcaggtataccattcatggcgcggtttgttttgaatatgataatccgaatttaagagggttgcaatggaaagtggtgaaaggaattaggggttacaaacaacacagagggaagggatgtgcgtgtttgagttgttgcagtgtgggtggtgactatgcaagtgagtga

SEQ ID NO: 80164 - DNA, 153 bp, Glycine max
  Peptide Sequence Number=SeqID_171849
atggaggtggtgatattgatggtggcggtgacactaatgatggtggtggaaataatgatggtggtgatggtggtggtgatggtaatgacaatggtggtaatgatagcggtgttagtggttatggtggtaacaatgatggcggctaatatataa

SEQ ID NO: 80165 - DNA, 291 bp, Glycine max
  Peptide Sequence Number=SeqID_171850
atggcattagaagaactcaaagccaaacctagttcaactacgacaaacttcagggagccatacgtgctagttatcaattatgattcggagcatgaacaacacaattcccttttggagcatcacagtgatccttcctttgatgagcatactagtggtcatcatcacagtgacattgcttgttcaaaaaggacaaagttacttgaaaggctaaaaagatgggttgatgcaggcagtgaaaaacctagagttaggcattctatttccaaaggggcagacgaacattgcacctaa

SEQ ID NO: 80166 - DNA, 633 bp, Glycine max
  Peptide Sequence Number=SeqID_171851
atggctaaggttgagtcaaaggactcggcttctggctttcccaaatttgtgctattccatttgatggatgagagcccttttgaccttccacacactatctacatcaacattctacaaaacatgaagactcttggaggagaggaccacatatactatgccaccctagtcaacaaacttctttgggaataccaagtcttccatgtattcaagcaatccatcatcaataaaggcaccttctatgcaagacaacaacacttcagtgttgtcaatctcaaggaaaataaagtggacatcaagaggaacatgccaattcctccaatggacgaggaagacattaagaagatgaggcagaagaaacttgtcaaaacaactattgatgaagaaaagcttcttcaaacctttagcattgccaaggagcgaggtaacaccaactcttactcctcaaccatcaagtccaccttccacacagccacacagaccttcatccccatcaacacatccaagtttaaaccccttgaagacgtgaccggaggcaatggaacaacccagcaactgaagccatttctcgcagaaagtttcttgttgctttcttcaacaaaaaccaatagaactactacaagaagagtgatataa

SEQ ID NO: 80167 - DNA, 291 bp, Glycine max
  Peptide Sequence Number=SeqID_171852
atgtccttgtgtgtttcagaaagtgtaaaggatttgcgagatagtggaactcgcaagcgggtttcttggggattggaaccaaagactcatctttttcaagatgatggagttccactaagcgatcaaaagcagataagctactcgatggtggaaaagtgtcgtgaaatggacacatttcaacgtttgattgcagggtgggactttggggctaatgttcatgtatgtgctgataagaaaaatattttctttatatcaagaatcaagcacacctgctgtgagcatgaggaatga

SEQ ID NO: 80168 - DNA, 633 bp, Glycine max
  Peptide Sequence Number=SeqID_171853
atgactgaggatgttcctcacatgactgaggatgtccctcatatggctgaggatgcacctgagatgactgcggacgtacaggcaactgttgcagaggacttaggtcgtgatggtgctgagggagcattgtgtcccgacatccttcagcacaaggttcctttaagcacttcacctagccatctgttcccccgaacacaaggttcaagatcatcacaggatccaaacacaaacagcaaaccgggacaagcgcatgagacaatttatgctaagactcaagcctatatgcaatgtggtaccatgtcagtgaaaaacctcatcgggcgcctaggagtacatgacaagacaaaccacacaataggagaccagtcagggttacagtgttttgcgaaaatgctccaaccatatgagatcaacataggtttaaaggagcactcaaactgtgtgactttcaaggcctacactccgaagagtccgtcagggcctctccctcctgattcaggtccaacccagaaaacattttatcacacagactctatctatgaattgtacaaaacacacgacttctcaattattctcaaaataattttaactcgtcgccatttaagggtcttatcattaactcgtcgcccttaa

SEQ ID NO: 80169 - DNA, 312 bp, Glycine max
  Peptide Sequence Number=SeqID_171854
atggatctacttagaacttgtcatcatattttcttggactggtgttttatccgcgaacttctcaaggtgttagaatgtcccaagttgaagatacttcaactaaatattcaagacatagcttttgttggggaaatcacaagttttgaatttctcaaccatgaaaaatatgagtttagagagctccttgcagaaataagaggattgagcaatctaaggttgctagatttgattgattgctcaacgctaggagtgttcccttgcaacatgatattgagcttgacaacaatggcgaatgcatcttatatggtgtag

SEQ ID NO: 80170 - DNA, 237 bp, Glycine max
  Peptide Sequence Number=SeqID_171855
atggatgaagataatgataatgatgctgaaaatgatttggtatttgaagatgatgatgcactaaattgggcaactgtgtatgaggcttcggggtttgaggatattgaacttgaatctgaagaagatgaaatcatggttaattttgaggcatttgatggagaagagggagagggagatgctccactaccttatgataacaacgaagatgattatgttgggattgaagaagatgattag

SEQ ID NO: 80171 - DNA, 388 bp, Glycine max
  Peptide Sequence Number=SeqID_171856
atgggttgttgttgggatatgtctttttgggggcacattttcctgtttgggattcttttacaaagaatttctcaaactagggctgttcttgagctatttcccagggggtgctcttttggcacgtaccctgcatgggaagcgccattgcaattggcgagttcatgcatggttgacacttgtcacctgctggaggaaagcgccaacacagttggcgatttgaccggatggcgccagtggtattggcgctttgactggtctgtccgtcaatcagcagctgcagcagcagcagcaaaggtgcaggctaggcagcctaggtgcgcagggaagcgtcattcccaatggcgcgtcttgcttgaccggaaagcgctgttgccattagcgcttcgtg

SEQ ID NO: 80172 - DNA, 357 bp, Glycine max
  Peptide Sequence Number=SeqID_171857
atgtgtcctcctctagaaaaggttaacaccaaaggtgctcagaagaaatcgatgaccaaacatcaaatatcaataaagtgtgatttgtcttactgggaatatgttgatgctttatattctgtgcaaaatagtaattcttcagtcaaacatagcgcatcatcatctgaccaagcaattccaagaaggactatgccgatgttggatcaatttcatccatgcattcatgattccattgaaaacattgtcgatgtcaaagttgatggtatggtgaagattaacggtctttggtgcacaaccatgtgcttaaagaacttgccaaatggtctgatgagtatatcaacctccttggtggcatag

SEQ ID NO: 80173 - DNA, 372 bp, Glycine max
  Peptide Sequence Number=SeqID_171858
atgactgttggcagattttctgaaaactctccactgagttccgttgctggtaatcgattacaaacatatggtaatcgattacatgttcaaaattcaaattcaaaacctttttcaacagctctttttcattcttcccttctggtaatcgattacacttcctgtccaaccactgctcttgcaacactttttcgccgaatctccactcaaactcgtcaacggactccaaaatccgacgccatttgcacatgcattgtcggaggcaaattgatcaatgcggaaatgaaggtggaagcagtagccaagctaatcaccggcgataagagaacaaaggcactgagagagagcggggaggcggtagaatgcaagatttaa

SEQ ID NO: 80174 - DNA, 598 bp, Glycine max
  Peptide Sequence Number=SeqID_171859
atggaggaagcacaaagttggcataagagggtgctgccagcatttgtgggggaaggcccaattgggtgttgcgatgcattggttctacatttggagccaagaaacatagattcagattgggagtcattttccacagctttgatcaaaagatttggagataactatgtgttcttgaaagagaggaccaacatttcagagctgaaacgcatgctgcgcatattattcaatgaagaggctgattgccaggcaactgagcaagacaaaaatagcatggggggaagtgggtcagaacgcaatgaagtagaggctagttcttggacaagaaagttcttgaaatcagaaaacaaaagtaaaggtacagtaatcaagaactacacactttgtggtggagaagaaaccaaaaatgatgaagcaaaattagtaagagaaacaaagattgaaaaggttatggaggaagaagttgatccattgttaaagagggagaagcacaaggaaaatagagtgatgatgtgggctgttgttatgatgaaacaaaaatcattcatgaaggtggttggaacatcaatggtgtcggaatcttggaatgtcaacttggtgg

SEQ ID NO: 80175 - DNA, 354 bp, Glycine max
  Peptide Sequence Number=SeqID_171860
atgacatgtgaagggcaaggattgttgtcagatgtgaaccttacggggcggaactttaggccttcagcaacaattaatagtcttgataatgtctctacctctgggccttcatccttctccatttgggccttcatccttctccatttgggccttcatccttctccactcgggggctttatccttctccacttaggcattcgtccttctccacttggacctttagcctatatttggccagtttcaggattctcatcattccctccttcttggaaaacatttgccctcaaatgtccaggatcatcaccgggttcaagtaccacttccttctttttcttatgggcttacttggcatag

SEQ ID NO: 80176 - DNA, 534 bp, Glycine max
  Peptide Sequence Number=SeqID_171861
atggatcagagagtgagaactcaagcacaaggacctctagaaagagccaaaggaaacatgaggaaagatcaaggagatcatcctccatgggaaaacctaggccttctggttgaaccaaggaattaccatccctcagaccaaataggaggagttatagtcgtgcagctgagtatcatctattcaactacggagattgccaagctggtaatggaagcaatgaaaaaaatagaaaaaatatctgcttctgcaaaagtttccaaaccaaggactactggttcctcaacaagaatagaaactgaagctacctattcaaggaccatgagaatcccccaagagaggcacaaaaacagaaaagataagatgttaaggaaatattcatgtccttctccacatcctagtgatgttcatcctaagttgccagactatgatgacatagtcatgttcatcctagtttttgttcatcctaagtcaattttgataccaaaatatagtacctttaaaatcaacggcagctttgagatccacaaagggtga

SEQ ID NO: 80177 - DNA, 446 bp, Glycine max
  Peptide Sequence Number=SeqID_171862
atggcgaaagtatggagtctgatcaaagcgatcttgattatagagtctgacaatgatgtttttacgttttggcttttccatttaaaagacatccagagagtaattcaagtgcctatgcaagaaataccaatttggattgaggttcataacatccctcttggcttgacaacgatagctgttggtaacttcctggaccaatttgtagactatgatgacaaacacaattcaagcccgttgatgtcttacatgaggataaaagttatgatcgatgtcaacaaacctctgaaatgtaccaagaagatcaagaaggaagggcacaatgatgatttatgtgggaagctattcaaagtggagaatgacaatggtctaagttcatgggggccagaactccgggcggatgcgcgcgtccttcggccatggaaagaggctcttgttatcctagggaa

SEQ ID NO: 80178 - DNA, 477 bp, Glycine max
  Peptide Sequence Number=SeqID_171863
atgaagagtacatccacttgtggatcagttcaagtggagggtacattcacttggttgttcaaagagaacaaagaagggtacatcccttgtggatctttggcttgtaaaggattttacaagcgggatgatggtggccacgaggatgatgagagatggattgatgagatgaagggattcatgaagagaagaggaggatccgtgaagggggaaagggaaaactatagcataaatggcaagaaaggggagaaggtctacgagcagaccttcactgtggcgcacagttgggttgggcaagttgaagatttcccttttgacatctacaaccaggttggacgaagtcgagcaacacaaagaggggcagtgatgagacggttgttgttgttaggtgagacgacaattcgaccgcataaggaggttatggtggagacaaaactgggtgcatatcaacaatctttttgggtcaacaacaagaggtaa

SEQ ID NO: 80179 - DNA, 621 bp, Glycine max
  Peptide Sequence Number=SeqID_171864
atggagataagattttcaagggttcttggaaatatgaaaattaatttacatccgtttattactcttgggagaagtcatattcctccactttataaatgggggcttgtaagaagttattgcaagcaagcgagatccttcaagagtgatagaattgtgactcctgtcaaaatgacatttgaaatatatgcaacttgcgtggtaccaataagtgctttctttgcatctagtctttggtttggtaacacagcctacttgcacatctccgtggcttttatccagatgctcaaagctctgatgccggtggcaactttcattatggctgttttgtgtggtattgacaaagcaagttggtacagtttaccaggtcacaggcatatttgcagaagctttaagactggtcttaacacaagttcttctgcagaaaaaggggttgactttaaatcctattacaagcttatattacatagctccctgcagttttgtgtttctctttgtgccttggtacctactagagaagcctgtgatggaagtttcacagattcagttcaatttttggatcttcttttccaacgctatatgtgctctagccttgaatttctccattttcttagtcattggtag

SEQ ID NO: 80180 - DNA, 615 bp, Glycine max
  Peptide Sequence Number=SeqID_171865
atgactaaaagcataggttcgggaaaatatctaggacttccatctatcattgggaagaagaagaaaaatctttggtttcatcaaggagatactttggaagcatatcaatcattggtcctcccaacacttatcaaaagcgagcaacgagattctcatcaaatcaataatggttttcgtgaattagtcttctctcttttggagtcccaaccaaatcatactttcaaaaaaattgcaatcattctttgggcaatatggagaagtcgtaattggaaaatatggaagaataatcatcaacaaccagttgtggaaatttacttggcaatgagtttcttccatgaatggctttcggtgagaactgcacagcatgacaacaaccaccagtcaacacaagcaagcacaatctggtctcctcctcttgttgatttatcaaatgcaatattgatgttgctatcttcaaggatgagttctcttttttgtgtagggatgtgcctacgagatcataatggtacatacatgaaagctccaacacactttcttcaaggtattccatctgttgcaatagctgaagtagtggctcttcacaaagtcttcaatgggctcagcaactccaactaa

SEQ ID NO: 80181 - DNA, 432 bp, Glycine max
  Peptide Sequence Number=SeqID_171866
atgactgttgtagacagtattaatacaactctccctaagatcgatagtgttaaagagtttatgggattagtgagagagcattctcaaacaactaataagtctcttgctgggacattaataagtacactaaccaccatgaagtttgatgattcatgtactatgcatgagcatgtcattgagatgacaaacattacaacaagaattaagaccttcggaattgctgtgaaaattaaagagtgtaggaaagaagaagacaaacacaaaatttatactggttcggcaacaacccgtgcctacatccagtccccaagcaaccaacagttcttgagatttctttcaaccttgtataaccctttacaagccaaagatacacaagggatgtaccctcccttgttctctttgaacaaccaagtggatgtaccctccacttga

SEQ ID NO: 80182 - DNA, 243 bp, Glycine max
  Peptide Sequence Number=SeqID_171867
atgcaaatgaaaccccttgaacatataaaaccccaaatcaaaccaccaaaacaatgcaaacgaaatgaacgcaaaaaaaccaccaacctgacaaaaagcgcgaaccctcacaatcacgagaatgcaggggagggaaaagcaaaccgcaaacagttaaaaaaacctacaaacatccttgccttgccacataggattgctgacttggactcaaacttgccacattgggatgcttacgtggactga

SEQ ID NO: 80183 - DNA, 279 bp, Glycine max
  Peptide Sequence Number=SeqID_171868
atgttgggtgtggcggggagggaggaagaagggggagagggagggggaggttgtggtggcggtcgcgtgctgcaagccttgcctgaactcgctgttaagggagtagaagggaggggaggggaggaacaagggggagagggacgggaagggggagggaggaagaagggggaaggggagtggcgaaagggggagaaggaggtcatgcggaaaaatacgcgaaaaaaccacactttaacacagcaacgggaccacaccggaaaaatgactcttaaacaataa

SEQ ID NO: 80184 - DNA, 363 bp, Glycine max
  Peptide Sequence Number=SeqID_171869
atggaggaaagcacagacaggtctaaggtggcagagaaaaggcaaatttctccatttggggttattttaaaaactttttcctcagatggggtgcttttaaaactatttatccaagagggttcttttggacgtaagctgcatgcatggtcaagcaaatcgccaatgggactggcgggtttgctgctggtgactggactcgccactgctagtggcgataagcacatgcaaagggagcaaatcgccagtgagactcgcgatataggtgcaaggtgggaacctttcccaccagtcaaactggcgagttccaggctgtttcgtaggccagcttttttcaagctttttcaggtggcaggtgctgtttag

SEQ ID NO: 80185 - DNA, 339 bp, Glycine max
  Peptide Sequence Number=SeqID_171870
atgtcgttaatattagctcctctatttggactattgcagtggcaaaggacgatgatgccccccagcggcgaaggcctactgcagctgcccggttttccaggcggatcccatgacacgtcagttctgagagattttgaaaatcttattgctcttatagtttggaatggagaggaatgttctaagttaaagctatcttcccatggaaggaagatgactaagttcgagaggcctactccagagattgaaggccttgtggctgccagcggactaagtcctttgatcgcatgttccctagatatgagtgatcgaggactaatgtctgcttttgtagaacactga

SEQ ID NO: 80186 - DNA, 258 bp, Glycine max
  Peptide Sequence Number=SeqID_171871
atggccatcgaaaccgaagcaacaactactacggccgttgaaaagggaaacacgactactgcgactgccaaaatcaaaacaatggctattacgaccatacaagagaacatgatagatggcgaggcgaaacgtaaaaatgcgtcttctcatgaagaaaacgtgtggagtcgccaccaacgtttattcgaggaaaatgttagaaaaaccaaaatgatgaagggtgttgcgcttgctcctacgtatcctcaggtgcaatga

SEQ ID NO: 80187 - DNA, 1182 bp, Glycine max
  Peptide Sequence Number=SeqID_171872
gaggagcagggagtgcgacttgggaaatacgagttgggaaagacacttggagaaggcaattttggaaaagtcaagttggcaagggacactcattctggcaaactatttgctgttaagatccttgacaagagcaagatcattgacctcaataacattgatcaggcatccaaaggtaaactgaaagaagctgaaggtaggaaaatattccagcagttgattgattgtgtgagcttctgccacaataaaggtgtcttccacagggatctcaagctggagaatgtacttgtggatgccaaagggaacataaagataaccgattttaatcttagtgctttgccccagcattttagggaagatgggttgctgcatacaacatgtggaagtcccaattatgttgcccctgaaattcttgccaataaaggctatgatggtgcaacatcagacatatggtcatgtggtgttatcttgtatgtaattctaacaggataccttccttttgatgacagaaatcttgcagttctctatcaaaagatttttaaaggagaagttcagataccaagatggctatcacctggttctcaaaacattataaagagaatgcttgatgccaatcctaaaacccggataacaatggctatgatcaaagaagatgaatggttcaaggagggttatactcctgcaaatccagaagatgaggaagagagtgtgtatattgatgacgaagacttttcaatccatgatgtgtcacatgaagcagatcaagggtgtccaagatcaccaacacttatcaatgcattccagttgatatcaatgtcttcaagtctagatctctctggtctttttgagcaagaggatgtttctgagaggaagataagatttacatccatccattcaccaaaagatttggttgagaggattgaagacattgtaacagaaatgggattcagagtccagaagaaaaatgggatgttgaaagtgatacaagagatcaaagtacagaaatgtccaggtagcttctcagtggaagcagaggtgtttgaaataagtccatccttgtatgtagtagagttaagtaagtcttgtggagatgcttctctatatagacagttatgtaagaagttatcaaatgatttgggtgttcacacaaggcaacaactagggagctcagaagtgatggcctaa

SEQ ID NO: 80188 - DNA, 1212 bp, Glycine max
  Peptide Sequence Number=SeqID_171873
atggctttagcactttcctccaccgcattgtcaagtcttccaaacagagaaattcgtcaaaagggtttcccagaaagaacacccacatgcttgagcctgaccagaagaacaattgcaaatgctacaaaaggagtctcagctgtctgtgaaccacttcctccagatagaccattgtggttccctggtagctcacctcctgagtggcttgatggcagtcttcctggtgatttcggattcgaccctcttggattaggtaaacaagtgttgcttttaccatggtctgatccagagttgttaaagtggttcgctcaggcagaactaatgcattcaagatgggcaatgctggcagtgttcggaattctggtccccgaattgctcgaaagaatcggctacatcgagaacttctcttggtacgatgctggcacacgagagtattttgtggaccccacaaccttattcgtcgtgcaaatgggcctgatgggctgggtggagggtcgaagatgggccgacattgttaacccagggagtgttgacattgagcccaaagtgccacacgtcacgaacccaaagcccgatgttgggtaccctggtgggctttggtttgacccaatgatgtggggaagaggttcgcctgagccagtgatggttttgaggaccaaggagatcaagaatggaagacttgcaatgttggcttttgttgggttctggttccaagctatttatacaggggaaggacccattgaaaatttgatggcacaccttgctgatcctggtcactgcaacattttctcggagccagttactattgatgtacgtgctgatacacagggtttttcaggtgggcccaaagatacttcagcgttgacagattatgttcatcatgtggcaatcaaagtttggaaaggacaggaatgtactaacttaaagttggcctctcatgggagaaaggtagagaaatttggaagacctacaccagagattgaaggcatagtggaaactagtagtttccatcttctgataggagatgtcactatcaccctcaatgatgtggcatcattgttacatctgtccattacaagcgccttccataccttcgatgctcatgatgtaaaccaagtcgtggacttgatagttgagttgcttgaagttagtacacaagaagcaaaagatgagacatttcaaaccaaagggacatatgttcgcctagcctga

SEQ ID NO: 80189 - DNA, 392 bp, Glycine max
  Peptide Sequence Number=SeqID_171874
atggtttcccttgtaggaactgatggacaagatgcatttgaaggtccagttgaggaggtggtcagagcagaggctaaggaagctaaagattcactggaaaaattggatattccggcttgggaagggcgtgcttatgactactgtatggaaaacctcaagaatatgggtttccctgttgatggacttgcatttcatccagagttgggaggcaatttggttaaagctggtcgatttggctatataaaaagagccatgcatggaaccaaaatgttgtctactcgtgctgtatgtgtcgcttctgccattggcgacactagtggtatcgccacctgcactggcgctttggccatgcagagtgaagtcgttggtcaacttggcgccaccagcctagg

SEQ ID NO: 80190 - DNA, 612 bp, Glycine max
  Peptide Sequence Number=SeqID_171875
tttaaatctgatttgacgaggaaatggacacttgcagccgacaaggacagtgtggatgacactagacccctcgtgggaggatgtgcggaaaaaggcacagaacagaagctgatggctgagaagacaaagaaaaaactagaggaagctactcaatccggaagcattgaggccgtgattgaccctctatctcccatcatacgacacgtgaagtggaagatggcccgcaccaagaaaactaggaagatgacgtctgaggcagcaaaggaaattattgagaagattacaagtgtcacagggttcctttgtccctcatggacatcaggatctcctgactgctgccattgggtgaccagaataccctggccgtgtgcgtgctactggagccggtgtgaccataaagcaatactttggatcagctccacgaacctcccgcagttcttcctccatgcctcccaaagatttcgagtagctgactcaacaaatcagggaccagctggaggagtcgatcacaaaaaaagtgactcggcagctgatgttatccttcagccagatgtaatcccagttgcaatcacatatccaatcacagggacttgcactgtctccgaagcctaa

SEQ ID NO: 80191 - DNA, 504 bp, Glycine max
  Peptide Sequence Number=SeqID_171876
atgaagagacggagaagagtacgtatattgactgaaattaagactcacttccagctagagttctggaaggaaattacacagatgcaaattctgggaacaagagagtatgagaaggatatgcttgcatttacaggttgcagtcacaatttgaccgcagaagaagatgaagagctacgacagatgcgaaatgaagttggtcactggaaggaggagattaatgggactgagaggagattgactggaggttgcccattaactccgagggaaacttccctattgcttagagcactaggttttccatcacaaaccaggatttatctggtagctggagaagcatatggtagaggaagtatgaaatatcttgaggatgatttccccaacattttctctcattcctctctctcttctgaagaagagttgaatactttcaggaatcaccagaacatgttagctggcatagaatatattgttgcacttcagagtgatgtatttctctatacttaa

SEQ ID NO: 80192 - DNA, 378 bp, Glycine max
  Peptide Sequence Number=SeqID_171877
atgtctaaccacatcgaagcaactcaaatgcaaaagatttctgcgtaccggcaacacctcaaacatcatcaaggtcgcggtgacgccggccttcgacgacgcgcaattctccggcgtaaaaggcctgggaatctccattgcgcgcctagacctagcacctggtggagtcatcccactccacactcaccctggagcctcagaactactgttgttgtgaagggaaaaatctgcaccggcttcattgcttcggacaacactgtgtacctcaaaaccctagaaaaaggtgatgtcatggtgtaccctcaagggttgttaatgctcaaccaaagcaccgagatgttattggccctatgggttatgttatgtattctaggataa

SEQ ID NO: 80193 - DNA, 198 bp, Glycine max
  Peptide Sequence Number=SeqID_171878
atgggtgtcaagtacctcgaagtagtcaaacgagggtcgcatcccaacaacggatggtccccagacgaaattaggggaagtaaagataggacactaatttcgttcgagcgaaacactattcggctggtgaaactccctgccagcggaacatgcaaaatttttgaaagtgatcagtaccgacgacctagatcatcctga

SEQ ID NO: 80194 - DNA, 2211 bp, Glycine max
  Peptide Sequence Number=SeqID_171879
atgaaacaagagtcaccagcctcaccactgccatcgtcgcttccacaaccatcaccaacaatgacaacaacgaaaaatgtgatcaagcttcagaacagtttaactccatcacggttaaggcttccttccaagtacagagagccgccaaagactccaccagaggttgttgtcaacaatgtggtggtgtcaacaccatcaaggagagccaagtctgtgactccagagttgaagcacaattcaaggatcaaaaggggtcttgtgctgaacaaggccaaacccaatgaagaggttgtgggaacaactcaaaggggtagggaagctgaagagactaaggttgtcgctcgtttcgtgagacctcatgttgtggaacaatttgctaggccaaggaatggggctggggattttgctttcaagagggacaaggaggactctgatgagaagagtaagaaagaattgatggagaagctcgaggcgagtgagagtttgatcaagaatctgcagtctgaagtgcaggctttgaaggctgaattggagaaagttaagggcttgaaagtggagctggagtctcacaacaggaaactcactgaggatcttgctgctgctgaagtaaaggtggtgtctttgggtggcaatgagaaggagccaaatggagaacatcagagccccaagtttaaacacattcagaaactcattgctgacaaattagaaaggtccattgtgaaaaaggaagccattgcaaatggagggtttgttgaagcatcaattccaccaccaactgcaattcctgccattcctgatgccccaactgcaaggaaaggaagaaaacccactcccaactcgtgcctgccgccacctccaccacctatgccaccatcaatcccttcaaggcctatagcaaaagcgagtaacactcaaagggtccctgcatttgtgaaactatttcacacattaaagaatcaagaagggatgaaaagcacaacagggacagttaaacagcagaaaccggtatctgtcaatgtacacagcagcattgttggagaaattcaaaaccgttccgctcatcttttagcaataagggcagacattgaaacaaaaggagctttcattaatgacctgataaaaaaggtggtagaagcagcctacacggatattgaagatgtcttaaattttgtcaattggcttgatggtgaactctcgtcattggctgatgagcgtgcagtcttgaaacattttaattggcccgagaggaaagctgatgctatgcgtgaagccgcagttgaatatcgcgaacttaaattgttagaacaagagatttcgtccttcaaggatgacccagaaattccatgtggagcttccttgagaaagatggccagcctattagacaagtctgagagcagcatacagagactaatcaagttgcaaaattctgcaatgcgttcatatcaagagtacaaaattccaactgcttggatgcttgattcaggaatcatgaccaaggcttctatgattctggtcaagatgtatatgaaaagagtgacaatggagcttggatctgctcggaactcagacaggtctagtcaagaatcccttctgcttcagggcatgcattttgcatatagagctcatcagtttgctggtggtctggatgcagaaactttgtgtgcttttgaagagataaggcaacatgtaccaggacacttggcagaacaattcccagaattgacagataaaattaaggaggtgttgattcctctttctcctttcgaagatcgcctggtttggaagcacactttttcaggagaaatgtgtatgaaagatgttttacatttctccagcccgctcttcctcagttcagctggtgcaaagtggttcattcatggttctatgtccatagtcaacatcaagaacaaggttattgcagatgtagttcttgctagcacttactctatgaattttaaagttcctatccatccgaataaagctcctactgttaaaccagtcacttggtctcctctttgtggatggattaaatgtaattctgatggtgccgctagaggagcaccaggtaatgtggcttgtggaggtatcttgggggattatcggggcagtatttcatggcatattggtagcactacagctctctttgcagagctcttggcagcaatgaagtcaatcgaaatagctgctagttgtggctggtgcaacttatga

SEQ ID NO: 80195 - DNA, 231 bp, Glycine max
  Peptide Sequence Number=SeqID_171880
atgcgaaaggtatttctctcagctcaaatatgtatcaaaattcccaacggtgagaatgctcagaattgggcttcaaacgtagtgcttaaatttcacgatgatccaatggtgaacgagtccaagatcatcgtttttctgagacaagttaggtggtctgcgggaaaaaaagagggttttgggagaaacgaaattgtgaggcagaggaggctgaagagtcagtctgaaaactga

SEQ ID NO: 80196 - DNA, 231 bp, Glycine max
  Peptide Sequence Number=SeqID_171881
atggatcaatggcatcttcgtcatcatgcgcatcaagtatacaaacgaggtctagtccaattgagggtgacgttttgtggatgcaacccaagcatgtttcagaacatgtttggaatgaggaagcagacagaaaactacacatcagacgagcagtgccgacgtatcaaggtgaagaacaaataccagaggaaattgttcctctgcttcggcaatgtgggttttattggataa

SEQ ID NO: 80197 - DNA, 906 bp, Glycine max
  Peptide Sequence Number=SeqID_171882
atggaagataaaattgtgataaatgaattgctgcaagatgaggaaaagccatcatctgataatactatgggatctactctcctcagcttgagcctgaataactcaggacaatcccttaaccaaatggggatgctgcgaatcaagcttgaggaagcaaagaaagagaatgaaatcttaaaggctatgctgaatcaggttaatgaacactgcactactcttcagaatcgcatactttttgagatgcagcagcatcaactatcagcttcatcatcatcacctcgcaataataataatcatcatgactcgcagggaaataaacaagatgccgagaaaccaatgctacacactcggcagtttttgaatattggcgagtcttcaattttagacggcaacacaaaagcatgtgcaatagcagaaaacgttgaaaagaagatattaggcaaaaaccttgcaagtgatattaataagtacaatgttaaaggtgaaatcaacagtcaaataacattgaatgaagtaaaaagcacagaagatcaagcatctgaggttacttgcaggagagctagagtgtccataagagcacgatcagatttttctttggtacttaaagcttttgtttatttattaaatcagatattacatgaagttgaaggatgggcgatgggtgtcaatggagaaagtacggacaaaagacagcgaaaggcaacccttgtcctcgagcctactaccgttgcagcatgggaactgcatgcccagttcgtaagcatgttcgtggatatacatttacattttcttgccatcatttcactttgctttaattacttccttgtgacatgcatacattatacacattgcatcattgctgtgagaggagggagaatcttaaattcagctgagaaaaacccttga

SEQ ID NO: 80198 - DNA, 288 bp, Glycine max
  Peptide Sequence Number=SeqID_171883
atgaaggtttatattgttgtcgataatttagatgtcaacagtatcaaatctgttaacttgagagctgtagtatattctaattttctccatgctagcagagttgagatcagtaagcttaaaatgagtattgaagggtctagctctggaaataatctggttgttactgatgttgacaattttcaacctgagtctttagataagtacaaagaagaaattaacaaattgcaaatggaagttgaacggtacatggaaaagaatataggaaatcctaaacctagaaatttttaa

SEQ ID NO: 80199 - DNA, 770 bp, Glycine max
  Peptide Sequence Number=SeqID_171884
ctgtagaggaagataaaagggggaaacatatcccttatagaaacacaacaactatggagggcaaatcctatgcaacggtagttggggagaaaaatcaataccatgcgaaggagaaaaatctaaaagatgcacgtaatgctaaagagggtggtaaagacgtagaggggatgtatgcaggtttgactatggagaaaacacagagtatgattacctctaatgatgatgatgtcatgtcactattatatgttgttcaacccatggaaccatgtgtactgtgtgatggcatccctctccaagcttggggggagcagtgcttttcaagggttgtgggactttttggaacatttgtgtccttagatattgaaattgctaacttagagagactaggtagagctcaaattatgctaaaggtctccttcttcttaccaatctcgagctgctatgatgtcaaggatagtgacaatgatgaagactttgaacatagtgtacttgagatggatatttcatccttctcgtcagagtgctattctaaggagggtatgagagcagaggatgatgagagtagtgtagtgtatcaacctatggaagtaggggtgggccagtccatggacttgagcccatttacccacccctatatggaagtaggtgagggcaagggtgcacgtgactacaaagtcctaggtgatgagcaaccaatagaaggaatccaagagcccctaaagtacaaggcgggaaatgagaaagagaatttgaaatgggtaaaggaatga

SEQ ID NO: 80200 - DNA, 375 bp, Glycine max
  Peptide Sequence Number=SeqID_171885
atgaaccaacaaacttgggatgaatttgctgcaagtcgcaagacccctacctggcaggactcgttacaagaacaaacgacacaaggtagttttgttccccatggtcatgatgacatacttaatattgccattgcgcgaccagaacatccaggtcgtgttcgtgtagcggggtctggtatgacaatcagtcaatactatggaagggcatcatgtggctccagtagttcctctacatcaatcacccaacaacagttggctgagataattggaagccttaaagaagagtacatgaatgagattatcagaaacccgaaggaagaagtcaggaatgagattgaagaagaaaacaagtggagtcaagagaaaaagaaatag

SEQ ID NO: 80201 - DNA, 765 bp, Glycine max
  Peptide Sequence Number=SeqID_171886
atggttcttaactttaagaacctacacaagaactatgttagagatgctcttctagtgaaatttgaggatgatgtgtacttaccaacggatgagccacatgggtcaattcaagctagcttgagccgcctttggtactatttaaaggggcctgtggtatttactgatgttacatggttttgtgaggattgtgcaacaaagcttggggtgccacctgctcttgaccaatctacacctatctcatttaagcttaaaaagaagcagaaggaaggaaaaactaactctagcttagttgctaaaacaaagggagtgttatctagtcgtcacatttcacctgagcctaagcatcctcaatgtagtaacagatgtgaagaatgtgaggtgaaagatgaatgtggaccaaaggatgtagctaattttgatgtaggcgaagaagaaagtgtggcaagggatttagctaattctgatgaaggtttcaaatttgttctagtttctcaaggagctaccgataatgattcaggttgtgtagaattagatggtcatgtttatgcatatcctactattgatccaatctggaggtacataaacgtgacagatgaggctgtccaaaagggaatcttctacccatccattgattgtatacgatatgttacaacagaggttgaggctgttgttgtacatgcaacgattgtagaaaagcagcctaaaggacatggtgatgtagggttcaaagacctatcaagaaatcaaaagtatggaaaattctga

SEQ ID NO: 80202 - DNA, 567 bp, Glycine max
  Peptide Sequence Number=SeqID_171887
atggatagtagatggaagtctatttataacaaggtccaacctatgtctactatgtgtatgttcttcctttctcttagcaaaacactcagaaacttagtaaaaggtctcatctgcattcagatgcccagaccaacgattaacgttgatcctgcaactggaagaggattaggaccacaaaaacaaaaatttcatagctatttgggggttgtggctcgagaaaagattcctattgtacttagcaataggaaagatgtgtcaaaatctctaaaggacctagtattggatgacattttggccaaatttgatatccctaaagcctcaaatgccaagaagaaggtcatgtccacggtagccactagatggaggcaatttaagtcttcgctaaccactaaatttgtctatgctgacactaatgatgagaaaagaaagaaaagacaagaggaggcaatgctgattgagaatacaccatttcttgaggaccatccatctcctattgaaagacatgtcaagtggaagatggctcgcacaaagcgatatgggcagatgacatctcaaacggcacaataa

SEQ ID NO: 80203 - DNA, 250 bp, Glycine max
  Peptide Sequence Number=SeqID_171888
caacttcctgatggcggtttccgccatcgccggcaacaatggtggaagaagaagaaacgccaaggagaaacgtacctcgaagaagaagcagcaacgcaaagaagaagctttcaacttgatcccgacaacaatggcggcaacgaagatgaggaagaagcagaaacgcgaagaagaagacttcacttgggaagaagaggcagcgcgaagaagaagatgcagaatgaagcagaagaatgaagaacaagaatga

SEQ ID NO: 80204 - DNA, 603 bp, Glycine max
  Peptide Sequence Number=SeqID_171889
atggcaaccgacagatacgcttctccgccagctacatcgccggaggagaacgctctctttctcgatatactacacgaagctcctcttttcgctcatcgcaaagccgcgagggttatcgggagcgttttctactgcatactactggcaagttcaaataattctaattctgctcctttggcaaaacatgcaggttatgctactttggccattggagctcactggatatttcgtccagtgcaaggactcatctctcccgtgctttgtagttgtgatgttctgcttttgctgttgacaggaatctttcaacaatacctggtttatcaagtgcagaagatacgcttgcagggctattatagtttcagtcagaagttgaaatttattgtccgcataccctttgctattacagcctatggaactgctgcaatgctacttgttatagtctggaaaccttacactggttttctgtctatctctgcaatattgaggattattatggtagttgaagcagtatctgccgggggaggaggagacggagctacaaattccatttatgatttgtttatactttatattgatggagctaaaatatcgcaacaaatttaa

SEQ ID NO: 80205 - DNA, 94 bp, Glycine max
  Peptide Sequence Number=SeqID_171890
atggcgacgaagtttgacattgagaagttcactggctctaatgacttcgggctatggaagatcaagatggaagcaatcttgattcaacaagaat

SEQ ID NO: 80206 - DNA, 258 bp, Glycine max
  Peptide Sequence Number=SeqID_171891
atggaaaagacttggcccgatattgtgattaacaacatggttattacaaatgatcaccaaccaaactctgcagaagttaccaagggaatgattaaccatttcagtctgattgttagtttttggatggtaaggactgctaaagttgaggctgggtataaagtatgtcattttgcaaaagcaatccaccacaacaaaaatggaattatgtctatgctgagtatgtgggaggcccaatacgaaatctgtagaagcaaataa

SEQ ID NO: 80207 - DNA, 84 bp, Glycine max
  Peptide Sequence Number=SeqID_171892
atggcggatgcaggttttagagagataatgtgtgcatatgagggagatgaaaggtggcatggccaatatgaaaaggtgaaataa

SEQ ID NO: 80208 - DNA, 333 bp, Glycine max
  Peptide Sequence Number=SeqID_171893
atggggcaaaatgacataagcgggttccttttacaaacaatttatcgtagggggtttgttttgaaagaatttccggtgaagtgtaaagcaacccaaagggttctgccaatcgcactggcgagatacccccatgccatccagcccatccatccatcatcgccagcccatccatgcatgcttggtttcgccagtcaaactggtgagatcactttaagttggttccgccagtcgaggttgcaggatggccttggtccattggttctgccagtgatactgacgagatacaacccgtgcagtgcaacagtaacatgcatgagggtaggttcagtatag

SEQ ID NO: 80209 - DNA, 468 bp, Glycine max
  Peptide Sequence Number=SeqID_171894
atgattcctccatctggtagattcgagggattcaatccctcaatcaatgaggccataaacctgatccaggcagaaatgatggactacattgccatcaaaataacaacttgcccaagcaactttactgctcagaattacccatgccatgttatgaaactcttaccagaggatcatagagactatccctgtctatccaatgatgaatacgaaagttgggatgtacagggtaatacacagtatcaatatagtctcatgagggcacaaattcaaggttacaagtggttcttctcagaatcaaataaacagaaaaaagataaggagatttacgaagccagcggatgtcatggacaacaaacccctcctttcccatccatcgacctctcaatggaagactcatccgacatcttctgttctgggaatatccaagacgaagaagatgttactatcacaaaatcaaccaagaattaa

SEQ ID NO: 80210 - DNA, 135 bp, Glycine max
  Peptide Sequence Number=SeqID_171895
atgtcagcttcagtgcagctccctgtttcgctttctgggatactacttgtttgtgtggatctgaaatttaccggcaagtgcacgagatcgtcaagctcaagtactaaacaccgatgtctcgtgagtttagcctaa

SEQ ID NO: 80211 - DNA, 363 bp, Glycine max
  Peptide Sequence Number=SeqID_171896
atggatgattttagtgaacatgaggatcaacagttctttgatcacatcaatgaccaaagcgatgacgagggtgttggcggaccaacgtcacctccattgaaatatcaccaacctaggtgttcaatggagttgaaccttgaccacctacgacaccattttgttcaacaacaagatagtgtacaaccaccaaccggtgcactcgagataggcacccctcgagggcctacaacaccccaactaacttatggattcaggaaacatcccatttcttctacctgcgccacattgcacaaaatttccttcgcgatacgcatacacggagaagatgcattggcaacatcttggggatatccgtgcatataa

SEQ ID NO: 80212 - DNA, 87 bp, Glycine max
  Peptide Sequence Number=SeqID_171897
atgacggcgactttttctagggttttgtgggacgctgagcttgtcaaagtagcggagaagctcggggccgttgagggattggagtga

SEQ ID NO: 80213 - DNA, 285 bp, Glycine max
  Peptide Sequence Number=SeqID_171898
atgttcctcatattcaacactagtgctttgaaaggacttgatgatactccacaaccgaaatccaaggctgctgctaggtggattgttgttaagtgtaatagacaaaaaggaatcactgaatgtggctactacgtgatgcactggatgtccacgataatcttaggatctttcaggaataattgggagacgtattttaatgaagttagaccattggaagcagagagattcaaggcacttcgcatacagtgggcacagtattatctaaaagttagaaatcaaacatag

SEQ ID NO: 80214 - DNA, 645 bp, Glycine max
  Peptide Sequence Number=SeqID_171899
atgcaactccaactcacactctccagtctcttcctctcccttttgttaacaataacattaacatctccaaccttggcagcacaaagcaagccgcaggatctggtccggtcctcgtgcgtgcacgcgcggtacccgcgtctgtgcctgcacaccctctccaactatccgggctccgccaacacgccattagacgtggcccggacagcgctgaaggtgagcctagcgcacacacgccgggcctccaagttcctgcacgcgctttctcatgacgattcaatcatcatgagaaagcgtgagcgctccgcgctgcgagactgcacggagcagatctcggactctattgatcagcttcggcggagtctcgacgagctgcagcatctccgctcggagacattccggtggcagatgagcaacgccctgacgtgggtcagcgccgccctcaccgatggcgacacctgcctcgaaggcttcggagggaatgccaggcccgacgtcaaacggagagtcacggatgttgcgagggtcactagcaatgctttgtatatgattaatcggctgggtcaaagtaggaccggaaagcccaagtacaagcccaggcccaggactcagcctggctctgcctcaagtactgaaaaattgaattag

SEQ ID NO: 80215 - DNA, 319 bp, Glycine max
  Peptide Sequence Number=SeqID_171900
actacggtgtgagcaacacttttaatgttactgacttgactctttgtgatgtagatacctttaacatcaattcaagggcgaattcttcccacgaagtagggtatgatagaggactatccaaggaggaagagtttgacttacgtgggcttaacatggatggaccaatcactagagcaaggagtaagagatttcaagaaaagcttgagccacgtggcctggaaaacgccactcgtagtggcgagttgcctgcaacctgcaagtcgccagtccttctggcgagtctgctctgcgtcttagaaaccgctagtttgactagcgg

SEQ ID NO: 80216 - DNA, 258 bp, Glycine max
  Peptide Sequence Number=SeqID_171901
atggatttttacaaggttgaaagaaatatcaaggaccgcaggtcgcttggggactggagtaagaaagcgaataaagggtcgttggcaaacactgttagagtggagaataagaactggcaaggcaccttggctaagatgatgatgatggagcacgacgatagaggcaatgattggcaaaacaatggcagcgacaataacaaagatggcaacgaaaggctagggctcgagagttttgggcataaaaacgggacaatgtaa

SEQ ID NO: 80217 - DNA, 672 bp, Glycine max
  Peptide Sequence Number=SeqID_171902
atggctgggagaacaggacatcatgatcataactttagtatggtcacatcggtggatgaaagaaagggtaaaagtcctcattcatctcaagaagctttggaggtattggagtttaataggtttgttgaggatttagagctagtagtggatgtgccaattgtaggtggaaagttcatgtggatcagtgcgggggctattgaagaagggtggaatttggaggtgtacggagatatggaggcaaagaggaaaaacctggtcctcttaattaatgagctatataagaaggctgaagatggtacgataacgaattcaaaggattacatggctaagagacggcgactcaaatataagcttttttcacacaatagtgaattagaggaggagaacaactcaataaaaggtccatttgtggatggaagttgggtggaggaaccaaaggtggtcaaagcgacggtcaaaaagtattttgaagaaaaaattaaggaggaagatgtcccgctagtgaggttagatgatgtcagattcacaaaactagaagatcatgataatgtcactcttacagtagagtttacaaaggaggaggtcagacaggcaatatgggagtgtgatggcaataaatgccaaggcctgatggttataacttccacttcatcaagaagtgttggagtttga

SEQ ID NO: 80218 - DNA, 336 bp, Glycine max
  Peptide Sequence Number=SeqID_171903
atggttgtcaattacaagccatcctctttgcatacaaagcacatgcataggggtgttctattgcgggatgccagtattggcaaaggagctaaagaagctatcactggagctgagccacaagacaactacacgcttcgagtttcacaaggaagtactattcaagaccttttggagcagcaaggtcttgatcaaacattagaagatgaaagactgacttctataaatgaaactgagtggactaagatccaaaggaggattgtgagcacgattcggttagcccttgctcccgagataaaacacaacgtgttgaaggagacaacaccgaaggccttgtga

SEQ ID NO: 80219 - DNA, 560 bp, Glycine max
  Peptide Sequence Number=SeqID_171904
caccggcgagtttgatttgccggaaaattttgatgcctcgtcgccggtgaccggaggacatgcgtatggcgccatgctgccggtgttcctcaacgacctgaggagtaatcatcacaaggagcttgttgagatcacgctggagctcgaaaacgacgccgttgtgctctgcaacgtggcgccggcgccgtcttctgctccgaacgcttcgccgtcgtcgagcaccgccggcggtgatggaagcggcggaggcgtggcgcggagtctttcgattacgtcgaggattcggaggaagtttccgtggctgcggtcgatgtcgtcggcgtcggtggagagtgccgccgccagcgtggaggatccgttggtgacggcgcgaaacgcgcggaaaatgagagtgaagcttgagcggacgaggtcgagcgcgcagagagctttgaaaggtttgagattcatcagcaagtccggcgaggccacggaggagctgtgtcggaaggtggaagaaaggttcaacgtgttggccaaggatggcttactcgctcgtgaagactttggtgaatgcatag

SEQ ID NO: 80220 - DNA, 264 bp, Glycine max
  Peptide Sequence Number=SeqID_171905
atgttgtgcaaaccacctttgaagtgtttgaagattgtgatcatggctaatttgcttactatgttttttgttatggaaatgatagtagtgaacggtttcaatttcggagcaagtggcttgagcaagaattactacttcttgagttgccctattgctgaacttgttgttaagaacactatcaacagggctctgcaagatgatcccaccctagcagcaggtcttgttagagtgcacttccatgactgttccatgatccaatgctaa

SEQ ID NO: 80221 - DNA, 507 bp, Glycine max
  Peptide Sequence Number=SeqID_171906
atggacctctatcctatgaacctccagaccaaatttcgaaaagatccaacggtaaacgatggctgggaagcatttttaccgagacagcttcatgtaacttccttgagaagcttcattaagaggcttcctcgagaagcttcctccttaactagccttcaacgacttgaagaatgcaattacgacagctctggtcttgcttctgcccaatttcgcactaccctttattctggaaacaaacgcgtccaacgtcagaatgggtgtggttttgtctcaacagggtcaccctattgcttttttctgcaaatccttcagtcccaagctgcttcatgcctccacctatgtccgagaactcttcaccattactactgcagtaaagaaatgacatcaatatttattgggccatcacttaatcatcctcacggaccatcggagcctcaaggagttgatgactcaagtggtgcaaacaccagagcaacaaatgtatttagccagactgattggctatga

SEQ ID NO: 80222 - DNA, 521 bp, Glycine max
  Peptide Sequence Number=SeqID_171907
ccaataactgtggcagcaagatcatgatcaccgcacgaaaatctgatttagcctttacttccagcatagaatccaattataaggtgtataacttgcatcccttgaaagaagatgaggccttggatctatttcttaggaacacttttcagggtcattcatgcccctcacatttgattgacatatgtaaatgcatcttaagaaaatgtggggctcttccccttgaatttgttgcaatcagtgatgtcctagctacaaaagacaagcacaggatcgatgaatgggacatgattttctgtattcttggagctaaaattcatggaaatggaaaacttgataatttcaaaacaatactcaacctcaatttcaatgaaggattcattaaagccaaagaatggaaaacaaagaaagatgttgcagatgattacctcaaggagctcctgaacaaaaacttgatacagggatcatgtgtcaagaagctttctggaaaaccaaagcttgatgacaatagagcaacaaagtaa

SEQ ID NO: 80223 - DNA, 351 bp, Glycine max
  Peptide Sequence Number=SeqID_171908
atgaaagtctttggtttggaggagttgcatggtggcggggcaggtgttgttgtcggtctcgagccagcgttggatgttggagtggtcataggtgactctggtgcagaggatgacaagggatttcatgaggatgaaggagatagggcacttgaagaacctgtgaataagatgaagagggcaagggatgatatctatggacaaaaccaagtccctggaagtgggggaggaggcggtggaggaggcggtgacaatcaaggtgttgttggtggggtagcaactacttcccaaaagctgactaccaatgatgttttatcttatttgaaggaagttaaagacatgtttcaggactaa

SEQ ID NO: 80224 - DNA, 348 bp, Glycine max
  Peptide Sequence Number=SeqID_171909
atgaattcagcaataggaggggtgccaatagcagaagagaaatgggctgcacgaagccacacgcttagcgcgcgtccaagcgctaagcgcccagatgacctcccgcaaacgtcgagttgtgcccacacctggggaagcattaggttaggactcctcccgcttcacctcggagatcgcttggcacaggtggtcagatttgacgctgagacgattaatgatttcctcgacaccccgatcatcctcgtagatggggaagagcacccagcctactcccagtacctccgcactcctcccgatcatgacaccatcctttccaccttgtgcacaccagggggcgttttgtgctga

SEQ ID NO: 80225 - DNA, 183 bp, Glycine max
  Peptide Sequence Number=SeqID_171910
atggggagggcaagtgagggtgggggaactcgtggaagagagtggggtagtggtggaggatggggacagttaggccgaggaagaaggaagaaggaagaaggaggtagagagaaagaccaaggtttttcgagggaagggagacaacgctcaaacgacgccgttttgaattttaacaatttttaa

SEQ ID NO: 80226 - DNA, 252 bp, Glycine max
  Peptide Sequence Number=SeqID_171911
atgtcctttgttgtctcatgcgatgatgcatggaccaaactaaagaaggcttatgccaatcgctctcttgctaaaatcctgtccttcaagctcaaggagcagcttgccacgatctccaaagagcaagagtattggtgttcagaattcggggatcctttcactgcacacgatcggaaccaaccggttgtcgtatcttgggagaggagtgtaatcaaattttcctaccagtgcagtggggcgttttctctctaa

SEQ ID NO: 80227 - DNA, 207 bp, Glycine max
  Peptide Sequence Number=SeqID_171912
atggatgaacatcaacaaacctggaaggaaatgactaacataatgataaagattaacaaagaatcaaatgaaatgttcaacactgttcatgttattgatcagctttatggtgaagtgggatgtgccgagtaccatgtactcatttatgaaagccgcaagattcattcatctgaacttggaagggatgaagtgtatactagtttataa

SEQ ID NO: 80228 - DNA, 141 bp, Glycine max
  Peptide Sequence Number=SeqID_171913
atgatcgcggtcacgattcgggaaaaaggtcactttggggcagttgcagctcgcccaggcgagctgaaacttaaccttgaagcaatgagctcgcctaggcgagctggagctcaccctagcaagttggtttcttcaccatga

SEQ ID NO: 80229 - DNA, 1224 bp, Glycine max
  Peptide Sequence Number=SeqID_171914
atgacaaagcaaaattttcctttgggttgctctgttgtttgcataagcataatcttaatccagttcattgcttcaatgaatttcagcacatcccagagcttcaaaaacgaaactagtagtatcagtacaactaccaccactactaaggcctttttcatatttggcgactctactgtagactctggcaacaacaactacctaaatactatccctgagaacaaggcagattacaaaccatatggacaaaacggcttttttcaagaacccacgggaagattctcagatggtcgtgtcattgtagattttatagctgaatatgctaagctgccactacttcctccatttttacaaccaaatgctgattacagtaacggtgccaactttgcttctggtggggccggtgttcttgctgaaacccatcagggactggtgattgaccttcaaacacaattaagtcactttgaagaagtgacgaaattattatcagaaaatctaggagagaagaaggcaaaggaattgatctcagaagcaatttatttcattagcataggaagcaacgattacatgggtggatatcttggtaacccaaaaatgcaagaaagctacaatcctgaacaatatgttggaatggtcattggaaacttgacacatgcagtccaaagcctatatgagaaaggggctagaaggtttgggttcttaagtttgtctcctttgggttgcttgccagctcttagagctctaaaccaagaagccaacaaaggtggttgttttgaagcagcttctgctcttgctctagcacataataatgctttgagtaatgttctcccaagcctcgagcatgtccttgaaggattcaagtactctaactctaatttctatgattggcttcgagatagaatagacaaccctgcaaattatggctttaaggatggagttaatgcttgctgtggaagtggaccttatgggggtgtcttcagttgtggaggaacaaagaaagtcatagagtacttcagcttatgcgacaatgttggtgagtatgtatggtgggattcttttcacccaacagagaagatccatgaacaattgtctaaggcattatggaatggaccaccttcctcggtagggccatacaatttagaaaacttcttcaacaaagagatcaagctcactattgctgatgtagttgatgctccacaaattcagaatggagaatttcactactga

SEQ ID NO: 80230 - DNA, 441 bp, Glycine max
  Peptide Sequence Number=SeqID_171915
atgtctgtacacggccctgtgatggaggatgatatttttactctatggacatggttgaagggatttgagaaggattttgacaggccctatagctactggtcatctaacatgtcactgagacaaacaaccaccgtgccaaaaggagacagaaagcatcagggaggtagacaggtgctaatcgtcgaggtagggatgggggaggcagcagatcttggagcagggaaagaaaaaccttcacattctcctcagattcaattgaagaaagcagaagtgtgtaatacaacagtgctggatgaagttcaacagcaatggaacctcgggaaagccctaggtcttaaggttgacacagaccaatctatctatatccaaaactttgccaacatggaagtccgtgataaggaggaagctatggagctgggaaatagaaaaacttgcagatga

SEQ ID NO: 80231 - DNA, 576 bp, Glycine max
  Peptide Sequence Number=SeqID_171916
atgggttgctaccttgaaacccctcagtctctcaccgtcgtggtttcacctttgtgtagccgcgcagtgccaccattgtcgtgttctcgtgtcgccgtcaacgttgaaggtgtgaaccctcactctcactttcgcctctgccatgccgcgacgttgaaggtggttcatgctggtcaatatcctcttgacatttataataggctatgccttaggatggatccttatcaaattaacaaaggctcccaaacacttggaagggctaataatgggtgtctgttttgtagctatagttgcatcaagggaattcaagattctcctctgaatacaaagatcaagctgtgggagtcttgtttctggttctttcgctacttctttgtgatcaagaacattcaagaaatcatgtcaaacataatcaggattgagaaattcaatggaaagaacagcttcaatctgtggcgcatcaagatgcgtgctttgttgaaggaacaacgtgtatgggctactgttgcttctgcatctgtgaagaccgaaatggcttctgactcaaacagacaagacctctatttcaaagactga

SEQ ID NO: 80232 - DNA, 438 bp, Glycine max
  Peptide Sequence Number=SeqID_171917
atgtctcttgcaactctttttggaaagcttcaggaacatgaaatggaacttatgagactccatcaacatgaagagaatgacaaaaagaataaaagaattgcactcagagcctcatcatcttctattcaagaagaaagtgacaaagaggacttgaatgaaatagaagaagatgatgatttcagattttttgtgaagagattcaataaatttatgagaaacaaaggaaatcaaaggagatcaaataccaatccaaataagaaaggagaaaattcctccttagccccaaaatgttatgaatgcgatcaacctgggcacttgagattcgattgttctgtctttaaaaaaataatggaaaatctgacaagagaaatttcaaagaaaagaaataaaagaaagcatacaacacttgggaagataatgcatgaattcttcaagtga

SEQ ID NO: 80233 - DNA, 1224 bp, Glycine max
  Peptide Sequence Number=SeqID_171918
atgcctaaaaaaggggtgaggacccctgtgtttctactggaaatcgtgatgtatgcgctaagcacgcctgctgcgcttagcctgttcatcgcagctgttaaatctttggatttccagatgatcacgctaagccgaccatgtcgcgctaagcgcgataagcgcaccctatgcactaagcctgaatgttattctggtgaggctgagctaagcgtgccctactgcgctaagctcaagtcctctactgaaaggtacacagacataatggtgcctagaaagatacttccagagagaaatgtggtgatataccacactgagttcgatgatttcaaagaaaagattgagagaagaaattggcatgaagagttgaccagctttgaagaaggcagcattgatgttgccattgtaaaagaattttatgctaacctctatgatctggaggataaatcaccaaaacaagtgagggtcaaaggccatctagtgaagtttgacgaagacgcccttaacacattcttgaatacccctgtgatcattgaggagggggaaacactatctgcttattccaggtttgcactcctgaggcctgatcctcaggaattggcagccaagctctgtatcccagggaggggatttgagcttaataagaactgctggaatcttgatgatctaacagtgacttttaaaggacctaggaaggccaaggggaagaaatttgagactctcccatcttctaaggttccccctaccacatcagcaccagcttcttctaccctagctacctctgctccatcaccaactcaactaccagttttagctctttcttcttccggaccatcatatttttcttttacaccagagatgctacatgctatgatgcagagcctacaccgagggcagttggattggccaggagtccagccttctccttctggagggggtgggacctctgcagcccaagagcctgagcccacagaggaggatacaccagcagtagaggatgatctcactcctcctgagccctttttatttgcttctaattcagttgtggctcatgaggaagtaccttcaccagagcctatttcagagccatcccctacacctatttctgaggataccctgccatccgcaccagcattggagcaagagcagcccatttcacaagatccaccagctgctccagtgctggatcttaatgagcatgcagaggatcacccacaggaggattga

SEQ ID NO: 80234 - DNA, 297 bp, Glycine max
  Peptide Sequence Number=SeqID_171919
atgaaaaaaagcattgagggcttgttctctactgaatccttgaggtggattgcagaaaacaacaacgactcatggtggccaccaatggtcgtgggtggtagagaagcagctcgggagtccacttttagcgctaagcacaactttttgcgcaattccttttgcgctaagcgtgacaattcgcgctcagcacaatttccttgggttggaattgcgcttagcacacttcttacacaaagagagaggttaaaaattattattttggaaatcccaacggtcagaccatggggcataggttag

SEQ ID NO: 80235 - DNA, 1806 bp, Glycine max
  Peptide Sequence Number=SeqID_171920
ggtcatgtaacacggtatggaactcctttgagactcaggctgatcaccatgggatggggagctgcctgtgcacaacagggtgacctcgacacatgctgcctagtttttctaagtgagagtgtcgtgtggacatgcttaggctatttccttgatgaatggacagtagtggagtacttgaagttagattcttttatggagctgccaagccgacatgatgacaatggtgatatcatagtgccaaggcgggtcgttacaacctgcaaaacaaatgactctaacgctcaaggttcaattgaacctagtacttataggagtggaatggagctatgggtccttgtttttaagggaaaaagaggttgtctagtgttgaagtctggtgtccagggtagtagccttgacaagtacgagggtgacaagcttgttgagcccccaagtgaggacaagtgttgtccggtgtcaagagcagtaacctcaacaggtgtgagagttgcaggttcctccgacagtgaatcctcttcctcagagaagttgagggcttcgtgtcgtactggtggaggcacctctcgcctccacgggagggtgcgaccttccactacttccctaaccaaggagcctatctccttcacggtggttctcccctcttctgactacaagattggttgggtatccttgaacaacgtgtccaagacgttttttgagtttgactcaaatgtctttcgcagcttcaagaaatgtttcttcaaggtcctggctactgatgtcgtgcctgatggtttgccacttatgttcaacagggacggaattatgggtaactttcgttggaggccactggtgaagcaggtcaatcctgctggtcgaaccgtgccaccatctgttgttccccttactgctaaagaaaggggtcaacttgctggtgaggttggccctgttgttgttactgaggtcgtccctagtcacccttcaagtttgcaagattttcctctggctctgtcagccgtcgaggatcttgctcctgctactgttgttgctgctacttctgctccttcacctcctcttaccgtacctattcgggaggttacttctgccactagagttagtgcaccaactacatcggttggttctattattgcatcctcgtcaaccattgtcacacccttgttgagtgtcaatcgccttcctcgtcttctcgtcacagtctctttggatcacctgtacactttcaatgatactgattcaatgtggggtgtgaattacaagttggagcagaagacccctttgataaaaacctcattcgatcagttggggttcaaaacactatggactccgccaaagtcttccttcagagaagagttccctaaggtagctaacgccaacatcgccttcgctgaagctataaagtcaaaccatcagttgtcttccatggaagagaaaaacgacttggctgacaaggtggaaggcattatggcaaagaggaacgagcttgctaaggtggatgtcaatttggaggcctggctgaaagagttagagtccaagcaagaggagttcgagctactggtggcaaaggagaggggggccagcaaggagcttgaagatgatttgataatttacaagaatgaggttatgaggcagcatgagaagggctttcaaaaggccgccaggcaggccgagttcttcaccaaggatcttgatttgggtctttttgaccctttcaaggatgtgaaggacagtgttttgcttgacaataaagaaattgctacggaggaggaggctgttaatgaggagcagggttctgaggagaggcgatga

SEQ ID NO: 80236 - DNA, 267 bp, Glycine max
  Peptide Sequence Number=SeqID_171921
atgagtggtcatccagacctaacaaggaaagtgatgacgaagaaccccaataaagtaaaggtgcaaggaagaaaacttcaaaaaaacccaaaaatagtcttgtcatcaagggaccaaccttcatctcttcctcaaatagaaccttcccttactctttatcccaatacacctattcctgaaacttcagcagcgcaatcaaaacttgtagaagaatatgcttcgaacgctacacacaccagcactgaagctactgttcaaattcaataa

SEQ ID NO: 80237 - DNA, 1674 bp, Glycine max
  Peptide Sequence Number=SeqID_171922
atggcctcttcaaacaccccttctactgagattatcccaaccatggaaatcaccattatccacatatacaatgagtcatccattaatatagaacacttttttgacattcacgaactcaaaaaagtgggtctaaagcttaatgagactctattgttctgtgtcaacaagaagactatagcatccaaggttttgggtgtcaaggtggtgttgtctagtgacactattgtcaaggcaataggatgtctgcatgaaggtagtacttatcaaggaaaatgggagaagaactatgactctcgtgttacaagagcactttactgggagaattctgacaagaaagtgaaaatctgggccaacattttgaacaagagtgctcttcacatagcagcttcaaaaacaaccttgtctaacctccacaacttcatactgtttcacttgatgaagaatctcccctttgaccttccacacatcatctacatcaacatattgaggaacctaaagggcttagaacaaagtttgaagaagactccattggtggacctagatgctatcaataaaaggaaacagaagaggctagctaaagtcattgctgatgaagaccaagacctaagtgagactgatgaaggtctagtacaagcagtccttcaaaagcggaaaatagctgctctggtcatttcctttactaggaacaaggaggatccaacctcttcatcctcattagatactgagtccacgaatgacactcttatctctcccctctgtaaacatgctccatccactcaaccacgtacactgccatcacctcttcatctggatagattccgaagggttgccccaagggaagccttaatagatgctaagaggtttcctttggcatttactaatggtaatcctactcctgagaccctatattctaaacttatattttctaaacctatggcaagggaaaacatcattgtccaagcgcctacctggatgaagcatgactgtgagcatactctatctgaatccttcaaggctctacctacaaatgccatagttcatcttcgctctcctcaatggactcatccagtggccactgatatcaagatgtctgctaataaagtgagtccacgtctaccaatttgggatgtagctaagaagaacaaatttgagctttattacaatgaaaagttgcccagaaggaaaataaaggtggagattgctaattttccctcctccacttctggttatgatggaagtaacaatactaagcaccgcgatgtcattcaggtgttatgtcctgttaggaagtatcactttgatgatgcctctcaacagaggaaaaaggccaaagaagaagttggtgttgttgctgagaaagaaaatgttgcctctatccaagctaaagcatttgctaaatctgtggatgacaccattgtacctgggatcatcattgttcttacgaacactggtgtgatggacgaaactcctgaggagtccaatatagttatggctgatgaagttgaacacaacgttatagaacctacgtccaagcagtctaaaacttcaaatgtggctacttctagagataagggcgaacctgatgctatcatagttactctaccagttccggcctcactcctctcaactatgcacaacccaccactgtcactagagatcaagtacaagatatga

SEQ ID NO: 80238 - DNA, 171 bp, Glycine max
  Peptide Sequence Number=SeqID_171923
atgtgcaagactcttgtgatgaaaggtgaagatgatgattcatacatggacacttatgttagtcctttgtctacacaaatgacttctaacagcatcggagaagaagaagctgatgacgttcatgctaatcgtaatgatcatgatgaaggagaattaattaacatcgtctaa

SEQ ID NO: 80239 - DNA, 318 bp, Glycine max
  Peptide Sequence Number=SeqID_171924
atgaagctcatttacccgagcttgatgactcaaagactcaagaaaactaggaacaagcttgcaataagaagaagcacggctgaactccactctctcatgtttgaattcgtgcaaaatgaagggatgaaggctccaaaagatttttttcacaaagaccaatgtcgcaacctacccttttgcgggcgagcaaggcgaggctcacgggtcgacaaaagcggggctcttgctcctacgtaccctccatcgaagaggaaatcagacctacgtagttctttcaaaaggggcgaatcaagtgattcttttttacttggaaggtag

SEQ ID NO: 80240 - DNA, 462 bp, Glycine max
  Peptide Sequence Number=SeqID_171925
atgggctacgtgggagtacgtgagctcagttggaggtgggcaataggggatggtgggtttatgcgcgatttgtggatgtggaaaacttgttgtgcaccatcgcccgaccgccacctaagtggtacctggagatatgtcgcgggggtcaggagaccttggggacgtcaggcgagctcttggcagtcaacagataaaaggaacaaataccacaaagcaaggaggcttgtgtggtggctggccagctgtgaatcttgtgtgatatataggttatggcctctggtaatcgattaccaagggcttgaaaacgaggttgtggaggcctctggtaatcgattaccagtctgtgtaatcgattacacagaggaatgggtcactggtaatcgattaccagggatgaaaagccttgagataccccttttacttgcatgtagtggttatgagacgcattgtgttgcggcgtag

SEQ ID NO: 80241 - DNA, 237 bp, Glycine max
  Peptide Sequence Number=SeqID_171926
atggcaatgttgggttggtccaaagtttcttgcataattgttcagttttcgagctttgtcgagctccttagcttcgataggatatcgaccctatcattgtcaaccctggggaaaactgccaggaaaccacattacaagcgaaacctcaaagagagttgggcttcgtcctcaaaaggaaacaacaccagaaaatctagccttccatggattcaaacagaaaacgcaaatgaaacatga

SEQ ID NO: 80242 - DNA, 158 bp, Glycine max
  Peptide Sequence Number=SeqID_171927
atgactttatggaatgacagtggggacccaccaaccctggagcagatgatggagcaaatggaatacattaggagacagatggcacaaatggaagacataaggagggagaactggttgagcccagcaagtgcaccagatcacgcaagtagtataaaatg

SEQ ID NO: 80243 - DNA, 525 bp, Glycine max
  Peptide Sequence Number=SeqID_171928
atggaggtaggacaccttctcttaggtaggccatggcaatatgatatgaaaatcatctataatggcctaactaatgagaaaaccctcgcccaccttgaaacaaagtttatgttgcatcctcaaaaacctttacagctaagaaggaaagtcattgtgcaacaaggacaaacattcaagaaacttcccttcttagacaacctccacatcttctccttttttaaagaacacttgttagcactaccatatctcttgagcttgaggttattcctcaggtattacgaggcaccaaatccctatgataggtgtgagcaaggagttaccacaaaccctaagagaataaagctcattcctgaatgtcccactccaacaagtataagggaaatttggggcttccatgacttaacaaacttttacaaaagtgttgagagaagaagcccagagtttgaaaaacctctggatttgaggtcaaatccttttcaaggaggaagggatgatgcaatcctaccccccaagggcattggataa

SEQ ID NO: 80244 - DNA, 1056 bp, Glycine max
  Peptide Sequence Number=SeqID_171929
atggcagaatcctcaaagaagagaaagggatcctcctccaccaccaccactgcaggccaacgccgccacggcacatccgatgacccaccaacatcaaatcctccttccttttcatctcccaggtcattaactttgttttctttcaatgaccagcgccagaggtattattcccaattctccaatcgtgttattcttgaccctaagtatttagatggtgaattctttgatggcgaaacatttgattgctaccaagtgtttcaaaattctgaattagttgaatttatgtctctaaaattgccatattatcctgaattagttagagtcttttacaataatctgaaaattcaggatggagtcattttttctgaggtgcatcatatccctattattattgatcaatccctattttattctttgactaaactgagcagtcagggtgtttcttttgagggcactctagttgatgactggaaacatgtctattctaatcatgatgctcgtaaaatggtctgcactgaccatgatgatatgactggcagattgttggctgggtccaccaatcttgctcaggcctctgaggaggatttaatcttgttatcggctcttcaaatcggtcgccaaattgattgggcccatcttgttaggtaccgaatgcataaggcattacgggccaatgcacctcttccgtatcctcatcttgttaccttgtttcttcaacatttcaatgtgcctttagaggatgaaccttttgttaaggttaaaagatattttgctattggtgttggtgctattacttcttttggataccaaaaagatatggatggccaatgggtgcgtaagcaagacctgcctcctcctattcccgatgaacgtacaccgtctccaccaccgcaatgggatgcctcttcctccttattgactgaagtcctcactgagctacgggatcttagagcttttgtcgatgatcgctttgatgcaatggactcccatatcacgcgtcttgaagacagcatgagtttcatccgacgttgctttgatccatctaccgattattag

SEQ ID NO: 80245 - DNA, 330 bp, Glycine max
  Peptide Sequence Number=SeqID_171930
atgataaatcttttggaaatgcagcgggaaagtcttggagggagatggagatttagggtgggggggggggattttgcgtttaaagaaaagttcaaggggcttaaaaaagttttaaaagtatggaatatagatcattttggtaatgtccacaagaaattccaagagatctctaaagaaatgaatattcttaatgtaaaggaagaaggaagggcattgatcgagggggagttgagaagaaggattgagcttcaagggaatttttgggaggcactttgcaaccatgaatctcttatgaggcaaaaatcaagagctaggtatgtaacatcctaa

SEQ ID NO: 80246 - DNA, 840 bp, Glycine max
  Peptide Sequence Number=SeqID_171931
atgtcggtggcttcttccttcctttcacttggaggcgcatacctccacggaactgcgtggctgttttggtatggaaacagaataggtttaattaccgaggggtatcagggcatttggggagctgcgtctctagtgaaatatatcactacaggcttaggccttccaaaacctcccttggtcttggggtatcggggcatttggggagctgcgtctctgctgctcttcactcccctcatcgccgacttccagccagccttggtctatcatctgttgcaacagcgcgccgggatgcatcaaacaggaatctttcccgtgcccacccggggaattatgccccccttttgtagggcctcagataaacctccttggggtcgtcaagtccttcaaaggcttggacctgcgtggcctacccgactcgacggcattaactgctccccctccatgattggcaagtgggttcattttcacgttgggccggtcctcttgaaacgtcagccatccggcgtttatcaaatgttggaccttgtatttaagggccaggcagtgttcgggggagtggcccggggttttcccatggtatgcgcaggttgcgtcagggaaaggaggctggtagattttcccgggagatatcacagccatctggttggcgatgagggatggcaagaggtcttcgtacgtcattgggattgggatgaatgttgtcctcgggggaaagttccttatcgtgttggaaccggcgccaaactgggcattaccggccgggcgagtcggggttggagtcgtagcttggggggtctccctctagatgggcgaaggcgccctagcttgtacgggtgctga

SEQ ID NO: 80247 - DNA, 999 bp, Glycine max
  Peptide Sequence Number=SeqID_171932
atgagcatgttaggcctgagagacctagttctcatagctcaaaccccttcttcccttcaccaccaacaccaaggccaacccatttcagaaaaccagactcacactcacactccaaaccttcctttgccttcttcagcagcttctctcagtgttggctttggaattttccctctcctcactgccacaccatgtgtgccacagcctcatcaaaacaatgaggttcaagagtgtggtggtggtggtgccaatagtaacactaccaccaccaattattggaacctcaagatgtgccaagaagtgaataatcctccaaagaagggtgtgatcaacgtggctgatcatgatgatgagaagggtgtgatggagagtgaggaaaacggggtctatgggcctgactttagggtgtgccaagattgtggcaacagggctaagaaagattgcgtctttagaagatgcaggacttgctgcaagggacgtgggtatgattgtaacactcacgtgaagagcacgtggatcccctccgttcgccgccgcgagcgcgagatcacggtggcttccggtggcggtgttggcggcaatggtggttgtaagaggccaagagctgtggtggggtcatctcaaaatgccacttctcatagttccaactctaatgctacaactcctaagagcttagctactagctcttttcatcaagatgctagcttcaagcagtctttaccgggtcatgttcgtgcaccagcagtgttcaagtgccatagagtctctgccattgggaatggtgaagatgagtttgcatacttggcaacggtccagattagtgggcatgtgttcaaagggtttctctatgaccatggtgttgatgggaaaaccgcaaatgtagtcccttgtgtctcggaactgcagctgggaaacaattgcagtgggaagaacagagaatgttcctctgcaattgcaattggggttgcaaataacaatgcataccctgcttctgcgagttga

SEQ ID NO: 80248 - DNA, 351 bp, Glycine max
  Peptide Sequence Number=SeqID_171933
atgcgtgacacgagcctccagctgatcgtggtcagccttcaactttctcaactcctcctcatggcatcgctccatctccgcaatgcggttttggagttgctagagagtatcagtatcgtgggcgccaaatgtacttaccaaaatctggagctggcacacatcaaggtggacgtggctaaggtggtctcctggacttcacacgttggactgagagtgacctttgttaggaggaaaggagggggaacctgcaaaacaaaggactttgatgctcaattgctaagggtcagatgttcatgctcttgtaccagagctgacatggaaggtggacacatgtctcagaatactaagtag

SEQ ID NO: 80249 - DNA, 234 bp, Glycine max
  Peptide Sequence Number=SeqID_171934
atgttgttcattctcgctccaattattgacttcaagctgaccaagattgatcatacgctgcaacagctcctccactgccgcgcatgtctccatgtcgtgtggcagacccaggcgtggcattactcaatcgagtgccccggggttcccccgtggtatgcacatgtaccacttgggaaagaggacttgataagttcttcccggggttactaccgccatatggatggacaacaatga

SEQ ID NO: 80250 - DNA, 324 bp, Glycine max
  Peptide Sequence Number=SeqID_171935
atgacacagtctgagaattcttttgattcttcccattccctaatacaaaagcgttcaaaggttaaaccgcctgagaattcttttgtatccccattcacaaagtatcaaagaggttacatctacttgggtttggctgagaacaagagagggtacatctcttgtggatcagttctagtggagggtacatccactaggttcaaagagaacaagggagggtacatcccttgtggatctttgcttgtaaaaggttttttacaaggttggaagaaatcccaaggatcgcaggtcgcttggggactggaggtaggcacgggtttgtgctga

SEQ ID NO: 80251 - DNA, 348 bp, Glycine max
  Peptide Sequence Number=SeqID_171936
atggccctgaggaaacttgcctcaaagagatccaggaaggataaagcggccgaaggaattagttccgctcccgaggacgatgagtataccgatttccaggaggagatagttcgctggcggtgggcatcactggttacccccatggccaagtttgatccagacatagtcctcgaattttatgccaatgcttggcctacggaggaaggcgtgcgagatatgaggtcttggggtcaggagtgcgagtatggccagagaaggaaccagtctgatgggttcgatgaggaggccatcgcccagttgctatgtataccggggcaagattttgcccagactgctgccgagagacgg

SEQ ID NO: 80252 - DNA, 137 bp, Glycine max
  Peptide Sequence Number=SeqID_171937
atggaagatattcctaaagatatccatattgcaactacaaaggttcctaataagtatagccaagttggtctcccaggaaccaagaggaggcaaggagttagaaacctaggtagggaaatagggatgatccaaccaag

SEQ ID NO: 80253 - DNA, 147 bp, Glycine max
  Peptide Sequence Number=SeqID_171938
atggcatcagcaatcacctgggccacatggacgctcatccgtgtcaggatggcatacaccaattggcacttagacagagagaggtcggagttgtggttgctaggcaagacattgctgagcagcagattcatccaaatctgggtcagg

SEQ ID NO: 80254 - DNA, 528 bp, Glycine max
  Peptide Sequence Number=SeqID_171939
atggcatataatgctagctctaaagaaaatcaaaatgtaatgaacagtcaagaaattgatgtggccaagagctactccatagaaaagtctcaaggaacacctaagttagaactctacaatcaaggtgaagcagaaagagaagaagtgactcaatgtgtggccagaatagaagaagaccttgtagagattgaagctcaagaggaaatccctaccaaagagcatggattaagaggaaaagatgaaataaaaggtgaggaaaaagcacaacaatgggaagagtacatacaacaagatattcaacaagaaagtatgctccaaatcaataactttcctcatcaattgattgtcaggaagcaaaggcaaggagagcaaaagagagcattaagtgtctttctctcccggatcaccaacccctcttctgaaatgagttggcatacacttccaaaatacatgaagttcatggaattcctagctaaaaggtggaactataaggaggatgtgttctttgtgaccttcatgccaccttga

SEQ ID NO: 80255 - DNA, 377 bp, Glycine max
  Peptide Sequence Number=SeqID_171940
ttggggcagttgatgggtcaacttcaacggaaagccttttgcaaagcctatggtaagatttgggacctaactacggtggaggatttccagctaataccaattgtggaagagtttgaagaaatcctgggatgcctactgggaggaaggaagccataccttttctcagggttctatccctccatggtcagagttgccaaggcaaaggccttggcaagtcaaggcgaatgggctcctttcattgacatcttgatgcttttgatcttcggagttgtcctctttccaaatggggaagggttagtggacctagcggtgattgacgctttcctcacttttcaccacatcaaggaaagcccggtcctcgctattttggccgacat

SEQ ID NO: 80256 - DNA, 981 bp, Glycine max
  Peptide Sequence Number=SeqID_171941
ttgggtacttcacatgccggtattgttgagttgccggccgatgttgcggtaggtacactggttaaagatcattataatattcaggatgattaccgctacgagatcggtttaacgcccaatcgtgcggatgcagcttcccatttgggcgttgcaagagatattgcggcacattcccgtacgcaactgctgaaagcagatgtttcggcattcaaagcaggtgctgcagaaggaacagctgtggttgtcgacaatgcgcaggcgagtccccgctacagcggtattaatatcagtggcgtccaggttgctgaatctccagactggttaaaagaaaaattaaatgtgatcggcgttcgtccgatcaataatatcgtagacgttacgaattacattttacatgatttagggcagccgcttcatgcttttgatgccgataaaattgctggaaataaagtccttgttcgtcttgcgactgagggtgagaaatttgttaccctggatggggtagagcgtgccttgtcttcagaggacttggtgatcgccgacgctgaaaaaccgatgtgtattgcgggtgtttttggtggtgcattttccggtgtttctgcagaaacaacaaatgtatttttggaatcggcttatttcaatgctgtttcggttcgtaaaacctccaaaagacatggactaaaaactgacgcatctttccgtttcgaacgtgggaccgatcctaatatgacggttgaagcgctcaaacgtgcggctttattgattcaggaaatcgctggtggaactatttcatcgactttaaaagatgaatatcctgtcgagatcaaaccattttcatttcatgctattccaaatgacgaaatcaaatcgattatcgtagccttggggattgaagttgctgccgaaaccgaatcgggacttgatgtcttggtaccggcttatcgcgtagatgtcacacgtgaagtggatgttgttgaagag

SEQ ID NO: 80257 - DNA, 225 bp, Glycine max
  Peptide Sequence Number=SeqID_171942
gtcacagctagacctttagcctctaagcattggcgagcattctcccaccaatactcagcttcttccaccagagtatatgtaccaaaagaaactttctacccctctggacatgctgatgcaatcctccttaggaagggatcagtcactagagccatgagcaagaggctccaagaggattgggctatagctgctgaagaaggccctagggttctcatgaacctcagg

SEQ ID NO: 80258 - DNA, 249 bp, Glycine max
  Peptide Sequence Number=SeqID_171943
atggtgatggtagatccttggacttggggatcccttgaatcgaaagtcttcttggcgtatgagttcatgcatggagttcaaatagtggctcgtgaccatgaagtggtgaagagtgaggcaatgcaagatactagagcttgttggcaacaatggctggctaagcaggaaagagacttacacttaagagggagattgttggagtacaagtatgaggtgaaatctcacatcggaaaggaatgggaaatttga

SEQ ID NO: 80259 - DNA, 966 bp, Glycine max
  Peptide Sequence Number=SeqID_171944
ctgtggccctttaccagcaccatccagtcaacggaaaacgcctacgtgcgcggccaggtgacctttatcagcccgcaggtcagcggctacctgacgaacgttgaggtggttgatttacagccggtgcgcaaaggacagctgctgatgaccattgacgatcgtatctatcgccagcgcgtgcatcaggcgcaggcacagctggcgatgaagatcgccgcgcagaataacaaccagcagcagcagaagagtgcggaagccactatcgtcagcaataaagccgcgctggagaatgccaaagcgcaggcgctgaaaagcagtctcgatttgaagcgggtggaaaatctggcggcggatggctcgctgtcggtacgcgagcgtgatgccgcgcgcgcagccaatgcgcaggcgcaggcccagctgcgccaggcggcggcgcaggtggcggtctcgcagcagaatctgcaaaccaccatcgttaaccgcgcggcgctggccggcgacgtagccagcgcacaggcggcactggagctggccaatatcgatctggacaatacgcgcattatcgcgccggacagcggccagctcggtcagctgtcggtgcgcaaaggcacctacgttactgccggcacgcggctgacctcggtggtgccggataataaatgggtgattgccaacctgaaggaaacccagctggcgcgcgtgcgccccggtctgccggtgtcgatccgcgttgatgcgctggacggcaagcgctttgacggccgcgttgagtttatctcgcccgccgccggatctgagttcagcgccatctcgccagataacgccaccggtaacttcgtgaaaatcgcccaacgcattccggtgcgtatcaaaattcttggcgacgatctgcagcagctgcggcccggcatgtcggtggaggtcaacatcgataccgccgccgaaccccaccgggagacaccatga

SEQ ID NO: 80260 - DNA, 537 bp, Glycine max
  Peptide Sequence Number=SeqID_171945
atggaggtcaacatggctacagtcgttgccgtaagtaccgccattgaggtggacccgactcacccacctggccttaatcaacattccttcccaccatatggcttgcctcccaactatacaccacctaatgtttcccacgctcctgatgagaatgtcgataactctgctcccataccctttgagagccaacatccccaatctggtcatgcacaagtccctcaacccatgggggagacacatgaagtaccccgagaccacactctagccgacttcgagcctcacctcagatatgccactgaggggcaagcatttggtggcgtacccctgccaaacactttggggggccctcagtatcgcccacaaccacaatccttgcattttgcggtgggaagagtccctcctgctatggtggaaagggagaaatttgatcatatagaggaaaggctaagggtcattgaaggaggcaaaaattatgcctttgctgacaaggtagaactttgcctagtgcccgacgtcattatccctctaaagttcaag

SEQ ID NO: 80261 - DNA, 426 bp, Glycine max
  Peptide Sequence Number=SeqID_171946
atgttgggtgcacctagcaacactcttttgttgatgggttactttgaaattgtttgtagggatatgctaggtgcacccagcaatattgctggtgcacccagcaatttattgaaaggtcaattttgcccttcatttaaaaacataaaaaactttttccctctttcggaagcattctgtcttctctcttccgcgaaaaaccttttctcctctcttctctcttccgcgaaagcaagcttccttggtggtcttcttctccgcgaggcttctccgccttcatcttctccgcaaggcttctctcttccatttgcattcgagatgaactttagggtagaggacgccggaaaaaatagcggaagcttggtgacggtgagccttccggaagatttccggaagaagggttcttccgaagttgtgtatgtttactaa

SEQ ID NO: 80262 - DNA, 279 bp, Glycine max
  Peptide Sequence Number=SeqID_171947
atgagggatccactgttgttcataacactcctttgttgcctggccaagcatctcactgaaacatgtatgcgagtggggaattctgatatttatggattcctcgagccacagtccattcattggtctaggcaatcgcagtttgagtctgaaaattacataaagagttggatgcagagttcacaacgcaatgtctatcttggagcctacctaaatgggttccactgcagcggacactggcagatggtggtcatcctgcccaaggaacaccttgttgtctag

SEQ ID NO: 80263 - DNA, 75 bp, Glycine max
  Peptide Sequence Number=SeqID_171948
atgggtgttaagtacctcgacccggtcaagcgagggtcgtatgctatcaaacaatggtccccagacgaaattagg

SEQ ID NO: 80264 - DNA, 273 bp, Glycine max
  Peptide Sequence Number=SeqID_171949
atgtccataaataaggtggcgaccttgtatgcaaaatggcgtgggggtaaagcaccaaaatgggcccctttagagaaacggtcgaccaccaccaaaattgaagtaaagccatgggactggggaagtcccatgatgaagaatgaaggagcaatcaagaggaagccaaattttgctatgataatgaaggaggtcccgtcaaatggaatattccggggtgagaagttggccccggtgtggcatacgggacaatacatctgcggcaacattgccgaa

SEQ ID NO: 80265 - DNA, 937 bp, Glycine max
  Peptide Sequence Number=SeqID_171950
cggtaccgaagccacgatgagcgcaatccgtgtcgctcgcggctttaccaaacgcagcaaaattatcaaatttgaaggctgttaccatggccatgctgacgcgctgctggtaaaggccggttccggcctgcttacgtttggcgaaccaagctcagcgggagttccaccagaagtggctgcacacaccttgacgctggactacaacaacacacagatgctcaaagatactttttccagcatcggcgatgaaatcgcgtgcgtgatccttgaaccagtcgtcggcaatatgaacctcattgttccgcatcaagagttcttgcaaaccctgcgtgaactgtgcacccaacatggcaccgtcttgatttttgacgaagtcatgaccggcttccgcgtggcattgggcggggcacaagccttatatggcatcacaccagacatgacaactctgggtaaagtcatcggcggcggattaccagtcggtgcctttggtggccgcaaggacattatgagcgtactggctccgctaggtccggtttaccaggcgggtacattgtcgggtaacccggtggcagtcactgcaggcctcacgaccttgaaattggttcaagcaccaggcttctatgaaaaactaacagcgcaaacaacaaaactcatggatggtttcaagcaggcagcacaagctgccggtgtcgcgttcagtgcacaaagtgtaggcgggatgttcggcctgtacttcagcgcccaatgcccaagtagttacgcggaaatgatgctggcagacaaaaatgccttcaatacatttttccatagcatgctggatagcggcatttaccttggcccatccgcgttcgaagcaggctttgtctcggcagcgcatactgatgcggacattgcacaaaccgtgcaagccgctactaaagcatttgctgcactttaa

SEQ ID NO: 80266 - DNA, 912 bp, Glycine max
  Peptide Sequence Number=SeqID_171951
atgattctcggcgcgtcgagcattggtttgattgtactgctggtgcagagcgtcgaaggggaaaaggaggcgattgccgcgcgtcaggccaagctggcgctggagattgccaacaaaaccctgccgctgtttcgtcaggttaatagcgactcgctgcgcaaagtgtgcgccatcattcgcagtgacatccatgccgatgcggtggcgatcactaacaccaaacagattctggcttacgtcggctacggcgagcagaactaccacaacggcgacgacggcatcagtccgaccaccgcgcaggcgatcgccagcggaaaaattatcattaagaataatgatgaggcacaccgcaccaaagatatccactcaatgctggtgattcccctttgggaaaaaggggaagtgaccggcacgctgaaaatctattatcgccgcgcccatcgtattaccggttcactgaaagagatggcggtcggtctgtcgcaaatcatctcgacgcagctggaagtctcgcgtgccgagcagttacgcgagatggccaataaagcggaactgcgcgcgctgcaaagcaaaatcaacccgcacttcctgtttaacgcgctgaatgccatctcctcatcaattcgcctgaatccggacacggcgcgccagctggtgattaatctgtcgcgctacctgcgttacaacctggaactcaacgacgatgaacccatcgacatcaaaaaagagctgtggcaggtgaaagattacatcgccattgagcaggcacggtttggcgacaagctgtcgatgatttacgacatcgatgaagatctgcacttttcgctgcccagcctgctgattcagcgctggtggagaacgccatcgtgcacggtattcagccctgttgcggcaaaggcgtggtcacgctaa

SEQ ID NO: 80267 - DNA, 669 bp, Glycine max
  Peptide Sequence Number=SeqID_171952
atggagagaagtatgatagatgctgccagtggtggagcccttggagacatgacccctgctgaagccagaaatttaattgagaagatggcttcaaactcccagcaatttagtgccagaagtgatgctattctcattagaggagtgcatgaagtagccataaattcattaggtgagactaagaagcttgaaggtaaactagatgccttggttaacctggtaacccaactggccatgaataaaaaatttgcacctgttgccagactttgtggtttatgctcctctcccgaccaccacacagaccattgcccttctgtgcaacaatctgaagcaattgaacagcctgaagcttatgctgcaaacatctacaacagacctcctcaacctcacaataggtacaatcccggatggaggaatcatcccaaccttagatggtcgaatccttcacaacagcagcagcaacaacaacaaccttattttcaaaatgttgctggcccaagcagaccatacgttcctccaccaatccaacagcaacaaccccagaaacaacaaatagttaaggcccctccacaaccttcccttgaagaacttgtgaggcaaatgactatgcaaaacatgcagtttcaacaagagaccaaagcctccattcagagcttaactaatcagatgtga

SEQ ID NO: 80268 - DNA, 153 bp, Glycine max
  Peptide Sequence Number=SeqID_171953
aatgctgtaagcgtttcaactcgaattactccacggattaagcattcttcagctgttgacattacaactgcagaagacaacttcttccgtggagactcacgaaagacattttccacgagcactcacggaagaagctgtcttccgcagttgtga

SEQ ID NO: 80269 - DNA, 753 bp, Glycine max
  Peptide Sequence Number=SeqID_171954
atggttagaaccataggattgcatcaggctttaggcaaagttataggaagatccttaggtgcaaaagttagtggtgatgcggatgaagcccctcaacggcgaaggccaacaacatctgcacgtaggcaacaaacaactgcacctgttgttgaggatgttgagaatgcagatcatcgagttgatgagatagtcctggagttttatgctaatgcttggcccacagaagagggagtgcgagacatgcggtcatgggtgaggggtcagtggattccctttgacgcagatgccctcagccagtttctgggtgacccgctagtgttggaggaaggccaggagtgcgagtttagtcagaggaggaacagggtcaatgggttcgacgaggaggccattgcccagctgttatgcacattggggcaggattttgcccagaccgctgcagggaggcgggtgcggatcatgcacaccaatatgaccaccttaacccagatgtggatgacattgctgctcagcaatgtcttgcctagtgatcataactctaatctccctctgccgaagtgtcaactggtgtatgccatcctgacacggatgagcgtccacgtggcccagttgattgttgacgccatctatttatttgcaggtatgtcactcaccaggcaccctctagacccagataagtctaacagggccatggggttttcggcattgatcacgggcctctgccagtcattcggggttcccgtcacctctagtaag

SEQ ID NO: 80270 - DNA, 148 bp, Glycine max
  Peptide Sequence Number=SeqID_171955
ggccaatagtttccttttatcagttcttgggccaccccctgatcttggaggagggccacctatgcaagtacaaccagaggaggaggctatcatgcagctactatgcataccggggcaagatttcacccgtgccgctgcaaagaaatga

SEQ ID NO: 80271 - DNA, 495 bp, Glycine max
  Peptide Sequence Number=SeqID_171956
atgtttaaggatgcccaaaatgaaaataaaaggccatattggattggagatcatgtttggaacgatctattatcacattggaatgcacctgagtatcgttccaagtgtgcacaggcaaaaaaaaatcagtcatatgaaaagggtgggtgtatgcacacaggtggttctatcaacttgcaggatcatgtcatttgcttgtcaaaggagcttggtcgatctgtatatgtagatgaggaagaatttgaggctagactatctcaagttaggtatgatgctgcatcaagtgttggtaaatcccaattcactcccttagaccctgctgaagaacaaagacttaggagtcggtgttgggttgcagtggcaggaccaaagcgtaaagtacccctttatggtactggagaccttgctcatacttacaaatatggaaatgacaacttcatgcagcatacgcaaggatcttccagtcacgctaaagatgctacaaagattaattga

SEQ ID NO: 80272 - DNA, 375 bp, Glycine max
  Peptide Sequence Number=SeqID_171957
atggaggctaggcccatgatcaacagatcgccatcccacgtccagcttcggacaccgttctcgttggtatatggaatggaggcaacagatcgccatcccacgtccagcttcggacaagcgagaagcgctactgggaggcaggctaggttagctcgcctgggcgagcacccctgcaccagaaaacataaaaacgaggggagggagaggcgtgtccagctcagggaggatgagtacacggacttccaagaggagatagctcgcatgcattggacacctctagtgactctcatggccaagtttgaccccgagatagtcctagagttctacgctaatgcctggcccacagaggagggagttcgggacatgcgctcatgg

SEQ ID NO: 80273 - DNA, 114 bp, Glycine max
  Peptide Sequence Number=SeqID_171958
ggagaagagagacatgctcaaaaagaattaccacgggcggttatttccggaatggatcccgtgaaatacatctttgagaaaccggccctcacaggacgaattgctaggtggcag

SEQ ID NO: 80274 - DNA, 366 bp, Glycine max
  Peptide Sequence Number=SeqID_171959
atgggctcaaaaatctaccctaaggttcatgagaaccctatggccttctttagtagctctagcccaagcctcttagaatcttctatccaatacccttggggggtaggattgcatcataaatccttgtgctttgttggtgcccaaaataggtattgggttcccttgaaccctaagagaataaaggtcattcatttgtggcccactccaccaagtataaggaaaatttggggcttccatgaggggatgatgcaatcctaccccccaagggcattcgatagaagactccaagaagattggaccagagctgctgaagaaggccctagggttctcataagccttagggtagatttttggcccatgggctaa

SEQ ID NO: 80275 - DNA, 72 bp, Glycine max
  Peptide Sequence Number=SeqID_171960
atggttattcccaagttcaaggtgccggactttgacaagaaccttcctgagtccattcttggaaagacctaa

SEQ ID NO: 80276 - DNA, 409 bp, Glycine max
  Peptide Sequence Number=SeqID_171961
atgttttgatgataacaaagatgatgccaaaggtgatgacaaaaagctcaaaggtcaatcaaagaatgagttcaagatgttcaagatagaatcaagaacacttcaagattcaagaggaaagttgaattcaagaatcaagattcaagattcaagagatcaaggttcaagactcaagattcaagaatcaagaaaaggctattcaagaatcaagaaaaagcttaatcaagataagtatgaaaagcttaatcaagatcaaagagtttttactctctgggtacatctacttgggttgttgattgagaacaagagagggtacatctcttgtggatcaattctagtggaggctacatccactaggttcaaagagaacaagggagggtacatcccttgtggatctttgcttgtaaag

SEQ ID NO: 80277 - DNA, 494 bp, Glycine max
  Peptide Sequence Number=SeqID_171962
tgatgaagaaggggaaaagacactcacacagtggggaaaagaagaagaataagaggtacagggaacaaaaccttgatgttgagataattgttgccacgcagaacagtgaagatggagtaatgtacaatcctcattgtaaagctgaggagatccaagggttagatgggcacagagattctgatactggagcagctatcaaaccatgtaggtcaaagaaagacaagaagaaaagaaaggaggttcaagattcaccagaaaaggagggagaagggtgcaatcagactgttatgggggataccattggagaccctctcaaagatacttcaggcccttcactcaacatcctcatcaagctcatggcagttgagtcgcttcttgctggacctgaaagggagaggcaactatcagatacagatgtccaatcagctgtgtgggaggtctgtggtgattctggagctttacaattgcttgttgatcttcttcatgtgaagtga

SEQ ID NO: 80278 - DNA, 207 bp, Glycine max
  Peptide Sequence Number=SeqID_171963
atgccaatatggctttgcctgaatccctgtgctcctcattacgtgcatccctatgttcatgcatatccttgtactcttagtgttacgtgttgctatcatgggggaccatggcgattgccactatatcccgttgatggttactggcggggcaacaaccacaaggggaagatgaggaagagtagacgtaacacttatggtgatttttga

SEQ ID NO: 80279 - DNA, 691 bp, Glycine max
  Peptide Sequence Number=SeqID_171964
atgagggcgagccctggtgcagcggtaaagttgtgccttggtgacttgttggtcatgggttcgaatcccggaaacagccctctttgcatatgcaagggtaaggctgcgtacaatatccctcccccataccttcgcatagcgaagagcctctgggcaattgataatacgtacatgatgaattcggttataacagtgttgtgtttcaatggaagggtatatgaagataatgatggtgtaatatttgaaggcagtaaaaaaacgattcagattaaacgtggaattagtttcaatactttgaagaaaaaaattggagacaaggaaaatatagtcttgcaaatttgcgatgacgaagacgttgaaacgatgctggaaagttttaaacaacaacaagaaatgtcagttctagaattgtacatagaaaaggatgtggctggtggttcaatgtttcattctgcaaattcccttacatcatgtggaaattatgtatctaatgattacacacaaccgccaacaaatatgagcaatttaaatcttgacgaagatgatgatcatgatgatgatgattatcttgtgtctaactcatacgttgaagagtcgttagacgaagatgacaatgttgacggtatatcagatacagacaatgaagtctccgacatgattccaccagtaagaattgttcacccagcagaag

SEQ ID NO: 80280 - DNA, 1309 bp, Glycine max
  Peptide Sequence Number=SeqID_171965
atggcaagagcctttggaaatttttgcctaaaagactatggtgtcgcctcagtccctgatgtgtcttacagaaatcttaccaacgaggataagtttgtggttttggcttctgatgggatcatggctgaggcagttggtggtgcgtttctctctgctttccttgatgttgtgttcgacaagctggtcaccgatgaggttgttgacttcatccgtggaaagaagcttgacctcaatttgcttgagaacttgaagaccactctgagactggttggagctgtgcttgacgatgctgagaagaaacaaatcaaactctccagtgtcaaccagtggctcattgagctcaaagatgttctctatgaggccgatgacttgctggatgaaatttccaccaaatctgcaactcaaaagaagggtcttcctttgcaagtgatggcaggggagagcaacgagtcatggaatgctcagccaacaacatctctggaagatggatatggtatgtatggtagggatacagacaaggaggccataatgaggttgttgttagaggatagcagtaatgttcttcctctaagtaaattgtcaaatgaagattgttggctagtgtttgcaaaccatgcatttccttcctcgggatcagcacgatcactcggaggtatgttgagaagaaagcatgccattagggattggaataatatacttgaaagcgacatttgggaacttcctgaaagtcagtgtaaaattattccggctttgagaatcagttatcattatctccctccacatctaaaacggtgctttgtttattgttcattatacccgaaagattatgaatttcaaaaggatgacttgatcttgttgtggatggctgaagatcttttgaagcttccaaacaaaggaaagtcgttagaagttggttacgagtattttgatgatttagtttcaagatcattttttcaacattcaagaagtaatttaacttgggacaattgttttgtaatgcatgacctcgtgcatgatctagcattatcccttggtggagaattctacttcagatcagaagaccttagaaaagaaaccaagattggtataaagactcgtcatttgtccgtgacaaagttcagtgatccaatctcaaagattgaagtgtttgacaaactacaatttttgagaactttcatggcaatttattttaaagattctccgttcaacaaggaaaaggaaccaggtattgtagtcttgaagcttaagtgcttgagagttttatcattctgtggcttcgcaagtctggatgttttgcctgattcaatag

SEQ ID NO: 80281 - DNA, 1402 bp, Glycine max
  Peptide Sequence Number=SeqID_171966
aaggacttgatcttgttgtgggcggctgaagatcttttgaagcttccaaacagaggaaaggcgttagaagttggttatgagtattttgatgatttagtttcaagatcattttttcatcgttctagtaatctaacttggggcaattattttgtaatgcatgacctcgtgcatgatctagcattataccttggtggagaattctatttcagatcagaagaacttggaaaagaaaccaagattggtataaagactcgtcatttgtcagttacagagttcagtgatccaatctcagatattgaagtttttgacagactacaatttttgagaactttattggcaattgattttaaagattcttcattcaacaagggaaaggcaccaggtattgtagcgtcgaagcttaaaatgttgaccaggttgcctactgacatgcaaaatcttgtaaacttgtgtcatcttcatattgatggtactgagataggagagatgcctagaggaatgggaatgttaagtcatttgcagcatttggatttctttattgtgggcaacaacaaagagaacggaatcaaagaactggggacactttcaaatcttcatggttcgctttctattaggaatttggagaatgtaaccagaagcaatgaagcattggaggctaggatgatggataagaagcacattaatcatttatccttggaatggtctaatggcaccgacttccaaactcaattagatgtactgtgcaaattaaaacctcacccaggcctagagtctctaacaatagggggctataatggaaccatatttccagattgggtgggaaatttttcctaccacaacatgacaagtctaagtttaaatggttgtaataactgttgtgtgcttccttcgcttgggcaactaccatctcttaagcagctctatatttcaagattgaagtcagtgaagactgttgatgcagggttttacaaaaatgaagattgtccttcttctgtgacacccttttcttcccttgaaacgctatacattggtcacatgtgttgctgggagttgtggagtatccctgagtcagacgcctttcctctactcaagtctcttacaatagaggattgccccaaactaaggggagatttgccaaatcaccttcctgctctggaaacactcaatattacaagatgccagcttcttgtctcttccctcccaagggctcccacccttaacatattagtgatatggaaaagtaacaatgtatcgttgcatgtgtttcctcttttgttggaatggatagatgtagaaggaagcccaatggtggagtccatgatcgaggccatctccagcatcgagccaacttgcctccaacgtttaagattgagggattgttcgtcagccatatcttttccgg

SEQ ID NO: 80282 - DNA, 1545 bp, Glycine max
  Peptide Sequence Number=SeqID_171967
atggatccaaccgtagcgaagcctggctttctcagaaacgttctggttcggttactcctcttcggcgttttcatcgtcgtcgtacggttcgcttacgtcatcaccctcgccggtgagtcctgcaccgtcggcgacttctgcttcttctctccgtcgatcaacctcgcaatcgccggcaccagatcaggcgccctcgcagcgcgcggaggagccgccgggccgccggagcgctatgccagcaaggactggatcaacggcgtccggttctactcgtcggctttccaggacatgatctccggtggcttcctctcgccggcggcgaaggcgctctgcgtggagacgccgaccggccgcgacgtcctcgcgctgcgcgagatcggcgtcatcgacgccgtcgggatctcgaagaaggcgtctccgccgcttgtgaaatccggcgaggctcgccggattccgttccccgatggctcgttcgacttcgtgttcgccggcgacggcgctttagaaaaatcgccgcggccggcggagttcgccgccgaaatctctcggacgctcaaacccgaagggtttgccgcgttccatgtaaaggccaatgacacttacagttacaattcattcgttgatttgtggaatttttgttgcaacgtggtgaaaataaacgacatgttagggtttgattcatccatacctcacataagagagatcgtggtgaagaaagtgcgtcacacaattgattctgaatccaattcaaactccaattccaatggaaaagaatgctctgttccggagtacaaggaaaagctggtgagaaatgcagaggctttgattgaagaggagccactgaagccatggctgactctaaagaaaaacgtgaagaacataaagtacctatcttcaatggttgatataagcttcaaggataggtatgtgtatgttgatgttggagctagaagctatggttccagcattggaagttggtttaggaaacagtacccgaaacagaacaagacctttcatgtgtatgcaattgaggctgataaaacgtttcatcaggagtatgaaacgaaaaagggtgttactttgttgccttatgctgcatgggtgaggaatgagagtttggtgtttgagattaaccgcgacccgggggagaaggagaaggagaaggagaaggagaaggttaagggtaagggaaggggaatggggaggattcaaccattgaaatcttcaggtggttttgatggtggtgaggttgagaagattcctgggttcgatttcgcagactggttgaagaacacggtttcggagaatgatttcgttgtgatgaagatggatgtggagggtactgagtttgatttgattccaagattgtttgaaactggggctatctgtttggtggatgagatttttcttgagtgccattacaataggtggcagaggtgttgccctggacagaggagccccaagtatgagaaaacttatgatcagtgcttgcagctcttcacttctctcagacaaagtggagttcttgttcatcaatggttttaa

SEQ ID NO: 80283 - DNA, 96 bp, Glycine max
  Peptide Sequence Number=SeqID_171968
atgagttacgcacgtatggtgtttgatgaaattcctgacccaaagcttatgcttagtcaaggacatgtagatgttggtgttaccaacttggtttga

SEQ ID NO: 80284 - DNA, 1464 bp, Glycine max
  Peptide Sequence Number=SeqID_171969
atgtctttcagtttcactgaccttctttctactaacaacaacaatagcttgaacatggatgatgatccctttggacttgaatttgctaataatttcaagtcagcttcactgcctctctctccttcttcaatctacccttcttcttatgctgagttccctcctggttttgtcccaacttcacagtcattgaattcacaccactttttttcttctcaaattgttcctgcatcttacacaactgagcaatcttctagcatgagctacaacatgagaaacacttcaactgagggtcaacaaggaaacaaggaggaagagagaaactactctgacctctctttcctaacaaaaacaaaccacgtgcctctctttcaatcttccacaaccatgtttcaagtggagccactaaagaaacaggacacaatgatatccagtgaagctgcaaagcaaacagatttctcatctgagaggacagaaacaaaacctgaatatccatctactcagggcttctcagcagcattagcctcaatcaaacctgaaatacaaagcaattctgctcctggttctgttcattttaactccacttatgctcctaagtctattagggaacaaaagagatcagaagatggttacaattggaggaagtatggagagaaacaagtgaaaggaagcgaaaatccgcgtagttattacaagtgcacgcacccgagttgtccaacaaagaagaaagttgagaggtctttggagggacatatcactgaaatagtatacaagggaagccacaatcatcccaagccacttggtagaaaaaatggttctcaatcaattcatcaaacttcttcgtcctgcactaactcagggatttctgatcaatctgtgggagaggaagatcttgagcaaacatcacagactagttattctggagggggtgatgatgaccttggaaatgaggccaaaagatggaagggggagaatgaaaatgatggccattcctattcttctgctgggagtagaactgttaaggaacctagagttgtagttcaaaccacaagtgaaattgacatacttgatgatggatataggtggaggaaatatggacagaaagtagttaaaggaaatccaaacccaaggagttactacaaatgtgtagccccagggttgtccaggaaacatatccatgatgtacctttaggacgaggaaactcaagctatagcatgaacagaacttctctaaacaacaacaccaacaccagcaccagcaatgtaacagctcctgcccctattaggccctcagcagtgactaattattctaactcagcaagtttcacaaactcacttcatgacacaaagccaccaacatctgcaagccaagaaccttttccaatggacgtgttgctgagccccggaagtatcggatttgcggctaatgacctgttccttcagtcttttttgtcaaagaacttttaa

SEQ ID NO: 80285 - DNA, 549 bp, Glycine max
  Peptide Sequence Number=SeqID_171970
atgcctagaggaatgggaatgttaagtcatttgcagcatttggatttctttattgtgggcaagcacaaagagaacggaatcaaagaactggggacactttcaaatcttcatgaagtagaaggaagcccaatggtggagtccatggtcgaggccatcaccagcatcgagccaacttgcctcgaacatttaacattgaacaattgttcgtcagccatatcttttccagggtcagagtcatttaagagtctgaattattttaagattacgggatgccccaatattgcatcattcccgagagaaggactgcctgcgcccaatttgacttatttcgctgttaagtattgcaacaagttgaagtcattgcctgatgagatgaataatctgctcccaaagttagaatatctccaagttaagcactgcccagaaatggagtcgtttcctgaacgggctgatcttccagggcaaaaggagaaagaaacaagggtctggtctgatgatggcagagtgtttcagataaggagagtggggaacaatgagaaactcaactga

SEQ ID NO: 80286 - DNA, 582 bp, Glycine max
  Peptide Sequence Number=SeqID_171971
atgaagaagcagaagctctccgagcctcaaaacgacaccaccaaccccttcgaggttctctccgaggagctaatgttcgtcatcctcgacttcctccaaacgacgtcgttggacaaaaaatctttctcgctcacgtcaccgtcgtttgcttcgcccgctacgtgcggaacacctgcccgcgctcgctgcccgctacccgaacgtaacggaattggatctttccttgtgtccgcgcgtgggcgacggcgcgctggggctcgtcgctggcgcgtacgcggcgacgctgcggcgaatggacctgtcgcggtcgcggcggttcacggcgaccgggctgctaagcctcggcgcacggtgcgagcacctggtggagctggacttgtcgaacgcgacggagctgagggacgccggcgtcgccgcggtggcgcgtgcgcggaacttgcggaagctgtggctggcgaggtgcaagatggtgacggatatggggattgggtgtattgcggtggggtgcaggaagctgaggctgctttgcttgaagtggtgtgtgggaattggggatttgggtgtggatttggttgcgattaa

SEQ ID NO: 80287 - DNA, 720 bp, Glycine max
  Peptide Sequence Number=SeqID_171972
atggcaacagagcgagtgcttcacatgaaggatggcttgagagaaacaagctatgcaaaaaactccttacttcagagaaaagtggcaatgaaagtgaaaatcatacttgaagagaatgtgaagcggatgatgtccaacataaatattgaaagctgcttacaagctcttctttcagtctatgaagcatacttcaagcaatttgaaaaggatttcaaactttttctaaagtcacgctcggaggaactaagatcgggtggtattatggtacttactttcattggcagagataaaactcgaaaaattaataatcctgcagaggtaattggtatggtactcaacggtatggtccaagagggtctggttgaagaggaaaaattggacttctttgatttacctatatatggtcctacagcagaagaagttggacaagtgattgaaagagaaggatcttttacccttcaaacattaaaaactatcaaaataggttgggatgcaaaccttgaagaggaagttgatgatggtattcttgatagcaaaataagaggggagtttatagctaagtctatcagagctgttttggaacctatcttgtcagctgagtttagcgaagatatcatggatgagttgttctcaagatacgcaaatctggttgcccaactcattgaggtggagacgttggagtatactaatgtagtagtcaccttgaccaaacattcttga

SEQ ID NO: 80288 - DNA, 666 bp, Glycine max
  Peptide Sequence Number=SeqID_171973
atggtggagtccatggtcgaggccatctccagcatcgagacaacttgcctccaacatttaaaattgagggattgttcgtcagctatatcttttccaggtggtcgtctacctgcatctctgaagactctggttatcagcaatcttaaaaatctggaattcccgacccaacacaagcaccagttactagaatcactgtttctatataatagttgcgattctctcaagtctcttccattggttacctttccaaatctcaaaagtctcccaatcgaaaactgtgaacacatggaatctcttttggtttcaggggcagagtcatttaagagtctgtgttctttgagaatttcccaatgccccaactttgtatcattctggagagaaggattgcctgcgcccaatttgactgattttgaagttttgcattgcgacaagttgaagtcattacctgacaaaatgagtactcttctcccaaagttagaatatcttgacatatccaactgcccagaaattgagtcgtttccagaagggggggactgccctggattggctatggcaagagcctttggaaatttttgcctaaaagactatggtgtcgcctcagtccctgatgtgtcttacagaaatcttaccaacgaggataagtttgtggttttggcttctgatggg

SEQ ID NO: 80289 - DNA, 393 bp, Glycine max
  Peptide Sequence Number=SeqID_171974
atgggtttgcaagccatcaatgaagatattgagttgaatcggctcgctgaacccgtgggtgggggagtcttccagagtaaaccatggaaacagtcaagagattcacttagttattcatcggggaattggtggaatgaagagatttccacctttcccttggcagtcttggactttggaaaatatttcttcaaaaatttctccaccacctcctcccatgtccgcaagctatttcctttgaacgagtgcaaccatctttttgcttcaccagccaaagagaaggagaataggttgaggtggatggcatcttcaggaactccgactattttcattgtgttgcaaatctctatctatgtagcaaggtgggcatacagatcttcattgggtagtccatga

SEQ ID NO: 80290 - DNA, 297 bp, Glycine max
  Peptide Sequence Number=SeqID_171975
atgataaaatccaatagtattgtagaaggaaattcagaagatgagaatgttggaaacttagcctaccagagctactccttcatggccaaagaagagaaggttaaaactgctgatgactcgcttaacgaggcaaattggctaagcgagatgcatccgcatggcgaggcatccagctcacttagcggatgggaaaccctagaagaggataagtcagagatctgtgcgctcaacacacagccggcccgcccagtgacgatgttgtctcttctcgcgcttagcgcgcctatgctcgcttag

SEQ ID NO: 80291 - DNA, 279 bp, Glycine max
  Peptide Sequence Number=SeqID_171976
atggtgatgggtgtaatccagattatggaaaaaaagaatattgcctttaccttgaattgttcttcttctcccttattctctggaggtattgaccctcgaacttttcttcctcaatgtcactcaggagaagctatgagaatttttgctgtagaagaagatcctactgtaaacagagtatggatgcctaaaagggactgccctggactggctatggcaagggcctttagaaatttttgcctaaaagactatggtgtcgcctcagtccctgatgtgtcttaa

SEQ ID NO: 80292 - DNA, 225 bp, Glycine max
  Peptide Sequence Number=SeqID_171977
atgactaggaaggaatggtggaggggtcctctcagaatcgaacaaactcagcaaccgttggcgggtactttcaaaatcaatcccaaggaattgagttggatgtgcaaagggaggaggggtgtgcagcaacgaaggtgtgtgcaaatggctatggcagccatggaaggcggccatgggctctcaatgaaagcaccaaattgttacgtgcagggaaaaactagctga

SEQ ID NO: 80293 - DNA, 282 bp, Glycine max
  Peptide Sequence Number=SeqID_171978
atgggatttgtagctggcagtgtttcttggtctataccttggatctcaatgaacaaaggaatgaggggagaaggagaagaaggtaatgaggttgtgctttacacctcttcgttggtcttcgattccattttcacatggttccttgcaccaaagtcatcaatggtggtgttgggtggtgctgtttgcgtgttggtggttgggtggaggtggggctacagtggtagtggtggtgttggaggggtagttttgccttcttggatttttgggaggtgcaagaaataa

SEQ ID NO: 80294 - DNA, 2684 bp, Glycine max
  Peptide Sequence Number=SeqID_171979
atggctgaggcagttggtggtgcattcctctctgctttccttgatgttgtgttcgacaagctgtctacagatgaggttgttgacttcatccgtggaaagaagcttgacctcaatttgcttgagaacttgaagaccactctgagagtggttggagctgtgcttgatgatgctgagaagaaacaaatcaaactctccagtgtcaaccagtggctcattgaggtcaaagatgctctctatgaggccgatgacttgctggatgaaatttctaccaaatctgcaactcaaaagaaggtaagtaaagtgctttctcgctttactgataggaaaatggccagtaagttggaaaaaatagttgacaaattagataaagttttaggaggcatgaagggtcttcctttgcaagtgatggcaggggagatgaacgagtcatggaatactcagccaacgacatcactggaagatggatatggcatgtatggtagggatacagacaaggagggcataatgaagttgttgttgtcagatgatagcagtgatggtgtactagtgtctgtgatcgctattgtaggcatgggtggggttggaaaaaccactttagcccgatctgtgttcaacaatgacaatttgaagcagatgtttgatttaaatgcatgggattatgagaattggagtaatcttacaaaaccatttctacatggaaaaaggggaagtaaaattctcttgacgacccgcaatgcaaatgtagtgaatgtagtcccttaccatattgttcaagtttatcctctaagtaaattgtcaaatgaagattgttggctagtgtttgcaaaccatgcatttcccccctcagaatcaaggggggaggatagaagagctttagaagaaattggaagggagattgttaaaaagtgtaatggattgcctttagcagcacggtcacttggaggtatgttgagaagaaagcatgctattagggattggaataatatacttgaaagcgacatttgggaacttcctgaaagtcagtgtaaaattattccagccttgagaattagttatcaatatctccctccacatttaaaacggtgctttgtttattgttcattataccctaaagatcatgaatttcaaaagaagaacttgatcttgttgtggatggctgaagatcttttgaagcttccaaacagaggaaaggcgttagaagttggttacgagtattttgatgatttagtttcgagatcattttttcaacgatcaagtaatcgaacttggggcaattattttgtaatgcatgacctcgttcatgatctagcattataccttggtggagaattctatttcagatcagaagaacttggaaaagaaaccaagattggtataaagactcgtcatttgtcagttacaaagttcagtgatccaatctcagatattgaagtttttgacaaactacaatttttgagaactttattggcaattgattttaaagattcttcattcaacaaggaaaaggcaccaggtattgtagcatcgaagcttaagtgcttgagagttttatcattttgtgactttgcaagtctggatgttttgcctgattcaataggtaaattgatccatttgcgttatttaaatctctcttttacaagaataagaacactgccggagtcattgtgtaatttgtacaatctacagactctggtgttgtctcgttgtagagtgttgaccaggttgcctactgacatgcaaaatcttataaacttgtgtcatcttcatattgatggtactgatataagagagatgcctagaggaatgggaatgttaaggcatttgcagcatttggatttctttactgtgggcaagcataaagagaacggaatcaaagaactggggacactttcaaatcttcatggttcgctttctattaggaatttggagaatgtaaccagaagcaatgaagcattggaggctaggatgctggataagaagcacattaatcatttatccttggaatggtctaatggcaccgacttccaaactgaattagatgtactgtgcaaattaaaacctcaccaaggcgtggaatctctaacaatacggggttataatggaaccatatttccagattgggtgggaaatttttcctaccacaacatgacaagtctaagtttaaatgattgtaataactgttgtgtgcttccttcgcttgggcaactaccatctcttaagaagctctatatttcaatattgaagtcagtgaagactgttgatgcagggttttacaaaaatgaagattgtccttctgtgacacccttttcttcccttgaatttctatccattgatgagatgtgttgctgggagttgtggagtatccctgagtcagacgcctttcctctactcaagtctcttacaatagaggattgccccaaactaaggggagatttgccaaatcaccttcctgctctggaaacacttaggattaaaaattgtgagcttcttgtctcttctctcccaagggctcccatccttaaggtcttagagatatgtaaaagcaataatgtatcgttgcatgtgtttcctcttttgttggaatcgatagaagtagaaggaagcccaatggtggagtccatgatcgaggccatcaccagcatcgagccaacttgcctccaacatttaacattgagggattgttc

SEQ ID NO: 80295 - DNA, 339 bp, Glycine max
  Peptide Sequence Number=SeqID_171980
atgggtattctcctcaattatatggtgctcaacttttccacttttacccaatgtgagacttcacctcacacttgtactccaacacatctccccttcaagtgtgagtctcttccacatggtagccttcctctggagctcacgagtatagccattctgaccacctgcagtacttgcactaccgctacatctgcggggtaccctgcgccgccatcttactcctctgagccggtcacgagtatagccattctggccacctatggtacttacaccgccactgcatgctgcgccgtgccatcttacttatttgagtcggtcaccaagtcgaaccttcatctctga

SEQ ID NO: 80296 - DNA, 447 bp, Glycine max
  Peptide Sequence Number=SeqID_171981
atggcttctccacctgcctcccctcctcctcctcctccttccgatgcatcggcttcaccgtttgccatgatgcggacacgcaaagcctcacgtctacgatccttgtctactggaccacctggtgctgagagaccagtggtccatgttgatcctgctaccggcaaggctgacggtccccacaggaagaaattaagaatatatttggggattgtggcacatgataaggtggacgtcacgcagaatttgaaaacccagaggcttctgacagtaggacgaaaaggaagttccttcagactgagatggaggcagtttaaatcaaacctcatgaggaaatgggcccttgcagccgatcaggatggtgtggacgacactgtatgtgagaaatacgacataagtaaggaaaaatggtcccagttttgccagactcgtagagacccttcttgggag

SEQ ID NO: 80297 - DNA, 456 bp, Glycine max
  Peptide Sequence Number=SeqID_171982
atgccagctctctatgtgtggctcgtctcacaccttttcctccaagaaagtaggcccacctgtccactgcaaggtcaccgcttatgcaccgagaagggaaaggcaaaatgggagcaacacttggctagtgtgacaacttggctaccccatgagaggagcgccatcggaggaaagcatcacgcctttcatcacacggggtttcagggaccccaacacgagggtgcttcaaggagtccgcaaggcataggatgtggtgcaaaggaaggcaaagagcttaggggaagcagtaatgggatcatcggcggctatcataagtggctgagagtccggacacaagggttggattggctcccaaagctaagggctgtgagaaaggaagaggctgaagctctagaagaaagtgaggaggttcaagccctaaaagcagagcttgaacaagcccgagcagtcaaatag

SEQ ID NO: 80298 - DNA, 290 bp, Glycine max
  Peptide Sequence Number=SeqID_171983
atgaaggatgcacgaacagcgcttggaaatcaattcgtggggctccagactcagtggttgaggatgcatgaacgacaatcaagtcatggggctccgaataagatggtggaggatgcacgaacagcgctaggcaatcaattcgtgtggctccggactcaatgggctaggcaatcaaatcgtcgggtttcggattcaatggtggacgatgcatttcctggggctcctaataagatggcggacgattcgctaacagatctaggcactccattcgagggtgtccggactcaatg

SEQ ID NO: 80299 - DNA, 156 bp, Glycine max
  Peptide Sequence Number=SeqID_171984
atgttgacatctctgggaaaggtgcaggtgacgatggcgtctccgcatgccaacggactcacaggtcacgatagcaaaaagtggggcagtcgacaaaagcaaggcttttgctcctacgtatcctcaatttgtgatgaggaactcagacctacgtag

SEQ ID NO: 80300 - DNA, 522 bp, Glycine max
  Peptide Sequence Number=SeqID_171985
gtcgactctagaggatccccgctcggtcgttcggctgcggcgagcggtatcagctcactcaaaggcggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggattagcagagcgaggtatgtaggcggtgctacagagttcttgaagtggtggcctaactacggctacactagaagaacagtatttggtatctgcgctctgctgaagccagttaccttcggaaaaagagttggtagctcttga

SEQ ID NO: 80301 - DNA, 724 bp, Glycine max
  Peptide Sequence Number=SeqID_171986
aggatcccacactacacgtcctcaacttcagaggactacacgtcctcgccttcacaggactacatgtccttgccttcagaggacagcacgtcctcgccttcagaggactgcacgtcctagtctttagaggactacatgccctcgccttgagagggctacatgccctcgtcttcagaggactacacatcctcgccttcaaaaggctacacgccctcgcctttagagggctacgtgtcctcactttcattcctggtccaccccctgatctcggaggagggccaactgtgcgagcacatttagagggaggctattgtgcagctattatgcatatcggagcaagatttcacccgtgccgctgcaaagagacgagtgcggatcatgcgcaccaacatgaccactcttacacagatatggatgggtgcccgtcccccttagcaaggtcatgccatcgtgacatagggatcacacccgcaagacacctagtggagccagagaagtccaacaaggtcctggggtttcaatctttgattacgggcctttgtcagttctacggagtgcccgtcgcccccaacaagggtgagacaccacaacagtctggggatggccgacagcaggcaatagacacaccgtcgccacctccagagcccctcagctcatctacaaaggctgaagcgttgcctatgacccgtgaccgactagcaggtgaccaagtccaaagccaaag

SEQ ID NO: 80302 - DNA, 297 bp, Glycine max
  Peptide Sequence Number=SeqID_171987
atgtcaggtgagctcagtcagcgttttggtatatccgaggactcaatacgccgcgatttgcgcgagctggccgctgaagggctgttacagcgcgtgcacggcggcgcgctgccggtatcagccgcgctggcatccttcgaaaaacgcaaaaacgtgcaaatgagttccaaaacagtgtgtggcgcaaaaggcggtgaagctgattcaactcgggcagaactggtgcagttgctaccagcagacctggctttcacggcgatcacccacagcccccggtattgcggttgcgctggttga

SEQ ID NO: 80303 - DNA, 312 bp, Glycine max
  Peptide Sequence Number=SeqID_171988
atgattgtaaggacctggcacggttgtgttccgctcaaacacgctgaagattttgcgaaacaccttgagaagacaggtgtggaacattcacgaagcattgccgggaatataggcgcttatgtgcgcagggaaacacagggcgactgggagcatttctttctggcaacttactggaaggatctgcagtcagtgaagaccttcgcgggagaaaactatcacgtggcagtgacgtatccggatgacgaacaatttgagttactttccgatccatacgtttttcagcacaccgtggaagccgttttaccgctttag

SEQ ID NO: 80304 - DNA, 315 bp, Glycine max
  Peptide Sequence Number=SeqID_171989
atgtgggcctttcataaaggtttacaaattgattgggcacatcttattagacatcacatgcataaggcattgcgattgaatgctcctttgccttaccctcatctagtcacccttttccttcaacacttcaacatccctcttgattctgaaccatatgttccaatcaagagatccttccttataggcgcttcagtcatagcatcctttgatatgtgcttcaatgggatggagtcaagaatcactaaggttgaagaagatgtgtcttacattcgttcaagatttgatctaccaccaccgccgccaccatcatcttag

SEQ ID NO: 80305 - DNA, 165 bp, Glycine max
  Peptide Sequence Number=SeqID_171990
atggttcttaatggtgcaaattgtaaggactggaaaaagaacatgcaaattgttcttggttgcatggatctagaccttgcattaaggattgagaaactcttttctcctacagtacctctgaacaaaggaactttaatgagaagtgggatcactcaaatcgcatga

SEQ ID NO: 80306 - DNA, 333 bp, Glycine max
  Peptide Sequence Number=SeqID_171991
atgggggttgctgatgtgccccagtgtgctcctttctcgtcctaccgcgttcgggagaggatggtgcgtggtggctgggagagttgggtctgcttcggcagccgaactaacagcggcagcagtcgccactgtttcactcaatttggagtgcttcttagtctaatagctcttaaggtggttggcccctttcttcttgactcaaattcttcaagatatggcaccaatcctcctttccaattccctatatggcaactcacaaacaaggaaacaaagagacaagcaataaccaaagacaaaaaaaatgaaatgaaagctaaaccaatagagttttaa

SEQ ID NO: 80307 - DNA, 582 bp, Glycine max
  Peptide Sequence Number=SeqID_171992
atggctcccgaagaactcgagcagctaactcaacaaatcagggaccagctggaggagtcgatcacagaaaaagtgacttggcagttgatgttatccttcagccagatgcagtctcagttgcaatcacagatccaatcacagggacttgcactgcatccgaagtctgaggttggtccttcagctgctcgtgtcagcataaaggggagttgtgttgatccctcagtggccgatccaaacacgggtgactcagaaaaatgcgagttatacattatagaaaattattcccgcctggttgccctaggaagggtttatgagggatccacaacgattcacaacatccctttgttgcatggccaagtgaaagttggtgttgaggaggttaaagatgcagaggctcccattcctgtacccactgacgaggcagctgtgtctccagcaaaacctccagataggctggatcataaggtcgatgatcccctatatttgatgacattgaccatcccacagctttttttgaagtctctccaggttatgtgggatgctaccgtgttcggggtgtttaatgaagacttctcgttgtaa

SEQ ID NO: 80308 - DNA, 233 bp, Glycine max
  Peptide Sequence Number=SeqID_171993
atgcctttcttcgttcatggttcgatattctggtgtcctaggcgtagaggaaccacaccaatccatcccgaacttggtggatactccggggaacagatatccagtggagatgacggggtggggcctgtagctcagaggattagagcacgtggctacgaaccacggtgtcgggggttcgaatccctcctcgccccacaaccggccaaaaaagggaaggatttttccctctgggg

SEQ ID NO: 80309 - DNA, 186 bp, Glycine max
  Peptide Sequence Number=SeqID_171994
atgagcaatgccataaatcatcatagacatctagagggtccatcttctcttctggagaatttgtatgtcttcataatcactgatccaggggtggttatagcactcctagaggatccaacatcgatatgtgtttgtcattggttatctgatcctccaggaatcaaagattcaggtggcaaaaattga

SEQ ID NO: 80310 - DNA, 551 bp, Glycine max
  Peptide Sequence Number=SeqID_171995
atggaacaggttaacgcaggaatgcgcgtagcccgtcggcagaatcgaccatttctgccatcacccgggcagtttgttgcatggtgccgggaagaagcatccgttaccgccggactgccaaacgtcagcgagctggttgatatggtttacgagtattgccggaagcgaggatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 80311 - DNA, 329 bp, Glycine max
  Peptide Sequence Number=SeqID_171996
atggctatcatagatattactggctcgaacaacaattacctcaacaaaccttttaagtttgaagggtatcattttaaatgttggaaacaaaagatgatgttttctttaactatgaggaaagttgtctatgttttgaacactgatattccagtgatacctgaagatgttgagaaggaagtgaaggataaaatgactatggaattagctctctggaatgaaaatgattacctatgcaagaatttcattctgaatgggttagctggtgatctctatgattattatagcccatataagtctgccaaattagtttggctggctctggaacagaa

SEQ ID NO: 80312 - DNA, 530 bp, Glycine max
  Peptide Sequence Number=SeqID_171997
gggtagagggtgtcacagtagctgcttttctggctaagattgagtctggacacatccatctatccagcagggatttcctttgttggaaggctaaccctaatggtctgtattccacaaagtctacctacaaagtgttgcaggaggctcgtaataatgctaatgaggacagggcttcaaggatcatatggagcctgaaaattcccccaagagcaagtgctttttcttggagattattcaacaataggctagcagctaccagatttttagaagatacaacaaagattcatattcatccacattcagtagattgctggaaacggagagcagaacctaatggacagtacacaacaaggggtgcataccttttgatgcaaggagaagcaactgaggaaaatagtgatggagtgtttacggagttatggaaattacaaatcccagcaaaagcaactatctttgcatggagattggttaaaaacaaactgccaaccaaggttaatctaagaagaagacaaatacaactcaagggttaa

SEQ ID NO: 80313 - DNA, 158 bp, Glycine max
  Peptide Sequence Number=SeqID_171998
atgtcgcggaacttcacggattgtgcaacaatgctttctattgacttccgacatgtcatggaacttcacggatttcctaacgatgggtgccaagtacctcgaagtggtcaaacgagggtcgcatcccaacaaacagatggtccccggacgaaattagg

SEQ ID NO: 80314 - DNA, 267 bp, Glycine max
  Peptide Sequence Number=SeqID_171999
atgctgggagaccttaaggtggcaacacaagggagtgacccagatgcctatgttgactgggagatgaagattcagcatgcattctcatacaatgattatcctgaagagcagaagggttatgcgaaagaggacaaggagatggagatggctctagtgagagccaacattgaagaggacaccaaagcagtgcatgatggcttcaccaacaagatttctttccagcaccatgaccagaaaattattcttaaacctcaatccctgaaagaa

SEQ ID NO: 80315 - DNA, 496 bp, Glycine max
  Peptide Sequence Number=SeqID_172000
atgattaggggcaatccaggtgatttacaatcctttgatcctgaaatagatagaacatttcatagattagttagacatagtgtgcattttggtcattatgtgcattttgagcattctgagcattctgttgagggtgattctgaatattctgattttgagcattccactactaattttcatactgagaacatggctcaacctccacctcatgagaggactcttagggagatggctgcacctgatttcacttatgaaagcttgtgcattcaatatcccgatgagggtgttccatgtgttctcaaaattggactaatacatttgctacccaagtttcatggtcttgcaggtgaagatcctcttaagcatcttaaggagttccatattgtttgttccaccatgaagccccctaatgtccaagaagatcatatctttctaaaggattttcctcattctttagagggagtggcaaaagattggctatactacctgctcccag

SEQ ID NO: 80316 - DNA, 120 bp, Glycine max
  Peptide Sequence Number=SeqID_172001
atgtttgcttacagtcctttcgctaagcgcaagcctcgcgctaagcgtatctttggtcatgtgctaagccgagagcctctagtgcttagcgctcaacccttgcatctcaggctgatttga

SEQ ID NO: 80317 - DNA, 111 bp, Glycine max
  Peptide Sequence Number=SeqID_172002
atatcaagggcacaccggagaccggcttacaaatctcaggttttcataaacaaagaaaccgaagcggcgacagagccgcacaggatcggtaaagagagagaagagggatga

SEQ ID NO: 80318 - DNA, 2361 bp, Glycine max
  Peptide Sequence Number=SeqID_172003
atgggatatggtggcagaatgcaagtggaggttagcaagcatacagagggggctaaggagaagatgctacgtcccaatggattgcccgaatccttgattcgatacgatgctcgtcagaaagagaaggcaaatagtacagtatctgagttgttgctggctgtgaggaggcctcgtgcactgagtgaatcagcagggcgtcccatgatcaaaaagtcagcatccggtgatgatgcacaagacaaaccgccagaaaagtcatctaggagaaaatctgagagtgtcgcttcttttagacgaaaatcacatgctggagacagaagttcaatggagagaatcactgagctacctgaaaagaaacacaagagctctcgtcgccgttctttcatggggttcatcaggaaaagccagtctaactttggaagcttcaatgatgaagcagttgtagagaacagctctgagagtagtgatgaggatgatgagaggcctgaaagttttgatggcaaagtacagaagaaggaaaagagaaagggtcttgatcttgctaccacacttgaacgtattgagaagaactttgtcatcactgatccaaggctgccggacaaccccattatttttgcatctgatagcttcctggagcttacagagtatagtcgtgaagaaatcttgggaagaaattgcaggtgcttccagctttacctcaggcttcatttaccggattatgaatgcttccatgaaggatcaaccgaaaaattctataaaaaggagtgcaactgttgcatacagaatacatataaagcaaataccgaaaacttgaggaaactaaactctaaaattattacaagacaacttccgaagactgatataccaggatatgatctggaaggtgttgccgaaaatcagtggtttttgcaaggccctgaaactgatccagcaacagtgagaaaaattagagaggctattgacaatcaaactgacgttaccgtgcagcttattaattatacgaagagtggtaaaaagttctggaacttgtttcatttgcagcctatgcgtgatcagaagggagaggtacaatattttattggagttcaacttgatggtagtcaacatgtggagccacttcacaaccgcattgctgacgatactgcaaaagagggagaacaattggtaaaagatactgcggaaaatgttgatgatgcactgagagaacttccagatgctaatatggtaatgtctcctgactatcagtttcctctgaaaagcttttgcattcaatttttctcacaatcttttggctaccttcagaaaccagaagatttatggatgaatcattcaaaagtggttcaccccaagcctcataggagggatgaagctgcttggaaagccattcagcagatcctaaatagtggagagcagataggcctgaatcattttaggccagttaaacccttgggatcaggagatactggcagtgtctatctggtggagctaggcgaaactggtcattattttgccatgaaggcaatggagaagggtgttatgctcaatcgtaacaaggtgcatagagcttgcacagagagagagatactcgacatgttggaccacccttttcttcctgcattatatgcttcctttcagacgaagacacatgtttgcttgataactgattattgttctggtggagaactattccttcttcttgaccgacagccagctaaggttctcagggaagatgcagtgagattttatgccgctgaagtagttgttgcgttggagtatcttcattgtcaaggtaggttcaaattcatcacccatacacatgggataatatatcgggatttgaagccagaaaatgtgttactacaaagcagtggacatgtgtctctaacagattttgatttgtcatgtttaacatcttgcaaaccacagcttctagttccagttataaatgaaaagaagaaagctcagaaaggcccacacgctccaatatttatggctgaacctatgagagcatcaaattcttttgtggggactgaagagtacatagctccggaaattataacgggttcaggccatacaagtgctgtggattggtgggctcttggaattcttttatatgaaatgttttatgggtatacaccattcaggggaaagactaggcaaagaacatttacaaatattctccacaaggaccttaaatttcccaaaagtaaacagatagttacaacaattacatcttcaacactcctccttaactttggaactgcaaactccaagctattgtctcaagtattcaaatctggcttttggaagtgccttggtcagaatgtcaacactttgattctctattttgcggtgcagtaa

SEQ ID NO: 80319 - DNA, 312 bp, Glycine max
  Peptide Sequence Number=SeqID_172004
atggagatgaaaaataatgaaaagtgtgcccaacaactttccaatagcaatttccgtcatcgttggcaacaatggtggaaaaagcaaaacgcgaagaagaaacgtaccttgaagaagaagcagacccacagtcctaatcatggcacgacaacaatgcgaagaagaaacacgaagaacaatgaagaagcagaaacgcgaagaacagtgaagaagatggaatcgcggcgcagaagaagactgaagaagcagacgaatgaagaagcagcagaatccgaggaagaagaagcagaactccgaggaagaagaagctga

SEQ ID NO: 80320 - DNA, 552 bp, Glycine max
  Peptide Sequence Number=SeqID_172005
atggaggagtcaactgaaaaactgttccttaaagagaaagcattgtccactcgcggcagtgggaatcgaattgcgcgtgggtgtccaaccaaagctaccctcaaatctcaatgctttctaccaacaacaacacaacaagttccaatggacacaccaaatgcacagccgcaagctgcatcagcaagcacgccaaggaaaaaaatgacaaagcaattgacagcaagagcagggaatatgactgttctgaaagacacggttggtggcactgaagagggtgaactacgtgtgttgctgacaaagcagaaccatgccggagaaacggttctttatgttgctgctgaatatggttatgttgatatggttagagagctgattcaatattatgatcttgctggggcgggaattaaggccaggaatgggtttgatgcactccacattgctgccaaacaaggggatttaggtatgtcttcaatgtggttttgtcgtctgttgttcttttgtggtgtgatcttgggagggaatctctgttgtgtttttgttgagatgccttga

SEQ ID NO: 80321 - DNA, 189 bp, Glycine max
  Peptide Sequence Number=SeqID_172006
atggaccattttaaagaagatttcaatgaagactataagtttgtggagaatgaaacattcatcaagtttctatttgtgattgttgaagaaatttctttccaagcactgcgagatggtttgtcttaccacgaatacatggacatcaacctagaacttcacttatacgagtttgactgctcacttcattga

SEQ ID NO: 80322 - DNA, 511 bp, Glycine max
  Peptide Sequence Number=SeqID_172007
cactaacatcgtcattgatcctccatctcccatcagacgacacatgaagtggaagatggcctgcaccaagaaaactgaccaaatgacgtctgaggcaacaaaggaaattgatgacaagattgcctcacagggttcctttgttgcccatagacgtcaggatgtacttactgctgccattgagcgactagaacaccctggttgtgtgcgtgctgttggagccagtggatcacagggacttgcactgcctcctgagtccgaggttagtccttcagctgctcgtgtcagcacaaaggagagttctgttgatcctttagggaatgacccagacacaggtgacttagaaaaatgtgggttatacgtcgaagaaaatcctccccgcctggttgccctaggaagactttgtgaggggttgaaaaccgttcacaacatccctttttgcaatgatcaaatcaaggttggtgttgaggaagttagagatgcagatgctcccattcctgtacccactcaagag

SEQ ID NO: 80323 - DNA, 246 bp, Glycine max
  Peptide Sequence Number=SeqID_172008
atgaatttattgcctagtgttgttcttctatcctccaccctcaaatcttatccggagcccctcaaattgcttgtgattcatgcatcctccaccatcgagtttggagccccacgaattgatttcctagcgctattcgtctatcctccaccctcaaatcttatccggagccccatgaattgcttgtcattcatgcatgctccaccttcgaagaaagaagaaggagagacggaagtcgtcatagactaa

SEQ ID NO: 80324 - DNA, 447 bp, Glycine max
  Peptide Sequence Number=SeqID_172009
atggcctcattgcaaatttcgcaaggcatatttcacctgagcgatagccgtaccctgaccctgccggacttaaccctgcacagcggcgaaagctgggcctttgtcggagccaacggcagcggtaaatcttcgctggcgcgcgcgctgtccggcgagctgacggcggccaagggcgagctgcggcaggattttcagcgccgcacccgtctgtcgctggagcagctacaacagctggtgacgcaggagtgggagcgcaacaacaccgatctgctgagtgaaggcgaagatgacaccggccgcaccgcgctagagatcattcaggatgaagtaaaggatgaggcgcgggcgcaggcgctggcccagcagtttggcatcagcgctttacttactcgccgcttcaaatacctttccaccggcgaaacgcgcaaaacgctgctgtgtcaggcg

SEQ ID NO: 80325 - DNA, 412 bp, Glycine max
  Peptide Sequence Number=SeqID_172010
gtcgactctagaggatcccactgagaagtactgcacgcagagacaggtccagggtgatgcaccacaagccgcggacgcgccgccaccacatcaggctggtccagccgaatcatttgacccggagcagtatttgcggcatttggttcgccagcaggcggccaaccaccgggcacatgtacagacccatgattgtctttaccagatgagcctcaacctgcagagccagggttttacttcttttccgtgccctactccggaccagttcagggcagaggtcgcatggcctggagattggcctgaggcccgggcaggagaggcaccagcagaggctcccgacgaggcagatgaggcccgcgaggacgaggagataaccgatttactggatttcttaggagggagcggggccacatga

SEQ ID NO: 80326 - DNA, 432 bp, Glycine max
  Peptide Sequence Number=SeqID_172011
atggcagcgcaattaatccatgatcgagtggaaatggagtgcctagagggagtttgggagaccctcgaaggcaatgcgaggtgccgattccgtggcacgattcgactcacggctacttcattggtacatccagaggaacccgcacacacgcttcagcgaactatggagtggatactacctacacctactccatatcgactagtggagccagtccaagtgatagaggtgtcgtcatctaaagaagaccctgaggaggacccagaggagttacctcctgagcctgctgtggatgctcttaactttccagagggtgatgaggacccactccctaatgtggattctccagaggacgtcatgtcagcatctgaggcagactctacggaggagagcggccctggagggatagcgactagtggagactcttcatcatag

SEQ ID NO: 80327 - DNA, 162 bp, Glycine max
  Peptide Sequence Number=SeqID_172012
atggctccaaactctgaaggtggaagacacatgaacgaaaaagaaattcatggggctccgaaaaaggaattgcactacgcaatcactacgcatggctccaaactcgaaggtggaggacacatgaacgaaaacgcaattcatggggctccgaaaaagggttga

SEQ ID NO: 80328 - DNA, 171 bp, Glycine max
  Peptide Sequence Number=SeqID_172013
atgacatgtgcttttcatgggggagtttcggggcattccattgtgcattgtatgaccttgaagcataagatgcaaagtttgattgatgcaggctggttgagattcgaggaggagaatcgctcaaattgctcgttctacacgtttggcgggggtgccgtaaatgacgagtaa

SEQ ID NO: 80329 - DNA, 453 bp, Glycine max
  Peptide Sequence Number=SeqID_172014
atccctgtgaagtgtcctgtgtcagaaatcattaagagccgaagagttcaagggagagaatgctacgaggtttcttgggaaggaatggatggacttgaaacttcaatagtacctgcagatcttatagaaagtgcttgtcgtgagaagattttggagttcgaggaaagaaaagctcaacggaagaaacaaaatattcagaaaagaaaaccaaagaaaaaggaaactaattcatctgtggcagagcttgatctaaaacttcagaatttgttgcttgatattaatttgagagacgaagccaacttcaatgcctctgattcttcaggaaggatatcaagaattacaactgatacggctgaagctgatctgaataccacagacttgttgcccctatcgcatgacatagaacactctggagttattaccgacaaaaacgagatttttaaggatatgtaa

SEQ ID NO: 80330 - DNA, 1016 bp, Glycine max
  Peptide Sequence Number=SeqID_172015
ccttaaggaattgggacggttgatgggacccctccaaaggcaagcctttcgcatagtgtacggaaagattttagatttggccacagcggtggtatttacggaagccattgtatccctcgcccaatactatgaccagccattgagatgcttcacgtttggggacttccaaatagtaccgactgttgaagaatttgaggagaatttaggatgccctcttgggggaagaaaaccgtatcttttctccgggtttcttccctccttgagcaagattgcagctacggtcgaagatttggcgagagagttggatcgtatgaagcaaactcgaaatggcgtagtgggcctaccgtggaaatacttggaaggaaaggcaagggatatggcgaatcaagaggaatgggtcccgtttgcagatatactagctttgctaatctttggggttgttctctttccaaacgtggacggcagcacaatcaactggtttcctcgatggaaggaaggaaaggagggagttctcttctcatgtggggactacccaaacattccgttgatagggacgaggggctgtattaactataatcctgcacttgccataagacagttagggtaccccatgaggggagcaccgaaggaagagagcctctcacctttccttgtgagagatttcagcgcgcaaagtctcaagattgtacaaagagtccacaaggcgtgggaaagcccattaaggaaagataaagaacttaggggcatccgtaatggcatcattggtgctccggaagaggatgaagaagtccaagctctaaaatcagagctaggaaaggcaagactcgccaaagaaaaattcaagtcagtcgctacagacatccggaaagagtgtgccgaattacgaaaggaaaatgcggctactgcaattgccctcgaacaagaaaccaagagggctcgcaaggaagagcatggccgagataaattccgaggagctttatgggacaacaacaatgagctcaagctccggaaagagg

SEQ ID NO: 80331 - DNA, 282 bp, Glycine max
  Peptide Sequence Number=SeqID_172016
atgtcagtgaaaaacctcgtcgggcgcctagaagtacatgacaaaatggaccacacaccagaagtcaggtcactctcattaggtaaaatcatagggaaaccagtcaatgtcacgctgttttgcgagaatgtttctaccatgtacgatcgacacaagcttaaaagagcactcaaacatggtgtatttaccccaaggcctagactccgaagagtctgtcaggttctctccctcttgagtcaggtccaacccagaaaatatttaacacgtagactctatctatga

SEQ ID NO: 80332 - DNA, 240 bp, Glycine max
  Peptide Sequence Number=SeqID_172017
atggcctctttagattcttggtttttcaaaagtattttcaggaataggttattccaagatcttgatgaagaccaagtcaacttttgtctcatgacaaaatctcatggaaaccacaaagaagaatctgtaaggaagaagtggtacatcgacagtggatgttccaagcatatgacgggagatgtatcaaaatttacaatcatttcccccaagaaaagtggacatgttacacacggctattag

SEQ ID NO: 80333 - DNA, 261 bp, Glycine max
  Peptide Sequence Number=SeqID_172018
atgggtgccaagtacctcgaagtgttcaaacgagggttgcatcccaacaatggatggtccccggacgaaattagggcgcataatgaccataatttgtctttgtgtgtctttggacgcgatcgagacttggcgacaagacgcagaatgaccataatttgtctctgcgtgccaccagacacgatcgcctctggatggcgaaaaggtgtacggaatgaccataatttgtctctgcgcgtttatcactcgacttgcgaaatctga

SEQ ID NO: 80334 - DNA, 944 bp, Glycine max
  Peptide Sequence Number=SeqID_172019
aggactacatgtcctcgccatcggagggctgcacgccctcaccttcagaggactgcgtatcctcacctttagaggactacacgtcctcacctttagaggactgcacgtcctcaccttcagaggactgcacatcctcaccttcagaggactgcacgtcctcgcctttagagggctagacgtcctcaccttcagagggttgcacgccctctccttcagaggagggctgcatgccctcaccttcaaaggattactcgtcctcgccatcagagggcttcacgccctcaccttcagaggactagacgtcctcaccttcagaggactacacgtgctcgcctatagagggctacgcgtcctcactttcagtgagctccatagccacaccttaagagaatttaagttcctgggccaccctttgatactggaggatcgaccaactgtgctagcacaaccagagagggaggctatcgcgcaactactatgcatactggggcaagatttcacccgtgccgctgcaaagagacgagtggatcgcgcccacaagacacctagtggacccggaggagcccaacagggccctagggtttccggctctggttacgggcctctatcagtcctacagggtgcctgtccccccagcaaggtcgtgccatcccgacatagggatcgcgcccacaagacaccagtggacccggaggagcccaatagggtcctggggtttccggctctggatcgcgcccgcaagacacccagtggacccgaagaagtccaacagggtcttggagttgccagctttgattacgggcctctgtcagttctacggagtgcttgtcgcccccagcaaggcacagggcaaaacaccacagcagcctggggatggccgatagtgggcaacagacgcaccgccaccacctctaagagttcacctcagctcatccacaaaaaag

SEQ ID NO: 80335 - DNA, 177 bp, Glycine max
  Peptide Sequence Number=SeqID_172020
atgttggttcctaagttgtggttctttcttgttgggggtttgaaaacaaaagatgatgacaaaggtgatgacaaaaagctcaaagatcaatcaaagaacaactcaagtgaatcaagaacaagtcaagagttcaagataagaatcaagaagaattcaagactcaagaagaaagtctag

SEQ ID NO: 80336 - DNA, 225 bp, Glycine max
  Peptide Sequence Number=SeqID_172021
atgtcgggactcatacgcgattctcctcaaatttcagccagcccgcatcaattagactttgcaccttacgcttcaggatcatacaacgctcaatggaatgccccggggctcctccatgataaagacacattgcgttcgagtcgtatccttagaaaaatggaggtttgtgctaaaggtggtgttcatcattggaagtgcggtagacaggctttgtggttgatttag

SEQ ID NO: 80337 - DNA, 468 bp, Glycine max
  Peptide Sequence Number=SeqID_172022
atgcaaagcttgcaagaactggctcagcaaaggccaattatgagtgtagatcaattcattgagaaggtggccttgcctggagcccaaccttcttttgtgggggataatgaaagttttatagcacaggcgcctcgacagcatgagctagagccaaaaaacaatcactcatctgaagccatcatccctggagctgttgatttttcgaaaagaagattagagatgagatccaatgaggttgctcatcctgagccagtgccagtatcagctgttgcaccatttctaggggtggatccatcttcacctcagcacacagcaaacttttccactcctgtcttagagatacctgagggccagaccataccagtcctgactctagacacttctcctccagctaatccagtattgcatctgacagatgaggaggatgttcagacacaggacacccaggaccagtcacaagaattttga

SEQ ID NO: 80338 - DNA, 420 bp, Glycine max
  Peptide Sequence Number=SeqID_172023
atggcccacgagcacaaagtggtggaagaatatgcccgagtgttcacggaaaaagaagctagaggggggaaagacgccataactaaacgcgccccaaggcatccctatcgcacaagatcaaaatctaggacgatgggtgaccaagaggaggtacaggaacagatgagagccgacatgtcggctttgaaagagcaaatggcttccatgatggatgccatgttaggaatgaggcaactaatggagaagaacgcggccaccgctgccgctgttagttcagctgccgaagcagacccaactctcccagctcacgcatcaccctatcctagatgtggtaggacaagaaaaaagcacactaggacacatcagcaacccccatctgggatacaatcgggtggcttacccttatggattgccacctaa

SEQ ID NO: 80339 - DNA, 471 bp, Glycine max
  Peptide Sequence Number=SeqID_172024
tgcaccatcacactcgaagatgttgcacttcatctaggcattagagtcaatggtcgtgttgtggctggacctaacttcttacattgggatgagttatgccacgagttactaggggaatttcctcccgaaaatgcacgtaaaagagctgcactgaagctgacatggttgctaaacatgttgcgcgcaccattacccgaagaaccaacaatgcaccaattacaatgcagaacaccgaatgctatactcaacctgcttcaatcaaccatcactcctactcatgatgcaattatgtattacaacgggaagcagaacataccacgccaaggtgagtttttggattactcctttactggaactaatccaataagatttggcattccttcgggatgtgacatggagaaactcaaggatttaatcaagcaagttgcacctataggggttccccctaatggaattcacggatcacaattg

SEQ ID NO: 80340 - DNA, 1026 bp, Glycine max
  Peptide Sequence Number=SeqID_172025
atggaagatcagggtcagcagcagcagcagcagcatcaagtggaggcaaagagtccaaggcaaggcaccgagaggagtgaagcggttcggtcaaggtggactccaaagccagaacaaatcctcatactcgagtccatcttcaacagtggcatggttaaccctccaaaggacgaaaccgtcagaataaggaagcttctcgagaaattcggcgccgtcggcgacgccaacgtcttctactggttccagaaccgccgctccagatcccgccgccgccagcgccagatgatgcaacagcaggctactgccaccgccaccgccaccgtcaccacctttgatcaccctcagcctcagactcagactcttgttaatgttggtggtgcaattccacatgatcaccacaccttgggaaaccttgttgttgcaactgaaagtagtgctacttcaaccatgggttttggttgttcttctcaatcttcttatggttttcttggttcctcttcttcttcttcttcttgtggtggtggtgtaattggtggccaacaacaaggcatggatggtttcttctcatcggtttcttctcatcaaatgggtttccctgatcaccaccacacttcacctgcttcatcagctttgtaccctcctcttgatccaaatttgacctaccaggctggatatgggggccctaatatttcaggattcattacagtgtttatcaatggaattgcaactgaacttccaaaggggccaatagacctcaaaaccgtgtttggagaagatgtaatgttagttcattcctctggagttccaattcccaccaatgaatttgggttcttgatgcataaccttcaacatggcgatagctactttctgggaggcgtgagagtgagcaattcgcaagttcaaaccttcgttaaaggggggtttgactgccagatggtggcagcacgggaaggagctttggcggtgatgacagatgggagtgagagcaagagacatgacaaggggttcatagagaggaaaggttag

SEQ ID NO: 80341 - DNA, 228 bp, Glycine max
  Peptide Sequence Number=SeqID_172026
atgagaaacctttccatttcgatgtatcatagcaccaaccacatgaatgtctgggtagtgaatgagacaataaaagagaacaagacaggaattgaccaaagggaaatggttcctgccacttgtgctatggtctcatcctggtctaagagagtcaaaattgggattgcgaagatcaacaggggaagaagacaaagtgcagttaaggacaaaactatccatgatctttga

SEQ ID NO: 80342 - DNA, 2001 bp, Glycine max
  Peptide Sequence Number=SeqID_172027
atgaggaggtcacccaatcgtgagtttacccatcgtgtgaagtctgtatctatggcaatgttcacgtcacaagaagttgatgctcttcaaaatgggggtaaccagcgtgcaagggaaatacatttgaaaaattgggacttccaaaggcagcggttgccagatagcagtaatgttgataaagtaagagagtttataaggaatgtatatgtggatcaaagatatgcagcagcaaagtcttctgataagcctccaagagatagtcctattgaagatgatacaaggcgtgccagttcctatcactcatattctcaaagtcctccatatgattaccaatatgaagatcgacgatatggaaaacaagcagctgcattgaccaggaagcctggttctgataaagtttgctatgaaagaaagataagtagtattatctttagtcctggtcggttcagcgatcatgcgtatgatgacagatttgcaaatgagagatctggtccaagaatctccgacttttctatgtctaatggtggtgagcaatttaaaactgattttcagcattctggtacctgttcaagtaaagatgtattgcctcatgtaacaaatacatctctggaaacaaactccaaaagagatgcagatggaattcatcgtccacagcaaatgtcaattggcagtttgttagcaggggagattgaacccgcgatcttccctcctttcccttcattcttaaccacccaaccaaccttatatcattgtgtgccttgcttaagcatgacattttcccttgtacaactctctggtaaacgagccagagatgaattacagcagtactggagaactacctcattgggatcaacagacagcaacctgtcatccttaagatcttacagttctggtggtttagttgattttttctcagaaccattccaagcttctggaccccatcaaaataaagtgtcttgtactccacaaccatctgatctgggaagtactgttagttcagatctttctgaggcaccagtggcacccaaaccattttcttcatctgcttcatctattgaccttttccagttaccagctgcaccctctcaggcttcatcagtggatctgtttcagtcatctgctttatctgcaattgcatctttcaatgagcgtcaacctttgaaaacatcacaatcctcatctgttgactttatggacctttctcagcagccatctgctgcaacctcaagtgagaagtcactggagttgtctgtcccagaaaatgaaggatgggcaacatttgatatgcctcagcacacatctactgcacaagtagaaattcaaccagcagtacaggaaaaatttgatccatttttgaacttaaatgcaaatacgctatggccatgttttgaaacttctagtgctagcgctctttcttcagttacatctaatttatggcgtgatgtcacatggaccagagaagaacaagtttctgttatggcatcaaactctcaatcatggagtgcatttaaggatcctgctaactctgttcctgtggatgctcttattactcaaggatcacaaatgcatgatcttccgtcaactgatgatcagtttttggatttaagagcttctgagggatccaataaagatggtatgcaccgcattgaccctgttgctgggtttgatcatgatctttcatcgcattttgttagtggctcaccatgtcctccatctgcatttcctccaatgggagaggttcagcctaatgaaatcaaccataaatcaactaatccatttgattatccttttgattcagatgtagaacataataatacgtgtcaattgcaattccttgacgtcagctctctacaagcagctctgccagattcccagctaacacccaccttccaaagtggtattgctgaaccatggctccctcagaatacactgaacccttatttctcctctgcaggacaaggtggtccttcaagactcatactggaagttcaaacattttaa

SEQ ID NO: 80343 - DNA, 1260 bp, Glycine max
  Peptide Sequence Number=SeqID_172028
atggcgctatcttcatcttcatcaccaccgcttcttcccttcgatctccaacggcaccgtttagttagcctcaaaccctatactcgttctcgttcttctcagtctcagcacaccgtcaccgtcaccgtcaccgccgctaaagctaaagcttcttctgctactccgttagtttactccaccagacaagggtttgacaccgtcaacattgccgaagatgtcacccagttgattggaaatacgccaatggtgtacctcaataaagttacggaaggttgtgtggctaacattgctgcaaaacttgagtctatggaaccttgccgaagtgtcaaggacagaattggctatagtatgttatctgatgctgaagagattggagcaatttctcctgggaagaccattttggttgaaccaacaactggaaatacgggacttggcattgcttttgttgcagcaacaaaggggtacaaacttatagtcacaatgccagcttctgttaatgttgagagaagaatccttttacgtgcatttggtgcagaggttattttgactgatgctgagaaggggctaaaaggggcagttgacaaagctgaagaaattgttcacagcacaaacaatgcttacatgtttcggcagtttgataacatgactaatacaaagatccacttcgaaactacagggccagagatatgggaggataccatgggtaatgttgacatattggtagctgggattggaactggtggcactgttactggcactggacaatatctgaaaatgatgaacaaaaatataaagtttgctgacagcatccacattatatttctcatatttggaatctctggagacctggctctgtgtcctgtgttggaaagggagagggagagggtggttggggtggaacctgcagacagaagtgttgtttcgggtgacagtcctggtttcatgccaagcattttggatgtcaaactgcttgatgaagttatcaagaataatctgctagaggttattctctttggctttggtatttctatactaaagagcaagctttgtctcgttacaaatgttgaagcggttgaaatggcaaggagattagcattgaaagaaggtttgctggttgggatttcttcaggagctgcagcagctgctgccataaatttagcaagacggcctgagaattctgggaaacttattgtgaagtggcagttgatggcaaagcataagagtgtgacaaataagggcttaggaaaagatgctgtctaa

SEQ ID NO: 80344 - DNA, 702 bp, Glycine max
  Peptide Sequence Number=SeqID_172029
atggggttccttcattttgggagaaaaagggaagattccaaaagaaaacatggtagaggagctggtggtgcagggtcagtgaaccgttggtctgattggggctgtgaatcttgcctttcatgggtcaatgatggaagtgactataataagcttcattttgttgagaaggagcctttgttaggtaggccatacacttcttgtgagggaaatgatgcttgtctaaatgcactatcaatgcttgctgggaagaaattttggtccccattgtcatttggttattcatatatgtcatggtatgagcacttgggtcccactgtttgccttgtctattgcagaaatcacaggatatgggagagcatcctaaaattcattgctcgcaagaggcatcttcatttcttgaccatagacttaaccaggcacactcatcattcagcttggagtaccatgcataatgtgatatgtggaggagaaaaatttgtggatagttatctaatgattttgaccaaagctggagtcagaataaatgtgattcaaggtgataaagacaaggctgtcccaatggagtgttgtagtaagttaaacttgaaggctcctaatgctgaaatcagcatcattccaaatgcaaaccatggcactgtactatttggcagaaagaaggaatttgcatgtagtttggagcatatatgggaatcttgctgttga

SEQ ID NO: 80345 - DNA, 573 bp, Glycine max
  Peptide Sequence Number=SeqID_172030
ggtgggcaatcgattacaaggcttaaaaatgaagacaagaggctaagatggtctctggtaatccattaccaaggggcttcaaaagggaactggaagactatggaggcctctggtaatcgattaccagtctgtgtaatcgattacacagaggaatgggtcactggtaatcgattaccagtgcctagaggggagcttgggagaccctcgaaggcaatgcgaggtgctggatttcggggcatgattcgattcacggctacttcattggtgcatccagatgaacccgcgcgtacgcttcagcgcactgtggagtggatactacccacacctacaccataccgtctagtggagccagtccaagtgatcgaggtgacgtcatccgaggaagaccctgaggaggaccctgaggagctacctctcgagcctgctgtggatgctcttgactttctagagggtgatgaggacgcagttcctgaggtggattctcccgaggacgtcatgtcggcatctgaggcagactctacggaggatagtggccctggagagatggcgatcagtggaggctcttcatcatag

SEQ ID NO: 80346 - DNA, 363 bp, Glycine max
  Peptide Sequence Number=SeqID_172031
atggctgaagagccaagaagagtaaccctggaggattattcaagttctactgtgccacaatttttcactagtattgcacaaccagaagttcaatctcagaccatcacatatcctccttctttgatacagctgattcaaaataatttgtttcatggtttacccattgaagacccttatgctcacttggctacctatatagagatatgcaatactattagtctgaagtcatgggatgaaatagtagaaaagttcttgaagaagtacttccctgaatcgaagactgcagaaggcaaagctgccatcccttccttccaccagtttccagatgaatcgttgagtgaggcacttggtgggatcctctag

SEQ ID NO: 80347 - DNA, 434 bp, Glycine max
  Peptide Sequence Number=SeqID_172032
ggtttggggttcggggtttggggttccgggttcggggttccgggttcggggttccgggttcggggttcggggttcagggttcggggtttagggttcagggttcggggtttagggttcggggtttagggtttggggtttggggttcggggttcggggtttggggttcggggttcggggttcggggtttggggtttcgggtttcgggtttcgggtttcgggtttcgggtttcgggtttcgggtttcgggtttcgggtttggggtttggggtttggggtttggggtttggggtttggggtttggggtttggggtttggggtttggggtttggggtttggggtttggggtttggggtttggggtttggggtttggggtttcgggtttcgggtttcgggtttcgggtttcgggtttcgggtttagggtttagggtttag

SEQ ID NO: 80348 - DNA, 249 bp, Glycine max
  Peptide Sequence Number=SeqID_172033
atggtctgtggcggcgatggccagcagcagcggtggaggaggatgatccttttcgcttcttcgatgattcttccatttgatgaagttttagtatatggtcaagaaggattccatagtcagaaagttgttgcttcatccataagatttgtgcacaacaactgccggcagaaatatattctgcttctgcagtggataaagcaacagtattttgtttcttactatgccaagaaactagagcagatccaatga

SEQ ID NO: 80349 - DNA, 540 bp, Glycine max
  Peptide Sequence Number=SeqID_172034
atgcaagagaagactagctctatgaagtgctttaaatgtcttggaagaggacacattacttctcaatgccccaccaagaaaaccatgattattagggccaagacatttatagtagacaagatgaggctactacttcaccttcctctagtgaaagtgaaaaagcaaaaaggggaagaatctagtgaagatatctacccccaagaagaaggacaacctttaatggttaaggaggagtgtaaagaggtaagtgtctcctccaagaggttagctaagaaggaaaggcattttgaaataaagacaaatattaaagaaatttcccctcttaagacaacctccacatttttctcctttgtaaaaaagacacttgttagcattgtctcacctcttaggcttgagtttattcctcaagtaaaggagttgttggatgagggtttggttcgcaagagcttaaatctttgtgctttgttggtgcccgaaataggggttctcatgaaccctaagagaataaaggtcattcctgagtggcccgctccaccaagt

SEQ ID NO: 80350 - DNA, 357 bp, Glycine max
  Peptide Sequence Number=SeqID_172035
atgcacaatgtgatatgtgggggagcaaaatttgtggatagttatctaatgattttgaccagagttggagttagaataaatgtgattcaaggtgataaagatcagattgtcccaatggagtgttgtagtaagttaaagttgaaggctcctaatgcggaaatctgcatcattccaaatgcaaaccatggcactgagaaggaaatagatgttgctgagtcatcaattcaagtgtgtaagggcccacatggaatgcaagaggataattctgttatgcatgatccggaattacagggaatgcgcaaaagcaccagagcacgcaaggccaacaaccaattgaaggatttcgttacttcttga

SEQ ID NO: 80351 - DNA, 2434 bp, Glycine max
  misc_feature (2358)..(2358): n is a, c, g, or t
  Peptide Sequence Number=SeqID_172036
cgtttgccgccgaaaatcacgttcccggctttgcccaaccggtgacctttgacagcaaaaccggtgtgctgctgctcggcaagccggcggcctgtgatgcatatgacttcgcgggaaatcgtcctgctggcgatcgccgtgctggctggcgcctgctttacgtggttttcgccgtgcgaactgctgctgattgcgctgggtatgacgctggtgatcaccatgggcggcgtggacgtctcggtgggcgtggtgatgggcgtggccgcgtggggcgtcggacaactgctgatgctgcaatccccgctgctggcggcgctggccggaccgcttatcggtctgctggcagggctgatcaccgcgctggtggtggtgatcggccgcattccggcaattgttggcacgctggggctgttcggcgtctggcgcacggcgctgtttgtgctgctgggcgggcagtggctttccggtctgccaggcgatctgacgcatgcgctgatgcagccgctgctggggctgccgctgatggcctggctgattatcgcggcctgggcgctggtgtggctggcgctgcgccatacgccgtacgggttatggctgctggccgccgcggcgtgctgtgcggcctggccgccacctgctacatcgccacctatcgtaacgtggagatgaccgtcggcggcacgctggcactggaggcgattgccgcggtgtctgctcggcacgctgctcggcgtactgctgttgcgcattctgcaaaatggcctgctgctgattggcgtgccctcgctatggcaaaccgtggttaccggggcggtgctgttgctggtgctgagcagcgaagcagccagtgggcggctgttatcgctaaggaggctggcatgaaactgtggcgcaaagcccccgatctgacgctgctgctggcgctgtggctgttgctgctgggcgccatcgcgattgtgctgccgcagatgctggcggcatggtcgctatcctccatcctgcagtttgccacgctgctgtcgctggtggcgcttgggcagtcgctggtggtgatgactggcggcggcggccttgatttgtcggttggcggtaacgtttcgctctcggcgcctggccggcgcgctgaacggcctgctggtggcgcgcttacgcctctggccgctgatcgttacgctcggcagtttttatctgttctccggtttggcgctggcattaaccggcggtgcggcgctggccggcgtgccgccgctgctgacgcagtggggccgggcggccatgctgtccgttccgttgcctttcttaacctgtgtcatcccggcgtttctgctggcgtggctgatcctcagcaacagcgcctggggcaaatggatttacgcctgcggcttcaacgagcacgccacgcggctggtgggcattccggtcgatcgcctgcggctgctgtcgctgaccgccgcgctgctgggtggcgtggcgatctttggcgggcgcggcagcgtagctggcgttctcgccgccgcgctgatgctggtcaccctcaaaacctgcatgttgcagctggggctgaacagcgtgtggcaactgggcgtggtgggcatgctgttaatcgtggtcgtatcgcgcagacattatgcgacctgctggcgtttccctcagtggtaaaggtcgatccgcgcgaggccgggccaggcgagcgcgactgccagcactatctacagcagcggctgatggcgctgggcatggacaccgatctgtgggatccggatggcccggcgctgtaccagaagtatcagggccgcccgggtgccaataaaggccgcaccttcgaaggccgtcccaatctgggcggcaccctgagcggatccggtggcggcaggtcgctgatgcttaccggccatattgacgtggtaccaccggggccggctgagcactggcacagcgatccatttgtgccggagatccgcaacgaggcggtatatggccgcggggcggtcgatatgaaaggcggcgtggcctgcatgctgatggcggtagagctgctgcaggatctcaacgtgcagctggctggcgacgtggtattcaccacggtagtggatgaagagatcggcggcatgggctcgctggcaatggtggatcgcggctttaaagccgatgccggtatcatgacggagcccactgccaaccgcattgcgccgatttgccacggcattttgtgggcgcgcatcattctggatggcatcggcggccatgcggaattaacgccgaacagctgggacagcagcggtccggttgatgccgtgatgttgtgccgccagatgctggacgggctcgatgtgctgaaccgccgctggcagacgcagnccgacaaaaaccatccactcatggatctgcccaaccagattatcgtgacgcaagtgaaagtgggcgagcatccggc

SEQ ID NO: 80352 - DNA, 324 bp, Glycine max
  Peptide Sequence Number=SeqID_172037
atgggtaaagcagaggaggtgcaaaagaaggtgaaggccgacatggaggccatgaaagagaaaatggccacaatgatggaggccatgatgagcatgaagaagataatggaagccaatgcggttacaattgccgctactagcactgttgctaaggtgaacccgatgcccccatctggcctcaaccaaatgaatcatccaaccttagatatgacacatgaaattcctcaccacaatctagccgacttcgagccttgcctcggatatgccactgaagggcaagcagttggtggtatacccctacaaaaccctttggagggcccttag

SEQ ID NO: 80353 - DNA, 570 bp, Glycine max
  Peptide Sequence Number=SeqID_172038
atgggtgccaaatacctcgaagtggtcaaacgagggtcgcatcccaacaacggatggtccccggacgaaattagggtcaagagcctaggaatcaccagtctaaaagagttagggcagttgatgggtcagctccagcgacaagctttttgcaaagcttacggtaaaatctgggacctagccatggcagaggtctccacaaaggccattgcctccctcgcccagtattatgaccaaccattgaggtgcttcacctttggggacttcaagctattgcccatggtggaagaagttgaagagatcttgggatgccctctagggggaaggaaaccatacctcttctcaggattctatccctctttagctagaatttctaagatagtccaaatctcggcgcatgaattagaccacagaaagcaagtcaaaaatggggtggttggagtatcgagaaaatgtttggaggcaaaagcaagaatcttggcaggtagaggcgaatgggccccgttcatagacatcctcgcactttcgatcttcggaggagtcctctttccaaatgtggaggggatcctctag

SEQ ID NO: 80354 - DNA, 653 bp, Glycine max
  Peptide Sequence Number=SeqID_172039
atgatgataaagcccctcaatcgcaccctgcgcatgggcctgctgtgcctgttggcgttgagcgccgccgcctgtcaaaaccaaaaatcgggcaaacccgccgtgaacacccaaaatcaggctgtgcaagcgccgtcagaagaggctttgcgcaagcagcgtgaggccgagcagctgcagcagtgccagcagcaactgggcgcattgcgcaccatcaacgagaagcagcatcagcgctataaacaggccttcgacagcctgatgagcggcgcttcgcagtacgccaatctgcgcgcgcgggtaaacggcgacacgcaggagacggtggatgcgctgtatcgctacaaggtcaactatctgtgcgccggggtgaatcaggcggtgttgaccgggctggcggatcgcggagagcaggcggacgacggcgtgcctgcgctgctgcagtttgccgagcagtatcaacggcagagcaccgggccgaagagcgaaaacgcggcgcccgccgaccatgcgtcggggcaaaaaaagcgtgagccggcgaagcgcccgtcggacacccaccagccggcttcaccggccaaagcttttacgctgagccaggcattattggcgcgtgaccaacagctggcgcgccagcgaatggaactgacgat

SEQ ID NO: 80355 - DNA, 375 bp, Glycine max
  Peptide Sequence Number=SeqID_172040
atgtctttaccctctggcgcagcctgcgttttggcgacaacctgcaaacctggtttgagcaacatacggcgatacctgcgccccgcagttcgactggcaaggaaagtgaggaacaacaatgaaaacgagggctggtgtgctcaccgttgccgctgccgcgctactgactggctgtacgccgcggatgaacgtgcaggcggcggcgctgaccctgaacgacgcccgggcgcagggccgggtgggggaaaccctcagcggctatctggccccgattcaacaggacgcggaaactttggcactggtcagccgcatcaacgcggcccgcacggaaaactaccagaaactggcggacagcaacaatctgccggtggatga

SEQ ID NO: 80356 - DNA, 342 bp, Glycine max
  Peptide Sequence Number=SeqID_172041
atggcttctagtaatcgattaccaattatcgcgatggcagcgcagttgatccatcattgcattgtgatggagtgcctagagggtgtttgggagaccctcgaaggcaatgagaggtgccgattccgtggcacaattcgactcactgctacttcattagtacatccggaggaacccgtacgcacacttcatcagcctgtggacgcccttgacttcccagaggatgatgaggacccactccctgatgttgattctccagaggatgttatgtcagcatctgaggtagactctacagaggagagcggccctggagggacagcgaatagtgacaactcttcatcatag

SEQ ID NO: 80357 - DNA, 730 bp, Glycine max
  Peptide Sequence Number=SeqID_172042
atggcggctgataaccagcccgaggccgttggccgcgccgccaatgctatgcaggtaatcgtcgccgttaatcaggcgtacgaccttttgcaggatgcggaaactgtcgccctccggcgccagcgtccaggtgacgtcagcggcgtagtgctgttcattgcccttgcggtactcgtaaaggaattgggcgcagcgtacttcgacgacctcatcgctggcgctgagcaggcgataacggccgctcatgcggatagcgtagttgagcacattggcgaaatcggtggtctgctgatcgatgggaatgatgtacattccctcagcgcgccacagcgccagccattcacggaattcgccttgatcgagcatctcttcggcggcgcgcatgccggtttcggcgctgacgtcgctgcgcagcgtcggcggcgcagcctggttggcgatgccgagctcagatttgttcagcgtatcgccgtactctccggatatgcggcccgcgcagcgcggaacgaggccatacaggcgacattggggcaggtaaaaccgttcgttttcaccgctgcacgcagacggtggcggcgcggtgcggcacctgctgactcgtcgtggccttccatcgcgcagaacggcctgggccagcctcgaggcgaaacctttgcctcgacgaagttagagcaggtatggaccggctacgctttgcaccagtgccgccagcgtttcggcggtatggctg

SEQ ID NO: 80358 - DNA, 753 bp, Glycine max
  Peptide Sequence Number=SeqID_172043
atgcaatctcagggactggcactgcctccgaagcctctggttggtctctcaagtcctcgagtaagcacaaacgagagttgtgttgatccctcaggaaatgatcctgagacgggtgactcagataggtgcgacttgtacatcgaagcaaatcctgctcgcctggttgccctggggagagtttatgagggatccactattgttcataacactcctttgtttcctggccaagtaaaggtgggtatggaggaggttaaagatccagatgcttcaattcttgtacccactgatgaggtttccatagtggggcaggcaattcacaccttccttgcttggccgacacatctggtcaagtctttatcacagcagacagttgtgtctccaacaaaaccacctccaaagttggatccagaggtcgatgatccactttatctgatgacattgaccatcccagagcttttcttgaggccttaccaggttacatgggatgccaccgtgttcggggtctttaatccagacttcccgctctacataaagcacgaagacctctccgaaatcgcacatggtggtcaatgtctcagcatatcaatgttacagttgtggattctgcatctgactgaaacaagtatgcgagtggggaattctgatatctatggattcctcgagctacagtccattcagaggtctaggcaatcgcagtttgagactgaaatggacattggcagatggcggtcatcatgcccaaggaacacctag

SEQ ID NO: 80359 - DNA, 324 bp, Glycine max
  Peptide Sequence Number=SeqID_172044
ggaaaactgccacgaagctacattataaacagaacctcgaagagagttaagcttcgttctcaaaagcctcctgtcgcaacgtgccctttgcaggcgagcgaaggcgaggctcacgggtgcgatttacaaaggaagaaagatgcgcggagtcgccaccaacgtttatttgtggaaaacgtcgggaaaaccgaaggaaaccggtcaaaaatgaaaattctaagttcgggagttgtagttacgcttgaggaaggtattagcacctctcacgtttgtctcaaaggacaacagcctatttttaagaattgtggaaattgtattacctaa

SEQ ID NO: 80360 - DNA, 539 bp, Glycine max
  Peptide Sequence Number=SeqID_172045
ggatcctgttgaagcagaacaatattcccgacaaatgatggagcgtggtcatggaatgtattacacgccagcaacattttccgaatatccttcacagatgtatcagtatccttttacaggtcatcatactgatacttctgagacctcacattcgttcggtggtgttgcggaaacacagcctcatttttcatggcccactatgactccttcacagcagcatgatgcccccatggcaacacctaacgccctatttgctccacaatggaataagcggggagacaacgcggcgacagaagaaatccttatcgtcaagcgcgaagatgggatcgaccatgtggcacatcttcacgacatcacggacaccataatgactgattttcatggttatggtttagaggtttatggattatgtcttggggttacgatttatgtgtttgggtttagggttagagcttacgggcttggattagggagcttatgggcttggattaggggtgggggttatgatttagggttagggttagggttagggttgaggg

SEQ ID NO: 80361 - DNA, 438 bp, Glycine max
  Peptide Sequence Number=SeqID_172046
atggtggctcgggtgatgctggggcacggctacgagcccagaatgggtttgggcaagaacaacggcagcacgaccagcctggtaagcaccagaggaaactgtgggaagtttgggttaggctataaacctacgcaggctgacataaggaaaaatatctcagaaaggaagaataaaggccagagcccgcggtcgggacaacgagctaaagaggccccgccgtgccacataagtaggagcttcataagtgcaggtactaataccggggacccggccgtcgatttcgagcaagaagcaaatcggatggagaatgaagaggacgaggatatagggcttcccctagagctggaaaggataatcgctcaggaggaccgagagataaggccgcatgaagaagagacaaaactcgtagacttaggaatcagcagtgggaaaaaggaa

SEQ ID NO: 80362 - DNA, 171 bp, Glycine max
  Peptide Sequence Number=SeqID_172047
atgcagcagaaacgacatcctcatgctcagtcatcttcacaaccaacaattaactacacttcggaatatgatagttcgggctctaattttttaactgcctatgaggattgtcaatctccaactaatcaacctgtaatcaacactgaaggtaataagtgcacatgctcttaa

SEQ ID NO: 80363 - DNA, 635 bp, Glycine max
  Peptide Sequence Number=SeqID_172048
atgttagtgagctgcccctcctccgcaccgtacgtagaagcggcggaagaatcattggaaacggctttccattcctttgaggtggtgagctgcgcctctgtggaaccgagtccgtcgctaccttctctctccacagtggccataatggtggcgcgtgttatgctcaggaacggatttgagcccggaatgggtctcgacaaggattgcctcgggaatgccgacgtggtcgatatcaagggaaatccatacaagtatggattagggtatgaacccgggatgccagggaggaggaacgtgccgtcaagatttcaggcggatagggcatggcccagccgtattagccagtgtttcaccagcgctggaatgacgtccgaggaggaggtggctgcaatagaagaggagttccctcaagacccaccaagttttgtgcaaccatgccaccccgattcccaagtggggaactggcgcgtgataagccagtcagaaatctatgccgctgattcaatatatgagggtcgattctttgaggatcctaacaacgagggtttgacaatcgatttcgatcgagatataagccaaacgataaatgaggaagaggaagaggaagaggacgacctgtcgccggaattggagag

SEQ ID NO: 80364 - DNA, 126 bp, Glycine max
  Peptide Sequence Number=SeqID_172049
atgtaccctctcttgttcttagtcaaacccaagctaaaggcccaagtgaagaaggacgaaggcctaagtggagaaggacaaagcccccgagtggagaaggatgaaggcccaagtggagaaggatga

SEQ ID NO: 80365 - DNA, 1745 bp, Glycine max
  Peptide Sequence Number=SeqID_172050
atggtctataaattggtggatttatttcttggagataaagaaacggttgtaaaacctaaaaaaactgcttatacagcatccgaattaaaaggatttgaagggatttatgagcgtatcccaggtagctactttgatgtttctgtaaaagaaaacaacctttacctaaaaacttataaacaggaagaaggagaacttttagaaccagttggagataaccggttcagcattccttccgttgctacggcaagccttgtttttaataaagattcagcttttttcaaaattgcggattttacatttccgatgaaaaaaatcagaatgaatccgcctaaagtggatttgaaagatttgaaaaaactggaaggattttaccgaaatgaagaattcaattacgatgtaccagctgttcaacaagcttttattcatcaaaatcctacttcggacagcttgatttccaatggacttcatcaggtacttacacttttaccagcacaggatatacagcgtttctcgctgtcgggtactataaaatcggatggtacacagtctttagtcatcagcctttttgatgctgaaaatacattgataaaaaccgaaactgctgaccggcaaggacagttcaggttttctgccctgaaagtcggtcgttaccaactgaaagtttacaggaatggttttgaggtttatcattcagaaaatattcctgtaacagaaaataagatgcttcctgttattgatcttacagtaaaatccattgaagaagttaccattaccaaaacccgtccttttatagaaagacaggaggggaagatgatccttaatgtagaaaacagcatttccgctaccggaagctcggcttttgaaatcctggagaaagcaccaggagtgagcgtggataataatgacaatttaagtcttcacggaaaaggaaatctgctggttcagattgacggtaaaaatacaccgatgacgggaagtgaccttgcgggttatctcagggggattccctcagcctccattgataaaatagaatttgttaccaatccttcttcgaaatatgatgcagaaggatcttcgattatcaatatcagattaaaaaaagagcaaaagaaggggactaacgggactgtttctatctctgcgggagccggtaaatatataaaaactaacaatacggtcagcatcaatcacaggagcgggaaggtgaatgcttttgcaaactatggctttgttgatagaattttttacaatcatctgcttttaaacaggaatttttatgaaaacaaccaatttaaaaaagcttttattcaggataatttcctgaagtttggaataacgggccatatgaccaggatggggatagattacgatctgaataacaagaatattcttgggctttctgtgggactagtagctaataatgttaaaattgacggaaatacctcaagcctcacactgggaagtaatcagcttccggaaagtaccttcggaaccataagtaaaacccggaatcatttcgctaatccttcccttaatctcaaccataaatacagccttgattctctgggatcagaactaacaacggattttgactatatcaactattcaaacggttctctacagaattttgaaaccaggaactacaatttatcgggtagtttggacaggcttgatattctgaaaggggatatgaaaggaaaactgaatattttttcattgaaaagcgaccttactaaaaactttaa

SEQ ID NO: 80366 - DNA, 279 bp, Glycine max
  Peptide Sequence Number=SeqID_172051
atgacattgaaatggaatgttgatgatgttggaaatgcattgagatgggggtgcgctgaccttgtcagatgtcccttgtgtgggaaactagagtggttaaagaatttaagcatttctaaggggatgcttagaagctttaattcatccatggtcaagtacttgatgacgcctatggttcatgccttatatgacacgggaaatagtataaactgtggcagtatgtactttgtactagggggtgtgtcacctggtagggaactcccttgtggcccaggctga

SEQ ID NO: 80367 - DNA, 345 bp, Glycine max
  Peptide Sequence Number=SeqID_172052
atgccagttttagaattatacatagaaaaggatgttgctggtggttctgcgtttcattctgcaaattctgttagatcatgtggaaataatttatctaataatgagtcggaaccgccaagaaatgtaagcaatttacatcaggatgaagatgaagaagatgatgatgattatcttgtgtctaattcatacgttgaagactctttagatgaagataatagtgttgatgatggaattcaaaatccattttggaatgatgctttccattataacaatatcaattggagtcatcctgatgaggaagacatttgcagtttggaaatgccatctacttttaatgttgggtaa

SEQ ID NO: 80368 - DNA, 1182 bp, Glycine max
  Peptide Sequence Number=SeqID_172053
atgttgctcgaccgggcgaaacgcgtcggtttcctctccgacgagaactacaagcttgtgaacaagattcttgaccggtccgggttgggaccgtggacgtatgtcccggagggtctcctggagatccctcccagactaacgttggaggaggcaaggaaggagacggacacggtgctcttcggggccgtcgacgagctcttggagaaaaccggtgttgaagccaaagacattgggattcttgtggtgaattgttgcttgttcaatcccacaccatctctctctgactccattgtcaaccggtacaagcttagagggaacattttggcctataatcttagtggcatggggtgcagtgctggggttcttgctgttgactttgccaaacagctcctacaggcacacccgaactcgtacgctttggttctaagcacagaaaacgaaatatcaagcatgtactggggcaacaacccttcaatgctgctggtcaattgcctcttccgcatgggcggctctgcagccctcctatcaagccacctctccgaccgccagcgctcgaagtacgagctcttccacacgctccggacccacgttggtgccgacgacaacagctacaaatgtgtctttcaggaagaggacgatgagaacaaggtaggcgtgtctctatccaaagagctcatgaacgtcgcaagggatgccttgaaagtccacatcacctccctcggcccggtggtgctcccgatctctgagaaactcaagtttctggttaacctaatcgagaggaaggtattgaagacgaagatcgagtcctacatgccgaacttcaagcttgcgttcaagcatttttgtatccacacgggaggtagggctgtgttggatcgcatgcagaagagcctcgagcttgaggattggcacatggagccttctagaatgacactttacaggtttggcaacacgtcttctagctcggtctggtatgagttggcatattgtgaggccaaggggaggattaagaagggtgatagggtttggcaaatggcgttcgggtccgggttcaagtgtaacactgctgtgtgggttgctttgaatacgatcgaaccagggtccatcaagagtccgtggagggatgagatacataattttcctgtcaaggttgatccactccctgtgaagagtaacaaatga

SEQ ID NO: 80369 - DNA, 393 bp, Glycine max
  Peptide Sequence Number=SeqID_172054
atggtaggagcagtaaagtgtgtcataattgccatgccagccacttgtctgagcaatggttttggtttgaaaagaaaaagtagtgtaatctctacattgagtgcatacacagaagcagtgagggagctggcatgtgagatattggagctaatagcagaggggttgggggtcccggacactcggatattcagcaagttcataagggatgttgatagtgactcagttctcaggctcaatcactacccacctataattaacaaggacaacaacaaagacatgtcacaacaatttaccaaggttggctttggagagcattctgaccctcagatcataaccattctcagatccaacgaagtgggtggcctccaaatttcccttcaagatggggtctag

SEQ ID NO: 80370 - DNA, 834 bp, Glycine max
  Peptide Sequence Number=SeqID_172055
atggctaagcgagtcagtctcgctaagccaccatgcctttgtagcttgaataagcctgggctaagcgagttagtctcgctaagcccaaaatggcctctaggaagaggaaatctactgcctctcggccctaggagccctatgacaccactagatttatttctgagggcgcctgggagagatatgcatagaacattcactcctggaacatccttccagagaggaatgttaatttatttatcacagaataagtcccctagacaagtcggagtccggggcaaattgattaagtttgttgctacctccctcaacacatttctggagaccccagtggttttggagccaggggagcacctcaccacctactccagattctgtcattcatgcccagaccctcaggagttcgccaccagactctgtattccagggcacggttttgttcttaatgctgagggagcaccctggaagatcctaaggaaggacctcaccaccctcgcccagacatggagtgtgttatcatactccaacctcgcccccacctctcacgtgtctgatcttaacatggacagggcaaggttagtttatggattagtcatgaagatggatatggacttgggctcactcatttctgaccagatctctcagatggcccagtccaactcctctcggcttgactttcctgcactcatcatagccttgtgcgtagctagaggagtcatatctgattccctcatgtttgagtccttgaaccccgccattaatttggcgtatattcagaagaattgttggaacccggatgatccttcaatcacatttccagggacctgcaagacttga

SEQ ID NO: 80371 - DNA, 642 bp, Glycine max
  Peptide Sequence Number=SeqID_172056
atgacatttggaattgctccacttctttggaaacgacaccttcatagatctagagaagtaacaaacggtgtaatccagtcatatgctcaagtcgagcaagttaaaatcggaaacactttagtgacttctttggttgaaaggtggagacctgagtcacacacgcttcatcttcttgttggtgaatgcacaatgaccttggaagatgttgctcatcaactgagtttacgcgttgatgttaaaaccccaaatcattttcccccccgcgcgatcagttaccaaaaccctttctccctttcttcctcattgctcaggctcgaaagacctatctccctttcttcctcgtcgtctcctcctcaccgtgccactcaacctgccattgaggttcatgtgactgccacaaactgctcaacctgcaactgcgctgctccacgagttcgggttttagacatagtcttggctcctggttggtgggttcgcaagtttgtggggtctgcgcagaaagctggtccatatattgtctgccttggtttttctggtttcctggccaattttcaggatagcaactcccctaaggctagctactttgctgcttttgttcctctggtcaactgcttgaggcttttggtcaatggtgtatattag

SEQ ID NO: 80372 - DNA, 334 bp, Glycine max
  Peptide Sequence Number=SeqID_172057
atggattcccaacctcacacacctcgtacaccaccaatcttggcgacacccaactcaacaatcacacctctatcttctttcaactacaagatttctgtcaaattagatgcaacaaactatcttgtatggctgcaacagattgaaccagtcctaagggctcattgccttcatcgtttctgtgtcattcctgagatacctcctcaatacgcttcggaacacgatcgccttgccaatattgaaaacccagctttcagcaactgggaattacaggaccagctcctcttagcatggctgcaatcatctctttcccctgccattcttccttctgtcattg

SEQ ID NO: 80373 - DNA, 117 bp, Glycine max
  Peptide Sequence Number=SeqID_172058
atggggaccaccacgggggtggagcttgccacccagctcgcccaggcgagcaaggttgcttcctccagacgcaacagccttccggaggaagaatctggaaggcccaagtgggtctga

SEQ ID NO: 80374 - DNA, 252 bp, Glycine max
  Peptide Sequence Number=SeqID_172059
atggtgacgttggagggagagtacggtgaggttcacggagctgaagttatcggtggcgcggccggagggagggaggacgcgaaggtcgaaccaagagagggactagaggagcacatggtagcgaaggacggttggggagaggtggtggtcaacggcgagatccgcagcaagaggtgtggcagagacaaggagggaggtgaattgggagagctccgacacgatggagaagagggcggggaggtagaggtttag

SEQ ID NO: 80375 - DNA, 2289 bp, Glycine max
  Peptide Sequence Number=SeqID_172060
atggaccacctaacagcagggcgcacaacacccaaggggtgcaaaccacccaacagttacaacccacccaaagggtgtaaaccacccaatagttacgattcacccaaagggtgcaaggtcagaagatgtgaatcaaggggacatgatccttgggaacagtcacagccaaccgttatgatccgcccaaggggtgcaaggtcagtagatgcgaatcaagagggcatgacccttgggaacagaataactgtaaactgtttagggacttttgtgattgagaaacagtgtaaggagtggatgcaaacttctcaaaatatgatctggagcagtgtattggttccttggggccttctccctaggataacgtcattctttgattctcaaggaaacgttgggatgacaccatcattgccaaagatatttcttcctggcccacctgaagctcttactgttctcttagatggttgtgttgttggttgtatagcttccagtgaagcagagaaagttgtggctcacatacgagaattaaaagtgtcatctgccgcagtgattcctgatgatatggaagtgggatatgttcctttgagcatggggggggcctatcctggtctttacctgtgcacatccccttcaagatttgttcggccagtaagaaatatatcaattccttccaatggaagtgaaaacattgaattcattgggccatttgagcaggtttttatggaaattagatgtcctgatggcggagatggtggaagaaaaagttcatttcctgcaactcatgaagaaattcatccaacagtaatgcttagtgtagttgctaatctcacaccatggtcagatcataatcagagtccacgaaatatgtaccagtgtcagatggcaaagcaaacaatggcattttcttcacaaactattcaacatcgtgcagatcaaaagttatatcatcttcagactcctcagactcccattgtacgcactagtacatatactaaatacaacattgatgaatttccaacaggcacaaatgctatagtcgcagttctggcatatacaggatatgatatggaggatgccatgattctaaataagtcatcagtggaacgtggaatgtttcatggacaaatatatcagacagaaactattgacttaactgaacaagggggaaggttagaccgatcttcaagaatgttcagaaaaagtaatttagagaaatcagcttgtccctcaatcgattcagatggacttccacatgttggtcagatgatacggccagatgaaccctattgtagcatttataatgaagtaacaagttccatacacaccttaaaaagaaagggttctgaagctgtttatgttgactatgttgctgttgatgtcaaaaacaagaagcaccttcaaaaggttaacatacgctttcgacatcctcggaaccctgttattggtgataaatttagcagtagacatgggcagaaaggcgtttgctctcagttgtggccagacgttgatatgccattttctggaaatactgggatgcgcccagatctcattatcaatcctcatgcatttccttccaggatgacaattgctatgcttttggaatctgttgctgctaagggaggtagcttgcgtggagaatttgtagatgcaactccatttcgaagttcagtgaagaaagacagtggggagtctgattcaatgtcaggttcaattgtcgatgatcttggccttctgctaagagaaaaaggatttaattatcacggtttggaggttctatatagtggtgtttatggaacggaactaacatgtgagatatttattggacctgtttattatcaacggctgcgtcacatggtttcagacaaatttcaggttcgatctactggcacaattgaccaggtcacccggcagccaataaaaggacgaaagcgtggtgggggaattcgatttggagaaatggaacgcgactctctgcttgcacatggagctgcatatcttctgcatgataggttgcacacctgttctgattatcacattgctgatgtttgttcactttgtggaagcatgcttacaacaacattcacccaacctcaaaagcggccagttcgggagattggtggtctacccccgggaagagctccgaaaaaggtcacttgtcatgcttgccaaacgagtaagggcatggagacagttgccatgccctatgtatttagatatttggctgccgagttagcagcaatgaatataaaaatgactcttaagctcagtgatggagctggagccggagcctga

SEQ ID NO: 80376 - DNA, 514 bp, Glycine max
  Peptide Sequence Number=SeqID_172061
ggcgatcggtgcgggcctcttcgctattacgccagctggcgaaagggggatgtgctgcaaggcgattaagttgggtaacgccagggttttcccagtcacgacgtttgccggaaacccctcgctcgaacccacaaaaccccctacactgctcttcgaagtgttgctcgaagagaaccctacatacactattggtactagggtgctgaaagtctcgtgggtgctcaaagctcaaagctttctccgcgaggaaagcttcaagtttcgtgccattttgttagatctcactgccattgtcactgtttgggttcgagggcaattcagtggatctgcactagtggatgagctccaggggcataatgctgtactgaaggactgcattgagcaattaacagccatagagtcatcaagaactagtcttgtgtctctcttgagagaagctcttgaggatcaggaattcaagctgggtcaagtccgtagccagattcaggtttggaacttatcccaattcaattag

SEQ ID NO: 80377 - DNA, 642 bp, Glycine max
  Peptide Sequence Number=SeqID_172062
atgactctgaacgtgtttttcatattgcaagtgacaaagtacaggcttgatgagaagtttaatgagcatgctttctcagtagtccaaccgggaattcttgataaaatcatttgtaggggatgtgaatgcaatacatctttagtggcttttcgaatacacgaggcaatacatttctgtgctggttttgacaaggatctttcattcacctcaaaaaggcctctctctgccaactgtgtagcttctttggagactgaggtatcagtgtctccagcaatagacactttctggaagtggcttaaagaagaaggtgttgtctctgccaagaccccagtgaagcctagtgtggtgccagaaggcctaggattggttgcactcaaagacatttctaggaatgaggttgtcttgcaggttcctaagcggctgtggattaaccctgatgttgtggctgcttcaaagattgggaaggtgtgcattggattaaagccttggctgcctgttgcattgtttctaataagagagaggtcaaggagtaattctctttggaagcattatttcagcattctgcttaaggaaactgactctactatatattgttgggtttcttttgctttgcttgttagggtgtgtttggataagatttaa

SEQ ID NO: 80378 - DNA, 168 bp, Glycine max
  Peptide Sequence Number=SeqID_172063
atgatcattatagggaatagtccaagtaggattgtcggcctaggatcttcttcatcaatggattcctttgcttcttggaagatgaatgacagcagaatggagaaggaagagagagaggagatgccacttcaaggacaagatgagtctagaagaagctcaccaccatag

SEQ ID NO: 80379 - DNA, 1680 bp, Glycine max
  Peptide Sequence Number=SeqID_172064
atggcttctccacctgcctcccctcctcctcctccttctgcttcttcggacgcttcggcttcaccatctgccatgaagcggacacgcaaagcctcacgtctacgatcgttgtctactaaaccacctggtgctgagagaccagtggtccatgtagatcttggtaccggcaaggccgacagtccccacaggaagaaattaagaacatatttggggattgtggcacgtgataaggtggacgtcacctatgagaactggaaggagtttaaatcagacctcacgaggaaatgggccctcgcagccaatcaggacggtgtggcggacactgtttgtgagaaatatggcattagcaaggaaaaatgggcccagttttgccagactcgtaaagacccttcttgggaggatgtgcgcaaaaaggcacaggccatccagaagcagaacactgccccccaccttctgtctcgtgggggttatgactatttggagcagaagctcctggctgagaagaccaagaagaagctggaggaagctgcacagtcaggaagcgttgatggcgtcatcgaccctccatccccggattcctttgaggagcaggaaacacagggatccttcgtcccccatggacgtcaggatgttctcaccactgttattggacgtccagagcaccctggatgtgtccgtgctgctggagccggtcagctgacccagcaaatcagggaccagctagaggagtccatcacagaaaaagtgacgcggcagctcatggcatccttcagccagatgcagtcccagattcagtctctgggacttgcagtgcctcccgagcctctggttggtccctctggtcctcgagtaagcacaaaagggagttgtgttgatccctcaggaaatgatcctgagacgggtgactcagataggtgcggcttgtacatcgaagcagatcatgcccgcctagtagccctggggagagtttatgagggatccactattgttcataacactcctttgttgcctaaccaagaaaaggtggctgtggaggaggttacagatgcagatgctccagttcttgtacccactaatgaggtttccttagtggggcaggcacttcacaccttccttgcttggtcgacacatctggtcaagtctttatcacagcaagttacatgggatgccaccgtgttcggggtctttaatccagatttctcgctctacataaagcacgaagacctttccgaaatcgcacacggtgggaattctgatatctatggattcctcgagccacagtccattcagaggtctgggcaatcgcagtttgagtctgaaagttacataaataattggatgcagagttcaaaatgcgatgtctatcttagagcctacctaaatgggccagacaactaccttaaggggattattaacagtgctttaaaaggtcttgatgatgctccacagcctaaatcaaaggctcctgctaggtggattgtcgtcaagtgtaatagacaaaaaggaagtactaagtgcggctactatgtcatgcactggatgtctaccatcattttaggaacttttaggaataactgggaagcgtattttaacgatcctagaccattggagccagagagattaaaggcgttgcggattcagtggacacaatattatctccgagttagagatcagacctag

SEQ ID NO: 80380 - DNA, 195 bp, Glycine max
  Peptide Sequence Number=SeqID_172065
atggtttcctttcttttatttcttgcttgtgacaatcctcacgattgcagcttaacagcaaatggatcttctttcttaggagatccttctgttccttcttccaagggtaagggtaaaaattcctatcctaggtcaaggtttatggccaatgagttgaggttttggctcaaaaggcttgtagaaggccggacatga

SEQ ID NO: 80381 - DNA, 210 bp, Glycine max
  Peptide Sequence Number=SeqID_172066
atggctgggacgccacaccctcacccaggagcgcagatcccgagctccctctttggtaggccaggtattggcataaaactccatgactatctccgggtcgaatttagccatgggtgtcacgagtggcgcctagcgcctacggcctatctcctcctgaaaatcagggaactcatcgtccctcagctggacccacctctctttaaggaatga

SEQ ID NO: 80382 - DNA, 207 bp, Glycine max
  Peptide Sequence Number=SeqID_172067
atgtcacgaaactttacggattacgcaaccatcccctcttcggattttggaaggttacggaactttacggattgcgcaataatgtttcttttcgactcccgacatgtcgcgaaacttcatagattgcttaacgatggctgtcaagttcctcgaagcggtcaagcgaaggttgcatgccatcaaacaatggtcctcgaacgaaattag

SEQ ID NO: 80383 - DNA, 234 bp, Glycine max
  Peptide Sequence Number=SeqID_172068
atgggcccgaaatctaccctaaggctcatgagaaccctagggtcttctcttgcatctttggcccaatcttcttggagtcttctatccaatgcacttggggctcagcagaaattcccaacagaagctttagccttccatggcaagttatcacctttcagttataatagggggttttggaagcaaaattcagattacgcagtggtgggggtgtctcctccacctctaggaacctag

SEQ ID NO: 80384 - DNA, 774 bp, Glycine max
  Peptide Sequence Number=SeqID_172069
atgcaggccctcacctccagaggactagacattcacgccttaagagcactacacgtcttcgccatcggagggctgcacgcctccacctttagaggacaacacgtccttgccatcaaagggttgcacgccctcaccttcagaggactacacatcttcgccatcaaagggttgcacgccctcactttcagagtactacacatccttgccatcagagggctgcacgtcctcgccatcagagggttgtactccctcaccttcagaagactacacgtccttgccatcagagggctccatgccctcatcttcagaggactccacgtccttgccatcagagggctccacgccctcatcttcagaggactacacgtccttgccatcagagggctgcacgccctcactttcagaggactagacatcctcgcctttagaggactacacgtcctcgccatgagagggttgcacgccctaacctttagtggaatacaggtccttgccagcagagggctggacgccctcaccttcagaggactacacatcttcaccatcaaggtactagacattctagcctttagaagaccacatgacctcgcaatcagagggccacacgtcctagccatcagagggctgcacgccgtcaccttcagaggactacaggtcctcgggatcagagggctgcacatcctcaccttcagagaactacacggccacgccatcagaggactagacatccacgcctttagaggactagacgtcctcgcctttaggggactacac

SEQ ID NO: 80385 - DNA, 231 bp, Glycine max
  Peptide Sequence Number=SeqID_172070
atggcacatcatgttccttttgcaggtgtagctgatttagatgatgaggggtctgcagatttaaggacaaatcctcttcaagaaggaggggatgatgcaatccttccaaggaggggacccatcaccagagtcatggctaggagactccaggaagattgggccaaggatgcaggagatgaccctaggattctcatgagccataggctaagtaaaaaagaggctaagtcatga

SEQ ID NO: 80386 - DNA, 482 bp, Glycine max
  Peptide Sequence Number=SeqID_172071
atggcttttgctttggctaacagacgcgggagtacatcaatcaccctcccccttgctatcaagcttatcgataccgtcgaccttcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 80387 - DNA, 198 bp, Glycine max
  Peptide Sequence Number=SeqID_172072
atgtcgttgcgtagcgctgttcatgtgtcctccgccttcgagtctagacccccgcgaatgtcattgcctagcgctgttcgccaattctccattctccactttttttcggagcctcatgaatgtcattgcctagcgctgttcatgtgtcctccgtcatcaagcgcggagcctctgaagaaaaaaaaagagaaggagtag

SEQ ID NO: 80388 - DNA, 596 bp, Glycine max
  Peptide Sequence Number=SeqID_172073
atgtctaaccagaagagcacagagtctgccataaagaatctggaggtccaaatgggacagctcacaaaacagttggcagataggtcatcaagcagctttagtgctaacactgagaaaaatccaaaggaagaatgtaaagctgtcatgacaacgagtagaatgggaacccatgtggatgaaagaaaagctgatcagaaggtggaggaagttaaacaacaactggctgatgaactgccgctggaaccggttgatgatttagttgaacttgaagaaattgttgaagaagcagaaggtgatgaagaaggagagacaccaataagagactgtcaagaaaaaggcaagagtgaggctaactcagaaaagaagaaagaggctactcctattgaatgtaagcagggggtgcaaatagcaatcaggcccacttgggccttccagattcttcctccagaaggcggttgcttctggaggaagcaacctggctcgcctggggggaggaatgaagaaggaaagggttcagccttcttggcacttcgtattctcttgaaattactaaggaaaattgtttacgtgaagaaaatccaagccaaggcgcttcc

SEQ ID NO: 80389 - DNA, 321 bp, Glycine max
  Peptide Sequence Number=SeqID_172074
atgggtatgagcccggaatggggatggaacagtaatggcatggcaagtttggtagagttcacggggaactgtggaaggtttggactgggatataagcctacgcgcaccaacatgaggaggagtgccctagaaaggagatccgataatgagtcctgtgaaggtaatgataccgaggagctagacgtcgattttgagcaactggtaaaccaagctgaggatggggaagatgaggattgggggtttccctcagagctaaaaagaatggttgaacaagaagacaaggaagttgatgcaatcctaccccgcaagggcattggatag

SEQ ID NO: 80390 - DNA, 81 bp, Glycine max
  Peptide Sequence Number=SeqID_172075
atggaagaatggtctcaaggtaagggtggatatgagaaggatatttacgctaaaactaaggaaaaagaggggcaatgggga

SEQ ID NO: 80391 - DNA, 489 bp, Glycine max
  Peptide Sequence Number=SeqID_172076
atgctgaaacatcttcaaattgcagaatcatcaaagaagcgaaaaggatcttcctccaccaccaccgctgttggccaccgctgccaaggaaattctggagaccatcctgcaccagttcctccttctctttcatcttcgcgatcatctatattattttcttcagatgatcagcgtcaaaggtactactctcaattctgtaataaagtcattctagaccctaagtaccttgaccttgaattttttgatgaagaaacatttgattgttacctagtgtttcaaaattctgctttgattgatttcatgactccaaaactgccctactttcccgaattagttaaggttttctataataatttgaaaattcaggatggtattctttactctaaggtgcataatattcccattgttattgatcagtccttgttctgttctttgactaaactacccaatcaaggtgttccttttgagggcacccttattgatgactag

SEQ ID NO: 80392 - DNA, 492 bp, Glycine max
  Peptide Sequence Number=SeqID_172077
atggccgtcctgcaattagttctttttcacaaactcagatttgagtttcatcggaccgaagccgtcgattttgcaatcgatattgtggtcaccttcaaccagacggatgcttttcactttagtgccgattttcagggtggaagagctgcctttcaccctgagatctttcactacggttacgctatcgccatctgccagcaggttaccgttggcatcgcgcactaccagcccttcgctgctgtcatccgcgctggcggaccagatatggccgcaggaggggcagttcaggccgggcaggcaggtaaagtcgtcatacattttcctcagtggtcggtatgcgatgaagaaggcaccgcaaaacgggcgccatcttataccctcatactttataaggacagtattaaagcatgttgccctgacgcgcctgggcgaccgcctgccccagctgccacaccgccatggcatagtgcgtgctgtggttgtagcgcgtga

SEQ ID NO: 80393 - DNA, 2300 bp, Glycine max
  Peptide Sequence Number=SeqID_172078
atgcgaactagcggtccagaatttctagaacgagttagcattacagcaggaatacctgataaagatggcgatgtgggttgctggagaggatttcataaattgggattagcactagcttttgaacatggatgcccagatgctacagtccccctcttttatcactcttcaaaaacgtggaagccacttattaaaagaggtttatataaagctgaatggcttaatgaagctatatttgatcttttcaatgaacctgtttactttgacgaattaaaaactcacagaccttgccttctaatcggaggccgtgggacaggtaaaacaacggtgttaagaggcttatcatatgaggggcaatatgcgtctttttctgcacacaaaaaaaatgtagaagaatggcctttttatgggatgtaccatcgagtcaatactaatagagtaactgcttttaggggaccagaaattgatgagtcaagctggactcgctatttttcacactatatcaacttgacattttgcaaacaaatattagactttgtaaagtggttcaacttaatcacaaaacttgacattgagttgaataaaagttctattaagaaaatttgcttgagccttggaattaatgaagttgatactttagaagaactttccgaagagttggaatatgctgtaattgattttgaaatttccgttaactcgataatagataacccgcctaaaaatctatctattcttgcggctccaatcgatatattgactgagtcgttgtgctcattatccatattcaagggtaaacagttctattttttaatagacgaatttgagaactttgaagattatcaacaaataattcttaataccattatcaagcattctaataactattatacatttaaaattggagttagagaattagggtggagacagagaggaacattaaactctaacgagtccttgatttctccagccgattatgcgttgataagtatttcagaaaggctgcaaaaaaataattttgagctttttgctaaaaaagtaataattgatagattaaaaaaagaattcactgaggttaaagacgagtgtattgaccccacaaatctcttaacatcaattacggaaagagaagaggctgaaatattaattggatctgaagattacaataaaacaatagaaagcctttcgactatagttagcaaaaaagatttagataaaattagaagcatagagagaggtatgttaggcttccttaaatacttatcaccagatgatgatacgtatgcacttaaagaatatgctctaaaatatttaaaagagccatcttcacttagaaatgaaatgaataatcatttctatgcctatctttttacactaaaaaaaggaaagactggtgtaagaaaattttattgcggatgggatgtatatctacttttggcaaatggaaatatttcgatatttaatagaactagttcatgcggcctttataaatcatatcgaaatgatggggttctttttgaacctattagtcccaagacccaaacagatgcggcaacacaaataggtaaaaagaatttgtctgaacttgaagggttaagtgtcgatggtgcaaaattaacaaaacttgttcttagtttaggacgaatttttcaagtgatggcatctgacggtaaagggcattcaccagaagttaaccagtttcatataaaaactgatagcataccatcagaagctaatgaggcagattttattcctgaagataattccatatacatcttcgggagatctggtgaagaacgttctaagcatattaattctgtatacactaatactcctaatgttgaatttagagaaatatttgctgaagacctttatggttttacatcagaaaatgaacataagttctatttacgttcggaaagaagcatattagatttcattgggttagtagaaataaaccaatgtgtttatatagacataacgggcttgactcattctgtatgggctagattaattcaggtttcattgaaccaaaaatataaagtgagagtagtttatgttgagccagatcaatactcaagaagcacagctcccgtggaaggacagatctatgatttaagtgaaaaaattcaagggatcgcacctttaactggattcgcaaaaatatctgatgattctgaaaaagactttcaatttattccattattaggatttgaagggacaaggctatcttttatcactgagcaagtgcaacccaacactgaaaatatcattccaattattggaacccctgggtttaaaccttg

SEQ ID NO: 80394 - DNA, 363 bp, Glycine max
  Peptide Sequence Number=SeqID_172079
atgttgctaagtagcaatgtcatctatatctgtgtaagagtggtcatgttggtgcgcatgatccgcactcgtctctttgcagcggcacgggtgaaatcttgccccggtatgcatagtagctgtgtgatagcctccctctctggttgtgcttgcacagttggccgtcctccaatatcagggggtggcccagggaccgtgcggatgtggagcacactgaaaatgaggacacgtagccctctaaaggtgagggcgtgcaaccctctcaaggcgatgatgtatagtcctctggaggtgagggcgtgtagtcctctcaaggtgagagcgtgcagccctctgttggcgaggacgtgtagtcctctaaag

SEQ ID NO: 80395 - DNA, 757 bp, Glycine max
  Peptide Sequence Number=SeqID_172080
ggcgttccgtgcgggcctcttcgttaggacgccagatggcgaaaggccccacagcaggaagagccccgccttcgacagatctccgcgaactgtcggaacggcgtcgtgcactgctctggtacgcacagccgcctgctgccgggatggtcaggatccaggcccagacgatgcgttcgatcacgccgaacttcagcgagcgcgggttcttggcgaagccgacgcccatgatcgcggtggagatgctgtgcgtggtcgagaccggcatgccgaagtgggcggccagggtcaggatggtggccgagctggtctccgcggcgaagccatggatcgggtgcagcttgaccatcttgtggcccagggtcttgatgatcttccagccacccgaggcggtaccggcagccatcaccaccgcacaggtcagcacgatccacatcgcgatgccgtcaccggcgtgggcgtccgggtgcatgaaggccagccaggacggcagatcgttcagtgcgccggtggcttcggcaccaatcagggtcatcgcgatgatgcccatggtcttctgcgcgtcgttgtggccgtgggcgaagcccatgtaggccgccgaggcgatctgcgccttgccgaagaaggcattgacgatgcgcggacgggccaggcggccgatggcgccaccacgccggccaggccggcgatcagcgcctcacaggaccatcaccagaatgctcagcaggaacatcggcgaggtgatcatcggcacgaatag

SEQ ID NO: 80396 - DNA, 246 bp, Glycine max
  Peptide Sequence Number=SeqID_172081
atgggtgcaaatgatatcatcattggtaaacagataatcaagtcaaactgttcagtatgcttcaagtcatgcatactactattcacaatcaaaaaaacaagttgtcgcaacctatcctttggagggagggcgacgcgagggctcacgggtgcatcttccaagaaaggaaaatgcgcggagtcaccaccaacatttattcgaggaaaacgtcgaaaaaactggaaagatgtggtctacgaactttaa

SEQ ID NO: 80397 - DNA, 285 bp, Glycine max
  Peptide Sequence Number=SeqID_172082
atgctgatgttcgctacgggatactacttgtttgtgtggatgcgaagtctattggcaagtgcaccaggtcgtcaagcgttgggtcctcttactgagcaaattgatgcaattaaggatgtttctctaattaaagatgtttctgtgttctatgctgaaggctcaagtactaaacatggatgtctcatagggaaagagtttacatcaattactcagcaagaatccccaactgagggtttagccttccatagcaaggaagctccttttacaatgaagaagaggagttaa

SEQ ID NO: 80398 - DNA, 196 bp, Glycine max
  Peptide Sequence Number=SeqID_172083
gaaagatgaccgatccaagtctaaaaagaagaatctgatgataatcatgaaacaggccaaatacagtctaaaggcccaagtggagaaggacaaaacccccgagtggagaaggatgaaggcccaagtggagaaggatgaaggcccagaggcagagacactatcaagactattaattgttgcggaaggcccaaactaa

SEQ ID NO: 80399 - DNA, 870 bp, Glycine max
  Peptide Sequence Number=SeqID_172084
atgtttaacccagaccagaatcgcctggcccccacgctggcgatgatcatggccgcttcacttgtgggatttatcaccggctatacggtgccattaatcagccttgagctggcgcagcagcaagttgctccgctttatgtcggcctgctggccgcgctgccgcccgctggaatgatgctctcttcttttctttctcccgcgctgtgccgtcgttttgaaatgggcgcgttgctcagcgttagcctgatcctgctggcgttggcgaccatcgcctcctgcatgaccaccgacatgacgctgttgctggtgccgcgtctgctaaccggactcgcctccggcgtcattatcgtattgggggaaagctggataaccggcggcgcggcgggcagtaatcgcgctactctcaccggcatctatgcctcggcctttaccggctgccagctcgccggcccgctgcttatctccgtcggccccgcctggcaacacgcagcgctgatggccattgtcgccattaccgccgtttgcctgctaatgctgcgtcatctgccgcgcggcagtcgcgaaagccttgccgagcgcgccagctggcgcagcctgggggcattcttgccagttctggcctctggggtattctgctttgccttcttcgacgccagtattctcgcgctactgccgctgtacggcatcgataaaggtttaaatgaaacgatggcggtactgctggtcagcgtcgtcctcaccggcgacgccatgttccaggcgccgctgggatgggttgccgaccgcttcggcatccgtcgcgtgcatcttatctgcgcggttgtctttagcctgtcgctactggcgctgccgtttatgctcgcctcgcgc

SEQ ID NO: 80400 - DNA, 659 bp, Glycine max
  Peptide Sequence Number=SeqID_172085
atgacggaagggtgtggtgaagggttttgccttgcaaaccttcccggtgatgcttttagtctatgggggaacttctttgaggcaaagaaacaaatgatggctgatgccaatcttggcaagccgttggttgaaatttgccccccggtcaacttcgtggttttgcccgttgttggcttggctagggtcggcggtgctgggttatggccccgtgctaagtttcggattggttggccccctcctcccccccgtgatcagttttgttgccaggattttgccaactttggcttgcgccccggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattgtgcgaatcaacggttcctctc

SEQ ID NO: 80401 - DNA, 279 bp, Glycine max
  Peptide Sequence Number=SeqID_172086
ggatcacgcctgcaagacacccagtggacccgaagaagtccaacagtgtcttggagttgtcaagctctaattatgggcctctgtcagtcctatggagtgcctgtcgcccccagcaaggtcatcaggtcccctactaatcgagctttcatcaagaagtactgcgtccccaggcaggtgcagggcgaaacaccacagcggcctggggatggccgacagcgggcgacagacgcaccgccatcacctctagagttcacctcagctcatccacaaaaacgttag

SEQ ID NO: 80402 - DNA, 234 bp, Glycine max
  Peptide Sequence Number=SeqID_172087
atggaagctcccgagaaattaaaattgtcactacttttcactcggatgtccgattcaggcgcattagatatcgagacgctcgaaattgaacgacaagaagctctcgagaaattcaaatccacatcacatattgagagtccctcgaaattgaacaacggaagctcgagaaatacaaatggtgataactttacacacggtggaccgattcaggcacatcacatgtcgagacgctag

SEQ ID NO: 80403 - DNA, 49 bp, Glycine max
  Peptide Sequence Number=SeqID_172088
ggtgaacactgtgaaaattttcccggacgcccaaaatggactcggatga

SEQ ID NO: 80404 - DNA, 252 bp, Glycine max
  Peptide Sequence Number=SeqID_172089
caaaagaaagtttataaagataaccactcgggtatttccgctcgccagcgtgactcaagcgtcagtatgacagatcttgtgagcgcggaagatgatcaaaagaaagtttatacggataaccactcgggtattttcacccgtcagcgtgactcaagcgtcagtatgacagatcttgtgagggtggccgacaaaagcgaggctcttgctactacgtatcctcaaatgaggaactcagacctacgtagttcttga

SEQ ID NO: 80405 - DNA, 237 bp, Glycine max
  Peptide Sequence Number=SeqID_172090
atggtgattttccaccatggagatgcagcggaagacaaaggagaagagcttggagaggatgcttcaatggaggaaaagaaagagagaaggggggagcacgaaattgaaggaataaaagagggaaagaagtggaactttgaagtgtatctcataagactttcattcatcaaagttacaacaagtgttacacatgcttctattaatagactaggtagcttccttgagaagctttcttaa

SEQ ID NO: 80406 - DNA, 298 bp, Glycine max
  Peptide Sequence Number=SeqID_172091
taccctcatcttcagagggctgctcgccctcaccttccgaggactacatgtcctcaccttcagaggactacacgtcctcgctttcagaggtctgcacgccctcaccttcatagggttacacgtcctcgcctttagaggactagacttcctcgcctttagaggtcttcacgtcctcacctttagaggactacacgtcctcgcctttagaggactacacgtcctcaccttcaacacgccctcgccttcagaggactacacgtcctcgtcatcagagggctgcacgccctcaccttcatag

SEQ ID NO: 80407 - DNA, 633 bp, Glycine max
  Peptide Sequence Number=SeqID_172092
gacaaagaactcaggggcagtaacaatgggcccatcggtggctatcataaatggttaaaagcccacgtgcaaggtttggattggctcccgagtttgagaaccgctaaaagggaggaagttgaggcaccggaggaagacgaagaggagaataccgaactgagagatataaatgtggctaccaccaaagccttggaacgagaaaccaagagggcttgtcgggaagaacacggccggaacaagttccgaggggctctgtggggcaacaacagcgagcttaagctccggagagaggaaagggaccaatcacgagtagacagtttgatcttgaaagatgagttgaagaccaacatgttagctatcatcaccaagtaccaagaagaactaaatctagccccagcccatgagcatagagtggcggacgagtatgcccaagtgtacgcggaaaaggaggctagaggaagggtgatcgactcgttacatcaagaggcaacgatatggatggaccgatttgctcttaccttgaacgggagtcaagaacttccccgattgctagccaaggccaaagctatggcggacacttactccgcccctaaggagatccacggacttctcagctattgtcagcagacttaa

SEQ ID NO: 80408 - DNA, 381 bp, Glycine max
  Peptide Sequence Number=SeqID_172093
atgtaccctcccttgttctctttgaacaacctagtggatgtaccctccactagaactgatccacaagagatgtaccctctcttgttctcagtcacaacaacccaagtagatgtaccctctacttgtatcacaaaggatgtaccctccaatgtgttaagacaaagttctcaggcggttagtccttcgaaactttgtgaaaggggaaacaaaagaattctcaggcgccaaagggagaagggaatgaaaaagatgaatagcacaagttttgttttcaaggttttgaaaactagaaaacttaagaaagcttttgcaaaggaagaagaagaagaagttcaaagagattcaagggttgtaaaggattgtaatgattgttctcaatga

SEQ ID NO: 80409 - DNA, 330 bp, Glycine max
  Peptide Sequence Number=SeqID_172094
atggcagagtccactagatccaaagccaattccgataggctggaggacgccattaccaagcttaccactcaccaactttctctcagtgacacactccagcacctcactcacaagattgatgagctcattcatcatcttcataaactcgatccacccaatcactcaccttcttcttcatccactgttcctttccctgtctcaccatcttccccacatcgtattaagctcgatgttctaaggagtttaagggaagagaaagtgcaaactcagatttatactggttcgatcacacccttgtgcctacgtccagtccccaagcaacccgcttga

SEQ ID NO: 80410 - DNA, 664 bp, Glycine max
  Peptide Sequence Number=SeqID_172095
tttcattgtcaacaattccccgacttcaatggggatcatcgcgtctatgccatatgtgagtcaacttgctgagtctagtacgtggggccctcaggatgattctattagttgcctctgcctgaccgttggtctgaggatgttcgatagaggtgaacttttccacctcgttggtcgtaatttcccgcagtggtcttgcttctacccacttggtgaagtagtggtcccagtatgtccattccccacatggcaaagggccaaggggagctcagactgtgaagattgtcaggaggactcgcaccactttggtggcaaaggagcgtcctctggtgtggaaactgcagatcctttcataaatttctctcatgatgaagttcttgtagggggtcatccaatttggttcctccttttctctagccataatttcatcaacatctatggtgggagtttagagtatctcttggatgatagtcttgaggtgcccaaccatcttggtatcggccatcttggagagcaagtctgctccggtgttgctttctctggggatgtagtacatttcaaaacatttgaaattgtcaatgagagtcttcgtgatgtgatagtacttgatcaacattgtttcctcgatctgatatatgttggtaacctatccttggacaagttgtga

SEQ ID NO: 80411 - DNA, 804 bp, Glycine max
  Peptide Sequence Number=SeqID_172096
atgcccttgtggggtaggattgcagcaaacgccatcgtcgcttttgctgaggtcataagacgttgcaaggatttacaggtggagataaaggacctagctggcaagttggagggcatcacgtcggagagggacgagcatgcgaaggtggttgttgacttagaggagaaggaagcccgtaaggagcttgaggaggaggtgctcgtttacaagaaggaggatgtgaaggatggtgtcctacttgacgaagaagacattgttgtggaagaagaggctgttgatgaagagaaaaatgtttcaaagcaaggggatgatgcctcttctcctgtgatgtttgtgaggagtatgtttgactttcccctggttgaaggtcttgccaaccatttggggagtaggtcgcttgacatgcatagttcctcctctgatggttatgaggagagtaagtgtgacttacaccagattgaaggtcttgtcatgcaatctgatgataggagtgcataccaagggcagtccttgggtttttgtactaagggcggaccttgggttttggaggagtgcataccaatgaccgaggacatgtttgcttggggttttgtcaagcctgtggagttgagtcaaggcttaccaaggatgggtcttggattttgtgaacctctgaggattactaagcatggagcttgggactcaccaagggcggaccttaggttttacgagccctttggaggatcaactagggaactgtcggacctgggttttaggcatcgtgctcttgcatacatgacacttgtcatgggtgacatgtactag

SEQ ID NO: 80412 - DNA, 252 bp, Glycine max
  Peptide Sequence Number=SeqID_172097
atgaaaatacaaaaaaagaaagatcaaggggttctcacggaccctaagagaataaaggtcattcctgagaggcccactccaccaacaccactcattgagttggtgaggaaccatgttccctcatgggaagatgcccaggaaaggggtgttgagggaagaagcctagagcttcaagaacctctggatttgaggtcaaatccttttcaaggggggaggaatgatgcaatcctaccccccaagggcattggatag

SEQ ID NO: 80413 - DNA, 393 bp, Glycine max
  Peptide Sequence Number=SeqID_172098
atgccctctcggggggagaaaaccgtatcttttctccggctttcttccttccttgagcaagattgcagctgtgattggggattcagcaaaagagttgggtcgcatgaagcaaattcggaatggaatagtgggcctgccacagaaatacttggaaggcaaggcaagggatatggcgagccattacaaggggggatccctcctcctcttctcagcacctcacaatcactctctagctcactaatctctctcaaattgaagaaccctaggcttctctgcaaagctgctcctcttgctgcctccagagcttctatcttgaaattagcattgtggtctccttgctctggaattctcaaaaaatgtgtgtaccctaattctgcacaagacaagctttaa

SEQ ID NO: 80414 - DNA, 268 bp, Glycine max
  Peptide Sequence Number=SeqID_172099
gtgtttgctacccgtgatgatgttttgaattgggctcaagctgttgcttatgaaattggttttgtggcagtcattatgaggagtggtcagtataggtgcaggaagacagattttgtaagaagagatactggtagtgatactgaaatgcaacaactaatgaagcttcttgaacaggatcagtatattcattggcatagattaaaggatgaagaagttgtacgtaatatcttctggtgtcatcctgatgcagtgaagttatccaatgcat

SEQ ID NO: 80415 - DNA, 387 bp, Glycine max
  Peptide Sequence Number=SeqID_172100
atggttgtcatcatcaaaaagggagaaaatgccttatgtgccatgaatccagattttgatcatatttgtgatcaaattctgattccttcaatggatagtctcatgacatgtctttttcatgttcccaccccaaggaagattggaaactcacttgagcattctaaatcttcagcaatggtgtctactagaggaagaggggggtcgtgggaacgtggtatggctcggttgattggcataggacatgaaaccagaggtctctactatcttgaaaccagcccttctatgtcttgtttggcatcttcgtctcctaaacttttgcatgatcacttaggtcatccacatttgtcaaaattgacaaaaatggttcctaaactcagcaagctttag

SEQ ID NO: 80416 - DNA, 399 bp, Glycine max
  Peptide Sequence Number=SeqID_172101
atggaggagttgattacaaaacacaactctctcccccaaaataatgccaacgtcatcaagtcggctcagcggctcctcaccagaatcttactccctacaccctgttgctgtcattctgctcccatgaacaaggcagtaagtgtcgaggccaccctgtcgcccaaggcaactccccccccccccaacagtgatcagcttgagtctcaagggagttccaaaccgagtgacacaccccctagtacaagtattcctccgcataaggaactacaaggacatccgacaaggtcaatgcacccccccatgaacatacacaacattcaatgtatgaaacatgggcatctcaagtacatgaccatggatgaattaaagcgcctaagcatcccctcagaaaatgcttaa

SEQ ID NO: 80417 - DNA, 303 bp, Glycine max
  Peptide Sequence Number=SeqID_172102
atgtcagagcacgaaagtggatccttctcagcaaccacagaggtcaacccaagagaacagtgtaaggtagttacgattgggagggggacaatggttggtttgaaggatgaaaatgagtttagtgagaacaagacaaatgaaggagttgtgaaaataagtgatgaaaaagtagttgaaaaaaataaaaaaaatgaagtattagctaaagaggaagagaaggaaataagtaaagtggagaagcagaaattgacaacatttcacaaaggcaaggtccaacaaaggcaaggtctcttgatagtctag

SEQ ID NO: 80418 - DNA, 147 bp, Glycine max
  Peptide Sequence Number=SeqID_172103
atgaagatgttgttttgtgtgatgtgctgcttatggaggcttgccacttacttcttgagtgcaagacaactgttgcacctttatcttcaagggaggtatttgataatgtctttcccaaagaggtgtctcatggtctacctcttctaa

SEQ ID NO: 80419 - DNA, 713 bp, Glycine max
  Peptide Sequence Number=SeqID_172104
gactacacgtcctcaccttcagagggctgcacaccctcacctttagagggctgcacgccctcaccttcagaggactacatgtcctcgccttcagaggactacatgtcctcgccattagaggacaaaacgttctcgcctttagaggactacacgtcctcgccatcagaggactacacgtcctcaccatcagagggttgcacgccctcgccttcagagggctacacgtcctcacctttagagggctacatacacgccctcagaggactacgcagggctacatgcaagccctcaaaggactacgcgtcctcaccttccgagggctacatgccctcgccttcagagggctacacgccctcaccttcagaggactacacatcctcacctttagaggactacacatcctcaccatcagaggactacatgtcctcaccttcagggggctacacgccctcaccttgagaggactacacgtcctcacctttagagggttgcatgtccttgcctttagagggctgcacaccctcttttttagtgggttgcacgccctcgcttttagagggttggacgccctcgccttcaaaggttcagttcctgggccaccccctgatcctggaggagggccaactatgcgagcacaactagagaaggaggctatcgtacagccactatgtatactggggcaagatttcacccgtgccattacaaagagatga

SEQ ID NO: 80420 - DNA, 192 bp, Glycine max
  Peptide Sequence Number=SeqID_172105
atgatgaaggtggagaagaaattgatacatagaataggacaacaacaatctccaaggagtaaaaagagtggggacaacaacaatctccaaggagtaaaaagagtggggtggaacaagcttaatcaattgaaaattgacggtgtgagattttccctggactctactaagggcaattttccttggcacccttaa

SEQ ID NO: 80421 - DNA, 249 bp, Glycine max
  Peptide Sequence Number=SeqID_172106
atgggcccgaaatctgccctaaggctcataagaaccctagggccttctcttgcatctctggcccaatctacttggagttttctatccaatgcccttgcgggcccttttggtatttcgagatcacttgaaattagagaaaaaaattgtttccgtgaagaaaatctaagccgagtgggtgatttcgcaaagattttcaaccgttcttcgacgttcttcgttcattcttcgtcattcttcggtcttcaaccg

SEQ ID NO: 80422 - DNA, 438 bp, Glycine max
  Peptide Sequence Number=SeqID_172107
atgcaattcatgggactccgaaaaaggggattagaatggagaattgcactaagcaatcactacgcatggctccaaactcgaaggtggaggacacatgaacgaaaacgcaattcatggggctccgaaaaagggttgagaatggagaattgcactaagcaatcactacgcatagctccaaactcgatggaatggagaattgcactaagcaatcactacgatagctccaaactcgaaggtggaggacacatgaacgaaaacgcaattcatggggctccgcaaagattgagaatggagaattgcactaagcaatcactacgcgtagctccaaactcaaaggtggaggacacattgaacgataacgcaattcatggggctccgaaaagattgagaatggagaatttcactaagcaatcactacgcatagttccaaactcgaag

SEQ ID NO: 80423 - DNA, 359 bp, Glycine max
  Peptide Sequence Number=SeqID_172108
atgaaaccatctctcaggcgctcaaccgcagcgctgctggcatcgtcattgttgttaaccatcggtcggggagcgacgctgccgttcatgaccatttatctcacgcgcgtctacaacatgagcgtcgagaatattggttatgccctgacgattgcgctgaccatcggcgtggtgttcagcctgggatttggcattctggcggataagtttgataaaaaacgctacatgctgattgcgatcgtggcgtttattgccggatttgtcgcgatcccgctggtggataacgtcacgctggtggtgctgttcttttccctgatcaactgcgcctactccgtattttcgacggtgctgaaagcctg

SEQ ID NO: 80424 - DNA, 1138 bp, Glycine max
  Peptide Sequence Number=SeqID_172109
gccgatgtacgaggccaccacgaagctgccgagcttgacgatgtcgtgaatgttggaaccggcaaccactttggtcatcagcgccagcacgccgtacggcgtcagtttcatgaccagacgcaccagcttcatcacccaggcttgcagggtgtcgatagccaccagcacgcgctcgcctttcggcttgtcgtctttcagcagttgcagcgacgccacgccgaggaaggtggcgaaaatcaccacgctgatgatcgacgtcgggctggcgccggtcagatcggcgaacgggttttttgggatgaacgacagcaccatctgcggcacggtcaggccttcggcggtcaggccgaacaggttggtgaccagtacgcccaccagcgccgagatcagcgtggtgaacagcagcgtgccgatagtcaggacgctgattttgcccagagaagaggcgttatgcagcttggccaccgcgctcaggatcgaggcgaacaccagcggcatgacgatcatttgcagcagctgcacatagccgttgccgacgatgttgaaccagctgatggattctttcagtaccgggttgtcggagccgtacaccagctgcaggcccagaccgaacaccacgccgaccaccaggccgaccagcacttttttcgccaggctccattgcttgtggcgggtttgcgccagcagcaacaggagcgcgacaaacaccagcacgcgaaaacgccagcggcacggccacagcagcggaacgccggcgggggtgagcatatcggccagcagatggctgaagtaaccgatgatcatggcgtgcagcgcgtcggccgggatcggccagctgcgcggcacgtccaactggaacagcgccatgccgccggcgatcgccagcaggctgtgggtgaaaccgcggtggccgaatgcgcgggcgatgggaatggcgagccagcgcagacgctggcccagcaccgacttggggtgatcgatgtccggcagcagcgaggtcagcagcgcggcgggtatgatgtgccaccagtcgccggtagccagctctggcgtcacttccgccttcttggcgaagatcgcgcaagcgacagagaatataaggtgtccttccgcggtcatgctgttgcgattccggctg

SEQ ID NO: 80425 - DNA, 732 bp, Glycine max
  Peptide Sequence Number=SeqID_172110
atgcaggtggggctgccgcccgtgccgtttgaaagcctgctgtcgtggctggccgccctgcagcgtgagcatggcatccgcgtgctggcgctcgccgtggaacgcgcggagcaggcgccgggcatagtgcagttggctgctgttgcgtggccgctgtcgttattgccgccgtcctattgccgtgcgttatccactgctggaattattcctgatgctgatggggataacgctggcctggcggctcggcatcggggtggattggtttttcatgctggcgttggttgcgctgttgctggcgttggcggcgatcgacaaccaatgtcagctgctgccggattgcctgacgctgtcgctgctgtggatcggcttactgtggcattgcctggcgcacccggcctttttgccggcggcggtcattggcgcgatggcgggctatctggcgctctggctattgtattggggatttcgtttggcgaccggccgcgaggggctgggatacggcgatttcaaactgttggcggcgcttggcgcctggggcggctatgccgctttgccgtcgatcctgctgttcgcctccgccggcagcctgctatggctgttgctgcgcgcgtggcgcggcggcgatgcggtccaatccctgcccttcgggccggggctggcgacggcgggcgccggcgcggtggcctgtcagtggcttgcgctgccgataaggggctaacgcagctgggctaa

SEQ ID NO: 80426 - DNA, 51 bp, Glycine max
  Peptide Sequence Number=SeqID_172111
gaatctaatggaaaggatccaaaagttaacttctagtgataattcccaagg

SEQ ID NO: 80427 - DNA, 727 bp, Glycine max
  Peptide Sequence Number=SeqID_172112
ggataccaaggaagcgcttggaggagaaggcgaaagctctggctagccaaggagaatgggcagcattcatcaacgtattagctttgctagtgtttgggacgatactattcccgaatgtagacgggttggtggatctagtggcgatcgatgcctttcttgcttatcaccacagcaaagaaagcccgatcatcgctattttggcagatttatatgatacattcgacttgagatgcgagaagagcagtgcaagaattgtctgttgtacgcctgctctttatgtatggctgggattcccaaatgtccctttgatggggatgagtggttacattaattataatcctatgctggccataagacagttaggctaccctatgagaggtgcgccgtcagaggaaatcatcatgcctttcatctcgcgaggttttaatgaagctaatgcaaagatacttcagaaaatctataaagcatggaatagagtgggaagaaaagataaggagcttaggggaagtagcaatggcgctgaaattcctaaggaaagtaaagaagtgcaagcttttaaaggagagcttgaaaagacaagagtggtgaaagagaagctgaagacggcagtcactagggtcaggaaagagtgtgatgagttaaaagatatcaacatgaccatggttgaagctaatgagctcaagcttagaaaggtcgagagggacaaatcaaggatggaaaacatggt

SEQ ID NO: 80428 - DNA, 312 bp, Glycine max
  Peptide Sequence Number=SeqID_172113
ttgagcctcagcctgcagagccagggttttacttcttttccgtgccctactccggaccagttcagggaagaggtcgcatggcctggagattggcctgaggcccgggcaggagaggcaccagcagaggctcccgacgaggcagatgaggcccgcgaggatgaggagatgaccgatttacttgatttcttaggagggagcggggccacattattgggagatcccttgatccatatttctttttgtttccatttttcttgttatatatcatcttatttttgtttgactaagggactaacatttatttcgtgttga

SEQ ID NO: 80429 - DNA, 417 bp, Glycine max
  Peptide Sequence Number=SeqID_172114
atgaagctggaagagactctagctcaatttatgcaggtttttatgtctaaccagaagagcacagagtctgccataaagaatctggagaaaatttttgaggaagcagaaggtgatgaagaaggagagataccaataagagactatcaagagagaataaagaagaaggaagaaaaagaaaaagaaaaagaagaagaaacaaaagaaaaagaagaaaaagaaaaaaagttgaaaaaggaaaaacaaaaagagaaggttgttgagattgaaaagaagaagcgcaagagtgaggctaactcaaaaaagaagaaagaggctactcctattgaatgtaagaaggtaccttatccattggtaccctcccggaaagataaagagcgacatttggccagatttcctgatatattcaagaaactgtaa

SEQ ID NO: 80430 - DNA, 461 bp, Glycine max
  Peptide Sequence Number=SeqID_172115
gtatgccacccaccaggcaccctctagacccggataagtctaacagggccctggggtttccagcgttgatcacgggcctttgccaatcattcggggttcccgtcacacctagtaaggtgatccgactgccgatcacccgggctttcattgagaagtattgcactcctaggcaggcgcaggggaatgcaccacaagccacagatgcaccgccgccacctcatcaggctgatcccgctgggtcattaggcatggagcgcctctgtcagcagggccagggtttcactgcttttgcatgccctactccagatcagtttagggttgaggtcgcatggcccagagattggcccgaggaccagacggaggaggcacctacaggagctcccaaagatgcagaggacgcccgcatggatgaggagatgacagacttgctcagcttcttgggaagaagcggagccacgtga

SEQ ID NO: 80431 - DNA, 345 bp, Glycine max
  Peptide Sequence Number=SeqID_172116
atggcagcgcagttgatccatgatcgcgtcgtgatggagtgcctagagggtgtttgggagaccctcgagggaaatgagaggtgccaattccgcggcatagttcgactcactgctacatcgcttgtgtcatcctccgaagaggatcctgaaggggacccagaggagttatctcctgaacctgctatggatgcccctgacttaccagaggatgatgaggacccacttcctgatgttgattctccagaggatattatgccagcacctgaggcaaactctacagaggagagtggtcctggagggatggcgaatagcgacgactcttcatcacagcaaacgactctttag

SEQ ID NO: 80432 - DNA, 1056 bp, Glycine max
  Peptide Sequence Number=SeqID_172117
atgtgcatccttctgaaggcgagggtgtgtagccctctgaaggcgaggacgtgtagtcctctaaaggcgagggcccgtagccctcttaaggtaagggcgtgtagccctctgaaggtgagggcgtgttgccctctgaaggcgaggacgtgtagtcctctgaaggcgagggtgcgcagccttctgaaggcgaggacgtgcaaccttctgaaggcgaggacttgtagtcctctgaaggcgaggacttgtagtcttctgaaggcgaggacgtgtagccctattaaggcaaggacatgtagccctgtgaaggctagggcatgcagccttgtgaaggcaagggcgtgctgccctctgaatgtgagtacgtgtagccctctgaaggcgaggatgtgtagccctcaaaaggcgagggcgtgcagccctctgaaggcgaggctgtgcagccctttaaaggcaagtgcgtgcagccctctgaagacaaggatgtgcatccttctgaaagcgagggcgtgcagccttcagaagttgaggacgtatagccctttgaaggcgagggcatgcatccctttaaaggcgaaggcgtgcagccctttgatgacgaggacgtgtattcctctgaaaatgagggcgttcagccctttgaatgcgaggacgtgttgtcctctgatggtcggggcatgtagtcctctgatggtgagggcgtgtagtcctctgaaggcaaggacgtgtggccctctgaaggcgagggcgtgtaaccttctgaaggcgaggacgtgtagccctctgaaggttaagatgtgtagccctcagaaggcgtgggcgtttggccctctaaaggtgagggcgtcaagccctctgatggcgaggacgtgtagtcctctaaaggctaagaagtgtagtcctctaaaggcgaggatgtgtagtcctctaaaggctaaggcgtgcaaccatctgaaggcgaggacgtgcagccctttgaaggcgtggacgtttcgcccttggaaggcgaggacatgtagccttctgaaggtgaggacgtgcagcggtgaggacgtgtag

SEQ ID NO: 80433 - DNA, 222 bp, Glycine max
  Peptide Sequence Number=SeqID_172118
atggatggactgaagcatttgatcaagcaagtgcacctcatgggattcccccttatggtattcatgaaacacaaacgacgatgtgtccttgtcgcaactgtagaaccaaggcttcaagaagattttgattatgccaatagtaaagcatatccaagacaattcaagaagattttcattattccaatagtcaagcatatccaagacaactcaggaggattttga

SEQ ID NO: 80434 - DNA, 902 bp, Glycine max
  Peptide Sequence Number=SeqID_172119
atggaactgaattttgggacaaaaaccccttcaaggtgacggccaaggctttcccaccaggatttcactacaaaccaaccaccatcctgaagacaataactttttatgaattgattttggtagattcaaactcagtatctatcaaacatttcaaagatccaaaagaccaaaccttaaacacccactcgacaatccaaatactaaaagttcttcaaccaagacactttggttcggacttgaacaaaggaaagagattttcagttccatttgatccggtaggttatacctattgggattacgttgatgcttggactaaggtgttttggcaccaaaatactcgcttcaagcattcatggttgatatatttcaagaccaacacaatttacaattttcccaattggtttttgcaatggtggcacttctttggaccaatcccagagatattcccagaaacggtccaacaaggatttgcccaatttaagaaacaatacaatttgcaggaatcacgaattccagcagatcttaaatacttttcaagctatgcattgtcatggatattctcatggcaacacgcatttgtaaaatggtggacacaatttgactcatccaaagcggatccagaacaagtaaaactctggttccaatcccatccagaattcctcaaagcagctgacccagaaacttctgtgtttttgaaccaaaagtctcatctgacagcatttttagcaggatcgacatcaaaggaggtcttagttaaaaatctgaaggaagttctacaaatgttacagcaggaagaagaagcttcatcctcaaagaaggaagaaacaagttctgctgaaaaagaagaagaagatcccttttaccaaaacgaagatgattgttttggtatctgtttagattaa

SEQ ID NO: 80435 - DNA, 533 bp, Glycine max
  Peptide Sequence Number=SeqID_172120
ccgggctgtcgagcgggtcaggagtcggattcgggtagggttcatcttcctctgtgataaggagaagaaccctagaggtgaaacgatgtcctctgtgggcgaggaggctatggcaagtgcggtggaagcggattggaacgcaaaggaagaggggccagtggcggcggacgcggatgggacggcgaacgacagtctgagagcttctcttcctgaaggcgtggtgttgtgtcgtcgaactgtggttcatggagtgcatgatatcaccgagatgagtgaggacagcctcgatgtgagtcaaggacccttcgtgcttgcttgtgtcggacatggaaggggattggtgctacggaaatggttgttggtggttggctgtgtgatggcaagggaaggagtggttcagcggatggtgtgggttggcatggctggagctggaagggcagccatggaagctccatttggcgagtggcggtcatggtctctcaatgaaagcaccaaattgttaggtgtagggaaaaagctagctgacttcgagg

SEQ ID NO: 80436 - DNA, 672 bp, Glycine max
  Peptide Sequence Number=SeqID_172121
atggccctcaagcataaggtccaaagcttgattgacgcgggatggctaacattccaagaagatggcctgaatgtgaagacaaatctgcttgccaatcatgggggatcggtggtaaatgcaatagaggcgcgtgggctagagaggccaaagcaaatgaaggacgtagtaacctcaagaaggtttatctttgaagcattgcaagaggcgggcatggtttcctttgatgggcacaaaggggacccctgtttgatgcatccggatgcatcacatgacatggaaacatgttcaacggtggaggagttgttacagcaaatgatggaccaaggccggtttgagatcagtgaagagaacaagggagaacaaaacgtgtgcatgcaattagcggacaaagaaagccccgctaaacccaagcctttggtgatacacttcaccagggatgtggtctcccagaaaccccgaggttctcgacctatcccgggtagtagacctatttcgttcccttatagaagcaacaaggcggtcccgtggagatacgcctctcagaagccaagtgaaaagaaagaggaggccactagcattgacctaccttctgtcaaagttaccaacatcaccagcctaagtggtgtgactcgtagcggttgcatctttgcggcgcctgacccattcgtgtga

SEQ ID NO: 80437 - DNA, 1671 bp, Glycine max
  Peptide Sequence Number=SeqID_172122
atgtctggaaccctagcaaccccgcgcgcgttactgtcgctgctggtggcggcctctctggtggtcgcaggcgctgtgcaggccgacgatgcctgcatcaaaccgcaggacatcaagcgcgaggcgctgtcgtcggcggtggtggagatggcctacagcacctcgcaacaggcgttgttcgtcagcgcgccggactggaaggaagaggcgcgctcccgcgtgctgcggctggatcccaacaccctggcgatcaaggcggagatcccgctgcaggtgaaaggcttcggcgtggcgctgaacgatgcgggcaatcgcctgtacctgactcagggcttcaacggcgaagtcggggtggtggacaccaccaccaaccacgcgctgggcagcatcaagctgctggacaaagcggtgctggagcaggcctacaagcaggcgggcatcagcggcaagcgcctggacttcctgctggcggagttgaagaagttcaaaatcaccgaggactacctgtaccgcattcgcgagatcaagtatgacgcgcaaagcggccgcttgttcctgccggggctgggcttcggcgtcgacagcgtgctgtacgtggtcgataccaaggccggcaagctggagaaagtgatcccgggcttcggctacaacgcggtgggtatcacattggatgagaagggccgccgggtattcgtctccaacatgcaggggcaggtgatcaccctgaacgccgacacgctggcgatcaccgccacccacgaagtgcaggccgatcagctgctgaatctggtgtatgatccggcgagcaatcgtctgctgggtgtcgatcagggtattgatcgcgataactaccgcaatcatcatctggggcacgactacgtgaagcgcagcagcggccaccgggtattcgcgctggatgcggacagcggcaaggtactggccagcgagctgacggatgaggtgccgatcggcctgctgctcgacgagcgcagccagcggctgtacgtcgccaaccgcaaaggcgtgcgcgtggatcacggcgccgggacgctgacggtgttcgacgccaagacgcttaagcgtctgcaaaccgtagatctgccgccgcaccctaacagtctggcgttggatccgaaaggcgacgcgctgttcgtgacggtgaaaaacgacggcgcttccaccaaggccggcaagccggaaagcgtggtgcaagtgggtgttgatgctcatgtagtaggtgcggcccggttcgttgtaggtggccgcgcctgcaccggcgatgttgatcgcgccggtgttcggatcgcccacgttctgcgcgttgccggcgcggaactggcgtttgtcgaacaggttatcgatgccggcggtgaggctgacgtttttggtcaggtcataggtcgcgctggcgccgacgacggcataagggctgacctcgcgggtttcgccgccggtggccggtttaccctggtagttgtacttcttcggcttctgacggccgtaccaggtcagggtggactgcatcgacagatcctgcgtggcctgccagctgagggtcgagttgacggtgaacttcgggatcaccgacaggtaatcgccggtggtcttgttcttgttctcgatcatgtaggtggcgttgttgctccaggtgacggtctcgctgaccggcac

SEQ ID NO: 80438 - DNA, 220 bp, Glycine max
  Peptide Sequence Number=SeqID_172123
atgaatgtcaaattacaaatatacaacaaaggcttaataaacgaagacatgcaaatcattcattttggtgtccgtgatgtcgtgaggatgtgccacatggtcgatcccatcttcgtgcttggcgatcaggatttcttctgcccgatgctcccgcttcttcttcgtcagcttcgcagaaaatgcgtgcgcaaatcaacaccgaataagtcacccgtattag

SEQ ID NO: 80439 - DNA, 249 bp, Glycine max
  Peptide Sequence Number=SeqID_172124
atggatgtgttgcgtgattgtgcaggagaaaggaaaagtaggcgtcagagagagaaagagagagaggtgagatcctatgcggttcatagtctagatcaggcgacaaagaggttcgatctggtgatgatgagtttagatctggcaatggagtgcatatttgacaatgaagcagaggcacgaaggtggtggtggttgtggttatggacagagtgcgacgcaaagtttagtggtcgttatggagggttttaa

SEQ ID NO: 80440 - DNA, 1308 bp, Glycine max
  Peptide Sequence Number=SeqID_172125
atggtggggaatagtgaagaagaccgagatggccttcaccaatcgccgttacgaatcccggaattgctctatgtttcggtgaagatggagaatcccaatctcactctctctggggaccttctccctcacatatctggctcttgcccttctggggatccttccaaagctctttctatggaacgggaatcagcgtcagtgtgggagttgagctttgttgttccacctaatcacgaagctttagagtttaagttccttttgaagcccaagtacatcgataatccttgttttgttgaggagggtccaagtcgagtacttattgggggagcattgcaatatggtgacaggctggctttgtttaggcttgataatgatcaagttcttgagtatcgagtatttgtggaagcaaaaagggcttctccctttgatcttgcagctagttggagggcttatcaggagaattttcgtctttcaactgtacgtgggatacctgatgtcagcataaattcagaagttcagacaggtagtgagtgcaaaacatttatcgtcaatggtcaagtgattagtcagaacatctcatctgtgagtttggaacttgatcttgagcattatattgttccatctcccccagtttctgcaagttcagcacttgtatatgctgctaacatgactgagaatcccaggtcactagatagtgggtttgccagcatttcgtcttctactgtagatggtggtgttcctatgattgatcaaccagaaacagtaaagtttatggaggttaatgcccctgatccagctaaggtgtaccaaagtcctggaatggttaaatctcagtcagcaggaaccattttacctctgcaaaaggaaggtgatatgagaggacttcttgttgataggggtgttggagttcccagacttgtaaaatcttctagctcatatgctttcactactaatcttaatttgtatactgatactaagaattcaattccagctgctgctggagctgttgcagctgctgcgattgcagatcagatgctaggtcccaaggagcatagacatttggcgattgtcatggtgagtttgccagctcgaggcaagacttacactgcagctaaactaacaagatatcttcgatggttaggtcataataccaaacacttcaatgttggtaagtatcgtcgccttaagcatggttctagtcaggaaaacttacaatccatgtcatattcttctctgcagtctgctgatttctttcgagctgacaatcctgaaggtgtggaggcacgtaatgaggtaactcctggccaataa

SEQ ID NO: 80441 - DNA, 441 bp, Glycine max
  Peptide Sequence Number=SeqID_172126
atgtccgatgggtttgaattcaaagtatgcctctttgaacatcttaaatgctggatattgagttgggttattgagctcaacctggtcttggcaagatctttcactagagacagatttgaggtttccaacatgaagaatggattctttcacaagaaccctgaagatttgtaccattctaaaaaaaatcattttttactttgtctccctaactgcttgtggagggaaccaacacttactcagaatgaagaggggaacgaagatgggttgaaaaacaacaacaacaacaacaacagaagagcatccaagttgaacaacaacaaaagcaacaagttcaatctctcaaaacaacatcaacaacagatccaagcgcgatgtagctctgatcaggccacgatccgatggcacaatgcggtggccctcgccagcgatatacatatctaa

SEQ ID NO: 80442 - DNA, 3231 bp, Glycine max
  Peptide Sequence Number=SeqID_172127
atggtgcggtttcgttgtgtgttctgcagcttactgcactatatgcttcctagaaagagagtgagggaaggaggagtggttgtagaagtagacagtgacgctaccaccaccaacaccaatagtgctgcggcgtcgtttcccaagaaggctcggatcgggagctttgctgcctgctcgggtgccggtgctgcggattcgccggtgaacgtcagcggccagggattcagtagcggcggcggcggcgacaacagcctcgggaactcggtcggaggaatggctttggggaattcgcacccggcggagatcgacgaggatctgcacagtcggcagctcgccgtgtatggccgggagaccatgcggaggctctttgcgtccagcgtcctcgtttcggggatgcagggtcttggtgttgagattgaaaatgatgttggcaagaacagggcagaggcttccgttagtaagttgcaagagcttaacaatgccgtggttgtactaagcttaacatcgaagctgacaaaagaacaactttctaatttccaggctgttgttttcactgaaatcagtcttgagaaagccattgagttcaatgattactgccacagtcatcagcctcctattgcctttattaaaagtgaagttaggggcctttttggttctctgttttgtgattttgggcctgagttcactgttgttgatgttgatggagaggatccccatactggtataattgcatccatcagcaatgacaaccctgctcttgtttcctgtgttgatgatgagaggctcgagtttcaggatggagatctggttgtattctctgaagttcatggtatgaaagagttgaatgatggaaagccaagaaagataaaaaatgctagagcatattcattcactcttgaagaagacaccacaaattatggtagatatgaaaaaggtggtatcgtcacacaagtcaaacaacccaaggttttgaactttaaaccactcagggaagcgctcagtgatcctggtgattttcttctgagtgatttttctaagtttgatcgcccacctctactgcatttagcattccaggctttggataagttcgtttctgagataggtcgcttccctgttgctggttcggaggatgatgcacagaaactaatatctattgccagtaatattaatggtagcttgggtgatggaagattagaagatgtgaatccgaaacttctacagcaattttcctttggcgctagggcagtattgaaccctatggcagccatgtttggtggaattgtaggacaagaggttgtaaaggcatgctctgggaaatttcatccactttttcaatttttctactttgactctgtggaatcactccctacagaaccgcttgatgctaatgatttaaaaccattgaatagtcgttatgatgcacagatttcagtttttggacaaaagttacagaagaagttagaggacgctgaagtttttgttgttggatctggtgcattgggatgtgaatttttgaaaaaccttgccctaatgggagtttcttgtggtcagggaaagctcacaattactgatgatgatgtcatagaaaagagtaacctaagtaggcagttcctcttccgtgattggaatattggccaggccaagtctacagttgctgcttcagctgctgcatctataaatccccgtcttaatattgacgctctgcaaaatcgtgttggccctgaaactgaaaatgtgtttcatgataccttctgggaaaacttgagtgtcgtgattaatgcactagacaatgtgaatgcaagactgtatgttgatcagaggtgcttgtatttccagaagtcacttcttgaatctggaactcttggggccaaatgcaatacccaaatggtcattccccacctaactgaaaattatggcgcatcaagagatccacctgagaaacaggcaccaatgtgtactgttcattcatttccacataacattgaccactgcttgacatgggctcggtcagagtttgagggtttgcttgagaaaactccagctgaagtaaatgcatatttatctaatccaaatgaatatactaatgcaatgaggaatgctggtgatgctcaagcgagggataacttagagcgtgttcttgagtgtttggacaaggagaagtgtgagacttttgaagattgtattacatgggctaggctaaagtttgaagattattttgctaaccgagtaaagcaattaatttatacttttcccgaagatgctgcaactagtactggagctcctttctggtctgcaccaaaacggttccctcatccactgcaattctcatcctctgatctgggtcatcttctgtttttgatggcagcttctatattacgagcagaaacatttggtattcctattcctgactgggtgaagcatcctaagaagttggctgaagctgttgatagagtgatagtacctgactttcagcctaagaaagatgcgaaaatagtgacagatgaaaaggccaccagtctctcatctgcgtctatagatgatgcagctgtgattaatgatttaatcgtcaagttagaggggtgccggacaaagctgcaaccagagttcaggatgaaaccagttcagtttgagaaggatgatgatacaaactaccatatggacctgatagctgggcttgcaaacatgagggcacggaactacagcattcctgaagttgacaagctgaaggccaagtttattgccggacggatcattccagcaattgcaacatcaactgccatggccacagggcttgtctgcctggagctgtacaaagctttggatggagggcacaaagttgaggactaccgaaacacatttgccaacttagcactgcctctcttttccattgcagagccagttccaccaaaggtcatcaagcatcaagatatgagttggacagtttgggacagatggattctaaaagacaatcctactcttagggagcttcttgagtggctgaaggcaaaaggtttgaatgcttatagtatttcatgtggaagttgtctgctctataatagcatgttccctaggcacagagaacgcatggacaaaaaaatggtggatttggctagggaagtggccaaggtggaaataccttcttaccgtcgtcacttggatgttgttgttgcctgtgaggatgatgaggataatgacattgacatcccccaaatatccatctatttccgttaa

SEQ ID NO: 80443 - DNA, 465 bp, Glycine max
  Peptide Sequence Number=SeqID_172128
ccgtcttccgttaagcggacacgcaaagtctcacgtttacgatcattgtctactagaccacctggtgctgagagaccagtggtccatgttgatcctgctaccgacaaggccgatggtccccacaggaagaaattaagaacatatttggggattatggcgcgtgataaggtggacgtcacctacgagaattggaaggaggtccctattgctcagaaggacctgatttgggaggatattcaggcggaatttgatatcccagaggcttttgacagtaggacgaaaaggaagttacttcagaccgtgggggagagatggaggacactgtctgtgagaaatatggcatcagcaaggaaaaatgggcccaattttgctagactcgcagagacccttcttgggaggatgtgcgcaagaaggcacagaccatctagaagcagaatactgccccccacgttttgtcttgtgggg

SEQ ID NO: 80444 - DNA, 291 bp, Glycine max
  Peptide Sequence Number=SeqID_172129
atgaagaagcatgatagaggcaaagggtcattaaagaacaatgacgactctttgcaaatccaaagaaagatatcaaagggaaataattgtcaattttgtaggaaatccgaacatttccagaaggattacctaaagtgtaagtcttggttcgaaaagaaaagtgagcttaatgctcatggaaaacaagcaaaacatacaaagaaaggagctacaagaagcactcagcttcttgaaatcgtgcatactgatatttgtggaccttttgatgttagttctttcggaaaagaatga

SEQ ID NO: 80445 - DNA, 567 bp, Glycine max
  Peptide Sequence Number=SeqID_172130
atgaaaagaaacccaaggtcaacaaaacgcgatccatcttattgggagtatgtaaatgcttttcattctacgcaaaatagcaattcgttagtgaagcgtagtgcattatcttctgagcaacccaatccaagaaggatcatgcctatgttggatcaatttcagccatttatccatgacttcattgataacattgttgatgtccaggctgatggaaactgtgggtatcggtcggttgctggtttattagaacttgacaaattctcaaaagactatatcaagctcttaggtgacacagacaaatttgaggaattaaggatgtcactacatgttgatgggttaaccaagggcactatggataagtggatggatataattgacatgagatatgtgattgcatcaagatttattttaaaagaccattgtcctttaccgccaatagcattgttatggtctagcaattgtcctcctcaggcgaagcagtggccaactccatatattagtaaaatgcagcattatagaagcttcacgatgtacaaaagagactatgttgacttaaatgatgattga

SEQ ID NO: 80446 - DNA, 462 bp, Glycine max
  Peptide Sequence Number=SeqID_172131
atgggttctccacctgcctccactcctcctcctcctcctcctcctcctcctcctcctcatccttcttcttctcctcctcctcctcctccttctccttcggatgcatcggcttcgctgtctgcggtgaagcgaacacccaaagcctcacgtctacgatcgttgtccactagaccacctggtgctaagagaccagtggtgcatgttgatcctgctaccgggaaggccgacggtccccacaggaagaaattaagaacatatttggggattgtggcgcgtgataaggtggacgtcacctacgagaactggaaggaggtccctactgctcagaaggacctgatttgggaggatattcaggtgaaatttgatatcctagaggcttttgacagtaggacgaaaaggaagttactgcagaccttaggggagagatggaggccgtttaaatcagacctcatgaggaaatga

SEQ ID NO: 80447 - DNA, 447 bp, Glycine max
  Peptide Sequence Number=SeqID_172132
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccggcgtttccccctggcggctccctcgtgcgctctcctgttcctgcctttcggtttaccggtgtcattccgctgttatggccgcgtttgtctcattccacgcctgacactcagttcccgg

SEQ ID NO: 80448 - DNA, 327 bp, Glycine max
  Peptide Sequence Number=SeqID_172133
atgatcacgctgtaccacactgtaattaaggcatcttttgagaaaagtacacatgtggttggacatgtttttaaagttaccttatacaagggactctttggcatgttatcaagaaagggtgaaaacaaaaggtgctcagaagaaatcaatgaccaaagatcaacaaagtgtgatccgtcttactatgagtatgttgatgcattacattttgtgcaaaatggtaattctttagacaaacgtagtgcatcatcatctaagcaagcaattccaagaaggaccatgccgatgttggatcaatttcatccatgcattcatgattccatttaa

SEQ ID NO: 80449 - DNA, 251 bp, Glycine max
  Peptide Sequence Number=SeqID_172134
atgccgtttttgtttctcctcctttattcttttgcgtccgtccatattttgtttcacgacagtctaacgacggtgttgaaggttacaaggctttgcccatggaagagttgggataggctactaaagaataaaaagaaggtggaaaaacacattaacattgcgatttttatctcaagaacttcatgggttcagagaaggtgggaaaacacattaaggttgcaatttttatctcaaaaacttcatgggttcag

SEQ ID NO: 80450 - DNA, 66 bp, Glycine max
  Peptide Sequence Number=SeqID_172135
gaacttgctagagatgccgctatcgctgtcggaagacacatgagcccgcttagagataagggatga

SEQ ID NO: 80451 - DNA, 543 bp, Glycine max
  Peptide Sequence Number=SeqID_172136
atgcacgtggctcaattgatttctgatgccatccactatttgcagggatcacgcccacaagacaccctgtggactcggagaagtccaacagggccctggggtttccagctctggttatgggcctctgtcaatcctactgggtgcccgtcccccccagcaaggtcacgccatcgtgacatagggattgcgcccgcaagacaccttgtggacccggagaagtctaacagggtcctggggtttccagctctgattacgggcctttgtcagttctacggagtgcccgtcgcccccaacaaggtcatcaggccccctattaaccgggctttcatcaagaagtaccgcgccccccaggcaagcgcagggcgagacaccacagcagccttgggatggtcggcaacgggcaatagacgcaccaccgccacctctagatcccctcagctcatctacaaaggttggagcgttgcctacgacttgtggctgaccagcaggcgaccaagtccaaagccaaaggtagcaagataccttggatacacatgtatatag

SEQ ID NO: 80452 - DNA, 225 bp, Glycine max
  Peptide Sequence Number=SeqID_172137
atgaaagtcaacaaaacaagagatgaattgaaagtctcggatttgaaaacttaccggttgaagaacgaagaacgcacgaagaacggtgaagaaccgcagaaaatcttcacgaaattgctcacagaaacgtctcagaagcattacggaagcatcacagcttggattttcttcacagaaacacttttttcacccaaaaatgctgaaatgcatagccaagggggttag

SEQ ID NO: 80453 - DNA, 69 bp, Glycine max
  Peptide Sequence Number=SeqID_172138
atgggttgccttctagctacggatatttggatgacgccacttccggtgaaggaagataagtcagggtag

SEQ ID NO: 80454 - DNA, 696 bp, Glycine max
  Peptide Sequence Number=SeqID_172139
atgacatgcggggaaccatttggtcccacactttttcaatttttgtcatccagtggcggcgggtccgatgacatgcaggaaccatttggtcccacgctttttcaccttttgtcatccagaggcggcaggcccgatgacatgcgggaaccatttggtccctgctcttttaccttttgtcatccagaggcggcgggcccgatgacatgcggggaaccatttggtcccacactttttcaccttttgtcatccagaggcggtgggcctgatgacatgcatggaaccatttggtctcgcacttttaccttttgtcatccagaggcggcgggcccgatgacatgcggaggcggtgggcctgatgacatgtgtggaaccatttggtcccgcacttttaccttttgtcatccagaggcggcgggcccgatgacattcgggaaccatttggtcccacactttttacttttgtcatccagaggcggcgggcccgatgacatgcggagacaaattatggtcattcgcacgctttttctatctagacaagttatggccattgtcgcaacctaccctttggcgggagggcgacgcgtgactcgcatgtgcgtattccaagaaaggaatacgcgcagagttgccaccaacatttatttgaggaaaacgtcggaaaaaccagaaaagacgtcatctatgaactctaagtga

SEQ ID NO: 80455 - DNA, 333 bp, Glycine max
  Peptide Sequence Number=SeqID_172140
atgaagaagatcctaggcctacaagctccaatggagcttacatcctgtgggagaagaaatcttttcgacaaagagttggggagagcttcagcctttattgaacaagctacagcaataagccctaatgaagctttgaaggattattgggtgtggggagctgacccaaagggaatctttactactagcactgcctatctttgtattaaaggtgatcagccaattggccacctaaatcgtggcttcagtcagctgtgggaaatcaaagtacctcctagagccctatcctttgcttggagactactttgggataggttaccgactaaggaaaattaa

SEQ ID NO: 80456 - DNA, 991 bp, Glycine max
  Peptide Sequence Number=SeqID_172141
ctcaagccaaaaaagcgggcctgatcggccaggcgattgtcatcctgtcttgctgactgcttggctgcatggcattcatacctaccagcaagccttgttgttaggtgtgttcctgggctttgccggcgccgcatttgccgttgcattgccgctggcttcccgctggtatccacctgagcatcagggaaccgcgcttggtatcgctggcgcaggaaattctggtacggccctggcagcgctgtttgcgcctggcctggccgtcgcttttggctggagcaatgtatttgggctggctcttattccgctggcactggctttaatcgtgtatgtattgatggcgaaagatgcacctgatgcaccagcgcccaaatccatgtcgcaatacttgtccgtgctgaaagacaaagatgcctggtggtttatgtttttctacagcgtcacctttggtggttttgtcggcatggcctcctctttgaccatttacttccatgaccagtatggcctggatcctgtgcatgccggttactttaccgcagcctgtgtctttgccggctccctggtccgtccatttggtggcctgctggctgaccgcatcggtggcatccgcagcctgagtgcgatgtatatcctggcggcgctcttcttgtttacattgagtgtagggattgagacgcaactcatcggtttaggggtcgtgatgttggccatggcggcattgggaatgggcaatggggccgtgttccagttggtcccacaacgtttccgcaaagagatcggcgtcatgaccggactggtgggcatggctggcggcgtaggtggtttttacctggcctccagcttgggttactccaagcaaatcactggcagttatcaggtgggcctgactattttcgcgggcctggctatcctggcgctgattggcttatccaatgtgaaaaaccgctggcggacgacctggggtgcagccaccgtcaccagtgctaaaatctag

SEQ ID NO: 80457 - DNA, 288 bp, Glycine max
  Peptide Sequence Number=SeqID_172142
atggataaatttgacatctttgtccctcatcctctcgtaattacattttttcttccactggagtgtgggtgcaagccattggtttgtttgctcaagcgacctgcgctcctaagtttggactttccaagaccgttcaatcagaaattactcttgctacacatttggacaacgattgatacctcaaagccttacactagggcaataagaggcaccatgcgtaaacctcaagcgaacctaggggcagatcagaaattctcacccaatagattctctgctacaaggtcatga

SEQ ID NO: 80458 - DNA, 591 bp, Glycine max
  Peptide Sequence Number=SeqID_172143
atggtaccctcccggaaagacaaagagagacatttggccagatttcttgacattttcaagaaattggaaatcactttgccttttggagaagctctccaacagatggcactctatgccaaaattttgaaggatatgctaaccaagaagaatcggtacatccatagtgactgtcgcaacctacccttttgcgggcgagcgaggcgaggctcacgggtcgacaagggtgtttcccttgctcctatgtattcctcaattgtgataaggaaatcagacctacgtagttctttcaaaaggggcgaatcaagtgattcttttttacttggaaggcggtcatttaaggcgttggaccttaaaatgatccattttacttggcgagaaaacggcttaagcgatcggtcaaagctcgttaaaaacggaagaaaagaaaccgaaagtgaacgaaataaagatgaaagccaaaaaaatggaaatgaattgaaagtctcagatttggaaacttactcattgaagaacgaagaacggatgaagaacggtgaggaacggaggaaaaccttcacggatttgcttacggaaacatctcggaagcattaa

SEQ ID NO: 80459 - DNA, 618 bp, Glycine max
  Peptide Sequence Number=SeqID_172144
atggcgaagtttataaattatccattaaccaatgaagaaattgaggtaaatcttgaatttgaagatcatttaaaatcatttaaggaaatgcatgaagaagctcaaaggcttgctgttttaaacaaaaagctgaaaagcaaactaaaattgcatatcactaaattggcttcaacacaaggtgaggtgaataaattgaaacaagaaaatgaaaaagttgtttcaagttgtaaagccactggttgtgattatacctctacttctttttacatggatgatcacaagtctttgcaaaccaagtttgaaaatttcaaaatggatcactatgctaaacgtatgaagttgcaaactgagctttcttatcataaagatatgtttgaaaaattaaacaaaggaaagagtaatcttaatcacatgctcactgtgcaaaaacatactacagataagaccagcttggcatataacatgcaaaccaccttttcaaagaaaactaagtttgtatcctcaaaaggggtgaacccaaacaaagtctccaaaaagaggaacatagtgtattctaagagaaatgcaaagacatgtcattattgcatgaaaagaagtcatacatcatataaatgctag

SEQ ID NO: 80460 - DNA, 854 bp, Glycine max
  Peptide Sequence Number=SeqID_172145
atgagttggcagcagttcaaatctcaatacctggtgcgcttttgggcgccgctgccggcggtgatcgccgccgggatcctttctacctactacttcggcatgaccggcaccttctgggcggtgaccggcgagttcacgcgctggggcggccatgtgctgcagtggttcggcctgcaccccgagcagtggggctatttcaaggttatcggcctgcagggcacgccgctggagcgcatcgacgggcgcatgatcatcggcatgttcgctggctgcatcgccgccgcgctgtgggccaacaacatcaagctgcgccagccgcagcaccgcattcgcatcgtgcaggcgctgctgggcggcattatcgccggcttcggcgcgcgcctggcgatgggttgcaacctggcggcattcttcaccggcattcctcagttttcgctgcacgcctggttcttcgcgctggcgaccgccgcaggttcgtacttcggcgccaaattcacgctgctgccgatgttccgcatcccggtcaaattgcaaaaggtgaaggccgccgcgccgctgacgcagaagcctgagcaggcgcgccgccgcttccggctgggcatggcggtcttcggcctggcggtggcttggtcgctgtggacgctgttcgatgcgccgaagctcggtatcgccatgctgttcggcatcggcttcggtctgctgatcgaacgcgcgcagatctgctttacctcggcgttccgcgatctgtggatcaccggccgcacccacatggcgaaagccatcatcatcggcatggcggtgagcgccatcggcatcttcagctacgtgcagctcggcgtggcgccgaaaatcat

SEQ ID NO: 80461 - DNA, 176 bp, Glycine max
  Peptide Sequence Number=SeqID_172146
atgatgatggtattcaagaattgagggcaattcctttcaaagggggaggggatggtacgaaaattgaccaagaggagttgaaaatcaacacaagtgacattcaaagggaagttaatggcgtgggggctgtttggaatcctcatcaagggctgagtttaattacttggctattttaa

SEQ ID NO: 80462 - DNA, 561 bp, Glycine max
  Peptide Sequence Number=SeqID_172147
atgatgcttggcagttgcaaaggacctacttcatttgaggatatcagaacggttgcaaatatccaatatccaacatatagagaaacatgttttgcaatgggctttttacaagatgacagagaatatgttgaggcaatcaaagaggctaaggactggggcatagctaattatctaaggaaattgtttgtattaattctattaataggtgccatgagcaaacctgaagaagtttggaaccaatgttggcattggctggttgatgacattgcatatcaacatagcaaatcaacaatgaactccaaattacagatcaatgatgatactcttagaaatttgacattgattgaaattgaacaactattgcacataaaccaaagatcactgaaagactatcctacaatgtcatatcctcaggatatcaatctgacatcctacctacaaaacaacttggtattatcagaacttgattacaaccatgatgcaaccagatcagaatttgagcatctttttgcatccatgacaggcaatctacctattcatatattatgtgggatcctctag

SEQ ID NO: 80463 - DNA, 565 bp, Glycine max
  Peptide Sequence Number=SeqID_172148
gactacacgtcctcacctttcgagtcgagggctacatgccctcgccatcagagggctacacgccctcaccaacagaggactacatgtcctcgcctttagaggactacacatcctcaccttcagaggacttcacgtcctcaccttcatagggttacacgccctcaccttcagagggctgcatgtcctcgctttcagaggactacacgtcctcaccttcataggactacacgtcctccacttcagaggaccaaacatcctcatcttcagaggactacatgtcctcatcttcagaggactacacgtcctcaccttcataggactacacgtcctccacttcagagggccaaacatcctcatcttcagaggactacacatcctcactgtcataaggctacacgccctcaccttcaaagggctgcatgtccgtgccttcagagggactagacattctcgccttcagagggctacacaccttcactttcagtgtactacacgtcctagccttcagagggctacacgttctcgctttcagagggctcaacatttgcactttaagagaatttaa

SEQ ID NO: 80464 - DNA, 303 bp, Glycine max
  Peptide Sequence Number=SeqID_172149
atgactcatcataattttcaagtgcaagccattggtctgtttgctcaagcgacctgtgctcttgagtttggacttccaagaccgttcaatcagagattactcgtcttgcacgttggtgagggtgccgtaaaacaacgaggacaacgcttcccttgtgttcaagaatcccctacaacaagagacccacggtctcttaatcccttttcagaaataagaagaagagaagaagagatctctcttaaaagagatagattgtacaatgaagatcaatcaaaattccttattgaatatgcaagtggttga

SEQ ID NO: 80465 - DNA, 939 bp, Glycine max
  Peptide Sequence Number=SeqID_172150
atgatgaagctcgacccgtacatcaacgtcgacccgggcaccatgagcccgttccagcacggtgaggtctacgtcaccgacgacggcgccgagaccgacctcgacctgggccactacgagcgcttcgtgcgcacccgcctgagccgcaagaactcggtcaccaccggccgcatctacgagaacgtgatccgcaaggagcgccgcggcgactacctgggcgcgaccgtgcaggtcattccgcacatcaccgatgaaatccgccgttgcatcgacgaagccaccgaaggctacgacgtggcgctggtcgagatcggcggtaccgtcggcgacatcgagtcgcttccgttcctggaggcgatccgccaggtgcgcaccgagcgtggcccggagaaggcgctgttcatgcacctcaccctggtgccgtacatcggcgccgccggtgagctgaagaccaagccgacccagcactcggtgaaggaactgcgctcgatcggcatccagccggacgtgctgctgtgccgctccgagcaggcggtgccggattcggagcgccgcaagatcgcccagttcaccaacgtttccgagcgcgcggtgatcagcgtgccggacgtggacgtgctgtaccgcattccgtcgggcctgcacgcgcagggcctggacgaaatcgtggtcaaccagctgaagctggctgacaaggcgggtccggtcgacctgtcgatgtgggaagacgcggtcgacgcgaccctgcatccgttggacgaagtgaccatcgccgtagtcggcaagtacgtggaccatcaggacgcctacaagtcggtcggtgaagcactcaagcatggcggcctgcgccagcgcaccaaggtcaacctgaagtggctggaagcacaggacctggaaggcaccgacatggccgcactggccgatgttgacggcatcctg

SEQ ID NO: 80466 - DNA, 84 bp, Glycine max
  Peptide Sequence Number=SeqID_172151
atggcacaaaatggaccccggggtactatcaaagatactcagctctacccagcagcattcttcctcctcctgtattggatgtga

SEQ ID NO: 80467 - DNA, 1503 bp, Glycine max
  Peptide Sequence Number=SeqID_172152
atgaactgcaaggccaacgtttccaaagagctcaacgccaagcacaagaagttactgatggctgctaggttcatcgatctttcgatatttttggggattaatcaatctgaatattgtggtttgatactggaagggcttcttaaattaccagagaataggggatgtgctgactgcaaagctaaaggtccaagatgggctagtgtaaatcttggcatctttatatgcatgcagtgttcaggaatacatcgaagtttgggggttcgttctgcaaccctggacacttggcttccagatcaagttgcattcatccaatcaatgggaaacgaaaaagcaaatagtttctgggaagcagaattacctccaaattatgacagagttggaattgagaatttcattcgtgcaaagtatgacgagaagagatggattccaagagatgggaattcaaaaacaccttctggattgagggaagagaaaagtccttcacattggcagaggcctgtggagagaagtggttatgctgctgtttctgaaaataaatttgaggaaaggaagaaaatccaaccatcaaatgcaatttctaccacaagaattaatgttcctgctcctcccacagcatctgagcaggtaactcctattaccaaacctcagcatgtggagaaagtggaaccagtagcaccacaaccaccagcttcccaaccacaagctgaaacatcaaagcaagctacagacacagttcaaaatatccctccaaaagttgactatgctacagaccttttcaacatgttgtctatggatggccctaatgaaaatggctctgaggcagctggtacaactactgatgataatcactgggcagctgctgcagaggtgtcaacagctgagaagactagtccgccgaaagcagctgatagtactcccgtgtctgcatctggaattgaggatcttttcaaagatttatctcctgtgactccaagcttgactccagaaaaaccacaaaaagatgtgaaaaatgatatcatgcgcctctttgagaagggcaatatagtgtctccattttctatgcatcaacagcagcttggcatgctagcacaccaacagtctcttctaatggctgctgcagctaaatctactggtggggatcccaggtatcctgctagcatacaacaacctaggccaccaaatgttcctatccaaagttggccagctactggctactcaattcctggagtaatgcccatgggtggtcagggagacctgcaaaaacttatgcagggtcagcctaggagcatgaccccagcacactttgcagggagctctgttcaatatccaccatccagtttctatggtatgggtcaagttgctcctccagttaacggtatgatgacgacaatgggagtgaataaacctcagtcaggagctcctgcagtgtcatctagccctacacagtctgcgaaggattatgatttttcctccttaacacaggggatgtttacgaaacagtga

SEQ ID NO: 80468 - DNA, 1020 bp, Glycine max
  Peptide Sequence Number=SeqID_172153
atggagatcacaaaaagaagttccctcctgatattcttcctagtgtttggcgcaggcttgatccatgccaaggcatatcaaaacctatactgcggcagaggaacccgatgctatggaaagcacatcacatgtcctgctgaatgccccgacagtgaaacaaacaatcctaagactaaggtttgccaaatcgattgcaacaaacctatttgcaaggcagtctgcagaagtcgcaagccaaactgcaatgcaccaggatctggatgctatgatccccgtttcattggtggggatggtagagtcttctacttccacggaaaaaccaacgaacacttcaccttagtttccgattccaaccttcagatgaatgcacgcttcatcggacacaggcctgaaggaagaagccgagactacacatggatccaagcccttggaatcctcttcaactccaaaaccttctcacttgaggccaccaagacaccccaatggaatgatgaacttgaccacttcaaattcacctataacgggaaccaagtagccctagctgaaggctctctctccacttggtacactgaagaaaaggacataaaggtggaaagagtggcaagcaagaacggtgtcatggttacactgaaggatgtggctgaaatattggtcaatgttgtgccaataaccaaagaagatgacagaattcacaactaccaagtgccctctgatgactgttttgctcacttggaagttcagttcaggttctttgctttgtcccaaaaagttgatggtgtgcttggaaggacttatagattggattttgagaaccctgcaaagcctggtgtggctatgcctgttgttggtggagaagacaagtacagaactaactcattgctctctcctcattgtggttcttgtgtgtactcacagggaagttcaactgagaaagagaccactccccaacaagtgatggaatatggcacccttgattgcaccaagttttcatatgggttgggaattgtttgcaggaaatga

SEQ ID NO: 80469 - DNA, 426 bp, Glycine max
  Peptide Sequence Number=SeqID_172154
atggctgtctcaagaagcaatggcttaatatttgtcatgttttttgcaatctttgtaatgcatattaatgcagaaactcaaacctgcaccaaccgtaggagtccatgttttctcaagaaaatacaatgcgctgctgaatgtccttcaaagtcaccaactaacctaaaagccaaagtctgctatcccttatgcaacactcaatgcaaaaattgtaaccaaactgcaatggccctggatctgcatgcttggacccccactttgttggtgcagatggaggtgctgttcaaattctatggtttatcttcgagagttgaaggagttcttggcaggacttatcagccagattttcagaatccagcaaagccaggtgtggcaatgctagtggattcattttctttgcttctacatcaatatagagaaaattaa

SEQ ID NO: 80470 - DNA, 1806 bp, Glycine max
  Peptide Sequence Number=SeqID_172155
atggattccaaaaccgagtttccaattcctagtgacaaagaacgtcaagctataaacaattacctccagatcgagcgcgaattcatggccaccaagggcttttataaagcagaaaggaaccttctgcatcggaagcacgcggttgcaacaattgctaagctctctcaaggccaagttgttgatgcgtatgttgcctatcttgcaatgaactacttcgatcgctatgcttcttccacgaatccatttgcagttgggctaggctcttctgtaactgatacagtttgtttcgttgcaacctgttgcttcatgctttccgctaagatgaggtcaaaccaattcgatctccaacagtttctgttcgagaaagatttgaattaccagcctactaggttagcggcaatggaacttagcattctcagtggccttaactggcgaatgctacctataactccgttttacttcctagatcactattaccccaccttcagcgaaatcggtggtttcaaacgccgatcgatcaatgagatcatagtccagtctcaaggagtgcaccaattcactgaattcaaaccttctcatattgcaatatccgcttttctagctgctactttcgttggatatccctcagagtttaatgcaattcaaaaatcacttgacaaaccggggaagctggagggctgttggaggcagctggtccatctttgtcataggagcgccatcgagatatgtagcgcttcaggaactgtaatatctgcaactaaaattaggacaaagctcccaatccaatctgaagaagctgcagcggaagaagcatcagagatacagacaaggaaatctgaagtacaaaaatatagcacaaccaagttcatccagttcacggtattggatactgaagaagaagaaaatgtagcaccattaatccgccgacgaagacgggaaagggtggaggcaactgaagaaggtgcagagccagaagctgagactgaggcaacaaagcaacaaggacttgaccagggaaaggctgtgacagtgggagattcatctgaacaaaaagatgcagaagctgagactaaggtaaacccaaaagaacatgacaagggtataggggagatagaggaaatatgtgaagaacatgtggaagctgagagtgagttacgactaagaaaggcaaagggcaaggccaaggtgggtgaagaggtactggagaaagggaaagccacaatcatttcagagatagttccagcagaagaagctgcaccaaagacactaatgaactttgatctgcggtggtcgacttctgtgcctgaatatgtagaagacagtgaacaggtggaagacaccgcatgctttggagttcgatgtcctggaacaatactgggatctggcgatgattcacctctaaaatcctttcaaggctatttgatcaacctgaggcgctttccatctcccacaatatcccgtgtggcactcgatcgacaagcaagtatgaggaaaatactcgaaataatttcaaagtctaagcatcttcttctttggggtcatgcatgcatgatggaatcgaccacgcaaaagaacaaaggcaaaaagtcatcgttgttgatgcgtttcaaacccgttatgggcatcgacgactctattataccaaaacgcaatgggagcgacccggttttgtcgtatctcgcggtcgcttacaacgacggtgccgttttgccggccatgttgtcgtcgttgtttggagcggcacatgccctcaagacggttatcagtgcaaccactttggtagttttcttcttcttgccacaatga

SEQ ID NO: 80471 - DNA, 2979 bp, Glycine max
  Peptide Sequence Number=SeqID_172156
atggctactaggatcatagaaagcttggtaaaaatcagtgaaacatattctctaatctttgatctgctctacggattcaacagcttcaatgataatgtacaagtgctagaaatgaaactagaagagttatgcagcctagaatatgacataaacaaagagcttgaaattgcagagctacagcaaggcaagaaaagaaaacgagaagttgaaaattggcagagaaatgttcaaaggaagaaaattgaagtctatggcatagttcaggaattgagggactgtggagtgtttaagcatctaaagttaactgcacaagtaaagaaactaataggacaagtgacagatcttgtggagtgtggtaggtttcctaaaggaattgtggggtgtgcacatgaatctagaggatatgcattgttgacaacaaaattagcaggtgcaatgtttcagaaaaatgttgctaagatatgggattggttgatgaatgatggtgagttgataattggtgtgtatggaatgggaggagtggggaaaactagtatgctaatgcacatacataatatgcttttaacaagagtcaccaactttgatagtgtgttttgggtgactctctcacagtcatttagcattcacaaattgcagtgtgatgtagccaaaatagttgggctagatatttcaaaagaaagtgatgaaaggaaaagagcagcaagattatcatggacattgatgagaaggaaaagatgtgtactttttttggatgatgtgtggagttattttccactagagaaggtgggaattcctgtgagggaagggctaaagttggttttgacaagtcgttcattagaagtgtgtcgaaggatgaattgtcaaaacaatgtcaaagtggagcctcttgctaaggaagaagcatggaccttgtttctagataaccttggacaacagactactctttctccagaagtaacaaaggttgctaggtctgtcgcaaaagaatgtgctggtttaccccttgcaattattacaatggccaggagcatgaggggagtggaagaaatttgtgagtggcggcatgctctggaagaactaagaaacacagaaattaggctggaagaaatggaaatggaggtactccgtgtgttgcaatttagctatgatcacttaaatgataacatgctacaaaagtgcttcttatgttgtgcattatatcctgaagactttgaaatagacagggatgttttgatagaaagttttgttgatgagggactggtgaatggaatgaaaagtttggaggctatgtttgatgaaggacaaaccatactgaataagcttgaaaacagttgtcttttggggaaagtggaaaattatgttggtggaaaaaaatgcatggggttacaggatgccagcagtcatatagctatcagcatgatgaaaaggggatgccaatgtgtggcaccaatagataatgtggaaggctattatgtgggaagtcaattggtgaaaatgcatgatttggtgagggctatggctattaatgttataaaggtgaactaccattttcttgtgaaggctgggttgcaattgactgagattccagatgaagtagaatggaacgaagacctggagaaggtttctctgatgtgtaattggatacatgaaattccaacaggcatatcacctaggtgtcctaaacttagaaccttgatcttgaagcataatgaatccctgacaagtatctcagattctttttttgttcacatgtcttcactccaagttcttgatttgtccttcacagacattgaggttttgccaaaatctgtggctgacttgaataccctcactgctttgttgctaacatcttgtaagaggttgaagcacatgccttcgctagcaaagctgcagaccttaataagattggacctatcttttactgcgatcacagaaatacctcaagatttggaaacgttggtcaaccttaaatggcttaatctttatgcaaaaaatttggtgtcaacaggaaaagaaatagcaaaattgattcacctgcagtttctgattcttcattggtggtccagaaagataaaagtgaaagtagaacacatatcatgcctgggaaagttggaaacatttgctggtaacttatacaacatgcagcatttcaatgcctatgtgaaaacaatgcatgaatatggacctagaagttaccttcttcagttagacagtgaagagtctcctggtaaatctccatggtacttttttgctgaagtttgtttcagcaaggatgtgatcatttcaaactgcaaaatcagaacaggagtaacaccccttatgctcccttcagacattcaacgcttgaaggttgaaagatgtcatgacataagaagcttatgtgatattttgtcattaaaaaatgccacttctttgaagcgctgtgagattgctgactgtgatggccaagagtacttgttttctttatgttgctcttcctcctgctgcacctctcttcacaacatagaatctgtggaactctataacctgaaaaacttgcacactctttgcaaggaaaacgaagctgtggctcaaacccttccacctccaggagcttttacttgtctcaagtatttttgcatctaccattgtcccattatcaagaagttgctgacaccaggattgctagcctatctacagaacttggaagagataattgttcataattgcaagtcaatggaggaaataatttcagtagatggcatagattatgaaagctctggtggtaacaaatattgtgtggctaatagagatgctgttaaagtcacacatccaaagttagtatcattatcattgaagcacctaccagaactcaggagcatatgtagaggactaatgatatgcgagtctctacaaaactttaggatctttaaatgccctaaactaataaggctccctgaaactgctaccccagttcagactttgtacgattgtttctga

SEQ ID NO: 80472 - DNA, 369 bp, Glycine max
  Peptide Sequence Number=SeqID_172157
atggcgccgcgtctcttgtcatgcttccgcaacaagcacgccggcgggtgcagccaccacgacgagggatgcggcgcatcatcggaggagtcggcggcgggggcgagggaagcagcaggagaggggccggtgctggtggagatgttcacgtcgcaggggtgcgcaacgtcgccggcggcggacctggacccatttgggtccagccagtggaccgttaggcagaaggcctatgttgaggcccttgggcttgacacgcttttcactccacaggttgtggtccaaggtcaggcccatctcgaaggaaatgacgataatgccctcatctctgccattacctctgcgcctaggttccctgctcccaccttccag

SEQ ID NO: 80473 - DNA, 174 bp, Glycine max
  Peptide Sequence Number=SeqID_172158
atgtttggaagcaaaggcgagaaccttggcaagtcaagaagaatgggccccgttcatggacatcctgatgggttggtggacctggcagtgattgatgcttttctcgcctttcacgaccgcaaggaaagcttggttgtcgctatcttagttgatctatatgacacatttgactga

SEQ ID NO: 80474 - DNA, 345 bp, Glycine max
  Peptide Sequence Number=SeqID_172159
atgtaccctctcttgttctcaattacaacaacccaagtagatgtaccctctacttgtaccacaaaggatgtaccctccaatgtgttaagacaaagttctcaggcgggaaagggaagaatcaaaagaattctcagactatgtcgttttgaattctttgaaaagggagaagggagacacaaaagaattcaggcggttagtcctttgttcttttggaaaagggagaagagagacacaaaaagaattcaggtgaacaaggttcggaaaccagaaaacttagaaagcttttggaaaaagaagaagaagaagaagttcaaaaagattttcaaagagattcgaaggttgtaa

SEQ ID NO: 80475 - DNA, 621 bp, Glycine max
  Peptide Sequence Number=SeqID_172160
actcatcttctccttgaagtggcatctcctctctctttccctttctccattccgctgccattcatcttccaagaagcaaaggaatccattgatgaagaagatcctaggcttacaagctctaatggagcttgcatcatcctaggcctacaagctccaatggagcttgcatcactagacgtcctcgccgtcagaggactacacgtcctcaccttcagaggactagacgtcctcgccgttagaggactagacgtcctcgccttcagaggactacatgtcctccacttcagaggactacacgtcctcgccttcagagggctatgcgctctcgccttcagtggaatccatatccgcaccttaagagaatttcagctactgtgcataccggggcaagatttcacccgtgccactgcaaagagacgagtttggatcatgcgcaccaacatgaccactcttacacggatatggatgacgttgctacttagcaacattccgtctagcggccgcaataccgatgtccccctgtggagggatcgtgcccacaagacacccagtggacccggaggagcccaacagggccctggggtttccagctgtggttatgggcctctgtcagtcctatag

SEQ ID NO: 80476 - DNA, 207 bp, Glycine max
  Peptide Sequence Number=SeqID_172161
atgtggctgaagccaccacagattcctttgaggagtaggcgacacagggatccttcatcccctatggacatcaggatgttctcaccgctactattagacatccagagcaccctggacgtgttcgtgctattggagccggtgtcaccatcaagcaatacttggatcggctccacggacgtcctgcagctcttcctccctgcctcctga

SEQ ID NO: 80477 - DNA, 438 bp, Glycine max
  Peptide Sequence Number=SeqID_172162
atgtcgcggaacttcacggattgtgctacaatgccttcttttgacttccggcacatcacggaacttcacgaattgcctaacgatgggccacaacagcagatgccaagtctctatgatcgaaccatgaagctagaagagactctagctcaatttatgcaagtgccaatgtctaaccaaaagagcacagagtctgcaattaagaatctgcaagttcaagtaggccagcttgcaaagcagttagctgaaagaccatccaacagctttacatcaaacacagagaaaaatcctaaggaagactacaaagcaatgataactagaagcagaatgctggctgatgaaccgacactggaaccggttgatgatttagttgaacttgaagaaagtgttgaggaagcagaaggtgttgaagaagaagacaaagttgttgaatgcaaagag

SEQ ID NO: 80478 - DNA, 105 bp, Glycine max
  Peptide Sequence Number=SeqID_172163
atgggggtgcaaatagcaaccaggcccacttgggccttccagaaaattcctccagaaggcgggggagaagtgaagaggaaaattgttcagcagccctcctcgtaa

SEQ ID NO: 80479 - DNA, 300 bp, Glycine max
  Peptide Sequence Number=SeqID_172164
atggctgcgagaaatgagcgagaacgacttcttaccgaggccttaaacaacttggcgcaagttatggccaatcagggaggcagtggaggagcaactatgtaccatggggagattgagaagatcttccgggtgatggagtgtcaggaccatcagaggtgttgtttgctactctacatgctagcagatgaggcggagtactggtgggagtactactcgcccacgtttagagggagcaggtggtgttgttgtccaatgggagactttcagacaaacttttctggagaagtattttccagatag

SEQ ID NO: 80480 - DNA, 763 bp, Glycine max
  Peptide Sequence Number=SeqID_172165
tagcatagacatcgccattgtaaaggagttttacgccaacctctattaccccgaggataaatcaactaagcaggtgagggtgagaggtcacctagtgaagtttgatgaggatactttaaacacatttctgaagaccccagtaattttggaggaattggagaacttgtgtacttattccagatttgcactcctgaggcctgatcctcaggaattggttgctaagctctgtatcccagggaggggattcaagcttaatgctgatgggcatcctttgaagatattgaggaagaacatgaccactctagctcagacatggagtgttctttccttttctagcctcattcctacctcccacacatctaatgtcaccttggacagagccaagttgatttatggtattatcatgaagatggatatgaatttggggtacctcatctcccaccagatctctctgattgcacagcatgacacatccagacttggattccttgccttaatcacaactctatgcaaggccagaggagtccaatcagattctagatccctggagaacttgagccctgccattaacttggcgtatattaagaagaattgttggaatcttaatgatccaatagtgacatttagagggccaaggaaggccaggggtaagagatcagaggtccccactacttcaacaccaccagaaacaccagctccttcttcttccgcagctccagtacctctcattcagactccagttattcctcctacatttacatag

SEQ ID NO: 80481 - DNA, 174 bp, Glycine max
  Peptide Sequence Number=SeqID_172166
atgtacatgtcagccctggcacgaaagtatgatcgtctcgcccttagcagccaggctactaggctgatagggaaatccgattcgccggaaagtgcaccagatcgtcaagtatttaaaattaagacggatgaatccgagtatcgaactcagggaactagtattagacagggttaa

SEQ ID NO: 80482 - DNA, 495 bp, Glycine max
  Peptide Sequence Number=SeqID_172167
atgggctcaaaatctaccctaaggctcatgagaaccctagggccttcccttggatctctagcccaatctacttggagtcttctacctaattcccttgcgggtagtcataactcttgcaagagcttaagtgaagaatttcatgactattatgaaggaaggcataggtcacatcttagacctcactcccataggagagaaaaggaaagaaagtctcaagaggctaacattaacctctcatacttccatgggaaggacaatgtagaggctaacttagattgggaaataaggatagaacaacaacttaaaatgaagtctacttcaaaatcttatggctctcactcttatccaaagaaagaccaaggtcaaggcatcttaggggtgactccttctaagcccaaagatgataaggggaagacaatagagaagcaaccccttaaggctagtatgcaagagaagactagctccatgaagtgctttaaatgttttggaagatga

SEQ ID NO: 80483 - DNA, 306 bp, Glycine max
  Peptide Sequence Number=SeqID_172168
tccaactcctctaggttgggatttcctgccttgatcacagctctctacaaggcaaggggagtcacttctgattccttctcttatgaatcattgagcccagccattaatttggcatatatcaagaaaaatatttggaacttggatgaaccttcggtctactttccagggactcacaaggctagggccaaagcagctgagatcccttcctcatccactcctcaggacccttctgtacccacttctgctccaccactagctccagctcatccaggaccttccacagaccttatcatggcgatgctctag

SEQ ID NO: 80484 - DNA, 513 bp, Glycine max
  Peptide Sequence Number=SeqID_172169
atgacccaagagctggtaacccgcgaagacaccttacagttatccgcacctcgtcattcagtgaccccaagtgtgattgatgagcagaggccaatatggtcatctgcgccttttccggagatgtcaacatcttccggtggagactttttcaagtctcacaagttatctagaactacgagcaagagccttgcttttgtcggccgccccacaatctctgtcatactgaccctgaggtcatgtgacatgcggagacaaaatttggtcattccgcatccctttgccattcagacacagtcgtgtccgatggcacgcagagacaaaatttggtcattctgcacccttttgtcatccagaggcggcgggcccgatgacatgcggagacaaaatttggtcattctgcacccctttgccattcagacacagtggtgtccgatggcacgcagagacaaaatttggtcattctgcacccttttgtcatccagaggcggcgggcccgatgacatgcggagataa

SEQ ID NO: 80485 - DNA, 663 bp, Glycine max
  Peptide Sequence Number=SeqID_172170
atgagtcttcattcttcatctagtgttaatggtgagggttctactcctaaggaccccttaaggtgccataagtcacatactaaacatcacttccaaagaagagaaaaggatagaaggactcaagaggttaacattagcctcccatatttccatggaaaagataatgttgaggcatacctagattggaaaataaaggttgaacaactctttgcttgccatcatattagtgaagaaagaaatgttccattggctacccttactttcaatggtatgccctttattggtggacttcccttgaaggaccaagcccatggaattttgggggctgtaccttcaaaacccaaggaagataagggtaagaccatagagaaatacatccctaagattagttcccaagaaaggactagcaacattaaatgcttcaaatgtcttgggagaggtcacattgcctctcaatgccccacaaagaaaaccatgatcatgaggggtcaagacatttatagtagtcaagaggagactacttcttgcccttcctctaggggaagtgaagatgaagtaaggggtgaagaatcttgtgaggaagtttacccccatgaagaaggtgatctcttaatggttagaaggctccttggaggtcaatcttgtgatctatctcaatcctaa

SEQ ID NO: 80486 - DNA, 51 bp, Glycine max
  Peptide Sequence Number=SeqID_172171
atgttttgtgtaatcgattacaatgatttggtaatcgattacaatgatttg

SEQ ID NO: 80487 - DNA, 905 bp, Glycine max
  Peptide Sequence Number=SeqID_172172
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgtccgctccacggccaaagctggtttatgaaggtgatttttggaatgctattatggccggccataaagttgtacaggatggcgtgttgctgtatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 80488 - DNA, 370 bp, Glycine max
  Peptide Sequence Number=SeqID_172173
atggataaagtggacataattggaggcgactactgcagccagtgcttaatgaaaggaatagtcgttatgaaagacggtttcaagaaatgtcatcacaaggtgtcaactttagacgatctggcgtcgtgccttgataagatgactcttttagctgaggaagatgatagaattattgaggcacgtgaaaaagctcctccttcgacccaaggtttagggcgacgtagggaaagtgtggatgcagaagcacatgtcattcctgcgatgccagagcagcaacatggaatgtattacacacctgatcagttcacccaagagtcgtctcaaatgtcccccctgtatccgtacccatatcaaagcgaaacttcatcag

SEQ ID NO: 80489 - DNA, 452 bp, Glycine max
  Peptide Sequence Number=SeqID_172174
atggttagaacacgaggtttaggtcgtgcgttaggagctggtagaggtagaggcattagtgaggatgcgcatgaggctgatgttcctcggcgtcgcaggcctactgcttcagcacgtaggcaacgggtttgcctgcgtgaggacatcacagagagacctgaggatgtgcctcagttgcatgaggatgttcctcatgtgtctgatgccaccctagagatgacaggcgccgtcgatgctgttcagacagagggagtggctactgatgggagcttggggtcacctgttgcagatgtgggatttcccggtggaccacgcaacccatcgattttgaccgattttgctgagcatgtcgcacatagcatctggagtggacaggaacgacccgatctgaagatggtctcccacggtagaaaagtagataaaattgggagaccagcgcctgagatcgaagg

SEQ ID NO: 80490 - DNA, 198 bp, Glycine max
  Peptide Sequence Number=SeqID_172175
cgtgaattcgctaagcgcaaccttcagtggctaagcgtgaggaagaatccaaaagaagataagttgtcaagttcgctaagcgcaccgctccaggtcatcaagcgcgctgcttcagctcatccactaagcgaaacaagcgtgctaagccaaaatccacttatgtgcgctaagcgatccaaatctgcactaagcgcatga

SEQ ID NO: 80491 - DNA, 507 bp, Glycine max
  Peptide Sequence Number=SeqID_172176
atgaaggccgacatggaggccttgaaagagcaaatggccacaatgatgaaggtcatgatgagcataaaggagataatggaagccaatgtggttgcagttgccgctgccagcgctgttgctaagcacgccttcccgccatatggcttgcctcccaactatacaccacccaatgtggcgtacactcccaatgagaatgtcaataactccactccgatactcattgagagccaacaacctcaatctaatcatgcacatgtctctcaaaccgtgggagagacacatgaaattccccaccacaatctagccgacttcgagccttgcctcggatatgccactgaagggcaagcagttggtgatatacccctgcaaaacactttggagggccctcagtatcacccacaaccacacctcttgcattccgcattgggtaaaaaccctcatgctatgacagaaatgggaaagttggatcatctagaggaaaggctcaaggccattgaaggaggctga

SEQ ID NO: 80492 - DNA, 1574 bp, Glycine max
  Peptide Sequence Number=SeqID_172177
atgttgtacgctgaatctgctcattcgaaagggagaatcaccatgtcagaccaagccttgaaaatcgtcactctgctcggcagcctgcgcaaaggctcctacaacgccatggtggcccgcgccctgcctgggctggccccacaaggcgtcacaattgaagcgctgccttccatccgcgatatcccgctgtacgacgccgacatgcaacagggtgaaggcttccctgccgctgtcgaggcgatcgccgaacagatccgccaggccgacggcgtgatcatcgtcacccctgaatataactattccgtgcccggtgggttgaagaacgccatcgactggctgtctcgcttgccgaatcagccgctggccggcaagccggtcgccattcaaaccagctcgatggggccgatcggcggcgcgcgctgccaataccatctgcgccagatcctggtgttcctcgatgcgatggtaatgaacaagcctgagtttatgggcggcgtgatccagagcaaggtcgatgaacaggccggtgaactgagcgatcagggaacgctggattttctgaccggccagctgtctgcgttcagcgattttattcgccgcgtggatcccgctttcgccgcagacatgcgttatcccgccggtgaagagccgctggagctgccggcacacagcgcgctcaacgcccagctgtcgcgatccgcgcaaaaccaggaagataaaaagctgggcgccatgtcgctgtacctgacgctgatgcgcgaagacggccgcaacgtctgggcgccctaccagctggcggtgtcatcggcggagaaagggcaaaccgagctggcggagcgctacctgcagctgagcgccgaccgcggcctgtggtactactacaacctgctggaggacgacgccttcaacagcatccagcactccgccacctaccaatcgatcctggccgccaccaaagcgcgctatctgcagcacgcccgccactatgaaggcaaggccagctacgcgatgccggacggcgaagcgccgcccgaaggctggccaacggtgatcttcctgcatacctacggcaaagccgccgccatcagccccgaagaacggctgctgttcggcgaaatgggcgtggcctacatcgagctcaacggcacgcagatgctgtcggaaaacagtttccgctggtcgaattacagcgacgagagcacccaaaccgccattcagcgtacgctgcaacagctggctccgcagctaaagctgaatccccggcggatttacctcagcgcccgcggccagggcgcactgcacgccgccaacctgatcgcgaagtacccgcagttttacgccggcgcgctcctgatcgcccccaacggggagatcaagccggcccagcagtcgctggcggcgcaaaagaaaatcgtgatggcgtattacgatcggcagaacttcagcgagcaggcgctggcattgcacttcgccaatctgttcggggaggataatcaggtgcagacgctgcacttcgcccagggagaggatgccgccggcagttggcaggcgcgcttcaagcggcgttgcagtgg

SEQ ID NO: 80493 - DNA, 519 bp, Glycine max
  Peptide Sequence Number=SeqID_172178
atgctggaggaacagatgaacgacgaatttaaaggcaaaagcggcaaggtaaaagtgatgtacgtacgtgatgaggagggcggtcagaagccaaatccccgtaccggcaaaggcggccgtcctgctgcgcgccaggaagagaatcgtcgctctggtcctcgcagcacccgtaataatgaagagagcggtcgtccgcgcaccgcccgtggcgatgatgccgggcgttcgcgtggtccgcgtgacgatagcgcgcgcggtcgccgcagcgatcgggacgatcgcggcttcagtgattcaccgtggcgcaccgtgtcacgtccgccagtcgccgctgaagcggatgcgggtgacgaagcggccagcagcaagccggttatcgacccggaactgattcgccgtcagcgtcaggaagagacgcgcgtatacggcgagaaacgcctgccaggcgctgttccagagccgtcccgaaagctgtatcgtccgcgcctggtttatccagagcgtgaccccgcgctttaa

SEQ ID NO: 80494 - DNA, 1121 bp, Glycine max
  Peptide Sequence Number=SeqID_172179
atgccaatcccgagagcaggagcgaatgatgagccaacgtggactggaagcgctgttacgaccgaaatcaattgcggtgctgggtgcgtcgataaaaccgggccgcgctggctatctgatgatgcgcaacctgctggcgggcggctttggcggtccggtgttgccggtcacgcccaaatacaaggcggtcagcggcgtgctggcctggccggatgtggccaccctgcccttcgcccccgatctggcgattatctgcacccacgccagacgcaatctggaacttttacagcagctgggagaaaaaggctcctgtgccagccagtggcagatgcgcctgctgggccccaacagtctgggcctgttagccccctggcaggggctgaatgccagcttctcaccggtaccgattgcgaaaggacgcatcgcctttatttcgcaatcggcggcggcgacagcctggatattgacgtcgacgacctgctggattttcttgcacgcgatggcaaaaccagcgccattttgctctacctggaacacctgagcgatgcccggcgcttcgtttctgcctcgcgtagcgcagcgcgtaataaacctattctggtgatcaaaagcggtcgcagccaccaggctcaggcgatgatcggcaccgccagcggactggatgctgcctgggatgccgccattcagcgcgccggtctgctgcgcgtgcaggacacgcatgagctgttttccgccgtggagtcgctcagccacatgcgcccgctgcgcggtgagcgcctgatgattatcagcaacggcgccgctccggcagccctggcgctggatgaactctatgcgcgtaacggcaagctggcgacgctggatgagcccacgctgcaggcgctggcggccctgctgccggagggcatcgggcgcggtaatccgctggatttgaaagatcatgcaacccccgcgctgtacgtggcctgcgtaacacagctgctcgacagccatgaactggatgcgctgatgattattcattcacccagcgccgtctctccggccagtgaaaccgccacgcagattattgcggcggtggccgcgcatccgcggggtaagcaggtgacgctgctgaccaactg

SEQ ID NO: 80495 - DNA, 564 bp, Glycine max
  Peptide Sequence Number=SeqID_172180
atgcagttgaatggcggatggctggtgggcgcgcgtcgggtgccttcgccgcatcacgattgccgcccggacgatgaaaacccttctttactggtggtacataatatcagcctgccgccgggggagtttggcggcccgtggattgacgcgctatttaccggtacattggatgccgacgcgcatccttacttcgccgggattgctcatctgcgcgtttcggcgcattgtctgattcgccgcgatggcgagatagtccagtatgtaccctttgataagcgcgcatggcatgcgggcgtctccagctatcacggccgcgagcgctgcaatgatttttcgatcggcattgagctggaagggacggatactcaggcttacaccgaggcgcagtaccagcagttagtggtgattacccaggcgcttatccagcgttatcttggtattgctgataatattaccggccattgcgatatcgcgccgatacgtaaaacggatcccggcccggcctttgattgggcaaaataccgcggtatgttggccgcatcgtcacataaggagataccatga

SEQ ID NO: 80496 - DNA, 162 bp, Glycine max
  Peptide Sequence Number=SeqID_172181
atgtctaatgatcctagaaataacaaagtggatgatcttggagatgacaaagaaggatgggtaggtgttgtgggtgcttcagattgtccatggcagcgatggccaacagcagcggcggtggaggatgatccctttctcttcttcaatgattcttccatttaa

SEQ ID NO: 80497 - DNA, 159 bp, Glycine max
  Peptide Sequence Number=SeqID_172182
atgaaatttgatagaagcggagaggagttcattgaagaattgtgggttgatattctgacctacgctagtgctcaatatagagcagaatgttttggacttgggtactatgtcgagtcgacaacactttatttacatacgtcagagtttgtgcttaaataa

SEQ ID NO: 80498 - DNA, 351 bp, Glycine max
  Peptide Sequence Number=SeqID_172183
atgaaaacgtcttggaagcattacggaagtgcctcggcttggatatttttcatggaaacaattttcttgactaattccgagagaatcctaaataccagaaaggctgaacacttttactctgccctttttccccaatttataggagaaaagagggaggtggttgccgcccagctcgcccaggcaagttgggttgcttccaccagaagaatgttgcgaaactttacggattacgcaacaatgccctttttgacttctagaatgttgtggaactttacagatcgtgcaacaatgcttcctttcaacttccggcatgttgcggaacttcatggattgcctaacgattggtgttaa

SEQ ID NO: 80499 - DNA, 720 bp, Glycine max
  Peptide Sequence Number=SeqID_172184
atgacgttcaacgcgagcaccatcacaacggcgtcggaaggagcctggcagggcgataatcccctgaaccacgctcttcctttgttgatcgttcaaaccatcctcgtagtcttcgtgagccgcacactcgcctttctcctcaaaccctttcgtcaacctaaagttgtcgccgagattattggtggaattttgttggggccttctgctattgggcgcaacaagaaattcatgcacatagtgttcccagcatggagcactaccatgctggaatcagtggcaagcttcggcctcttattctatctatttctggtgggcctagagctcgactttcgcaccattcgccggagcggcaagcaagccttcaacatcgcggtggccggaataaccctccccttcatctgcgccgtgggagtaacgttccttctccagagagccatccgctctgaaaaccataacatagggtacgttcagcacttcgtgttcttaggggtatctctgtccatcacggctttccctgtgctcgcgcgcatcttagcggagctcaaactgctgaccacacgtgtgggagaaaccgccatggcggctgcagccttcaacgacgtcgctgcgtgggttttgttggccttggcggtggctttggctggccagggacacaaaagcagcttgttgacatcaatatgggtgctcttctcaggtggacctactatagttataacttaa

SEQ ID NO: 80500 - DNA, 2967 bp, Glycine max
  Peptide Sequence Number=SeqID_172185
atgaatggagtgcagaacagaagggttcacaatgttgagaaaccttttccaggatgcctgggaagagtggtgaatctctttgatttgaccgggggtgtaaatggaaacaagctactcacagacaggcctcatcgcgatgcatcttcactctccagaagtcaatcagatgttgcaaggatcatgagtcctaccttgggtgatcagatagaggataagctgattgtttctgactcaatgagagctacaaataagaaaataaatggaacacccatcaagatgctcatagaccaagaaatgtccaaagaagttgtttccaagcacaacccaccaccaaatgtagttgcaaaattaatggggcttgaagccctcccacagggtgagctatctgtggagagaagccatagaggagattattctcaacatatgtgtggtcattcagggacaccattcaaccactggaacctggaagataggtttatggacaaggaaatgcttcatgaagttcatccaaacacagaacagattgcttataaagatatttatgaaatatggctgcaatcacagagaacaagcaatgtaagagacaagacaccggagagagaaaagtggactgaagatgttaatgggaagaaaatggctcttattcgccagaaatttatggaagctaaacgtctgtctacagatgagagactacgccagtccaaggagtttgaagatgccttggaagttttaagttccaataatgatctgttagtcaggttattggattctcaaaatctttatgaacttcagtctactccagtagcagagacaaagcgtattactgttcttaaaccttcgaagatggttgacaatgaaaattctggtggaaaggggaagaaaaacgacaagcagattaagaaaccagcaaatgttggtgctggatgggagaaatacagtcctgcatactccccagccagtcagaaaattgacgagtttgcagttcaacctactcgaatagtggtattgaagcctagccctgggaaggcacatgagattaaggctgtgtcttctcctactatgtcatcacctcgaaatctgcagagtggaaatttctaccaagaacctgaggatgatgatgatgtactggaatcaagaaaagtgccaagtcaaattacacaacaaatgcatgaaaatctgaggagccatcaaagagatgaaatattgtattcttcagtattctccaatggctatactggtgatgagagttcattcaacaaatcagatcatgagtacactgctgggaatttcagtgatttggaagttatgtccccatctccaagacattcttgggattacatcaatcgcagtggcagtcctttttcttcatcatccttcagccgtgcatcctgttctcctgagtcgtcagtttgcagagaggccaagaaacgactttctgaaagatgggccatgatgtcaaataagggttctcaagaacaaaggcatatgcgtagaagctctaccttgggtgagatgcttgctctttcggatataaagaaatctgtaatatctgagcttgagggtattcataaagaacaggaaccaagtgaatctgtttcttgtagtcgaaattttaaagcggaaacatgtatggatggttctcctagaaacctttctaggtcaaaatctgttccaacatcttctactgtctatgaaaatgggctcaacgttgaagtttgtgataatgatgctggcaaagcacatgggtctggggagctgacaaagtcaaagagtatgaaatcatcatttaaagggaaagttacaagtttcttcttctcaaggaataagaaaccatccagagaaaaatcttgtctatctcaatctgttgatgaatcccaatccactgccattgaaacatcagattctccagtgaattcatctagagtccttagggatgatgtgtctcaaagcttcgacagtggatccatcggagagtgttctcttccagctccatatgaatcatcaggcaaaattttatcagattctatctctaatggacaaggtgctgtaccactggagattatggaatgttctaggatcatacatgctggattgactctgtcaaagtccatggtgcctgggatttcaagcgaaaaccaggatcagcccagtccaatttcagttttagagcctccatttgaagatgataatgctgttgtcgagtccttgggctgtgtgaggggtggtcagctgggatcacgggtgtctctgaagtctaatttaattgacaaatcaccaccaatagaatcaatagcccggaccctctcatgggatgattcttgtgcagaggtggcaagtccatacccattaaggccctcatcggcatccttagacactaagcaagactggcttgtctttgtcaagaaacttctatcagctgctggaattgatgatcaagtgcagcccggctcgttttactcgagatggcattcccttgaaagcccattggatccatcattgagggacaaatacgccaatctcaatgacaaggagcctcagcagcaactccacgaggccaagcgaaggcagaggaggtccaatcagaagcttgtattcgattgtgtgaatgtctcactaatagaaattactggttatggatcagagaagaattacttgatgggtagtaggttgtgcagtgggagccacagcagggtccaagtcccagaagctgcatctcccccattggtggacctcattgtggcacagatgaaggagttaatatctagtgctatgagttctgtttgggtggtggattgtggggacagtaacagcctggtggtagagagtgttgtcagaaaagaggttgtgggcaaagggtgggttgagcttatgagattggagatggatattttggtgaaggaagtagaggggaagctgctagaagaacttgtggaggatgcggtggttgatttgacaggcagggcctga

SEQ ID NO: 80501 - DNA, 4212 bp, Glycine max
  Peptide Sequence Number=SeqID_172186
atgggatgcatgcgcttgagaatgacgtgggagcgcgtgttgagatgcgttgaaagagacaacccagatttgggtattgtctgggataggtgcgacagcggtggctggtggcaaacgacggcactggtgacaatggccggcgatagacagagatggaagtgcagagcaggattgtcccactttgataccaacctgaaatggttgggacgcgttgaaagagatgacctagatctgggtatcgtcggggataggtgcgatggcggtggctggcggcagacgacgacactggtgacaatggccggcaatagacagagatggaagtgcagagcaggatcatccaactcagataccaacctgaaatgtctgagtgtgaaaatatgcacacaaaaaggatcctcagcctggccagtggatggatggtcctttgcttgggcacataaaagctggagagtcagagaggagtttacacgaactgtcgcagctgcaattaatctatttgcagctactgagcttccacttcaacgagctatcctcccccctgttttgcatttgcttaatgatccaaatcctgctgttagggaagcagctattttgtgcattgaggagatgtatacacaagctggacctcaatttcgtgacgaacttcaccgccacaatcttccttcatctttggtgaaagatattaatgccaggctcgagggaattcaaccaaaagttcgctcttcggatggtccaggtggatatattactggggaaattaaacatgcaagtgttaatcccaagaaaagtagtccaaaggctaaaagttcctcaagggagaactctctttttggaggagaaggtgacatcactgagaaacccgtagaccctgtcaaggtatattcagataaggagttaatcagggaatttgagaagattgcatctacccttgtgcctgaaaaagactggtcaattcgaactgctgctctgcagagagttgaaggtcttgttcttggaggtgctgtggattatccatgttttcgtgggctcctgaagcaacttgttggacctttaagcacacaattgtcagaccgaagatctaccattgtgaagcaggcttgccatctattgtgctttttgtcaaaggaactcttgggtgattttgaggcatgtgctgaaatgtttataccagtccttttcaagctggttgtgattactgtgcttgtaattgcagagtctgcagataactgcattaaaacgatgctgcgcaactgcaaagttgctcgtgtgcttccccgtatagccgattgtgcaaaaaatgatcgcaatgcagtacttcgtgcaaggtgttgtgaatatgcttatttggtcctagaacattggcctgatgcacctgaaatacatcgatcagctgatttatatgaggatctgataaagtgttgtgtttcagacgcaatgagtgaggtacggtctactgcaaggatgtgctacagaatgtttgcaaaaacttggccagagcgttctcgtcgcctattttcatcctttgaccctgcgattcaacgggatggaggaatacatcgacgacatgcttcaccttccattcgagatagaggtgcaccgacgtcattatctagccaggcctctgctccctctaatctacctggttatggaacttctgctattgttgctatggataaaagttcaagtatatcatcagggacatctatctcatctggcatacttctttcacaagctaagtcacttggtaagggtacagaacgtagtttggaaagcatgttacatgcaagcaaacagaaggtttctgctattgaaagcatgcttagaggcttggatttgtctgataagcataattcatcttctctccggtcaacaagtttggatctaggagttgaccctccatcatctcgtgatccacctttccctgcagctgtccccgcatctaatcatctgacaagctctttaacaacagaatcaactacttccggcatcaataaaggtagtaaccgaaatggtggtctcggtttgtctgacataatcactcagattcaagcttcgaaagattctgccaagttatcctatcgtagtaatgttggtattgagcctttatcatcatattcgagtaaaagggcatctgaaagacaagaaagaagttctctcgatgataaccatgatatgagggagactaggcgatatatgaaccccaacactgatagacagtatttggatgccccttatagagatggaaactttagggaatctcataatagttatgtgcctaatttccagagaccactattgagaaagaatgtggctggacgcatgtctgctggcaggaggagttttgatgataatcagctatctcttggagagatgtcgaattttgcagatggaccagcatctcttcatgaagctttgagtgaaggacttagttcaggttccgattggtctgctagggttgctgcctttaattatcttcattctttgttgcagcaaggtccgaagggaactctagaagttgttcagaattttgagaaggtaatgaagttgtttttccagcacttggatgatccccatcataaagttgcacaggctgctctttcaacacttgcagatattgttccagcatgccgaaagccttttgagggttatatggaaagaatattaccccatgtgttttctcggttaattgaccctaaagaacttgtcaggcagccgtgttcaacaactctggaagtggtcagcaaaacttacagtatagattctctcttacctgcattattacgctcactagatgaacaaaggtctccaaaggctaaattggctgttattgaatttgctatcaattcctttaacaaacatgctatgaacccagaaggtgctgctaatattggcatcctaaaattatggcttgctaagttaacccctttggttcatgacaaaaatacaaagcttaaagaagcagctattacatgcattatatcagtgtactctcactttgattcaactgctgttcttaatttcattctgagtttgtcagttgaagaacaaaattccttgagacgagcattgaaacaatacacccctcgcattgaagtagacctaataaactatctgcagaacaagaaagagaaacaacgttctaagtcttcctatgatccatctgatgttgtgggaacatcctctgaagatggatatgttggttactctaggaaagctcattaccttggtaggtattctgctggttcacttgatagtgatggtggcaggaaatggagttcccaagattcaacactgataaaagccagtcttggtcaagcatcttctggtgaaactcgggaacatctgtatcataattttgagactgatcctaatagtggcagccttggttcaaaaactaaggatcttgcttatgccgtcaatccaatgggtcaaaactttggctctcaaactagccaacatggacacatggacagtagcgtgagcttagagggtctttcaactcctcgtctagatgtaaacggtttgatgtcatcagagcatttaaatggtgctgaaggctatgcaaatgacaaagagcatccttctgaattggaacttaatcatcactcagctgaagatatatgcagtgggggtgatggaagccctatttcaagtaaacggactgctcttcaacaattggttgaagcttctataacaaatgatcattctgtttggaccaagtacttcaatcagattttgacagttgtgcttgaggtgctggatgattcagattcctcagtcaaagagcttgctctttcactgatagttgaaatgcttaaaaaccagaaaggtgccatggagaactctgttgagattgtaattgagaagctgcttcatgttacaaaagatatcattcctaaggtctcgaatgaagcagagcactgcctgaccattgttctatctcagtatgatccattcagatgtttaagtgaagaactaatggctcagttaccctcgtttctgcctgcccttttcgaagcttttggtaaccagagtgcagatgttcggaagaccgttgttttctgtctcgtggatatttatatcatgcttgggagagcattcttgccatatttgcaagggcttaacagcacacagttgaagttggtcaccatttatgcaaatcgaatctcacaagccaggacaggcaaagcgattgatgccgttcaagactag

SEQ ID NO: 80502 - DNA, 382 bp, Glycine max
  Peptide Sequence Number=SeqID_172187
atgactagaggcaatccatctgacttacaaccctttgatcctgagatagataggacatttcatagattagttaggcatcattttataccttttgatcattctgagcattccataactggtgaatctgtgcattctgttattggtgattttgaacatcctgatcttgagcattataattttgagcattctgattctgagcattctgattttgcacattctgagaacatggcacaacctccacctcgtgagaggactctaagggaaatggctgcacctgatttcacctacgaaagcttgtgcatccaataccctgatgaggatgtcccatatgttcttaaaactggactaattcatttgcttccaaagtttcatggccttgcag

SEQ ID NO: 80503 - DNA, 534 bp, Glycine max
  Peptide Sequence Number=SeqID_172188
atggcttccagaaagagaaaaagtattggtacaaggcccacaactcaatatgatacaaggagattccactcctttgaggcctggacccgatacacagataatgttctaggaagacatatactgcctgagaggaaggtagaaatataccatattgagttggacgagtttaaggctgaattagagaggcataacttccataaacgcctcagcaatttagttgatagcagcatagatctagctttggtgaaggagttttatgccaacctttatagctctgaagggccttcaccaaagcaagttagggtcagaggccacttggtgaatattgatgcaaacagcctcaacacctttctggagacacccatggtactagctgagggtgaaaccttacccgcatattccagatactgcaggttgcccactgatattagagaaattgaggctgccttatgtatcccaggtcggaggtttgttttgaatgctgaaggccaccctgggaagattctcaggaaagatttaacaactcttgcttag

SEQ ID NO: 80504 - DNA, 342 bp, Glycine max
  Peptide Sequence Number=SeqID_172189
atggttatccgcacatttcgccagctaggggcaagcgagcccgttgacacacagagaccaaatgtggtcatctgcacccttcccggagatgtcagcatcttccggtcaagaccgcgaaaaagtctcaattctgctatcgtgacccgagggcctagtagcacgcatacacaccttatggttatccgcacctttcgtcatccagcgacgacaagtccgatgacgcgcgaagacaacatatggtcacccggacccttcctatccgaagactatcgaagtcccttttatcatccagagatgaacaagttcgatgatatcgagatgatgatggtcgtccacttctaa

SEQ ID NO: 80505 - DNA, 1047 bp, Glycine max
  Peptide Sequence Number=SeqID_172190
cgccagcgaaccgcggttggcggcggaatcgccgacgatcgccagcatctggcgccagggcccttgttcgcagcgggcgataagcttgctcagcagcgccttgccgacgcctttgccctgttgcccttcggcgatatacaccgagtcttccacggtaaagcgataggccggccgggggcgatacggcgtggcgtagcagtagcccacaatatggccttcgcttttcgccaccagccagggcagcccggcttcttgcaccttgctcagccgcagctgcatttccgccaggggcggcggctgttcttcaaacgaggcggcaccgtacagcacgtggtgggtgtaaatgcgcagcacggcggccatatcgtccggcgtggcgtcaaggaggctgagtacgggagcggagagcgtcatggtaatgcctgtttaccttggaaatcagcggataaacgccattatgcgcgccgctcgccgccggggggctctttggggagagcccctgtggcgcagtgcctggaattaccagcctttcaccgcgccgccgttgaagattttctcggcggctttggcgacttcgtccgactcataggccttgatgaagttctgcacgttcggcgcgtccttgttgtcttcgcgggtgacgatgatgttggtgtacggcgagtccttatcctcgatgaagatgccgtctttggttggcgacaggccggtctggttgatgtaggtggtgctgatgacggcgacggtgacctttggatcgtccagcacgtgcggcagctgcgcgccttccagctccatgatttggtaacggtgcgggttggcgctgatgtccagagctgtgggcaacaaccccttgccttgtttcagcgtaatcaatccggttttttccagcagcagcagggcgcgccccaggttggtcggatcgagcgggatggcgatcaccgcgccgtccggcagctctttgagcgattttatctttttggagtagccggccatcgggaagacaaaggtattgccgaccgccaccagcttatagccgtgatcttt

SEQ ID NO: 80506 - DNA, 606 bp, Glycine max
  Peptide Sequence Number=SeqID_172191
aatatcattgaggtaccctctgtttatcataaacaatggactccagattacccggattatgtggtgttggactacaatggaaagaagcaccatataagagttagaaaatttagtaaccgagtctacattgttgatggtctcaaacacttcaggagggatatgggaatatatgaaggtgtgatgatcacatttgctgcgccggacaagaattggaagtttgatatccacttctcaccgccactgcatgcacagacatgtggcaggcctgtccattctgccagagaatatgtgtttactgtggatgtcgacaatcggatgattgttagactttatccattggtactgccactcgatgttgtgggttatgttaatgcaggagacggctatgttactgtccttggtgtttgtgggcattgtcacttttggaagttgagtatgcataatgggcttaaatgttttgctgacccatggttccaattcttaacagaaaacgatttgatggccggtgacgaagttgtcttttatttcaggccaaatcaacttctttgggaggttattgccagaaagcaaactgtgtgggacgaggacgaggacgactccccatga

SEQ ID NO: 80507 - DNA, 257 bp, Glycine max
  Peptide Sequence Number=SeqID_172192
atgtcattgcctagcgctgttcatgtgttctcccttatcaggtgcgaagcttctggtgactgggaagcacgttattctgttgttttccagatcggtttcttcgccaaaagaaaaaaagaagaagtagagatgagagtcgtcatcgcgaaaagggcaggatggacaaaatcagtgtcctatctttgctttcctcttatctccgatgagaggcttgtgcaatccgtgaaattccgtaatgtggcggaagtcgaaaagag

SEQ ID NO: 80508 - DNA, 435 bp, Glycine max
  Peptide Sequence Number=SeqID_172193
atgcccaacaccatccgagcttttcggcccacaccggaaacccctccaattcggcacccgtccagtaaaggacaattgcccctccacaaagagcccctactcaagccctgggagaaaccctccagtaaagaagcttctggagtttgccccaattccgatgtcatacggggacttattgccatccttcatcgccaaccaattggtggtggtaaccccccgaagaatctaccagtctcttttcctgagatggtacaaccccgacgcgacctgcacgtatcacggaggatggctaacattccaagaagatggcccaaatgtgaagacaaatcggctcgccaatcatgggggaccgacggtaaatgcaatagaggtgtgcagactgcaaagacccaagcaaatgaaggacgcggtaacctcaagaaggtttatctttga

SEQ ID NO: 80509 - DNA, 360 bp, Glycine max
  Peptide Sequence Number=SeqID_172194
atgcacgtgctcagcgcatcatcagctcgctcagcgaggcatttctcaccttccaggcttagcacgagtttggtgttgcgcgaaaatttacttactcgtgctaagcgcaagaatggcgctaagcacgacgtcgagtactttattattacatgcttgtggcttgatcacccatatgtgtgtactgttaggggctttagcattgaaagatgtattgtctccttagaacttgatagagcaggatttggttaccgtatgtctggacatggagtgcgggcattggatagaagactccaagaagattgggccaaagatgcaagagaaggccctagggttctcatgagccttagggtagatttctga

SEQ ID NO: 80510 - DNA, 622 bp, Glycine max
  Peptide Sequence Number=SeqID_172195
aagagggctacacgccctcgccttccgaggactacatcttctctcctttagaggactacacgtcctcaccttcaaagggttgtacgccctcaccttcgtagggctacacgccctcaccttcagagggttgcacgccctcgccttcagagggctacacgtcctcgtcgtcagagggctacacgcccttgccttcagaggactacatgtcctcacctttataggactacacgtccttgcgtttagaggactacacctcctcaccttcagagggttgcacgccctcgcctttagaggactacacatcctcacctttagagggctgcacgcatttgccttcatagggctacacgccctcacctttagaggactacatttcatctccttcagagggctacacgccctcgccttgagagggctacgcatcctcaccttcagatggctgcacgcccacgccttcagagggctgcatggcctcaccttcaaagggcgacacatcctcaacttcagagggttgcacaccctcttctttagagggctatgcgtcctgatttttagtgggctctacatctgcaccttaagagaatttaaggtaagtatgcacgtggctcaacagatttcttga

SEQ ID NO: 80511 - DNA, 660 bp, Glycine max
  Peptide Sequence Number=SeqID_172196
atgggtcaacttcaacggcaagccttccgcaaagcctatggtaaggtttgggacctagctagggtagaagtctccatggaaccgattgcatccctttcccagtattatgaccagcccctaaggtgcttcacatttgaggacttccagctagtgccgactatgaaagaatttgaagaaatcctgggatgcccactgggaggaaggaagccatatcttttctctgggttctatccctccacgacaagagttgccaagtaccaaggaagtgtttggaggaaagggcaaaggccttggcaaatcaaggcgaatgggctttcttttattgacatcttggcgcttttgatctttggagttgtcctctttccgaatatggaagggttagtggacctagcagcgattgacgctttcctcgcctttcatcatggcaaggaaagcccggtcgtcgccattttggccatgtatgacacgttcgaccggggatacccgtctatccgctacaaggtcaccgctcgtgcgtcgaaaagggaaagggagtcaagaacttccccgattgctagccaaggccaaagcagtggcggacacctactccgcccccgaggagatccacggacttctcagctattgtcagcatatgatagacttaatggaccatatgattag

SEQ ID NO: 80512 - DNA, 267 bp, Glycine max
  Peptide Sequence Number=SeqID_172197
atgtcgagcgtctcgttatattacgggactcaatcagacatccgagtaaaaagttattgtcgttggaattggctgagagcttcaacattcaattttgagcgtctcgatctcagaggtgcagaattcaatatcgagcgtctcaatagattacgggactcattcagacatccgagtaaaaagttattgtcgtttgaattagctcagagtttcagaattcaatttcgagcgtctcgatatattacgggactcaatcagacatctgagtaa

SEQ ID NO: 80513 - DNA, 316 bp, Glycine max
  Peptide Sequence Number=SeqID_172198
gagacttcttggttatgggaagctaaaatcctctgttggatcttccctgtagggtcattcaacagtggaaattggtctgattctgatgaccttgataggacagggctaagttgttgtactatcacgaggaatcgggtgcacttgccggaagcgaacacctgcgctcttgagttgatctccaagtttgttcaatcagaaattgttggttctccacgtttgacaacaatagatgcctcagagccctacactagggcaatgagaggcaccatgcatgagcctcaagtgaacctaggggcagataagaagttctcaccag

SEQ ID NO: 80514 - DNA, 334 bp, Glycine max
  Peptide Sequence Number=SeqID_172199
ttgcttcctgcacctctgtctctctgtcattccacgacccttgcaaaaacaccttgtcctcaaggtgttgggattcaatgcatggcttccaaaagtgatgccgagatcccaagtcccataaagaggaacaatgttgaagaacttgttgaaggaaatggtggacatggaggcgcagttggcatgggaagcagaggcggcatggacggcggaggtggcataggtagtggagtcagcatgggtgacgaagtcggcatgggcggcggcggcgacattggcaacgaagtcagcatgagccgcgaagttgacatgagcatagttgatatgatgtgtgaat

SEQ ID NO: 80515 - DNA, 555 bp, Glycine max
  Peptide Sequence Number=SeqID_172200
atggcagaatcgtcaaagaagcgaaagggatcatcctccaccaccgctgctgctagccatcgccgccacggaccatctgaagcaccgaaaacaccaattcatccttccttatcatctccacgatcatcaactctattttcttcagatgatcaactgtttaaaaactatggattggttgaatttatgtccttaaaattgccttactatcctgaacttgttaaagtgttctatagcaatttaaaaattcaagatgatattatttcttctgaggtgcatgatatatctatgatcattgatcaatctctgttcttttcattaactaaactacccagtcaaggtgcaccttttgagggcaccattgtcgatgactggaaattcgattattctagtcatgatgctcgccgtatggtttgtaatgaccaagctgaaatgaccggtagattgctggtcggatcattaacctttgattgtcgcatcatgcactatattatcgctagaattttgcttccccgttcttctaatttggctcaagcctttgaggaggggatcctctag

SEQ ID NO: 80516 - DNA, 627 bp, Glycine max
  Peptide Sequence Number=SeqID_172201
atggttcagagtaccctcacctttagagggctacacacctccaccttcaaagggctacacgccctcgccttcagagagctacgcgccctcacctttagaggactacacgtcgtcgccttcagagggctacacgccctcgccttcagaggactacacgtcctcaccatcagagggttgcacgtcctcgccatcagagggccacacgccctcgccttcaaaggactacacgtactcaacttcagaggacaacacgttctccccttcaaaggactacacgtccttatttgtcggagggctacacgtcctcaccttcagagggctacacgccctcgccttcatagggctacacgccctcaccttcagaggactacatttcctcaccttcagaggactacacgtcctcaccttcagaggactacacgccctcgctttcagaggactacatgtcctcgccttcagaggactacacatcctcaccttgagagggctacacgtcctcaccatcagagggctacacgccctcgccttcagagggctacgcgctttcaccttcagaggactacacgtcctcgccttcagaggactacacgtcctcgccttcaaaggactacacgtccttgcctttag

SEQ ID NO: 80517 - DNA, 86 bp, Glycine max
  Peptide Sequence Number=SeqID_172202
atgggggcaagatacgcggagaaacgcgaggaactggaaccagagaaacggcacggaaaccgaggcaggattttagcgtttcaaag

SEQ ID NO: 80518 - DNA, 756 bp, Glycine max
  Peptide Sequence Number=SeqID_172203
atgccctgtctgacaaaagaactgcgaaatatgggagaagctgcaaagaagatctgccttgcttcactgaaaaatcaatcatgccatgtaggggaaggatcctttagtagccctagtactgatgctaaagggagaaacaaccctgagttggatctcacacttggcatatctaccactcattctgcacaaacaagtgacaaccataaccatacttctgatcaagttgagaagaatctcatcaagggtagccctacaactcctggtgccggtgtcaatttcaacattaaccaagtttatgaaagacaattaagtataccaggcttggaactcaagttagccaccgaaaaggaggatataaaaaagctaaaccggatcatgtcaaatcgagcttcttcagagaaatatagaacgaagaggacgctctacatggagcagttggaaaagctaacaagagctctctcgctacaaacctccaacactcgtcaacaatttgaagagactaaaaatttgcaacaaacattgctggttgagcaacatcaattgaaattacaaatagcagcttttgaaaaggacaagatagctaaagaagagagctcaaacttgttctacttctcagatgaaatcagaaagaacattgcagaagtgaataggctgagagaactccaaattaatcaattgcaagctaatcaacatgcaatgcctaattcggatggtggttcgaatgcaattgatgcacaactcgatctcaacctctag

SEQ ID NO: 80519 - DNA, 573 bp, Glycine max
  Peptide Sequence Number=SeqID_172204
atgtatggattcctcgagccacagtccattcagagatctggacaattgcaatttgaatcagaaagttacatgaagagttggatgcagaattcaaaacgcgatgtctaccttggagcctacctgaatggcgcatactggcaaatggtcgtcattttgcctaaggaaaatgtagttgtctggttttgttccttgcataacaagctatacaactaccttaaaggaataattaacaggccaacgttgtttttcaatacatttgcattagcattactcaacaacatcaatattttaatgttccttgtattcaataatgctttgaaaggacttgatgatactccacaacctaaatccaaggttggtgctaggtggattgttgttaagagtaatagacaaaaaggaaacactgagtgtggctattacatgatgcactggaagtccactataatcttaggaagtttcaggaataattggaaaacgtattttaatgatgttagaccattggaagtagagagattgaaggcgcttcgcatccagtgggcacagtattatctcaaagttagaaataaaacttaa

SEQ ID NO: 80520 - DNA, 178 bp, Glycine max
  Peptide Sequence Number=SeqID_172205
aatttggcttagtgcgaggttgttgtcgcttagcgggatctgcagatcagaaaacctgcaacttccgctaagccaagctctaatccgcttagctgaaattatgcattttaagtgtagaggagctagcgctgagcggttaaaagcatcgcttaacacgcatactgccgcaagcgattga

SEQ ID NO: 80521 - DNA, 278 bp, Glycine max
  Peptide Sequence Number=SeqID_172206
ggtacatcctttgtggtacaagtagagggtacatctacttgggtttgactgagaacaagagagggtacatctcttgtggatcagttctagtggagggtacatccactaggttgttcaaagagaacaagggagggtacatcccttgtggatctttgcttgtaaagaaattttacaaggttgaaaagaaatctcaaggatcgcaggtcgcttggggactggatgtaggcatgggttgtttccgaaccagtataaaacttgggggagttgttagttggtga

SEQ ID NO: 80522 - DNA, 231 bp, Glycine max
  Peptide Sequence Number=SeqID_172207
atggcagcggaatggagaaggaagagagagaggagatgccacttcaaggagaagatgagtctagaagaagctcaccaccataggacgccatggataagagcttggtggaagaaggagatgaatgaagggagagggagagaagagcacgaaattttgtgctctaaaagagctttgaaatctgaaaccactaatacaagatcaattccaagattctccactaagtgtgcttaa

SEQ ID NO: 80523 - DNA, 246 bp, Glycine max
  Peptide Sequence Number=SeqID_172208
atgtcacttcgtggtagaacaaggtatagttttagggcatatcatttccagtatgggcatagaggtagaccgtgcaaagatagctgttatttcacaattgccttacccctcttgagtgcgagaggcgctttatcaaggattttaccaaagtggcccttccactatccaatctgctgcaaaaggaggaggagtttgattttgatgatcgatgcaaagaggcttttgattgcctcaagcgtgcgttga

SEQ ID NO: 80524 - DNA, 1511 bp, Glycine max
  Peptide Sequence Number=SeqID_172209
acccttgtgatgaaaggtggtacgtggttctacacgggaaaacaattggtgttaatgtagaagatgatgattcatacattggtacttatgttagtcctttgtccacacaaatgactcctaacatcgtcgaaaaagaagaagttgacgacgttcatgctaatcatagactggtggtccatgtcgatcttgcgatcgggaaggccgacgatatgggaggatatttagttaaatttgatatccctgaagcatctaacgccgacaaggatagtgtggatgacactgtttgtgaaaaatacggcattagcaaggagaaatgggcccagttttgtcaaacccacagagacccctcatgggaggatgtgcggaaaaaggcacaggccatccagaaacaaaacaccttcccccattccggaagcactgaggtggtgattgaccctctatctcccatcagacgacacgtgaagtggaagatggcccgcaccaagaaaactgggcagatgatgtctgaggcatcaaaggaaattgcaaagaagattgattctttggaagagcaggtgtcacagggttcctttgtcccctatggatctggtgtgaccataaagcaatactttggatcggctccacgaacctcccacacttcttcctccatggctcctgaagaactagagcaactgactcaacaaatcagggaccagttggaggagtcgatcacacaaaaaggacttgcactgcctccggagcctgaggttggtccctcagctactcatgtcagcataaaggggttttgtgttgatccctcagcgaccgatctagacatgagtgacttagacaaatgcgggttgtacatcgaagaaaatccttcctgcccggttgccctaggaagagtttatgagggatccacagtcgttcataacatccctttgttgcatggccaagtgaaggttagtgttgaggaggttaaaaatgcaaatgctctcattcttgtacccaccgacgaggttattttagtggggcaggcacttaacaccttccttgcttggccgacacatctcgtcaagcgtttatcagaattggtagctatgtctccagcaaaacctgcagataggccggatcctgaggttatgtgggatgcttccttgttcgggctgtttaattcagacttccccttgtacataaagcatgaagatctgtctgaaatagcacatggtggtcaatgtcttagcatctctgttatacaattgtggatttttgctttgaaaggacttgatgatactccacgacctaaatccaaggctggtgctaggtggattgttgttaagtgtaatagacaaaaaggaaacactgagtgtggctattacatgatgcactggaagtccactataatcttaggaagtttcaagaataattggaaaacgtattttaatgatgttagaccattggaagcagagagattgaaggcgcttcgcatccagtgggcacagtattatctcaaagttagaaatgaaacttaa

SEQ ID NO: 80525 - DNA, 276 bp, Glycine max
  Peptide Sequence Number=SeqID_172210
atggggaaagggaagctggagttaggttttgaagaccagaaaattgattttgacttgtttgttgaagacaagcctactccagaacacaatgtttgcttgcaggtaatgggagaaggtcaagaggttctgaaggtgagaaccaaaactcctttcaccaagcgcctgcttctcgctaagcgcataatcgttcatgcactaagccacgagattcaagcgcttggcgcacaaccctggcatctgaggctgactaattccactaagctagccaaggtttag

SEQ ID NO: 80526 - DNA, 1170 bp, Glycine max
  Peptide Sequence Number=SeqID_172211
gaacgagaaacagggaaaccgattatcaccgggaggcacaagggtgacttctatgttctctcccctatgccagaatcatatttttctaatcgtttcaaattcggatcagcaaacatttggcatcaacatctaggacatcctcaaataaaggaattaagggagtcaattgaactacctctgatgaatcctgagctctttcttcaatttggaattaaacctccaaagggtgttctcctttacgggcctcctggtactggtaaaacattgttagccgggctattgccagttgtttccagtgccataattgacaagtacattggagaaagtgccaggttaatcagagagatgtttggttatgcacgtgatcaccagtcgtgcatcatttttatggatgagattgatgccattggaggtctccgtttctgtgagggaacaagtgcagatcgtgagattcagagaatgctaatggagctgcttaatcaacttgatggatttgatcaacttggaaagttgtgcggtagagaaattcactctattgattatcctttggcaagtatttataccttatggagtttaggtttgagagtagggtggagttgggagaaaggggttgagaggtggagggaggatgctaaagccattgtgatgatatgtggaggagaagaacaacaacaactatttttcaatgattacaataatgtctacaaggcaaccatttttcctcacaatgttgggctaggagttactaggcaaaccttggtttttcaaatgctaatgctgttatatgcagttgaatatttcaatatgctaacattggatttatcactagacccctcaattaattatccttcattcaatatgctagcattggagagaattgaaaaggagaaagaagaagccttcaagatacatgagcaaaagatattgcaactccaatctgactatgaaaaggaggttgaaaagttaattaggcaaattagcaaaagtgttgttttcaccttcttgctaagccaatctgttgacttcgcgagtgtcgcaacgtgcccttttgcgggcgagcgaggcgaggctcacgggtgcgctttccaaaggagaaaaaatgcgcggagtcgccaccaacgtttatttgtggaaaacgtcggaaaaatcgaaggaaaccggtcaaaatga

SEQ ID NO: 80527 - DNA, 1008 bp, Glycine max
  Peptide Sequence Number=SeqID_172212
atgggggattcacaagaaaataacaaaggaaagagtagagacaaagataattatgtatcttggactatggaggataccaatgagttgttgcacctcttggtggatgctatgaataggggattgcgtgatgccaatgggtcacttagcaaacaaaatgtagaacgaataatacttcctcaactcaatgcaaaaactaaattccctaaaacttatagtcattatttgagtcggatgaagtggtttcgaaaccagtataacatgatgtcaacccttatgcgcaacaactctggctttggatgggacccaattggaaaaactttcactgctcatgaggatgtatggaaagattacttaaagtcccacccaagtcacagcaaacttcgaggaaaaagtatggttgattatgagtatttgaagatcgttgttgggggtggagtttctagcgggaataattctatatcagtcgatccagatgatattgatgcaacaacttttgagccagaaaatagaactgttgggatagaagaattttcatatgatcctaatagtgatacattcataacaccaaataactatgaaccagcatatcagcctccatcaccaaaccaaccaagtccaccatcccacccccctttagattcagaggttcccatagaaaaacaaaactgtcacaagcgaaggagatccgagtatggagggagttcaagcgctgttgggatcaacaatcaagacaacgttctggaaaatctttctgttggcattgggactattgctgtgaattttgaaaaaatatccaacatgatggagaaaagagaaaaagatagagatagagatagagagctcgagggtattatttgggatgttataaaagaaattccaaatttggatgacataacgcgtttcaagacagctgaattgttaaatactaaagcaaaaaaggattttttcttgaagatgtcaccggaagaacgctcatcttggataaactttaagttagggaataattaa

SEQ ID NO: 80528 - DNA, 524 bp, Glycine max
  Peptide Sequence Number=SeqID_172213
atgactaggggcaatccaggtgatttacaaccctttgatcctgaaatagatagaacctttcatagagtagttaggcatagtgtgcatcctgatcattctgtgcattttgagcattttaagcatttcgagcattctgtgtattctgagcattatgttgctggtgattctaaacattttgattttgagcatttggctgctaatttttatactgagaacatggctcaacctccacctcgtgagaggactcttagggagatggttgcacctgacttcacttatgaaagcttgtccattcaatatcctgatgaggatgttccatatgttctcaagactggactaatacatttgttgcccaagtttcatggtcttgcaggtgaagatcctcataagcatcttaaggaattccatattgtctgttccaccatgaagccccctgatgtccaagaagatcatatctttctaaaggcttttcctcattctctagagggagtggcgaaagattggttgtactaccttgctcccag

SEQ ID NO: 80529 - DNA, 1092 bp, Glycine max
  Peptide Sequence Number=SeqID_172214
atggttgcctctaaaccccccttgatccccattttgtcatttcaaagtttgcaaaagactttctatagggatgctcctggaactagtaactctactcctcaaaatgaaaataacaggttagagaatcctgcagatataaatccagctcttgttgcttccgagtctactccaaaactaatagtggatcaaactcaggcaaaaagccctgatgccgatcttaaaaaattacggagaatggagtctaatcggctttcatcccgaagatcgtggatgaagaagttgatatatttgaccaatttggaaaatcaagatcaattagctcaacttcgaccacaaattgcttcccatgaatcccagaaacaattcttaatgctagaaaaacagacactgctccagagaatggaaattcttgagaaagagataaacttcagagagtctgatcttgagatgaaaaaagaacaagtgaaatatctgagggaatcctatccgatgaatcaagctaagcaattgcaagaacaatttcttaattggaatattggtctgcaggatccaatgtccaatgatccaatcccaaattactatacaaactcggatcaaggaaattatgaactagagacttcatacatgctgcctgcagacctaagccagatgtggatgcctaatgttcctaatatgaatgaagtgaacttgagtcttcccaacaacatgggatcaatggtttcaaatgtgtatgaaaccaacttgagtcatcccaactacatgggatcaatggtttcaaatgtgtatgaaaccaacttgagtcatcccaactacataggaccaatgactccaaacatggatggaatgaacttgaatcttcctaactacacaggatcaatggctccttcagatatgaatgcaatgcaatttagtcttcccaacaacatgggacaaatggttccaatcatggatgaaacaaacttgaatcttcccaatttcatgggatcaatggctccagaaatgaatgaaatgaactttagtcttcccagcaacataggatcaatggcaccaaatcctccaagtggaactttcccaaatccgaaccttgattag

SEQ ID NO: 80530 - DNA, 501 bp, Glycine max
  Peptide Sequence Number=SeqID_172215
atgtataaacagaatgagaaggactttctcaagcttgtagtgaggcttggctacaacaatttattgcttatacagggagcaaaggatgcaattatcattcaaggggggtcagctatttctgcagcttgtgagtcaggaggagcagctacttcatctgatgatgcatcagaaatgatatcagaggaggagatgggggaactacttcaagctcaggcgaagaaggtggattcaccactggagattgtgggtgtgggctcaggcagagcagcctcgttgggtctcactgtagaagcaagcttcatgatgaatcaagttgattcaagtagttttgaagataacaaagatgatgacaaaaagcccaagagaatgatttcaagattgagtcaacaagattcaagaattaagagaatgatttcaagattgagccaacaagattcaagaatcaagagaagtttgatttcaagattcaagaaaaaaagaattcaagattcaagaaaataa

SEQ ID NO: 80531 - DNA, 297 bp, Glycine max
  Peptide Sequence Number=SeqID_172216
atggaaaagaagatgttacaaatgggcatagaagatcagaagatcagctttgatctatttcgtgaagataaagagccacctgaccggaatatctattttaaggttcatgtgatggaagaaagaagacctgagaagaaggtcttggaagtgggaacattattggatcctggatatcaggatgatgcgtcaagaagcttttcagtatgcttatccgctaagcccagaccttgcgctaagcgcaatctcttcacgcgcgaagccgagcttgctcgcgctaagtgcaaggactctgattga

SEQ ID NO: 80532 - DNA, 498 bp, Glycine max
  Peptide Sequence Number=SeqID_172217
atggctgctagtgaccatgcaattctgcgtgatagagcccacattcctaccaagagaagcctggttgtgtcatatgtggtggagcacatgagttcgactgttgtattccccaagaagaaacacgacatgaagtcaactacatggggaaccagccaagacaaaatttcaatgcagggacaatggaggaatcaccctggaaagcagttcaacaaagaccagggtggtccatctaacaggccacaacaacaagggcctagcctttatgatcgaacaacgaagctggaagagactcttgctcagtttatgcaagtgggacaattggcaaaacaattggcagactgtccgtttagcagctttggagctaatactgagaaaaatccaaataaggaatgtaaagttgtcatgaccaaaagcagattggtgactgcgaatgagagtgagaatggaataggtgcagagaaacaacagttggtgtctgacccagcacttgatcctgtg

SEQ ID NO: 80533 - DNA, 279 bp, Glycine max
  Peptide Sequence Number=SeqID_172218
atggcttcccaaaagagaaaggcacctacctcagcatcccaggcccgctatgaccgctctagattcacatctcaggaggcctgggatcgctactctgatatagtgattggcaggaagatcctggctgagagaaatgtcatgatttaccatacagaatttgatgaattcaagtataaggtgagggtgagaggccacttaattaagtttgatgaagatgccctcaacaccttcctaaaaacaccagtgatcaacgaggagggggaagacctcccagcttaa

SEQ ID NO: 80534 - DNA, 619 bp, Glycine max
  Peptide Sequence Number=SeqID_172219
gatgtcacatcactcatttaagggtaacagtctgaaaacctgggaggaaattgttgaaaagtttctgaagaaatatttcccagagtcaaagattgcagaagggaaagctacaatctctttatttcatcagttccttgatgagtccttgagtgaagcgttggagaggggaaaaataaagctaaagacccttgaaaaggcaactgagctaattgagaatatgtcagccagcgatcatgccattctgcacgacagagttcatcaacccacaaagaaaagcttgttacaggttgtaccatatgtggtgaggctcatgaaacaggccaatgtattcccattgaagaaaacactcaagaaattcactatatgggaaatcaacaaaggcaaggatatactcggggaggattctcaggcttccaaaaagaattccaaggaggaatgcaaagctgtgatgacaaggagtaagaggtttgtggaggcagaggatgaggatagtgtcatgtccaagaagaaagctgctgaaaagaaagacgaactcgctaagcgcgcctatcgcgctatgcgagttcatcttgtgaggatgaacactcatcctcctattaagatacctgtggctaagtga

SEQ ID NO: 80535 - DNA, 90 bp, Glycine max
  Peptide Sequence Number=SeqID_172220
gttttactctcgtcttccggaaacattcaagcccaacaacgtgcgagattcttctctgctgggcagggacggttgagtgcaatggcgtag

SEQ ID NO: 80536 - DNA, 230 bp, Glycine max
  Peptide Sequence Number=SeqID_172221
gccgcagaggagtccttagaaatgtcctttcaagccttagaagtggtgagcaatgcttatgtggattcttccccggtacaaccacgctcatctggggccacattgatggtagcttgagtaatgttgggaaatggatacgagcccgaaatgggtatgggccggaacagcaatggtgtagcaagtttggtggagttcacacggaaccgcagaaggtttggactgggatatga

SEQ ID NO: 80537 - DNA, 177 bp, Glycine max
  Peptide Sequence Number=SeqID_172222
atgaggacatttggaaaacaaagatacttaggattgaagagaggtatgatttttcccgtcatgagggtgtgtttttgccgagacaaggaacaatttggaaaaggaaggaagagttttcagaatttcttggagcaaagtttgcttaaagggaagaattggttgaaacctaagtgctga

SEQ ID NO: 80538 - DNA, 192 bp, Glycine max
  Peptide Sequence Number=SeqID_172223
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggggtgttgctcacaaattttcagctcatttggatatcgtttga

SEQ ID NO: 80539 - DNA, 1227 bp, Glycine max
  Peptide Sequence Number=SeqID_172224
gtcgagcatctcgccgacgcgcttgctgatcgcgtccttgcccaggccatcctgcttcaggccgaaggcaatgttctgctcgaccgtcatgtgcgggaacagggcataggactggaacatcatgttgaccggccgctgggtgatgctgcccttggtgggcgtctcgaagccgcccaggcagcgcagcagggtcgatttgccactgccggagccaccgagcagggcaaagatctcgcccttgcgcacgtccaggttgacgtcgtcgacggcgacgaaaccgtcgaattccttgcgcaggtcacgaatggagagatagccgggcgcaccggtcgtgtcgacgacggcggctaccggctgggcttcaacgggcatgggggctccgggagcgggcggtggacagcggcggccattctaacggccgggggccgaaggggatatgacggaggcaggtggcagcggccgctggccggcctcggggtcccgaggggtgtcggttttcccccgccatggtggcctgtccgctccaaggcctgggctcccctggacgaccctgcggccatcccggccaggcgccacgggcgttggcccgatctgcaacgattttcagaaccggatgtgttgaaggcccgggacattccccgcgcaatgccccggatcaaggccttgcatggacccacactggtgatttccgcggacagcccctcccccttcccgccccgcctgccgggctccctgcctgcaaggctgccactggtcatcatcggcgccggccaggccgggttgtccctcagcgcgctcctgcaggaggccggcgtcgcgcatcgcgtgctggaagccgaaaccgtgggcgccagctggcagcgacgctgggagtcgttccagaccaacaccgccaatgcgacgatggccctgcacggtcatgcctatgccggcgatgacccggaaggcttcatgggcgccccggaggtgatccggcacctccgcgagtatgcccacgagcgttccctgccgatcagcgaggggtgcgtggtccaccgggtcgggcccgagtccggtggctatgccatcgacagcagccaggggccgatccatgcccgcgcagtggtggtcgccaccggtgaataccgtcgcgcgcggatgccccgggtcccattcgcgcccgcaccaggcctcaccgtgctgcactccagcgactaccgcagtcccggcctgctacccgagggcgcg

SEQ ID NO: 80540 - DNA, 492 bp, Glycine max
  Peptide Sequence Number=SeqID_172225
atgccccaagagctggtagcccgcggagacaccttacagttatccgcacctcgtcattcagtaaccccaagtgtgattggtgagcagaggccaatgtggtcatttgcgccctttccggagatgtcagcatcttccggtggagactttttcaagtctcaaaagatacgtaggagcaagagccttgcttttgtcggccaccccacaagatctgtcatactgaccctgaggtcatgtgacatgcggagacaaaatttggtcattccgcacccctttgccattcagacacagtcgtgtccgatggcgcgcagagacaaaatttggtcattctgcaccctttgtcatccagaggcggcgggcccgatgatatgcggagacaaaatttggtcattccgcacccctttgccattcagacacagtcgtgtccgatggcgtgcagagacaaaatttggtcattctgcaccctttgtcatccagaggcggcgggcccgatga

SEQ ID NO: 80541 - DNA, 482 bp, Glycine max
  Peptide Sequence Number=SeqID_172226
gttgaaccatttatggtgaagctcatgaaacaggccaatgcaatcccactgatgataacactcaagaaattcatttcattgggaatcagcagaggtccttataatcagcaagggcagtggaggacccaccctggcaaccagttcaataaagaccaaggtggatccccaaaccggccaattcaacaagggcctaacatttttcagaggacaactaagttggaagagaccttgactcagtttacgcaggtaacgatgtcgaatcataagagtactgagtcagcactaaagaaccttgaattacaggtgggacaactggccaagcagatagctgacaagtcatcaaacagctttggagcaaatatagaaaataatcctaaggaggaatgcaaggctgtgatgaccaggagtaaaaggtttgtggaagctaaggatgaagaaaatgtggtagacaaggaacaactgagtggaagacaggtgttgag

SEQ ID NO: 80542 - DNA, 319 bp, Glycine max
  Peptide Sequence Number=SeqID_172227
gattcacaagcggttctcctcaaatttcagccagcccgcatcaatttaccttgcaccttacgcttcagggtcctacaatgctcaatggaatgccctggggcccctccatgataagcacatgttgcgttcgagtcgtatcctcagaaaaaaggaggctttttcgctgcaaaattcatttcttggttggtgttttggtttgcgcttagcattggatgtgcggccagcaaactttatggatgactgggtggtgggtaatgagaagggccgatattggctgagcaatgacattgttgggctggtgggaagtttggccatgtag

SEQ ID NO: 80543 - DNA, 147 bp, Glycine max
  Peptide Sequence Number=SeqID_172228
atggccttcaggagtcatcatagattaattacggaatgggctaagacggacgaaatcagtaggtacttggcacccatcgttgcacaatacgtgaagttccgtaacatgccggaaatcgaaaggaagcattgttacacaatccgtgag

SEQ ID NO: 80544 - DNA, 279 bp, Glycine max
  Peptide Sequence Number=SeqID_172229
atggcaaaaaatgatatgcaaatgccaccagatacaccggacacgatggaggtccgacgaaaatggaaggtaaaatatgggaagatgttgtttgttctgagaatgacggtcaacaaggaattaattgatcacattagagatcttgacacaccaaaggatgtatgggagacactagaaaaactcttctccaagaaaaatgttgctcgattgcagttgctggaaaatgaacttgcatccacagtgcaagatctgagtgagaaaatcagtgaggcaaggtga

SEQ ID NO: 80545 - DNA, 528 bp, Glycine max
  Peptide Sequence Number=SeqID_172230
atgtacgacattagcaaggagaaatggacccaattttgtcagagccgcagagacccttcatgggaggatgttcgaaaaaaagcacaagccatccaaaaacaaaacactgcccctcacatgatgtctcgttggggttatgaatatttagaaaagaaattgatcgatgagaagagaaagaaaaaactagagaaagctactcaatccgaaagcactgacaccgtcattgatcctccatctcccatcaaacgacacgtgaagtggaagctagcccgtaccaaggaaactggtgacatgacatctgaggcagcaaaagaaattgttgacaagattgatgcgcttgaggagcaggcctcacagggttactttgttacccatggacgtcatgatatactgactgatgccattgggagccggtataaccatcaagcaatactttggatcggctacaaggacctcctccattgctctcaaatacctgcaacagttgacgcaacaaatcaaggaccagctagaggattcgatcactga

SEQ ID NO: 80546 - DNA, 446 bp, Glycine max
  Peptide Sequence Number=SeqID_172231
gtttggattggctcccaaatttgagaaccactaagggggtggaagttgaagctccggaggaggacgatgaggatttgcctaaggtccaagagaagcttgtcgtagcggttatgcgagatcgagaccaacatgttaaccatcgtcagcaagtaccaagaagaattaaatctagccaggcccacaagcacaaagtggcagatgaatatgcccgagtgtacgcggaaaaggaggctagaggaagggtgattgactcgttacatcaagaggcaacgatgtggatggaccgattttctcttactttgaacgggagtcaacaacttccccgattgctggccaaggccaaagcaatggcggatgcctactccgctcccgaggagatccacgaactcctcaactattgtaagcatatgatagacttaatggcccatataattaggaaccactag

SEQ ID NO: 80547 - DNA, 129 bp, Glycine max
  Peptide Sequence Number=SeqID_172232
atggagatgcagcggaagacaaaggagaagagaggatgcttcaatgaaggaaaagaaagaggtagagaaagagagagaggggagcacgaaattgaaggaataaaagaggtagagaagtggaactttgaa

SEQ ID NO: 80548 - DNA, 126 bp, Glycine max
  Peptide Sequence Number=SeqID_172233
atggaagtgtttcactcaaaaatgggtgaagctttggttgcttcaaatccaatggtgctcctaggatggttaacctccaagactaaaaaattttctttcaagcaatgcaccaatttcctcttctaa

SEQ ID NO: 80549 - DNA, 219 bp, Glycine max
  Peptide Sequence Number=SeqID_172234
atggaagaattgtgcctagtgtcagaagtcgtcattcctccgaagttcaaggtgctggatttcgacagatacaaagggactactggccccaagaatcacctaaagatgttttcactgagctgtcctcctctggctgagcgcatgatccgttgggcgcataaaagaacctggaagaagatgacctgtacaggtgcgttgagcgagagtcaaactcgctaa

SEQ ID NO: 80550 - DNA, 330 bp, Glycine max
  Peptide Sequence Number=SeqID_172235
atgtcctcgccttcagaagactgcacgtccttgccttcagaggactacatgtcctcgccttcaaagggttgcacaccttcgcctttagaggactacacgtccttgcttttagagggctccacatctgcaccttcagaggacttaatcccttggtcaccccctgatctcggaggagggccaactttgcgagcacaaccagaggcaggctatcgtgcagccactatgcatactggagcaagatttcaaccgtgccgctacaaagagacgagtgcggatcatgcgcaccaacatgactactcttacacagatatggatgacgttgctacttag

SEQ ID NO: 80551 - DNA, 228 bp, Glycine max
  Peptide Sequence Number=SeqID_172236
atggcttccggggcttcaaggactcccgccttccagagtattttcgtagcaggattgcttctggaggaagcaacccaaacacaccaaaggtcccagtggagtcaccaactatcgcaacctaccctttggcgggagggcgacgtggggctcacgggtgtgtcttccaagggaggaaggcgcgcggagtcgccaccaacgtttatttggggaaaatgtcggaaaaactga

SEQ ID NO: 80552 - DNA, 297 bp, Glycine max
  Peptide Sequence Number=SeqID_172237
atgttgggtgaggaatctgaggatgatgatcagaaaggcttggattctactgagtcaaatgacgaccaagatgaagaggaagaactgatgcagataaaagatgaaacagaaacaaatcttgtcaatcttcgaaaaacaatatactcagcaatttatattatcgaacagctagttcagattcagagccagacttggcatgttctgatgaaagtgacagaagacgaagaaaacggaggagaaagtgtaaagcaatttgatgctattgtcgaaggcgcttgcatccacaaaactgattga

SEQ ID NO: 80553 - DNA, 129 bp, Glycine max
  Peptide Sequence Number=SeqID_172238
atggcgccgctcatggtgcagcttgagcaacaatggcctcctcaaaacgcacgtggtgccgccagaagattgtcggaaaatggtggtgtgggagtgaaatgtgataggggtggtggtggtggatggtga

SEQ ID NO: 80554 - DNA, 828 bp, Glycine max
  Peptide Sequence Number=SeqID_172239
atgaagagttttttgttggggtgtgtggccactgtggagaaaaatagaccctattttgcaatgttgtttattcagtttatgtatgctggaatggccttgttgtccaaggctgcaatttcaaagggaatgagcccttatgtgtttgttgtttatagacaagcctttgcatctgttgctctatctccatttgctttctttgacagcaagcaatcagctcctttgtcatgcagcttgttgtgcaaattgtttctagtttcccttgttgggttaacggcgagttcaaacctttactgtgtttcaatcaactacacctctgcaacatttgctgcagccgccacaaacactgtccctgccattactttcatcatggctgctttaattagggtggaaagcatttccataaaacgtgtgcatggattggccaagattttggggtctgttctaagccttgctggggcaattacatttgctttagtcaaaggaccttccctgggttttatgaaatggtatccagaaaatcaaaaccatagttctcacctattaacaacggttcactccaaagtcgatatagttagaggctctcttatgatgctctcagcaaacactgcatggtccttgtggcttatcttgcagggatttgttgtgaagcagtacccagcaaaatttcgcctcactgctatacaatgcttgtttagcttcatgcagtctactgttgtggctgtagcagtagagaggaataatccttcagcatggaggcttggatgggatattcatcttctttctgtggcttactgtgtacgcgtttataatctaatattgcatgcatag

SEQ ID NO: 80555 - DNA, 126 bp, Glycine max
  Peptide Sequence Number=SeqID_172240
atgagtgatttcttgaaaaatttcataagaagagaaaccagactcaacagccacaaagacaaaaagggaggtgcaaatagaggacaagcccaaaaggaagctcacaaaaccagcatacctaagtga

SEQ ID NO: 80556 - DNA, 4428 bp, Glycine max
  Peptide Sequence Number=SeqID_172241
atgtcaaagaaggatgaaggtgaaggaaccctagaaagatgcacatggaaagccaaaaaggacttaacacaaggaaggatgcaagaaagtgaagaagtcaatgaagcaattgacaaaagaaaaggcaaagagattcaacattttgtggataagggtaatggtgaagaactcatcagcatgaagatagaagctaaacaagacttaacaaaagaggcaatgcaagaaagtgaagacgtcaaagaaacaatgttcaaaagagaaggcaaagagattgactattttttggatgagaatgaaggtgaagaacccagaaggatgcatatgagagcaaagaaggatttaataacagagacagtgcaagatagtgaagatgtcaaagaagaaatggtcaaaaggaatgacaaagagaatgaaaattttgcagaaaatggtgaaggtgaagaacccagaaggatgcatatggaagtaaagaaggacttaaaaaaagagacagtgcataaaagtgaacttgccaaagatataatggtcaaaagaaaagataaagagattgataattttgctgataaaggtgaaggtgaagaacccaaaaggatgtatatcgaagcaaataaggacttagcaaaagagattatgaaaaaaggtgatgtcaaagaattaacagtcaaaagaaaagataaagagtttgataattttgttgataagggtgaaggtgaagaacccaaaaggattcttatggaaacaaagaacttaaaaaaagagacaatgcaagaaagtgaagatgtcaaagaagaaattgccaaaaggaaagacaaagatattgagtattctgtgaataagggaaaaggtgaagaacccaaaaggatgatggatgtggaagcaaagaatgaccttaccatagaagcaatgaaagaagctaaagatgtcacagaagtaatggtcaaaagaaaagacaaagagattaagaattttgtagataaaagtgaaggtaaagaacccaaaagaatgcatatggaagcaaaggagcacttagcaaaagagacaatgcaagaaaataaagatgtcaaagaagcaatgttcaaagaaaaaggcaaagagactgaatattttgttattaagggtgaaggagaagaacccaaaaggatgcatatgaaagcaaagaaggacttaacaacaaatacaatgcaagaaagtgaatatgttaaagaagcaatgggcaaaagaaaatgtgaagaagagattgactatttttttaatgagggtgaaggtgaagaacccaacaggatgcatatggaggcaaaggacataacaacagagataatgcaagaaagtgaagatatcaaagaagcaaccattaaaagaaaaggcaaagagactgaatattttgtgggtcagggtgaaggtaaagaacctaaaaggattcatacggaagcaaaaaaagacttcacaaaaaagacaatgcaagaagttgaatatgatagtgaagcaatggtcaaaagaaaaggaaaagaaattgattattttgtgaataagagcgaaggtgaagaactcaaaaggacgcatatggaagcaaagaaagacatagcaaaagaaacaatgcaagaggaaattgaaaagattaagaatggaattaaggatagtgatcaacaaaatgtactggagaaaactggtaaaggaaaatttgaagtaccaactgaagagttgcccaagctaattgggaggccagatggaagtagaggactcaaggttgcaaatatggaagaacaaaaggagatgatcaaagaagaaatggttgaaaccaaaagttcaatggaaaaagtgaaaggagaaaagtccaacacaacaagcaaggttactgagaaaaacatggcaactgagatcatacagaaggaaactgaggagtccaacattgaaagaatgtctagagatggaccatatgtaccaaacaatatggtcaaagtagtatttgaagtgttggggactttccaggcaaagcttcccaagcaggtgattgaagcaatttcccaaaataaaaaagaaaaaaatgaatatgttattgtgaaattgaaaggagaaggatctataaagatgcatgttgaaccaaatgacgcttttgatgaggatgaaattgaggacataaatcagaaagaaatcggaaagccaaaactcaagtctagtgaccaaataagcgagacagatgatgttgatgttggggtatttgatggaagcaaaagaccaaagtttccaaagatgggggaaacaaaagatgtcaaagaagacagtgcaaaaattgaggagtcagtggagaaagtaaatgaagacaaatatgagaaaatacaagttgaagaaaaagggggtatgagaaaagacacaacaggggagtctactcagacagaaagagaaggttctaagatccaaacaatggaaaaagatcaacattgtttacaagaaacaattagtaaaggaatatttgaagcaagcacggctgcaaaagaagagtttcctgtgataacggtggattcactagctgataaaagaaagggactaaaaggaaaaaagatagatgaagcaaaagttgccaaagaagagttagtcaagcaaacaagtgaggaaaagaaaataattatcaaagaaaagggttctagaattgaacaatttgtgaagaaagtacaaggagagaaatatgaaatgatacaagctgaagcaaaagaaggtttgaggaaagatataactaagggaaaagatcaacaaggtttgcaagaagggacaagtagaggaagatatgaagcaaacacaacaagagaaaaaactttgaagccagaaattcctctagaaaaacaaataaagaaaggagaaccaatcacaagaaaagatgagtttgccaaaggacaaaaattcagggagacaatacaagaggaaattgaagggcataaggataaaattgatgtcagtgatcaacatgtgcaaagagatgtcgtcaaaggagttggaaaagtagacactataggaaaggagatgatcaaaaaagaatatgtagcacatcttggcccagtagctaaaaggatggaaacaaaaaaagacttgaaagcaactcctgaaaaagagaaatacacaatagctcaaaatgttaaagatgaaaagccaaggatatatgaagaaaatataaaagttgatgttgaaaaggtggataagaaaggatatcaaacaaaagttgtagaagaagggatgttaaaaggggaacacaaagcagaagtagttcttgagataaaaacggaaaggccaaaggttgcaaagagagaagaaactaaagaggcttccaaactaccattcaaaagagagatgggaaaaacaattcaaagtgcagaagataggaggcctaaaacaggagaaataacttcagagtttgaaaaggttattgaattcaaacaagctgtagaaaaaatgcatgaaagtcacaacggagaacatcaaagagactcaaaagaagtcacacctaaaaaggaggtgaaacctccaacaataactccagagcaaggagttgaaaagtcaaagaaggaagatgtgtcacctatgcctatggcaatccaaagaaaagaacctcatgaattatcattgccaagcaaggactacgaaattccaaagatagagggagtacaacaagaaaaggaggggaaaagattcactcatgcactagaagcattcacttttaaaaaagaagaaaaagaacttgcgcaaatttcgggtacacattcaaaagcaaaaggtgagattgacgagccacaagtaaatcaactgccatctccatctatagaaatgtggagcaaagagtcgcgtgaattagaaaagaatggtataaaagaggatgactcaaaggctaaaagtttagtgaatatgcaagaaggaaaaaaatctattcattcttcagagggtactacaacatcagaagtagttgcagatgaagcggctaaaccctcaaaattttcaagttcatcttccactcaaccatttgaagttgaaggcaaggataagatagatgctagtagtgacgaagaatctcaagtttccaacagggaccctgaaatagatggtcaagaatcaaccaaaagtgaaacagacgaagaagttgaacaaagagaaacacttcagccagagtcccctgaagatcaacaatgcataaacaaagatcaagaagaaagccatgaaacacatgaaattgaagaaaaggtttatgagcaagtagatgaattcgatcaagaacactctcaactgttagaggagcaaaaagaatgtgaggaggaagccactgaagggaagaagaacggccaaaaaggatcaaagaaactgtttgtttcgattatcatagccggatcaggccttcttgcttctggaatatttctctttattcgacatagaagagccagaaaagggtaa

SEQ ID NO: 80557 - DNA, 693 bp, Glycine max
  Peptide Sequence Number=SeqID_172242
ttgaagctgcggcaatggcacaattggtgtgaagtgaagggtgagcaagctatagctttgaagcttgagattgttcttgagctcaacgtgaattgtgggttgatacttcaactgggtccagttagggttccaaaaagagttactgagaatttgaaattacagattctgggatggtcagtaatgggattgaatatttgtctaacttccatggaatcattagaaggttttgattgcaaacgaaagaaagatcttagtcaaatgagcaatgatgagttggtgacacttgacaacatatcccaagacgagcttgaatcaacttcatctgagaaggaagagaattggagggaaaatttggagcagaaatcatcagaggttaattctacagctggagtaggtttggaccatttcatcctagagcctactggaacagagaggaacctgcttgttgctgaccatgagattatattttctagatcaatgatggagaaatgtgattctccaaggcaagacttaatattggacaggctgtcagagtgtgaaaaggagtatggacattgtgttaggctggcaactcatgctgattttgacacatttgtaaagtctgctggtgtcaatttctatccgttgggtggcgatcctcgagctttggcagaatgtaagaggttcctttttaatactgccattaatatctaa

SEQ ID NO: 80558 - DNA, 141 bp, Glycine max
  Peptide Sequence Number=SeqID_172243
atgactacagggctgaaatatgacaatttgtttgagaataatgccaaaaatgggagtttctacctccagtccaaagttcatcgggccaaggaatgtctagaggcagttcaacaaggcaagagccagggtacccctagttga

SEQ ID NO: 80559 - DNA, 108 bp, Glycine max
  Peptide Sequence Number=SeqID_172244
atggcggcaatggaggatgctagggtttcaatttgggaactgttggagtattctccgcctcaaacacagcaaatgctaaacaatgttagcactgattggttagactaa

SEQ ID NO: 80560 - DNA, 1278 bp, Glycine max
  Peptide Sequence Number=SeqID_172245
atggtaaatggccattctgtgagggtgaaatattgtgacacttgtatgctgtatcgtcctcctcgttgttcgcattgctccatttgcaacaattgtgttgaacgttttgatcaccattgcccttgggtgggccaatgtattgggctgaggaactaccgttacttctttctgtttgtttcttcggcaactattctatgtatctatgtgttttccatctcagctttttacatcaaggttctgatggatcgttatcacgggacagtttgggaggcaatgaaagaatcccctgcatctgttatattaatggcatattgtttcatctctttgtggtttgtcggtggattaactggctttcatttgtaccttattggcacaaatcagactacctatgagaacttccgctacagagccgataacaggatcaatgtttacaaccggggttgtttaaacaatttcctagaagtattttgtacaaaagtgaaaccctcaaggaacaatttccgagcttttgttcaagaggaggtaccgaggccacctcctccggtcatttcccgggaacctgaaccagatctgggtggtggagatcctcgttctaaagttgaagatgatctagatattggtgaagacctgttaaagatatcacagcgtcggaatattgaagaaattgacgaggacatccggagcagagggagcattggacctccccataatacatctgaagttgattcagttttgggttcagatcgccgggccccaacaattcgatccgaagcaaggcactcgagtgagggacgaagtgaaagctgggaaattgcgtccgagatgtggggttacttagatattaaagatggaaaaggaaatggtgctgggcaggacaaggcaaggtgccttgaagttctccaagccgaacctcaaattgttggggctaaagataatgttgagctttgcaagttgatccttgaatttggattaaaaaaggggttagaggcccaaagattcctcaaagatgcaatgatgacaaccccttcaccagccattgtgcaatgtgcaactagcctttatgatggtacgattggatcattcaaaagttcattgagtgaattggctgaggatggccaaacggcaaattatgatgctaaagtggctggtgatggacctacaacttgtgacatagccttaagtaatgcaaagatcgtcaatcctactatttcagctctgaacaaggacatcctgttgattagcaaacttgcatttctagccaccgacaagcttccctag

SEQ ID NO: 80561 - DNA, 408 bp, Glycine max
  Peptide Sequence Number=SeqID_172246
atgttggacagctgctactattcagggttctgggaggcatgggatgggagtgatggggtggtggggcctcttgtaaggaagggtatgccaccatctactagtgatgaaacaatttggttggattcacatggtagtgtagtgggaccctacttgcttagttgtgggcaggggagcaaaacggagtcgttttccactgtatgtcaaacttggtggctcagtgctccgtggaccttgtattttaattcagacaatgaaaagattaccttgatccctctgctttcagatcttatagcagaaattaccctatggattcatgatctgctgtatatgattgaccaaattgataacatttttagttttaaaattgggacaactaccaattgggattgggctgtgcattccttctga

SEQ ID NO: 80562 - DNA, 192 bp, Glycine max
  Peptide Sequence Number=SeqID_172247
atggcgaagaagcgaaagtccatcgccaacagcctcgacgacgtggatcgaaccctatacacgtcgttttgcactgccgccaattccctctcacagctctacacgcactccatgaaccaccagaagctctccttcaatgccggggaacgacatgccctcattggtggcttgcgctgtggtggtattggttaa

SEQ ID NO: 80563 - DNA, 492 bp, Glycine max
  Peptide Sequence Number=SeqID_172248
atggccacaaccacggtcctggacaccccagaaaccttgatgttgcaaccaaaattgcggttgtgtctctacgacaaggacagcgacctcgcctggccgtttcgcgaccttgaaggtctcgaccatgatgacataagggaaactgcctatgaaatcttcttcaccgcgtgccggtcctcgccggggttcggtggccgaagcccgatcacattttattctaagcatgatgggagtggtgaggggaggagtacgccggtgtcccagacaagtagggtgaagcaagcgcttgggctgaggatgctgagaagctccttgtctcagaggataatggtgtcggcaccggcgtcgccggtgactgagcggagtcctcggtctcgggctgtgccacggaggacggtgacgatggcagaagtcatgaggctgcagatgggggtgtcggagcagagtgatagccggctgaggaaaacacttgtgaggacacttgttggccaa

SEQ ID NO: 80564 - DNA, 1479 bp, Glycine max
  Peptide Sequence Number=SeqID_172249
atggggagctatgagtctgattacagtgctgaccctgttgatgatgatgatgattctgaaagtggttcagacaatgaagaattgggaaagttgagcattggggtcaataggatgggcgagttaactgtgaactgtgaaagtggggaagacggtcgcggtttgcaaatgaagatgaagcttcatctgaatcaacaggattctggtgtatatttgcctcctagggtatgtgttgggacgtggaatgttggaggaaagcttccacctgacgatcttgatattgatgattggctcggtgtcaatgaaccagctgacatctatgtcctcggtcttcaagagattgtacccttaaaccctggtaacatatttggtgctgaagatacccgtcctgttccaaaatgggagaatattattcgagaaacactgaatagagtccgacctgaaatgccaaagataaaatcctttagtgaccctccatctccatcaaaatttaagccatcagatgacatccctgatatagaagaagaaatattacttgaaagtgatagtgacattggtgaggaagtccatcctttggatgaagaaaacaatatttgtgatggaacattcatgggtgaaactgtgaatacaaatttattagcttctgatgctgctgatattgcaaactccggcttgccagttaaaactgatttacagaggcagttttcttttccaaagatgtttgataagcaacacagtttttcagaaaacatggtcacgccatttgcccaccaggccactaaactaactcgaatgcttagtgggtctgaaaggatgggtttgagctggccagagcctccactgcatctgctatctcagcgagttttggacagaccaacttcttttaaatcactcaaatcctttaaatcatctaagtcgttcaaaacattcaactctttcaagtcaattatggatgaaatgccggggattgtaggtcttcctgaaattgaccttgaagctttgataaagagaaaaagaagatcaccatatgtaaggattgtgagcaagcaaatggttgggattttcatcaccgtttgggttcgtcggagcttgcgtaaacaaattcagaatttaaaggtttcaactgttggagttggtgttatgggctatattggtaacaagctcatacgggaactcaagaacggtgtgtttggaggatggtcagaaggcgtgttaaactttccaccaacttataagtatgaggttaattcagataagtattatggagaggatcccaaggttggaaagcgctcaccagcatggtgtgatcgtattctttcatatggcaagggaatgagattattgagttacaaaagggcagagctcaaactctccgatcacagacctgtgaccgccacatatatggttgaagttgagatattctctcctaggaagctacagagagccctaactttcactgatgcagagattgaaaatgaacaa

SEQ ID NO: 80565 - DNA, 1407 bp, Glycine max
  Peptide Sequence Number=SeqID_172250
atggacggagcttcatcagtgattccagaatattcggagataggcagcacaagtagttcagagagtcaagctcaggctcagtatttggagacacaattaaccaacatgcttcgaaaagtggatccagaaattacagaactcaatgagaaatgcatttatagagtaccagaaaaatttcgccgtgttaatccaaaagcctatactcctcgggttgtttcaattggcccgtttcacaatccacggtactctaacggaggtgacaatttgaaactaatggaagaacgaaagctgaaatatcttgagaaatttctaaatagaaacaagcacttgagcatgaagggtttatttctcagacttattgagaaggaaaagcagataagaggttattatgcagagcctgtcagttatagcagcgacgatttcttaacgatgattctagttgatgcttgttttataattgagcattttcttagatactatacaggcttaactttaacagaaagagacaccttatcagaaccatgcttgttaagtgatatttatcatgatatgattctgcttgaaaatcaacttccttttttcgttcttgaagacatattcaactctgctcacccgggtatgattgttgaatttccctacaaggatgttaaaggcataaacgacgactacgctggccctattacagatgttgagtctctctcctttattgctattactttccactattttcgaaaatacaaccactatatcatagaacctgcccatattgatcgtccatatcatttcattgatcttctaagaatcttttggcttccaattccaattcctcctgaaagtctaaaatcaggttttatggataaacttataccaagtgcaagccaactatcagaggtaggtctgatattcaaagctagtttaactccaggcttgtttgacataaaatatgatcatcatatgggtgttatggaaattccatgcatacttataaatcacaagacggagacggagttgagaaatatactggcattagagcaatgtcgctacatactttcacccaacatgactcagtacttgttcatcctagattgtcttgtcaacaccgacaaagacgcaagcatactaattgataacaaaatttttatcaattggttgggtgatgccaatgctgtggctaaaatgtttaacagtctttgttcaaatgttggtctgccatttatcagtgaagagtgtttttctctctgtgataacttggttaaattctatgaaaatcctcgcaacaagtacaaggctatcttttatcatgagtacttcaacactccatggaaaaaagcatctacatctgctgcagttctactccttttgctcactctgattcagactatatgttccgtcatctcgtttttttga

SEQ ID NO: 80566 - DNA, 1890 bp, Glycine max
  Peptide Sequence Number=SeqID_172251
atggcggcggcgatggttccagcaggagcattgaacggtatgcaatctgggaatgcctctttgtacgttggtgatcttgaaaggaacgttgacgaggcgcagctgtttcaactgtttgcccgagtgggcccaatattttcaattagagtttgtagggatgagacaaaccgatctcttggatatgcttatgttaactttgtcaacccacaggatgctgctaatgccatggagcatctgaatttcactcctctgaatggaaaatccattcgtgttatgttttctaaccgagatcctagcattcgaaaaagtggatatgcaaatgtgtttatcaagaaccttgacatatcaatagataacaagacattgcatgacacttttgctgcctttggatttgtactctctagtaaggtagccgttgatagcattggtcagtcgaaagggtatggatttgtgcaatttgacaatgaagagtctgcgcaaaatgctatcaaagagttgaatggcatgttgataaatgataaaaaagtctatgttggactctttgttaatcgccaggaaagggctcaggtagatggatcaccaaagttcaccaatgtgtatgtgaaaaacttttccgaaacatatactgatgaagatcttgagcagctctttagcacctatggtacaataactagtgctgtggtcatgaaagacacagatggaaaatctagatgttttggttttgtgaatttcgaaagtccagattcagcggttgctgcggttgaaaggttaaacggaaccacagtcaatgatgataaggttttatatgtagggagagctcaaagaaaagcagaaagagaggcggagttgaaagccagatttgagttggaaagaataaggaaatatgaaaaataccatggtactaatttgtacgtgaaaaaccttgactataatatcaatgatgacaaattgaaggagctgttttctgagtttggaacaataacatcttgcaaggtgatgcttgaaccgaatgggcgtagcaagggttatggttttgttgccttttctgctcctcggaatgcaaatagagccttgcatgaaatgaatggaaagatgattggacggaggcccctatatgtagctgtggcccaacgcaaagaagagaggaaggctcttttggaggctcaattttctcaaatgcatgccctatatgcaatcacgcatttacctacgggaatccctgtatatcatccaggggcaccaagacatggccctcaagcattgcattatggtcaaggggcaccaagtcttgtagcacctcaaccaacaggatatggtttccagcagcagctcttgccgggcatgcatcctggtgttgctccaaatttcatcatgccataccaccgccagagacaggttcctccaagacttagaaatctccaccggaaccagatgttgcatcttaactccagccaagggtttggatacatgggaaatggtcaaaatggcatggatccgtcagtagttccccatggtatagtggctccaatgatgccattgccctttgatggttcaggaatttccgcagctcctacttataatcagcatcctggtggttcattgtccaacacatttgcctcagctctggcttctgctaccccagaaaatcagcacctgatgctagctgaacatctatatccacttgtggacgaaattactaaaaatcatcatcagactgaaaaggtgacaggaatgttgttggaaatggatcagtcggaggtcatccatctgactgagtctcccgaggacttgaaaataaaggtgtttgaggcaatgcaggcccttggtgaagccgcaccagattctgaagaagttggtgatcaacttggctcagtctcattgaaggaatga

SEQ ID NO: 80567 - DNA, 2262 bp, Glycine max
  Peptide Sequence Number=SeqID_172252
atggatttcggtgaaggttacgtatcaaatgagcatcgcgagcttcatcgatctgcaacagaaagtgcagatccattatctgtttctccattgcagctttcacctaagtcatcacgatctcaaaaatctccaaggtcccctaaaactcctaggtctccacaatctccaaggtccccaaaggtgcagggcaagtgcagcaatctaagtccaaggagtcatagacaatcatatttccaaaaagatggacgtccaaagaaaggtgaagtctttttacccattgaagtttttcatggcttgataacttcttcaccaagtagctaccataaaatatgtggtggttctgggggaaaaggcacctggggtggattgcttgatacagatgacacaaatgttcttgatcctaatgatccaaactatgacagcagtgaggaattagaccattcaaatgaaaagaaaccgatgacagatcttgacaactacaagaaaaaagctacaataatagtggaggaatattttgccactgatgatgttgttgcaacaatgaatgaagttaaagaattgggaaaaccacagtatggctactattttgtcaaaaaacttgtctctatgtccatggacagacatgacaaagaaaaagaaatggctgctattctgttatctgcactttatgccgacgtacttgatccttcacaagtttacaaaggcttcagcaaattagttgactcagcagatgacttgattgtagatataccagacacagttgaagttctagctcttttcatagctcgagctgtggttgatgacatacttcctcctgcatttttgaagaagcacatggcctacttacccaaagattcaaaaggggttgaggtcttgaaaaaaactgagaaaagctatctagctgcccctctgcatgcggaaatcatagagcgatgctggggtggaagtaagaataccacagttgatgatgttaaagccaagataaacaattttttgaaggagtatgttggaagtggtgacaagaaagaagccttcagatgcatcaaagatttgaaagttccttttttccatcacgaaatagtgaagcgggcacttataatggcaatggagagacgtcaagcagaatccccactgttagacctgttgagggcagcagctgaagaaggtttcattaactccagccaaatgtctaaaggtttcggtcggttgattgacactgttgacgacttatcacttgacataccagatgcacgtggaatactacagaaactgatgtctaaagcagcatctgagggttggttatgtgtgtcatctttgaaatcactttcagtggagcctgaaaagaacaccatagaagatagtgctgccaaaagtttcaaggtaaagactcagtctatcattcaagagtacttcttatcgggtgatatattggaggtaaatagctgtctagaacaagaaaacagcaagaactgtgctgcactcaatgcaatctttgttaaaaaactgataactctggcaatggataggaagaatagagagaaggaaatggcttctgtgttgctgtcgtctttgtgcttcccagccgatgatgtagtgagtggttttgtaatgttgatagagtcagcagatgatactgctctcgacaatcctgttgttgtcgaggatcttgctatgtttctagctagagcagtggtggatgaagtcctagccccacaacaccttgaagagattggagcacagagtttgggaccaggttcaattgggagcaaagtgcttcaaatgacaaagtcattgctaaaggcaagacttgccggggagcgaatcttaagatgttggggtggtggagggagtagcaggcctggatgggcatttgaggatgtcaaggacatgattgggaagctgttggaggagtatgagtctggaggcgagataagggaggcatgtcgctgcatgaaagagttaggaatgccatttttccatcatgaggttgttaagaaggctttggtgacaaccattgaaaagaagaatgagaggttgtggggtttactcaaggagtgctttgaatcaggactaataaccatgaatcaaatggtgaagggttttggaagggttgctgaatctcttgatgacttggccttggatgtccctgatgctaaaaatcagtttgcatgctattttgaaagagcaaaggccaatggatggttggacaattcattttgtttcagcaaacaggaacatgcaacagagaatggcactcactaa

SEQ ID NO: 80568 - DNA, 636 bp, Glycine max
  Peptide Sequence Number=SeqID_172253
atggaagggccaacaagtgattcactgagtcaacaacaatgtttggagacaaaattgaccgagatgcttcaagatgtggaacctccagcaatgtatggacttgataagcaatgcatttatagagtaccacaaacattcgtgaaactaatccgaaagcctatacacctctatttgtttccactggcccttttcacaatgctacctatggcagattttgttgtcacacttcaagcgtcggaagaaaaaattcgaagttgttatggagaacgtattaaatgtaatagcgacgatttcttaaagatgattttagttgacgcttgcttcataattgagcattttttgagatggcatagattcgaagactggcagggaaaggaccctttgttgataaaaccatggatgagttgggatattaggaaggagttggtactactagaaaatcagcttcctttctttgttcttgaacagctttacaacctcactggtatgaatcgggaatttccctcctttcttcagatttctttcaactgtttgaagcatgtgggtttgggatatgtaacaaggtgtcccaacagagtccccaaagcacttcaccgatcttttgagaacttgaataatattgtcatcaaaatttga

SEQ ID NO: 80569 - DNA, 873 bp, Glycine max
  Peptide Sequence Number=SeqID_172254
atgcagaagaatgatgttctgagagtgttaaagttggatggtgatgcgaatttgaggatttatagttcatcatataaagggagtggaacttctatcataagatgggctgctgtgaaagatcacaatacaaggactcagaattttgagaagattgatccaaataatagtaggaaagggtgtaggatgaaggttaggctagaggattgtcctgaaaagatggggatgttaaacattccaagatttggaggactatatggtcagtatgatctcgtggagtatgcttctggtgcaccaattcagttctcatataaggagctcaaaggcctcacaaatgggtttaacgaaaagcttggtgctgggagttttggttctatttatagaggaatgcttggtaatggaactattgttgtgattaagcaaattcagggaattgaactagaagagaaacaatttaagttggaaattgctaccaaattttatctcggcactatttttattcgatgtgggacttcaacatgccccatcaccacattgcaagggggtatcaactatcatgatttcgaggccaaactctcctatttcaaccttgtaaagctcataactcccaaggatgacaggtaccaaaccgtgttaaatatgagaggaaccaaaggcttttggtgcattcaggagcaaccatctcagaggacagcaataagcaaagtcttgcacatgcttgaaggtgttacaaagattaagaagccaccagcaccaaaatcaatgaatggagggtcgttcagtggaaatgaagaatggttgagaaagaatgtcagtgctctttccactgtgtcaaccccaacaccaacttgttcttcctcttcgtttcattattaa

SEQ ID NO: 80570 - DNA, 2037 bp, Glycine max
  Peptide Sequence Number=SeqID_172255
atgggagaatgggagccaacttggagcacaagagctgcagaagaagctgaggctgtggcagccataccatgttcaggacatggaagagcctacttagatggtcttattcttaaagggcatgaacatgtacatgtttgtgagtgcaattcatgcaatggtggatctgattgcttcaagtttttatcagattgtattgccaacgcttcaagtggggacccatattttttggagccattttggatgcgacatgcagcaagtagcgcaattttagtatcagggtggcacagaatgagctattcttatagtgatggatcatacatttcagaagtattggttaagtacatccaaaaagttcatagcatcgttggaaatgcaatcactaaaggaaggtacttcatatttggaagtggctcaacgcaactattcaatgctgctgtttatgccttgtctctcaactcttcagtgtctccagcaaaagtggtagccacgaccccatattacccactctatagaacacaaacccaactctttaattctagggattttagttatgaaggagacacgtccttgtggaaaaacaacacagatagcaactctagatttattgagtttgtgacttcaccgaacaatccagatggaaagttgactaagagagttcttgaaggtcctaatgtaaaaaccatttatgatcgagcctattattggccacatttcactgctattccttcaccagctgatgaagatcttatgctgtttacaatttccaagctcacaggccatgctgggagtagatttggatgggcaataataaaggacgaggcagtatatcaaaagatgttgatatatctgcaattgaacaccattggagtttcccgtgacgttcagctgagagcattaaaacttttggacgtgattgttgaaggagatggaaaagaaatattccaatttgcatattcaaccatgagagatcgttggataaggttgaaacaagtcatatctgaatcaaagcggttttctctacagaaactgtctccccaatactgtacctttttcaagagggtcagagatccttcaccagcttacgcttggttaaagtgtgagagacaagaagagagtaattgctatgaaatccttgaagctgctggcatcattggccgtgaaggaaacagcttcagcacacagcagagactcccttcgcatccaatgtctacgctcttcatcgccctccaatgctgccaatgctccaccatgcaggcactctctctctctctctctctctctctcatattctgtgtgcattctaatccaattgattgcaactatgttcaggtgaagcagaagaagaagagcagcaacaaatggaattgcgcggtctgcaaccagaagcaatcggtttgcagagtcttcgcccagggattcatggccaaggagcttcgcaagttcgtccaggacttcaacatgtcccgcaagtccttcgacgacggagaatatccccttgccggaaccctaaatccgccgcttcccgccacggaacacggagacgccgagctcaacctcaaaaagaagcggaacgattggtccgcgtacctccaccaggaacaacaaccagatcatgatgcagatgatgattttgagccactggttgtgactgagttgcaaaaaggtatgttcaagaaacgcagagtggtggaggattctactgcaggaagtgacaggcttttcaaaaagtcccttttccataactctcaagaggagctaaggatagatcaaccaagagttacatcattgactgaaagcaatccaaagagaaataattacgtaacaccaactaatcagaggactcaaaaatgcaaaccaactagcagcagggcagcctccaaatggaacaattacttaactgaggacaatgaaaatttagagcttggatggaagaaaagctttaactttgaggaccattcaggtccaaggaacaacaccgtcttagagaccatgactagtgaaatagtagaagatgatattcacccagattttatgtga

SEQ ID NO: 80571 - DNA, 1524 bp, Glycine max
  Peptide Sequence Number=SeqID_172256
atggaacaacctccttcgtcgtctcttcaggtggagacagcacaacaagcaggacctagtcctctcagaaaaatgatcgctgtctcgtcaatcgccgcgggaattcaattcgggtgggccctacagctctctcttttgacaccctacgtccagaccctgggcgtcccccacgcatgggcctccttcatttggctctgcggcccaatctctgggctgctggtgcagcccattgtagggtacagtagcgaccgatgtagatctcgtttcggtcgccgccgtcccttcatcttagccggggccgttgctgttgccatcgccgtcttcctaattggctatgcagccgatataggacacgcagctggcgacgacctcgcaaagaagacccgcccacgggctgttgcaatcttcgtggtcggcttctggatcctggacgtggccaacaacatgctccagggtccatgccgggcatttctcggcgacctcgccgccggggaccaccgcaagacgagaaccgccaacgcattcttctcgttcttcatggccatcggaaacgtcctcggctacgcagcaggctcctacgacaaactccaccgcgccttcaaattcacacaaaccgaagcgtgtgacgtcttctgtgcaaatctcaagagctgtttcttcttctcaattgtccttctcctcgttctttgtttcgttgtgctcacttgcgtggaagaccctcagtttacgccacgtggggatgaggacaattacgaaaacgacggcgtttcgcggtcgtggttttcgtgctttggtgaactctgcggtgcgtttaggggtctaaagaggccaatgtggctgctgatgttggtgaccgctattaactgggtggcgtggttcccttatgtgttgttcgacactgattggatggggcgagaggtgtacggtggtaaggtgggggacaaagcatacgattccggagtgcatgtgggggcattggggcttatgctgaactctgtggttttggcattgatgtcgttggcggtggaacccttgggtcgtttggttgggggagttaagtggctgtgggggatcgttaacgttattctcgccgtttgcatggcaatgacggtgcttatcacaaaggctgcagaacatgaacgcttaaacgccgtttcccttgttggatatccctcacttggtgtcaaagctgctgcattgactttcttctccgtccttggtgttcctcttgcgattacttacagcgtcccatttgctctggcatccatatactccaccacttcaggagcaggccaaggtttatctttgggtgtcctcaatgttgcaattgtcgtgccacagatgatagtatcggctataagtggacagtgggataaatggtttggtggtggcaacttgccggcgtttgtgctgggtgccgtggcggccgccgtgagtgccgtgctagcggttgttctgctgccaaaaccaaagccagcagatgtggccaaggtttcttccgtcactgctgggagtttccattag

SEQ ID NO: 80572 - DNA, 750 bp, Glycine max
  Peptide Sequence Number=SeqID_172257
atggagattaacttggactacgagatagcttggaaccatgtaataggaatttgcagggctagtcaagttgttgatttgttcccaaccgtgtcccccgaaattattgtccgcgaggcaaggttggaggactactggggagtggcagagacgcactgcaagtgcttcttccctgaatattccttcccattagattttgtgctgaggatagacagattggtggtggctatgttagcagctatgttagccggattctttaggcctagagattgcagaaggatctgtttggtggctgttattgacagctcacttgatgagtcattttcatttgaaagtgagggtctcaagattggtggttttgatgggaaattcagcctcaacaagggctatgtggctggtatattaacagtagacaataatgcagactttttaccaagaaaggggccacgacgacatagaaggactggaattgcatacatatcaaatgtggcggtccgggaaaattttcggagaaaggggatagctaagaaattgatagcaaaggcagagtgtcatgccagaagttggggctgtcgtgccattgcattgcactgtgacttgaacaatcctgtggccacaatgttatacaaaggacaaggttacaaatgtatcatggttccagaaggagcaaattggcctcagccaagaacctcaccagacatcagattcaacttcatgatgaaacttctcaaaaattcacttgggaggaagtaa

SEQ ID NO: 80573 - DNA, 204 bp, Glycine max
  Peptide Sequence Number=SeqID_172258
atgtcgttgaggaaattaagaatagtaaaaggtggaaacaagggtgataaggtgatcctgttacgtaaggttgtcactgccaggttgagtggtatgagggagacaagagagaagaaaagaggtggagaagtgatggaagaaatgagagacgaagggagaccaagggagaagggttggatgtgtaggaaaaagggagaagggtag

SEQ ID NO: 80574 - DNA, 1749 bp, Glycine max
  Peptide Sequence Number=SeqID_172259
atgggtttcaacattcaaccctatgggattcagtccatgctcaaggaaggccataagcacctttctggcctcgatgaagcggttctcaagaacatcgacgcctgcaaacaactttccactatcactcgaacttccctcggtcccaatgggatgaataagatggttataaatcacttggacaagctttttgtcacgaacgatgctgggacgattgtgaatgaacttgaagttcagcatcctgctgccaaggttttggttttggctgggaaggctcaacaagaggagattggggatggagctaatttaactatttcatttgctggggagctcctgcagggtgccgaggaacttatcaggatgggtttgcatccgagcgagatcatcagtggatacactaaagcaatcaacaagactgttcaaatattggatgaactagttgaggatggttctgacaatatggatgttcgtgataaggaacaagttatttcaagaatgaaagcagccgttgccagcaagcaatttggtcaagaagatatcatatgttcgcttgttgctgatgcatgcatccaagtgtgccccaaaaaccctgcaaactttaatgtggacaacgttcgtgttgcaaagctcttgggagggggcttgcataacagtactgtagttcgaggattggttctgaaaagtgatgctgtcgggactataaagcaagcagaaaaggcgaaggttgctgtgtttgctagtggtgttgatacatctgcaactgagactaaaggaactgtcctcatacatacagctgagcagttatattttttttattgtttgagtggtgaagcctattttgtgtttgctggtataagttggagatcaatccccatctcccagataagaaagttgaaagtggattgtgataggctagaaaattattcaaaaactgaagaggctaaagtagaggagctcatcaaggcagtagcagattcaggtgccaaagtgattgtcagtggaggagcagtaggagaaatggctttgcatttctgtgagcgttacaagcttatggttctgaaaatcagctcaaagtttgaactacgtcgattttgccggacaaccggctctgttgccatgctaaaactttgccaaccaaacccagatgatcttggatatgtagattccgtttcagttcaggaaattggtggtgtcagggtgaccattgtgaaaaatgaagagggtggaaattctgtagccactgttgttttacgaggaagtactgatagtatactagatgatcttgaaagagcagtggatgatggagtgaacacttacaaggcaatgtgcagggatagccgctttgtacctggagctgcagctactgaaattgagttagctaaaagggtgaaagacttttccttcaaggagacagggttggatcagtatgctattgcaaaatttgctgaaagttttgaaatgattcctagaactttggctgagaatgctggcctaaatgcaatggagatcatatcttctctgtatgcagaacatgcatctggaaatgccaaagttggcattgatttggaagaaggcatatgtaaggatgtctcaaccttgagcatttgggatctccatgtgactaagttatttgctcttaaatatgctgcagatgctgcatgcactgtactacgtgtggaccagattattatggcaaaaccagctggtggtccaaggagagaacagcctgctggtggtatggatgaagactaa

SEQ ID NO: 80575 - DNA, 2940 bp, Glycine max
  Peptide Sequence Number=SeqID_172260
atgaacgaaactgaaacaaacattcgtgacaactaccaacgactaccctctatgcttatttcttccctttctcttcgtcccttcttcttcctatgtcccaaggcctattcttttccacgccaatgcaaattcccacttcaaaattttcccaaacccattttcaatgatcacaagttactgtctggaaatttgagttttgcggctttcagtaacactgcattgagctatgcctacagcaacgacgaaggagaagcaaatggaatcaatttcttgcacctcatggaagaacgtggggttcgtgcgaattcccagacctatttgtggcttttagatgggtgtttgagttctgggtggttttctgatggttggaagcttcatgggaagattctgaagatgggtttttgtgcagaagtggttttgtgtgagcgtcttatggacttgtacattgcctttggtgacttggatggtgcagttacggtgtttgatgaaatgcctgttagaccgttgtcttgttggaacaaggttttgcacaggtttgttgctgggaagatggcgggtcgtgttctgggtttgtttaggcgaatgttgcaggaaaaggtgaagcctgatgagagaacttatgctggggttttgaggggttgtggtggtggtgatgttcctttccactgtgtggagaagatacatgcaaggactataactcatgctaagaaggtttttgacggtttacagaagagggatagtgtttcttgggtagctatgctatccggtttatcacaaagtgggtgtgaagaagaggcgagggatgaagtttcatataattcgctcatctctggtttatctcaacaaggatatagtgacaaagctttagagttgtttaagaaaatgtgtcttgattgcctaaagcctgactgtgttacagttgcaagtcttttgagtgcctgttcatcagttggggctcttctggtaggaaagcaattccactcgtatgctataaaggctgggatgtcttcagatattatcttggaaggtgcactgcttgatctttatgtgaaatgctcggatataaaaactgcccatgaatttttcctttcaactgaaactgaaaatgtggtgttgtggaatgtgatgcttgtagcttatggcctgctagacaatctaaatgaatcatttaaaatatttactcagatgcagatggaaggcattgaaccaaatcaattcacctatccaagtattttgagaacttgctcttctttgagggctgttgatttaggagaacaaattcacactcaagtcctaaaaactggctttcagttcaatgtgtatgtctctagtgtgcttattgacatgtatgctaaattaggaaaattggatcatgcccttaaaatctttagaagactaaaagaaaaagatgttgtttcttggacagccatgattgctgggtacgcacagcatgaaaagtttgctgaagctcttaacctctttaaagaaatgcaagatcaagggatacactctgataatataggatttgcaagtgcaattagtgcatgtgcgggtatccaagcacttaatcaaggacagcaaattcatgctcaggcatgtgtctctggttattcagatgatctttcagttggtaatgcacttgttagtctttatgctaggtgtgggaaagtacgagatgcatactttgcttttgataaaatattttctaaagataatatatcatggaactcattgatatctggttttgcacaaagtggacattgtgaggaagcactaagtctattttctcaaatgagtaaagctggacaagaaatcaattcattcacatttggtcctgcagttagtgctgctgccaatgttgctaatgttaaactagggaagcagattcatgccatgattataaaaactggccatgattcagaaactgaagtttctaatgttttgatcacactatatgcaaaatgtggtaacattgatgatgctgagagacagttttttgaaatgcctgagaaaaatgagatttcttggaatgccatgcttactggttattctcaacatggtcatggatttaaagcattaagcctttttgaggatatgaagcagcttggtgtattgccaaatcatgtcaccttcgtgggagttttatcagcatgtagccatgtgggtttggttgatgagggaattaagtattttcaatcaatgagggaagttcatggtttggtgccaaaacctgaacattatgcatgtgttgtggatcttcttgggcggtctggtcttttaagccgtgcaaggagatttgttgaggagatgccaattcaaccagatgcaatggtctgtaggacccttttaagtgcttgtattgttcataagaatattgatattggagagtttgctgctagtcatcttctggaactggaacccaaagattcagcaacctatgttctgctttcaaatatgtatgcagtgactgggaaatggggttgtagggatcggacaaggcaaatgatgaaagatagaggtgttaaaaaagagcctggtcgtagctggatagaagttaataactcagttcatgcattttttgctggtgatcagaaacaccctaatgtagataagatatatgaatatctccgagatttgaatgaactggcagctgaaaatggttacataccacagaccaatagccttttgaatgatgcagaacgacgtcaaaagggtccaacacaaattattcacagtgagaaactggcaattgcttttggattgcttagtttgtctagctcaactcctatccatgtttttaaaaaccttcgtgtttgtggtgattgccataactggattaagtatgtctctaagatttcagatcgagtaattgtggtgagagattcatatcgctttcatcattttaagggtggtatttgttcatgtaaagattactggtaa

SEQ ID NO: 80576 - DNA, 1443 bp, Glycine max
  Peptide Sequence Number=SeqID_172261
atggtgataatgggaaaagggcttggggtgaattgggggactcaagccacacaccagttgagggcagacacagtggttgagatgttgaaggacaatgggattcagaaggtgaagctgtttgatgcagatgagtctagcatgagtgctctatctggctctgggattgaagtcatggttgccattcccaataaccaacttgctgagatgaatgactatgatcgtgctttgcagtgggtcaagaagaatgtcactcggtacaacttcaggggtggagttaacatcaaggtgtcaatttgtgaatgtgggatgtttttaaacttgagggagagtaaaatgtatgtagcagttgggaacgagccatttttaaaatcctacaatggttcattcttgaacatcaccctccctgcattacagaacattcaaaatgcactcaatgatgcaggcctaggggactccataaaggccacagtacccttaaatgctgatgtgtacgagtctccaccgaacagtcctgtgccctcagcaggaatatttaggcctgatataagtgaccttatgacccaaatagtgcaatttttggcaaagaacaaagcaccattcacagtcaacatttaccccttcttgagcctctatgggaatgacaatttcccctttgactatgccttctttgatggtgtggccaatcccataattgataatggggtttcatacaccaatgtctttgatgcaaattttgacaccttggtctctgccctaaaaaaagtagggtatgggaacatgccagttttggtaggagaggtagggtggcccacagatggtgacaaaaatgctaatgtaggaaatgcttttaggttctacaatgggcttctaccaaggcttgcaatgaataaagggaccccgcttaggccaggatttattgaagtttacctatttgggctcattgatgaggatgccaagaacattgccccagggaactttgagagacattggggtatttttgggtatgatgggaagcccaagtttccaatggacctttctggaaaaggccaaaagaaggtactagttggtgctcaaaatgtgcactatcttgagccaaattggtgcatgtttaaccctgatgcacaggacctaagcaaacttgctgataatataaactatgcttgcacccttgctgattgcactgcacttggatatggttcttcttgcaacaacttggatgccaatggaaatgcctcatatgcatttaatatgtactaccagacacaggatcagaattacatggcctgcaattttgaaggcttggcaaggcttacaacaagcaatatttcaacacctacttgcaattttattgttcagataaatccttccttgtcctcttctttgaggccccaaatagtagctttcttgtttgtcactctactacccttcattctatttttgtag

SEQ ID NO: 80577 - DNA, 972 bp, Glycine max
  Peptide Sequence Number=SeqID_172262
atggaaattcaattccagcatccaaagaagcacttgagagcaagcacatcaaaaggaggcaaagggagaaacaacaacaacaaaaccaaaagcaagtatgttggggtgaggcaaagagcatcagggaaatgggttgctgagatcaaagacacaacacaaaagataagaatgtggcttggcacatatgagacagcagaggaagcagcaagggcttatgatgaagctgcatgcctccttcgtggatccaacactcgcaccaacttcatcacacgtgtgtcccttgattcccctctcgcttcgcggattcagaatcttgtcaacaacagaaaaggtaccaaaaccaaacaagaacaatatgtcgtggaaacatgtgacacaaggatcaagagcaaccgacatgagtcgatcgctctaccagaaggagctagtcctccacaacgtggtgaactaaggtctgaatcttcgttggaagacgtgtccaaatttagtatccaacaactgtatattgatcaggattgtctccgaaagaaaatacgtgtgggaaatgagaagaaaagaagggtcaatagcaccacttgtagtactagtaatagtactaattcaagcaataatagtgactcatgtgagaactcactttctagtgagacaacaacacaaaacacacaacaatttgatgatgatgcttatagacctgatttgagcaatttcatggtgtccgagtcaggttctcatcagaacaatccttcatggggttttgaaccttcttttagccaagtaatggatgtagcaaacctgcctgatatagctggcttggagcttccagattttgaaaggataaaagttgaaaggcaaatatcagcttcactttatgcaattaatggtgtgcaagagtacatggacactcttcaagactctaacaataataatggagctatctgggatttcccacccttttgctcttttttgtgttaa

SEQ ID NO: 80578 - DNA, 2301 bp, Glycine max
  Peptide Sequence Number=SeqID_172263
atggagaatgatatagagggtgtgcattggtgcaacatatgctctaaaatggtgaatccaatgagtgatgatgagaacatatgcccgttttgtgagacagaattttctgaggtaatggacaacctaagggaccagaatgatgtttttgacttaaggtcagcttgggtgttctcgctttacgccccaatttttctcggtttgatgggtgctttcagcccttccctagcaagaattgctccacatggaggcagcagcagctcaaggggtgtggaagaagaggttgagcaagagagggaaaatgaacttgtgcttgggagaaggagaagaacttcaacttacatgatgcacctctttcgcggtcttcacattaggatggtgtctgaacttgaaaaccctgaagacaataataggaacatggatggcagcagcatacttgtgattgatccattcagtgaaggtgcattgattgtgaggggacctaacttgagccacacaactagttcgaatgagaataatgctgtcggaagctccttgaatgaccttgtggtaggatctggctttgatttgttgctacagcatttggcacagattggtcctggtggctattcaagtgttaaccctccggcacagaaggcggcaattgaggcattgcctagtgtgactagtgaggagaagtttcagtgcccagtgtgcttggaggatgttgaggttgggagtgaagcaaaggagatgccatgtttcagatgccatctgaggattcaactcttgaagccaatgtggacaatcggaacagtgagctggtcagagctggagaagagagacccagaaatggaaggaggaactggggtttcctcactgcagaaccattcaaaagaatctgttattatctcaggaaccaccacttacagaatagacatgctgggtctatactttgccacaagttttgaagtggttcctcctctagttagcacaaagattagagcagcattgctgcaatatgcagtcctaactgcggccgaagccatgctctccaaaggactcattggagttggagctggccatggtttgaacagcaatgtctggataggctcctgcagaagtttccccgctaagcataacacagtctgtgccatcaaggactgcattagcaacatcggtggcctcggctcgcaaacacttgataatctcaggactgcattgaacaacactggcattctctgtgctgtcatgttggataccaagggtccagagatcagaacagggtttttgaaacaagggaagcccatagaaatccaaagaggacaagaaatcacaatcacaactgactatagcataaagggtgatgaaaacatgatcagcatgagctacaacaagttggcacaccatttgagtccagagagtaatattctgtgtgctgatgggacaatcagtttcactgtcctggaatgtgacatggagaatggcttggttcgatgtcgttgcgaaaattctgcagttcttggggagaggaagaatgttaacctacctggagtggttgttgatcttccaaccttacagaaaaggacaaggaggacattttggagttcagatcttgtggaagtcagaaatctactaggaaagcatgcaaaaagcatacttctcatgtccaaggttgaaaatcaagagggtgttgccaattttgatgaaatactggcaaattcagatgcattcatggtggcaagaggtgacctgggaatggaaattccaattgagaagatctttcttgctcagaaagttatgaaacacaagtcaagcatacaaggcaagcctgtggtgacagccacccagatgttagagtctgcgatcaaatctccccggcctacgcgagctgaggccactaatgttgccaatacagtccttgatggcacagactgtgttatgcttagtggggaaactgctgcaggagcctatccagacattgctgttcaaaccatggccagaatatgttcagaggcggagagtttcatagactccactgacctattcaggagagtgatagaaacagctccaactccaatgagtcctttggagagcatggtttcggccgcagaaacccctctaaggcatagccttatctaccggggactaatacctgttttgggcacaggttcttatggagattccatgactaaatcaacagaagaaaccatagagcttgctctttcatatgctaagaaaaatgacttgtgcaagactggagactctgttgtagcactgcaccgtcttgagtctagtactgtcatcaagatattggatgtttga

SEQ ID NO: 80579 - DNA, 583 bp, Glycine max
  Peptide Sequence Number=SeqID_172264
atgcgactctcccagccattattcagatacaagcctttcacaagccaaaaaattaatggcacagtgaattttgttggacatagaacccatcttcaaacaagttataagaaaactgtagctcctattttcataaccaatggctccaatgctcctctcaccacaaagttagcaccctgcaatgcaatcacattgcctaccctctcagctgaggatgatgcaaacaatgctaacaaccgcaccaagaatgaggtttctaatggaacttccaagggaaagagcttctggggtgctgttagtttgatcattggcactgctgtgggtcctggaatgctggctttgcctgctttgactgttaaatctggtccatttccttcatcaatcataatacttgcttcatggctctatgtcatttcctcaatcattattgttgctgaactttgctttgaatccatggaacaagatggggttgaagaaatgagcttcacaagccttgcaacaaagacattaggaagtggttttggtgcattggttgctttggtttactcaactttgtctttttccttgctggtggcctgtgttgctg

SEQ ID NO: 80580 - DNA, 1065 bp, Glycine max
  Peptide Sequence Number=SeqID_172265
atgggaaccccacaatccaataacttgccaccaggttttaggttccaccctacagatgaagagctcattcttcactacctaaggaagaaggttgcctctattcctttgccagtttccatcatagctgaggttgatatctacaagtttgatccatgggagctaccagctaaggccgagtttggggagaaagagtggtacttcttcagtcctagagaccggaagtacccaaatggagcaaggccaaacagggcagcagcttcagggtattggaaggccacaggcactgataagaacatagtggcatcactgccaggaggaggggttagagagcactttggtgtgaagaaggctttggtgttctacaaaggaagacccccaaagggtgtcaagaccaattggatcatgcatgaatatcgctttgttgacaccaatagacccattaggatcaaagacacctccatgaggttggatgactgggttctatgccggatatacaagaagaccaaacatgctgtatctccaaccacagaggcagcatcatcaacactgcaagtgatcaatgagcaattagatcaagcagaagaagaggagcaaatcaaagacaaccttttaccaattttgaagaacaacactactcttgtccctcctcaacaaaccacactgctcatgtctcagaaatctttatccttttccaacctcttggatgccacagattactccatgctcagcaccatcttatctgagaataaccactccaataattaccttactccaagtgaagccttattcaataattgtgagaatctggatcaggaaattaccccccaaaattactactacaacaacaacaccaatagctacttgtttcagaagaacccttcccacatggaaaacatggctaggccaaaacgccacctttcaaacatggatcatgaggacaacatgatattatacccttcaaagaaatatcaaagttcctcttgcaattttcctaactctaatccacaatggaacttcatgttcaagcagccactcatgagtcctcaatatcttccatttcagtga

SEQ ID NO: 80581 - DNA, 2487 bp, Glycine max
  Peptide Sequence Number=SeqID_172266
atggctgtgctgatgatttttcacatgtttgctgcaatagctttgcctgcttatggagatgctttcatcggtgtcaacattggtacagatgccaccaacatgccaagtccaacagaggttgttgcccttcttaaggctcaaggtatccaacatgttagactctacgatgccgacagagccatgcttcgcactcttgccaacacaggaatccgtgtaattgtttctgttcccaatgatcagatactcggcattggtcagtccaatgccacggctgcaaattgggttgcacgcaatgtcatagctcatgttcctgctaccaacatcactgccatagctgttggttccgaagtcctaacttccctcccaaatgcagctcctgtcctagtctcagcactaaaattcattcaagctgcactagtcgcagccaatctcgaccagcaaatcaaagtctctactccacactcttcttctgtcatccttgactctttcccaccttctcaggcatttttcaataaaacatgggaccctgttatggttcccttgctcaattttttgcaatcaacaggttcatatcttatgctcaatgtgtacccttattatgattacatgcaaaccaatggtgtagtccctctagactatgctttgttccggcccttgcctccgaataaggaagctattgattccaacaccctcctgcattatactaatgtctttgatgcaattgttgatgctgcttattttgcaatgtcatatttgaagtttaccaacattcctattttagtcaccgagtcaggatggccctccaaaggcgactcgtctgagccggatgcaaccgttgataatgctaacacttacaatagtaacttgatcagacatgtccttaacaatagtgggactcctaagcaacctggaattgcagttagcacttatatttatgagctttataatgaagacttgagatcaggaccagtgtctgaaaataattgggggctgttttatgctaatggagctccagtttataccttacacttgaccaattctggtactgtatttgcaaatgacacaacaaaccaaaccttttgtgttgccaagagtaacgccgatacaaagatgcttcaggcagcgctcgactgggcttgtggaccggggaaggtggattgttcgcctttgctgcagggtcaaccttgttatgaaccaaatagtgtagcttcacatgctacatatgctatcaatgcatattatcagcagatggctaaatctgctgggacctgtgatttcaaaggagttgcctctgtcaccactacaaacccgagtcatggttcctgtatatttccaggaagtggtggtaaaaatgttaccagcgtaaatggcacagcattggctccatctaccaattccacaaattcaggcaagaagatgatcaaaagagcgcagtgccgactccgacatcttaagagcaagagggaggtgatggcaatgcaaattggcaaagacttgtctgagttaatacagaatggtcatcaagaaacagctattatgagacaatcggagaaaaaattggaggaatctcaagaaatcgctagagatacctctattgctgtcacaatgcaaaaatgtgataattcactctctgtagctgtagctgtggagctatttcctagtaatcttgtatacaaaaagtctctgacggatgatcagaaatacaaagtggttgatgaaattgctagcgacaattgcctccaacaagaggtgaaagaacatatagggaatcaattagtggaaagtgatggcgaaacgaatcacacaattgcagaatatacctcaactgaaaattctgcattggtgtatagtgtccagcaatatcccccgtgtggtgaagaaatggagaaagaagactttcctgatttgcaaaacaagggagaaacaatggctttgggaccttcatcagaaggagttagtttgcttccatatgctgaagcaatggtagagtactatgttgaagagattgaagaatctgagaattttgaatcaaaagatggtcaggaagaatcagcaagtgagaggtcaagcataagggttggcttaagaaagagcaaaggggcacctaagaaaagattgaaaaggagatcaagtttacttgaaagacaaggcacaacagaaaatggatgtataatatattatcaacagccatgcaagagtccctctactcagaactatgccaaggctacacaaagagaaaagctttcaaccttgactaatgtgactgcagctgatctgccttgttattgttgctttagctacgataaaaaatgttattcaagagccttgactatgaccacggagcagcccaaaaactacaaagacgagttgttaaggacatattcacgttcttctccacatcctaagcatgttcatcctaagttaccacagtgtgaggacatagttgctatctttacggctctcaagagagagagaggtagaggctag

SEQ ID NO: 80582 - DNA, 315 bp, Glycine max
  Peptide Sequence Number=SeqID_172267
atggcagttgaaggatcactcttttttggcatttattcccagacaaaagtgtaccttcaggggggagttcaaagtggggaaccacggcctcaagtgataataccatctgcagcatttagtggtgccatcatcagttttgtgttaggtccaacagatctgataaagtgtaggatgcagatacaaggcactgactctttggttcctaaatccagtagatacagtagtccccttgattgtgcccttaaaactgtaaaagctgaaggggtgaggaaattctgcaacattctgcaaaatttgattctagccatcctctaa

SEQ ID NO: 80583 - DNA, 462 bp, Glycine max
  Peptide Sequence Number=SeqID_172268
atggccgtggaatctttcgattgtttcaggttgaaacttggagtgccggctcaggatattatgatgaatggaaatggtactcagactgagtattggggcgaaagttcgggttcaacttcccatagcagtcagcaggatgtggaggatgacaggatgattgctcttgtgctgtcagaagagtatgccaaattagatggagcagttggtcggcgccttaccaacttggaacctgttcctcatgtaccccggataaattcctttttccccactgtaagtgatgccagtatggatcaccagcgcctgcttcagagagagtttggggcatgctgtagttatagtggcacgtttgggaggtcatgtagttgtggttggaaaaataagataattaagctgccacaaaacactattgatgagagcagcatactgacattccttccacctcttttgaataaaccaaggtag

SEQ ID NO: 80584 - DNA, 783 bp, Glycine max
  Peptide Sequence Number=SeqID_172269
acacagttagactttagttacttctcactagctagttacaagatgaagaataatagagcatctgggattttgaagttgatagctgcactgaggtcaatggcaaagtcaaaatctttggctctaaagtccaaaacgaacgccatcaaggctcggttggttatattctcacttgtgatgaacaagaggtatgtgatgagcaccatttctgacaagttccaatctcttctggggcatcaccattcacatctcaaagaagtggaagatggtaatgatagtgtggaggacaagtgcactgtggtgatcaatgacaatgcacacttgcatgaggattttgtttcgacctcaagtctacaagcatcgatagggtcatctatagtctcgacttctgagcgatgtgagatttttggacataccagaaaagcagtgtccaatgttaatcctagtgagacccaaatggtagtggaggacaatgatggtgctgatgatgatgatggatgtgaatgtttctacacgtatggtgatgatgatgatgatgatgatgatggtggtggtggtggcaataagtacccggatcttacacacacaatgtttgagtcagacgatttggaaattggagggtcagtgattgatttggtgaagagttcaaaagaagaggcagggcaagagttcaagatggaggatgagattgatcacatggctgatcttttcatcaggaaattccgcaggcaaatcatgctgcagaagcaagattctttgaagaggaacgagatgcaaatccaataa

SEQ ID NO: 80585 - DNA, 801 bp, Glycine max
  Peptide Sequence Number=SeqID_172270
atgacttcaaacttcaccattgaacaaaggctcgagcagctgcaaaaagcaaaagaagaagcacaaccccaaccacccaaaaaggccatgcaaaatccaacgtgtagcacatcatctccgagaccgaaagcatttcaccaagcgttacgagccgaaactgatatcattttgggtcccatccatcatggtgctcctaaactgcagctgggagagcagtacaagcaaaggtgggcagcgaggtacatcgacaccactggacaaaccccacaagacctacacaataaggttctgaaggatattggaaaccttaacaacttgtttgacgatgaccttttaacagcctctgcccaagagtaccagaagcaaggcgttgcaaccatagaagaaaagatttgctggatgatgggagacgtgctcttgttgaagaaccagcttccgttcccgttgctgcagctgctgtggagagacaccgaacgcgtgttgatgggaaaaatgagaaattttcttcggtgtcatcattgggccaccaaagaagaagacaagcttcctgagatcgttgtggatgacacaacagctgctactgtgctaaacctaatagcatatgagatgtgtcctgattttgagaacgactatgggatttgctcttatgtgtccttcttggactcactcattgaccacccagatgacgtgaaggcattgaggtcagaacaaattttgctcaattcgttaggtagtgatgagaaagtggccaacctcttcaataccataagcactgacttggtgcctgacatgggaaaataa

SEQ ID NO: 80586 - DNA, 201 bp, Glycine max
  Peptide Sequence Number=SeqID_172271
atggctgatatggaaatagttcttccagaaaagagaaatcctggattgactccaatggattgggtcaagtttcttgcatctgctatagttgggctggttgctgtagctagttctcttgatgtgaatacagctgatttgagggtcattggtgccgttctctccacagtacttggatacttggccaagacatacttcacgtaa

SEQ ID NO: 80587 - DNA, 2883 bp, Glycine max
  Peptide Sequence Number=SeqID_172272
atggctgctgatcagaggagaaaacgagtaaatggtgcaaacattgctggttatggttctagagagcaacacaggatcaaaagaaagaatttgggattagttcaaaatgatttgaacatgaggcctcacatctctgttgagtgggatggtaatcacaaaaaggttgttgctaagtgggaacagattggcatcagttggagacaaatgaaaccatttatcaatttggtttctaatgatcacaaaatcttggcagatgtgttcgcagtgcctcaagaaatttttgaattggataatttaagtgaagttctttcgtatgaggtttggaagacccatctttcagaaaatgagagaaaccttcttatgaattttctccctagtggctttgagtcacatcaagttgtggaagaactacttggtgggattaactttaactttggaaatcctttctcgaaatggggtgcttcgctatgtttaggcagtcttcatccagatatgattgttgaccaggaacagcatcttaagacagagaggagagaatactactcacacattcataattatcacaatgatatgataggatttctatcaaagttgaagaagagctggcaaagctgtaaagatccagaaaaggagattgtgcaaaagatatggaggacaaagcatgtagagaaaagaatgctctccaaagtgattgaatctagaggctatgatcataatgggaatgttacagggacatctgagtcatgctcctgggatgcagaggagaaagcatgtagtagcgacaaccaaatttcctcactgagaaaagacgataaacttcaaagaagggtgcttgaaaaatgcattgttaaaggtaaatccagaaatttgatggattctttggacaatatgcctaacgtgggagaaaagcccaagacaggagacaaactgcccaagcatagcattcattctagcgatagtgataaatacatgtcatgtatcaagattagcaagcagcagcatgaacttgttaagaatatgaagcaggctggtaaaagcatccaatctaggtcccttaaccgtgttttgggtaaccttgaaaaaattcatgtgcaaccatacaatacatttgtcaaagaagaacagaagaagttgcaggagcattggttgctattagtaaacaaagacctccctgcggcatatctaaattggacagagagacggatacagagacatgctgtgagaaattcattggttgcagagatgaaggataaatcaaatccattcatggaggaagaggatggtgtggacacagggagtgaacttaaggatcaggatggtgtgaactcagggagtgaactacaggatcacgatgaggtgaactcagggagtgaacttcaggatcaggatgaggacaaccttggctcaggggacaagctaaaggataagaatgaggataacatgagttcagaatgtgagcctcaggagcagaatgaggataatgtgacctcagggagcgaacttcaggatcagggtgaggataatgtcaactcgggtgatgagcttcaggatcaggtgaatgatggaggtctgaatgatcagtctgacttgaaagaagatgaggattctttttctaggtcccccgagaaccagtcccagcacaattcttatgttagtggtgatgatgagttcaaccgaatgagtgtagattcagaaaggaatattcttttatcaaaatcaaataatacttcatcgattagtggtgatcatgagttcaaccgaatgaatgtggattcagaaaagaatcttcttttatcaaaatcaaataatacttcattgaataaagatgagtattcaaggaatatgaacactcgggatgtttctattgatgaagaagcacctttcacttccagtggtgatgtctggcaaggagttgaaatgccacattcatactatgattctgctgtgacccacgagtatgcagccagtgggttatcactggctaatcctcaagtcagtcaagagcagccaactcgtatgattgatcttgaagctgatttgcgtcgagaagagacaggcaaagagttgttaagtaggcaattagataatgggaccttcagttcataccaaagccaggatcgaagtgtcttacttgaatcactcttcaaaggagaggggttgttaccttatcatcatgatcagaaagtagctgagttagatttccaaacttcaaacaatgttatgatggggggtggccaattttccagtcatttaaaggagccattgcaaacttcgctgacactggatcaggggcgaaggagagctactgaggtttacatgccagaaaacatgtcagagaatatttattcggatggaggaaggtatttgatccccaggcaagatcctttgactgcggtaaatatgactgattgggctgctaataatgctcgcatagcagggccttcccaatctcacttgaacactggagattttattgatcatcattggttccctgctgatcatcaagttcgtggtggtggctggaatggatctgatggtggtggtctttcaagtcaaagtcttggcactggagcaagcgctgatcagagtttatttagtattctgtcagagtgtgaccaattgcattcaggtagcccttatgattcagttagaaatactaaccagtttcttgcaccgagaacttatggattagcagatgcaggtacaccaagggtaaacacggttgcaccaccggcttctcatccattagattacttcaccagacgtgaagcacctagtggcctggtgcctgatgatacggtatggatgagcttgccgccacatcagaattcttcattacatgatcaaatcagaaagccatacttaaggtcatggaaccggtaa

SEQ ID NO: 80588 - DNA, 294 bp, Glycine max
  Peptide Sequence Number=SeqID_172273
atggagataagctcgagctacgagcactgcctcacctttatccacacttcggtggtacaattctcacaacaaactcagatgaacatttgtgccctcatctttagccaaaaatgcttccttgggatcgactctaagaaacaacaacaacaacaacaggagagaaagaggaagcttagtggaccttacaaaacttggggatcttcacgaaaaaggagaggttggaagggagaggttgggagggagagggttgggggaagaaatatggggtgggtgagtttaagaggaggggaatag

SEQ ID NO: 80589 - DNA, 93 bp, Glycine max
  Peptide Sequence Number=SeqID_172274
atgctcacagtagctgccgcaggcggcggcgtggtcgaggtggtcgcggcggtggctgagaaaatgaagaatcagcaacaaggtctagtctag

SEQ ID NO: 80590 - DNA, 483 bp, Glycine max
  Peptide Sequence Number=SeqID_172275
atgactctttcacagctgcttgataacttcctccacaaggcacatttcgcagcaacatcaagctgcctcaatgccgcaagttccttcttctcaaaggcacagaccgacacggcaccagcggcagcagctagagcggccacagcgtacacggtgaccacgacggtggctgccaccacggcaattacgacggcggagagagatatggtggagccgcggacgacgcgccgagagaggcagagtcacgacagcaatttcgcgatgcggcgatcgagctgcgttttgacgttggaggggttggagcaggtgacggagaaggtgtggagtcggggatggggttctggagggcatggaagaggcggacggcgcgaacgcagtcgttttgggtgggcgaatgtcggtgtaggaggtggtgtgaacggcgaggttgtactcgcgagagatgcggggagtgtcctctgtgaaacgcagcgtttttgtttgtga

SEQ ID NO: 80591 - DNA, 105 bp, Glycine max
  Peptide Sequence Number=SeqID_172276
atgactgaccttcgtgaagatggagagaactctattgacggtgaagatgaagagcaaaaacaagggacatattccttacttttcataggattagtcaaagaataa

SEQ ID NO: 80592 - DNA, 1776 bp, Glycine max
  Peptide Sequence Number=SeqID_172277
atggcaagcgcgttgcagcagcttcaaggggttcaagggaaacttgctgtgagtatgagtgtgaggaggagcttgcatcattgcaagtctcaaattgggtttgcagcatttggtgctcctgtttgtgcaaggagagtttggggcaatagggtggcattcagtgtcactacttgcaaggcctcaacaagtgatgtgattgagaagaatgcgactgagaatgggatggtgagtagtgagggtgaaaccagtttcacttgtgtcatgaagtttggtggctcctctgtggcttctgctgataggatgaaagaggtggctacccttatattgagttttcccgaggagaggcctattgttgttctctctgctatgggaaaaacaacaaacaagcttttgctgcatctagaagaattggagcaacttctgaaggggatagctatgatgaaagaattgactaaaaggactcaggactatttagtctcctttggagaatgcatgtcgacaaggatctttgctgcatatcttaataaaataggtgtcaaggctcgccaatatgatgcatttgagattggttttataacaactgacgacttcacaaatgcggacattttggaagcaacttatccagctgttgcaaagagattgcatggtgattggctctccgatcctgcaattgcaattgttactggcttccttggaaaggcccggaaatcatgtgcagtgacaacactgggaagagggggcagtgatttgacggctacaacaattgggaaagcactagggttgcctgagatccaggtatggaaggatgttgatggtgtcctaacctgtgatccaaatatatacccaaaagcagaacctgttccttatttgacatttgatgaggctgcagaactagcttactttggtgctcaggttctacatccacagtctatgagacctgccagagaaagtgatattcctgttagggttaaaaattcttacaaccctaaagctccaggtactctcatcaccaaggcaagagatatgagcaaggcagtattaacaagcattgttttgaaacgtaatgtgaccatgttggatatagcaagcactcgcatgcttggtcagtatggtttccttgctaaggtgttttcaatctttgaagagttaggcatatcagttgatgttgtagctacaagtgaagtcagtgtttccttgacactggatccatcaaagctatggagcagagagctaattcagcaggcaagtgaacttgaccatgttgtagaagaactcgagaaaatcgctgtggtgaatctcctacagaatagatccatcatctctctcattggaaatgttcagagatcatcactaatattggagaaggctttccgtgttcttcgaacccttggcgtcactgtgcaaatgatctcccagggtgcatctaaggtgaacatctcattggttgtaaatgacagtgaagcagagcagtgtgtgagggctctccactcagccttctttgagagtgagctctcagagttagagatggattacaaaaatggcaatggttctgttgatgaccttgtcactgtgatgtaccagaacaatgtattttacttgaagaaatatgctgggttgggaggaatggcaaagcattggtgtatcactagtcttggtagttggtattactatgcgccgtcgaagagggtacttgttgatctgggcaagtgcaccatcgaagacgatgatggaggtgtcatagaggccttcaagagcgagagtcacgggctaacttaa

SEQ ID NO: 80593 - DNA, 1248 bp, Glycine max
  Peptide Sequence Number=SeqID_172278
atgggtgcgagccaatcagtgcaaagtttggaagacagcgaagaagaggaacaagaggaggaagaagaagatgacgagaggaacctcaacgggcccttgatgggccgggcccaattgggcaaccacatggtgaagaaggttctggagcaggagcccgagatgctgccgtgccatgcctccgcttctccgctctcgccgcagctctcgtcgctcgggacgcctcggctcggcccctcgatcaaggtctgggacccctacaacgttctcggcccgccgccgcccgcactgtcccggagcttttcggggaacgggatagtcaccgtgccggacgacgaggcgttgacggaggttttcctaatcagccacggcgagtgcgagctgaatctggctccggacttggtcggcggccgctgccccgccgctgcgctgaccgtcaacgggaagcgccaggccagggctctggccgtgtttctcaagtcgcagggggttcggttcagcgccgtgtattcgtcgccgctgaatcgggcgcggtccatggcggtgtcggtgtgcaaggaacaaattcaatcctcagatgctcttgcagagattagtcaagggaattgggaaggctgccttcgatcagaaatatatactcccgaaattcagggcttaattgacaggttccagccagattttactgcaccttctggtgaatcacttagacaagtagaattccggatgattcacttcttaaatggaactatccttgcattacatgaaaaattgagatttgacttatcatcacatcaaaatgacagccaggcatttgcacagcacaactcccatgctcttctcactaactcaattcacgaccaagatggaccttctctccctccaaaccaatgggatttgctcaacaggcaccggcctgcattctcaaggaaaaagtctggtaagagcaggctacaatttgtgacaactactggtgatgaaattgaagacgaaatttcttctggcaacgtaaaccaccaaagttctctgcataattctggtttcaacagcttttcaccaactgtgtcttgtataggactatttactcattctgtgccaataaagtgtctcctgactggccttcttggatgtagtcctctgatgtcacataagttttgcatagaagactcttcagtgactgtgttgcagcattctctgagaactggttggcagattaaaaggctgaatgatacggcacaccttaggcttctctag

SEQ ID NO: 80594 - DNA, 1410 bp, Glycine max
  Peptide Sequence Number=SeqID_172279
atggcgccaaagaagaaacccgagtctgatcctcatggaatgttcagtggcatggtcgtgtttttggtccccaaaggagttcaatcccgtcgattccaggaaaggttggtgcaaatgggggctgtgatagaggagcgcttctccaaacgggtcactcatgtttttgctatgcactcagatgcccttcttcagcaactggatagggagcgtttgtcacgttttaaaggggactgcttgaaatcaggggagatactatcagaggatatgtatttactgaagttggattctcaaggtgaacatatacctgagaagtctttggaccctggactgactaatcaaaggacttcaagcgatcttcaacaattgcttaataaaaagagcaaattatctactgaggatacaaaaattgtaaaaaatgaaagccatgatgatgatggaaaagaaaaagcggtattttcatcaacaagcacaataagcagtcatggtgaagttgacagtttaagttatggaaacacaagacaacaacaccttgatgctgaaaatgaggcctcatccttatcataccatccacctgatctaaacaagaacataacagagatatttgggaaacttgtgaacatatatagagcattgggtgatgatcggaggtcctttagctatcacaaagctattgccgtgattgaaaagttgccattcaaaattgaaagtaccgaccagataaacaatctgccatctattggcaaatcaatgaaagatcatgttcaggagataatgactactgggaagttatccaaattggaacactttgaaactgatgagaagggacatcgttcgttagatgatcttaggaatgatgactcacttacaaatgcacagaagttagggttaaaatactttgatgatatcgggcaacggattccacgccacgaggctcaggagatggaacacattttacagaaagttggggaggatgttttgcctggggttgttatcatttgtgggggatcatatcgacgtgggaaagctacttgcggagacattgatatcattataacacatcctgatggaaaaagacaggctactgattctggtgttgacacttattttggtttttgcacctatcctggacgggagttgcggcatcgtattgatttaaaggtgtacccaagagacatatatgcttttggacttgtagcttggactggaaacgatgtcttgaatagaaggttgaggctgcaagcagaatctaaaggattccggcttgacgatacagggctatttccagctactcagggttctggcggcaaacggggtgcaaaaggtagtgcaagtttgaaatttaatactgaaaaggagatatttgatttcctagacttcccttgtcttgaaccacatgaaagaaatctctaa

SEQ ID NO: 80595 - DNA, 1542 bp, Glycine max
  Peptide Sequence Number=SeqID_172280
atggcgcctaaacatgacttagcctacacgaaaccaggttccgccgtggaagtgagcatcgacgacgatggcttcagcgggtcatggttttccgccaccattgtcagcagctgggccatcgacaggtttttggtcaagtaccataacctcgttgagaatgaactaagtcacacgccgctgcaagaagttgtctgtctccaccagctccggccactgcccccgccggaaaaacatcgggacttcaagtccggcgataaggtggacgcatttcacaacgacggctggtgggagggtcacatcacgggaaaattagggaatggaaggtttcgtgtgtatttcagggacacggaggagaacatggtcttttccaagaagcagctcaggacacactgcaagtggatcaatcacaattgggttttcccaactacagatcacaaggtatcggtaagtggtaaagaaacagaggggaagaaacggaggcgagacgagagggacagaatcagtgagttgccagactgcattctgatgcatataatgagtttcttggacacaaaagatgctgttcaaacttgtattttgtctaaacgatggaaagacctctgcaaatgtctcactgatctcacattccgctccccgtttagatgcaaatgcaagaagtattttaggaaatttgtgtcttgggttttgtctagtcgaaatgactcttgttccctacttaatgttgatattaacaacagctgtattgagactgaagagttagatagggtcatcaaatatgttatgtttcacaatgtccagaagttgacaatgtatataggtttaagcagcagacccaatttggattccctccctttggtcttttgcagcaagtctttgacttcccttaagctttgccttatgcatgatccctcttctagaatagtacttcctaaatctctgcacttgcctgcattgacaagtcttcatcttcaatgtgtcaattttacagcaattgacaatgactgtgctgaacccttttcaaactgtcacttgttaaatactttattcctatggaattgtgaaatgcatgacaatgcaaaagttctccgtatatctaattctaccctttcccatttgaaaataaccagttacataagttttcttacaacacaagctttccaaattgcactttctacaccaaatcttagttctttcactatcattggttttgctcctcaccaactctcttcctcgtgcaatcttgcttttcttggatcagtgtatattggtgtgtggtttgtctcaagttcaaccttcataagatgcctgcaagtgctagccaatgttaagatattgaagctaagttgggaaacgcttcaaatgatactatatgatctctcaaattccaattcaacaatgcctcaacccccttgctttgttagattggagtcgttgcatgtggaaaaagaatcatgccaacgatctgatggagaaataaacaatgtggtggagtacttgcttcaaaactctccaaaggctagagttgatatcataagtgcttaa

SEQ ID NO: 80596 - DNA, 909 bp, Glycine max
  Peptide Sequence Number=SeqID_172281
atggcattgcacattagctgtactatgagcaatgaagtgttagttcttctcttgttaacatctggccgagaccctggcataattccacgcaatgcacatcctccagaaccagaaggttttgaaggtagtctagatgttggggctggtcaaactcctcaattgcggttgcctcgaattaaggaagttgaggtcaatggaattactgttaaggtcaagtattgtgatacttgcatgctctacaggcctcctcgatgttctcactgctcaatttgtaataactgtgtggaacggtttgatcaccattgtccctgggttgggcagtgcattgggctgaattatggaggcagaggagacaacaatttggaaggcaatgatcaaaaccccagcctccatagggttaataatatacaccttcgtatcaatgtgactacatatgagaacttcagataccgatatgatcgacgggccaacccgtataacaagggagtgttcaataatttcttagagatattctgcaccagcattccccaatcaaagaacaatttcagggcaaaggtgccgatggaaccagtattacctgctcgatcagtgggtggaggctttatgagcccgagtatgggaaaagctgttgatgacatagagatgggtaggaaaactgtctgggccgacatgggtagtactgctcttgatccttctgaaggtcaattaaatgagcgcgtggcagtaaaggatggggaattcggtgagttgtctccagaaattaggacaacagtggacgaaacgagtgaccgtgccggaatacatcccaggagatccagctggggaagaaaaagtggaagctgggaaatgtcccctgaagttcttgctttggcagccagggttggggaatcaaatcgaatagcagtttga

SEQ ID NO: 80597 - DNA, 945 bp, Glycine max
  Peptide Sequence Number=SeqID_172282
atgaagcgttctgaccacctacgaagacaagctgtttacctcttattagcttgttctttcagtctgatctgtaaaagaggagaaattgcaaaccactgtaataattcaactctgtgctccagttttaccactaacccagattcagagcatgattacttctgcagaaaaaagggatcactagaacttttcaagtggattctaggacatcttccaactgcaatctctatcaaccatgaaaagtacatgcagatgtgtatgaacttcatatcatctttccttcagctatatctccgtgagatacattatgatcaccaagtgcttcttgattacctcatttcaaaagatactggaataagctgtgctaaatatcttctaagatgcttgcatttgatatgcaactcatggaagttatttgtggaatttccattatttggagaatttttggatcaatcatcttgcaagagaagaaaaattgtaggggatggtctacactttctagcagatggaatgcctacgtcaattgacaacagtggaagtatcatattgcatatcaagaattataaggaagacaggggtggcttcaagtactacaatattaagccattcaagaaagccggagaatgtttactatctttgaacaattctgtatataatcttcatcaaaagaagttgtttccgtataatcctaaagtgcttctgaaacggtattggtggcacggatggacaggaaatagagaaattttgtgctggttcatagttgtatggtcttggttcacttcaaatccgtcgattattctatgggtttggggttacatgccatttctggagaatctggtaatccaagcaattatcgcattgaaggatgtctttcttgcggatacctgcctttctcttggtacttggagcttgcattcatgctcctacaaaaaagcatgtaatgagtag

SEQ ID NO: 80598 - DNA, 816 bp, Glycine max
  Peptide Sequence Number=SeqID_172283
atgcaacgtttcagcaacacggtgataggattcttgaactttttcacgctcttggcatcaatacccatcataggtgcgggtctatggatggcaaggagcaccacaacatgtgaaaatttcttccaaaccccacttttggtgataggctttgttgtgcttgtgatttcgctagcgggtttcataggggcatgttttcatgtggcatgggcattgtgggtgtacttggtgatcatggtgttcattatagctgccctcttagggtttgccgtttttggctttgttgtgacggaacagggtgggggagtggaagtgcctggtagggcttacaaagagtatcgtctcgaccgttattcgccatggctgaggaataggattaaggatcctcagtactggagcaccattaggagctgcattttggggtctaacacttgtgcaaagcttgccttttggacccctcttgattatgtgcagagggacatgtctcccatacagtctggatgttgtaagccacccacagggtgcagttacaacgaggaaacagtggtagtgacacaagatccggactgctaccgttggaacaacgcccccactctgctttgctacgattgcgactcttgcaaggctggtgtgctcgaaaacattagaaggggctggcacaacatctctgttcttaacgttgtcgttcttgtgttcctcataggcatatattccattgccttttgtgctttcaggaatgccagaagagctcaaactgattatcctcatggagtaaaccgcatgaccaaagttaaacccagatgggattactattggtga

SEQ ID NO: 80599 - DNA, 1392 bp, Glycine max
  Peptide Sequence Number=SeqID_172284
atggagtacctattgaacagtataacacaagaagaagataccatgagcatgatcatttcagggaattgcatagataagaagcattatgttctggtgcatggggcatgccatggagcttggagttggtacaaactcaagccacgcttggaatctgcaggccacaagatcacatcactcgaccttgcagcttctggcatcaacatgaagaaaattgatgatgttcatactttctcacaatactctgaccctttgttgcggctaatggccacaattcccaaaaatgagaaggtagttctagttggtcacagccttggggggcttaacattgcacttgccatggacaaattcccaaaaaaggtaacagttggtgttttcttagctgcttttgctccagacactgaacaccaaccatcttatgtcttggaaaagtacaatgagaggaccccgtcgtctgcatggttggacacagaatttgctccaagtggaaacaaaacatcaatgttctttggtcccaacttcttgtccaacaagctataccagctctcccccattgaggaccttgaattggccaagactttagtaaggccatcatcactcttcgttgaagacttgtctacgcagaagaacttctccaaagagggatatgggtcagttccacgtgcatatattgtttgcactgaggacattgcaattccaatggaatatcagctctggatgatccaaaatgccgggattaatgacgttctaaagatcaaaggcgcagatcatatggctatgaatagcaagcctcgagaactatttgaatctctcgagaaaataccacggttggaatctgaaggccacaaggtcacagtgctcaaccatgcagcttctggcatcaacatgaagaaaattgaggatgttgacactttctcagagtacactgagcctttgctgcagctattggacacaattccctcaaatgagaaggtagttctagttggtcacagccttggggggatgagcatagcaattgcaatggaaaaatttccagaaaaggtagcagttggtgttttcttagctgcttttgctccagacgttgaacaccgcccatcttacgtcttggaaaaggaccttgaattggccatgactttggcaaggccatcatcatatttcatcgaagatttgtctaaggaaaagaacttctccaaacaaagatatgggtcagttccacgtgtttatattgtttgtcctgaagaccttggaattccattgaattaccaacactggatgatccaaaatgctgggttcaatgacgttgcggagatcaacggcgcagatcatatgccaatgttttgcaagccgcaagaattatgtgattctctccagcagatagctgctaaataccaatga

SEQ ID NO: 80600 - DNA, 2253 bp, Glycine max
  Peptide Sequence Number=SeqID_172285
atgcgccctctgttccgtttggctcaagtagcccggcgccactacaaggcgtcgtcgccaccaccaccgagcccaccgaaggccccaaagaagccgcagaagttcagcttcgacggcgcaacgtgggaggacccatacagctggatgtcgcagctgaacgacaaggtggcgatgcggcacatggacgtgtgcgtggagcaagaggagaagtacgccgaggccgtcatgtcggactccgataacctcctgaacaagctccactttgagatggcctctcgcatgcccttcgacctctccacccctcccctccgctggggcccctggctctactaccgccgcgccgaagaagccaaaccctaccccgtcctctgccgccggttggctagcttgtacgaagacttcatttcacataagtacccccccgcgggtttcgatttcactacgggaaagaccattgagcagaagctccttgattacaatcaagaagcccagagatttggaggttatgcttatgaggaactgtctgaggtttcgccgaatcatcagtttcttgcatatactatgtatgataaagaaaatgactacttcaaattatccgtgagaaatttgaattcgggttcgttgtgcagtaagcctcaggcagatcgagtttccaacttggcatgggccaaggatggacaggctctgctttacgttgtgacagataagaaaatgaggccttaccgtatctactacagtctgattggatcaactgatgaagatgttttgcttttggaagagtcagatgaaagtgttcacgttaatattaggcacacaaaagactttctatttgtgactgtaaatacattctctaccacatcatcaaaggtctttctaataaatgcagctgacctgttgtctggcttgaaactagtttgggagtgtgacgctctagctcactgcacaattgaacatcaccgagtggatgatccttcaagtacaagaaaatgggaggaggtattagtcgatgacccaggtttgattattgaggatattgattttagtgataaatacttagcactcattgtaagggaaggtcgaaaagttcagctttgttcagttggactgccattgccctttgggaagggagcagttaaactgaggaagctggacctacagtacttgcccattccaagacatgtttgccaaattacgcctggaccaaactatgactttttctcatctgtcatgcgctttataatatcatcacctgtgatgccagatgctgtggttgattatgacctggccacaggtaagtggaacatcattcaacagcaaaatgtgcttcatgacaggacaagaatactgtatggtaaaaattctgcaagtattagtatggagtcctcaaattcaaaacactccaatcctgtgaatgttaactctgaagatgaccacttatggaatgacctgtctgagttttatgcctgtgaacaatatgaggtcccttcatttgatggagttttgattcctttgactattgtttttgcacgtaacaataagatagaagctaaaaaacctgggatattgcatggacatggagcttatggtgaattacttgacaaacggtggcgcagtgaactaaaaagcctcctggatcgaggttgggttgttgcctatgccgatgttagaggtggaggtggttttggtaagaaatggcataatgacggaagacgtacaaagaaacataattcaatcaatgattacatctcttgtgccaaattcctcattgaaaaagatattgtgcatgaaaacaaattggctggttggggatatagtgctggaggacttttggttgcttctgctattaatcgttctccagatttatttcgtgctgcagtcttgaaggttccctttttagatgcaaccaacactcttctgtatcccatcttgccacttatagctgctgactatgaagagtttggctaccctggtgaccttgatgattttcttgcaattcgagaatattctccatatgacaatatacgaaaggatgttctttatccagctgtattagtaacctcatctttcaatacacgatttggggtatgggaagcagcaaaatgggttgcacgagttcgtgatctctcagtttacgacccaaagcggccaatattgctgaacttgaccacagatttagtggaggaaaaccgttatttgcagtccaaggaatcagcattagaggccacatttctcattaagatgatggaatattag

SEQ ID NO: 80601 - DNA, 186 bp, Glycine max
  Peptide Sequence Number=SeqID_172286
atggacatatacggtcctgagaaccttcatcttccacaacggtacaccgaacaatcattgagcaagtttaccgttgagcaagtttaccacttatatgattgtgaggattatctcagaaagaatctctcggcgcttgatcctgagatgcaagatgctccggtgaaggcagggatagtagttgtttga

SEQ ID NO: 80602 - DNA, 238 bp, Glycine max
  Peptide Sequence Number=SeqID_172287
aatgagtcatcatgaagaggaggctcctaagaatgagtctcataagcaagaagaacataagatggtgaagaagacttcatcaccgtatgaattgaatttcaacgatgacctcgaaactagacaaggaaaaggaggaataatgcatacaaatgttatgcacaatgatgaaacaagtgcaaacactagaatctcagaaagagacagttcaggtttgactaggcttactacagagcagtga

SEQ ID NO: 80603 - DNA, 231 bp, Glycine max
  Peptide Sequence Number=SeqID_172288
atggaggagctgccaggggcgtttggaagcagcgccagtttggctctccgtttgggccaaacagtcttttccacagcttcccttctcttcatgtgcttggatgttgatttctatggctacactgctttctggcactgttttttccatttttcacttcagtgtattaggatatttaaggaaatcaggaaacagtatagaagtaataggagatttgtagaagatatattctaa

SEQ ID NO: 80604 - DNA, 174 bp, Glycine max
  Peptide Sequence Number=SeqID_172289
atgcttgtctttgaacccattcgttcaagttgtggtggtgtcatcgtcttcttcgaggttgcaacgatgtttggtcaggaagatctggatgaaggaccatcggatttgaggaaggagagatgggagagggagagggggcgtgacacactatgggggaagaaggatgagatctga

SEQ ID NO: 80605 - DNA, 720 bp, Glycine max
  Peptide Sequence Number=SeqID_172290
atgaaatccattgttctaaagctcctcagggagaacaacagccttccaagctatgcgcgatcaaccgacatatgcaatgacacgatctacagatcatgccgaagctgcttggattcattactgtctctattcaagcaggctgcagaaccagacaaaccgagtgaggaccgtgatcctatagcaaagtgcatagctctcgaagctgataacttatcatggttgcttgagattttagttgacaaacaagccgctgatgagtttgcattgatgtgggcaaaccaacaggaactggcgttgctacacacgaagctgccaaccatgttgcgctaccatgttagctgcctttctgggaggctgtatgttggcatcggaagaggggagctgttgccgtcgaaggacacacgccggttgttgttacagacatggctgcagcctctgatgaatgactacaactggctgcagcatggatgcaggtcgtttgataggaaacttgtggaggaaggaattgggaggactattctgaccttgcctcttgagtatcaacagagcattttgctttcgtggttggggagtttcttgaaaactggtgatagctgtcccaatcttcagagggcatttgaggtatggtggaggagaaccttcattaggccatatgtggagaaccaaggtaatgttgctgtatcagatagtagtttaatgttgccaaagcagcatgagtga

SEQ ID NO: 80606 - DNA, 363 bp, Glycine max
  Peptide Sequence Number=SeqID_172291
atgagtaacatgcaatgttactattgggatgagaatgatcatgtgcaagcaaggtgcaaacaaatgaaagaagacttgaagaaattaagagatatgaacaaagatggtaagaactcccaagctagtgtagtaaaaagtgttgaagataaagatgatgtgtttttgacaacaaatgacaaggttggtaaaacaaaatgggtgatgaattatgttgcctcaaagcatatttgtagagatcgagagatgtttgacactttaaaaaccaatggagaattcgatcatttcaagttagggaatggtggaaaaatgaaagttgaaggcatagggagtgtgaggatgaagctccatgatgatgctatttga

SEQ ID NO: 80607 - DNA, 1113 bp, Glycine max
  Peptide Sequence Number=SeqID_172292
atgggggattcacaagaaaataacaaaggaaagagtagagacaaagataattatgaatcttggactatggaggataccaatgagttgttgcacctcttggtggatgctatgaataggggattgcgtgatgccaatgggtcacttagcaaacaaaatgtagaacgaataatacttcctcaactcaatgcaaaaactaaattccctaaaacttatagtcattatttgagtcggatgaagtggtttcgaaaccagtataacatgatgtcaacccttatgcgcaacaactctggctttggatgggacccaattggaaaaactttcactactcatgaggatgtatggaaagattacttaaagtcccacccaagtcacagcaaacttcgaggaaaaagtatggttgattatgagtatttgaagatcgttgttgggggtggagtttctagcggaaataattctatatcagtcgatccagatgatactgatgcaacaacttttgagccagaaaatagaactgttgggatagaagaattttcatatgatcctaatagtgatacattcataacaccaaataactatgaaccagcatatcagccttcatcaccaaaccaaccaagtccaccatcccacccccctttagattcagagcgaaggagatccgagtatggagggagttcaagcgctattgggatcaacaatcaaggcaacgttctggaaaatctttctgttggcattgggactattgctgtgaattttgaaaaaatatccaacatgatggagaaaagagaaaaagatagagatagagatagagagctcgagggtatttttaaatcgcggttcacaatttttaagtcagcacctccatttctatttaaaacacaagtagagcttgtgttggcatgtgcagcacttcataattttcttcgcaaagaatgtcgttctgatgaatttccagtggaacctactgacgagtcttcatcttcatcttcagtgttaccaaattacgaagacaatgatcatgaacccattgttcaaacacaagagcaggaacgagaagatgctaatatatggaggactaatataggttcagatatgtggagaaatgctaataattag

SEQ ID NO: 80608 - DNA, 594 bp, Glycine max
  Peptide Sequence Number=SeqID_172293
atggatggactgatagaggttctcaattgcatccttgaacaataccttcgagcttttgttcacgacaaatcggtaacgtatgggaaaagtccatcgtcaattcccagctatctacttgggtcctcaccagtcgaggccatcgactccttactagccacacaggccaccattcatgaaacattacagtgtcacctctcaaaggcccaagccactatgaagcgacacaaggtcacccatcgctgcgatgttcagctttcggtcaatgattggccttaccaaggtccctctcctcccagtccagaccccctacctcctatggccactgacaaccacccgataatagaacacatgtcgattcttgattggaaatgggacacaacgacaaatcccctgaccaagctaccgctggtgcactggtttgggttgccttcggaagacacaacatcagaacattgggaggatttatgggcttctcacaaccttctggacaaggttaattttccagagaaaggtgatgatagcaacattgcaacatatactaggcccaagaggacacagaagaagaggcccaattacctcattgactttgtgtaa

SEQ ID NO: 80609 - DNA, 348 bp, Glycine max
  Peptide Sequence Number=SeqID_172294
attcaaaggactaaccgcctgagaattctttgtctcaacacattggagggtacatcctttgtggtacaagtagaggatacatatacttgggttgttgtaactgagaacaagagagggtacatctcttgtggatcagttcaagtggagggtacatccacttggttgttcaaagagaacaagggagggtacatcccttgtggatctttgcttgtaaaggtttttacaagattgaaagaaatctcaagaatcggtggttgcttggggactggatgtaggcacggtttgttgccgaaccagttattcttgaaggtctatggcaggaagggtttatggcacttattagcttga

SEQ ID NO: 80610 - DNA, 1686 bp, Glycine max
  Peptide Sequence Number=SeqID_172295
atgcaaaacggcaacctccaagacgcgcttttgcaccgcaagtgccccgaactcttaaactggaacacgcgcttctcaattatcctcaacgtagggaaaggtattcactttcttcactcctatgacccccctgtaattcatggagacataaaaccgagtaacgttttgcttgatcgcgatttctggccgaggattggggactttgggcttgcgaggttgagctcggatactccgaggtttgaagttgaggttctggaatgtgggagtgttgataatgatgaagagaagatgaagacgaagaagaaggaggaggaggaggaggttgttgttgttgatgattgtggatcggtggagagtgctcatagtgtttttatggaggagggtgacatgggggtggagcaatcgccttcgccggagatggcggcgatgacttcgccagagaccaatttggcagtggcggaggcctcgcccgggtttgagaagggtagtgcgcagagtgagaaggagggtgtgaagaagattaatgagaaagggttgaagagtaattctgtgagggattggtggtggaagcatgaggatgaggttggggttggggagggtaaaaaggttaaggattatgtgatggagtggattggtagggatgtgaataaggaaagggtgaagagtggaattgagttggaaaatgtggagatagggaaggaagagaaaaataagaaggagaagaagagaaggaagaaggaattggaatggtgggaatcaatggaagaggaaaagtttgatggtgttgtgaaggggaagagaaggacggtgagggaatggtggaaggaggagtgttttgaggagaatgtgaatgcgaagacgacaaagaagaagaagaaggagaagaaaaagaggaagggtgggagtgtgaagagtgatgatgatgagaattgtggtgatgattggtggatgagtgatgatgcaatggataagaggaagggcaagagtaggagtaggaacaaccgtgggaacatggattgctggatggatgggttgagtggtgagttatggagagggaggaggaataatagctttgattctgctagtggggagattccaaagagtggtggtgtgagtagtactcctagtattaggggaactgtgtgttatgttgctcctgagtgtggctatggtggggaagtgtctgagaagtgtgatgtgtatagctttggggtgttgttgcttgtgatcatttctgggcggcgcccacttcaggtcagcggttcacccttgtccgagtttcaaagggcaaatctcctgtcatgggcgcgccattgtgcgcgaaatgggaagcttgttgagcttgttgatgagtctattgaattgttggataaggagcaggctcttctctgcatcagggtggctttgctttgcttgctgaagtcacctgctcgtcgtccttcaatgaaggaggttgtaggaatgctcagtggagaattggagcctccccaattgcctgttgaatactctccttcaaccccttctaggttccctttcaagtctagtagaaaaggcagttttgttcctaggtggaagagccatgttgtgaaaccaggcatacttccttgtatgcagttacatgtgatctcaaagattgtatattttggttcacccatgcagaacttcaataacttgtgtaaatactag

SEQ ID NO: 80611 - DNA, 670 bp, Glycine max
  Peptide Sequence Number=SeqID_172296
gcacatggctacaccacccagctcccctcctcctcatcctgagtcagcaaaaccttcgtcgtctacgtcgaagaagacaagaaaagaaacacggcttaaatcattggctactagactagttggggcagagagaccaatggttcatgtggatcctgccattgggaaagttgatgatttgaccttcaaatgggctctggcagacgacaaagaggacgaggacgataaagtatgtgaaaagtatgacataagttatgattatctagaagaaaagttgatggaggacaagaaaaagaaacgactggaggaagcaacccgatctggcagcactcacacaatcgttgatcctccatctctcattagacaacatgtgaagtggatggcccgcacgaaaaaatctggtcaaatgacgactgaggcaacaaagaaaattgcatataaaattgattcccgaaagagtaggcctcaaagggaagctttgtcgctcaaggacgagctctcacacatctacttccatggctctcgaagacctagagcagttgacacaaaaaatcagggaccagctagagaaggactcacactacctcctgagtctgaggttggtccttctactaatgtgttagcacaaaggaaagttttgtcgattccttggaataagaccagacatgggtga

SEQ ID NO: 80612 - DNA, 759 bp, Glycine max
  Peptide Sequence Number=SeqID_172297
atgcctcctaaggcagtagggacctcccaaagaggaggtcggagttcaagcaaaggtttcaaattagctctaccagagccaactatcaagaaaagctcttcagtatcttctaggtcaccaacccaggctgggtcttccacccagaaaactaaagttgaaggatggaacctgaatttcgggacaaaaaacccattcaaggcgacatataaggctttcccatcaggatttcatttcaaaccaactgccatcaataagacaagaaccttttatgaacttatattggtagactcaaatttagtgtctatcaaacacttcaagaacccaaaggaccaatcattgaatgctcactcaacgatccaaatcttaaatattcttcaaccaaggcattttggtcaagacctaaacaaaggcaaaaaaattttagtaccatttgatcctgtaggatatacctattgggattatgtggatgcttggatcaaggtattttggcaccataacacccgctacaagcattcatggctgatatatttcaagaccaacacggtctataacttgccaaactggttttttcaacggtgggatttctttggcccaataccagagatcttcccagagcagccggctcaaagtctaaagaaagcctggcagagaaccttaaaagaagttctccaagtgctacagcaagaagaagaaggctcttcctcaaagaaggaagaaacaagttcatctgaagaagaagaagaagaccccttctactag

SEQ ID NO: 80613 - DNA, 411 bp, Glycine max
  Peptide Sequence Number=SeqID_172298
atgcctcctaaggtgtcaagctcctccgggagaggaggaagatcaagaagtaaaggtaaagaagttcttttagctctacctgagccaataatcaaaaagacaacttcatcatcctctgggtcacttacccagactgggtcatcaacccagaaaacaaaaattgaagggtcattgacccaaatagctaccattaaacctgagtcatccacccaggactcccccaaaccagtaacaacaaagcagactgtggctgactacgcctggtcaattcaaacccttcaggcctttgaagacatgggccttaccaaaattccaaaattagccaagaaaacctgggcagaaatggcctcagaatcagacgatgatttcgaaacagatccaaaagaccaagcaaaccaagacagtttgtaa

SEQ ID NO: 80614 - DNA, 114 bp, Glycine max
  Peptide Sequence Number=SeqID_172299
atgatgcaatcctaccctgcaagggcattggatagtagactccaagtagattggatcagagatgtaagagaaggccctagggttctcatgagccttagggtaggatacccttga

SEQ ID NO: 80615 - DNA, 348 bp, Glycine max
  Peptide Sequence Number=SeqID_172300
atgccaggcgctgcttgctgttcagtaattcctgataagaacgggcgttcatacggagggggttgtcatgctcactgccatgattgccgcatgcgggctgtggggcgtcagctggtgcctcggcgatcgcctggccagcgcctggggcgttttgctgccatgcgcgctgatgccgctgctggccttgatcgatctggatatgatgcagctgcgcagcctgatcgtgatagcgatgttggcgacgctggtgatgctgttcaacagccggctgcgtcattatctgctgctgccttcctgcatggcgctggcgggcggcctggcggcggtcagcctcaacttcagcttcgg

SEQ ID NO: 80616 - DNA, 1119 bp, Glycine max
  Peptide Sequence Number=SeqID_172301
atgcccagcctctcggccgccagcgtgaagctgcaggcgtcggcaacgcgaatgaacaccagcaggtcggtcaggttatccaacggcatagacggccagtttatcagtcattttggcgcggatacactgaggctcttcatctgttgggagagtcattatgagtgccttacacgccggcggcggcgcaaaaccctggctggcgaccttcgccatcggcctatccacctttaccgtcgtcacggcagaaatgctgcccgtcgggctgctgaccccgatagtcagcaccttgaacgcatcgataggccgcgccgggctgctgatttccctgcctgccctgttcgccgcgctgttcgccccgctggtggtgctgggcgcccggcgcacggatcgccgcagcctgctgatcgtctttctgctactgctgatcgccgccaacctgctggccgccgccgctacctccatggcgctgctgttcgctgcgcgcatcctgctgggcttttgcatcggcggtatctgggccatcgccggcggattggcggaacgtctggtgccgccggcctccgtcggattggcgctgtccgtcatcttcggcggcgtagcggcggcctcggtgctcggcgtgccgctcggggtgttcctcggcgaagcgctgggctggcgcatggcgtttctggccgtcgccgtcctggcggcgctgaccctgctcctgctgctgtgcgtgctgccgccgctgccggtcacgcaggcggtgagctggcggtcgttcaccgcgcagcacgcgaatcgccggttgctcctcgggctgctgctgacgtttctgctggtcgccggccactttatggcctacacctttgtccgcccgctgctgcagacggtcgccggcatcgagagccgctgggtggggccgctgctgttcgcctacggcgccgccggtatcgtcgggaatttcatcgccggccaggccgccaccaaacggctgcgccgcaccctggcgctgatcgccttcgggctggcgctcgccgtcctgctgctgccgctgctgggccgcgcgccgctgagcggcggtgccttcctcctgctgtggggcatcgcctacgggcggcgtttccgtgtcgctga

SEQ ID NO: 80617 - DNA, 696 bp, Glycine max
  Peptide Sequence Number=SeqID_172302
atgctgctgctggacgtcatcccgctgtcgctggggctagaaaccatgggcggcctggtggagaaagtcattccgcgtaacaccaccattccggtggcgcgcgcgcaggagttcaccacctttaaggacggccagaccgcgatgtccatccacgtgatgcagggcgagcgtgagctggtacaggactgccgctctctggcgcgctttgcgctgcggggcattccggcgctgccggcgggcggggcgcatattcgcgtcaccttccaggtggatgcggacggcctgctgagcgtcacggcgatggagaaatccaccggtgtggaatcgtccatccaggtgaagccgtcctacggcctgaccgatggcgaaatcgcctccatgattcaggactcaatgagttacgccgagcaggatgtgaaggcgcgtatgctggcggaacagaaagtggaagccgcacgcgtgcttgaaagcctgaacggcgcgctcgctgccgatgccgcgctgttaagcgccgctgagcgtcaggtgattgacgaggctgccgcgcacttaagcgtggtcgcccagggcaatgacgctgatgcaatagaagaagccattaaaaacgttgataaacaaacccaggactttgctgctcgccgcatggacaaatctgtccgcgtcgcgctgaaaggccagtccgtggacgaggtttaa

SEQ ID NO: 80618 - DNA, 399 bp, Glycine max
  Peptide Sequence Number=SeqID_172303
atgcgagcacaaccagaggaggaggcaggtctccagcttcgacgaggaggctatcgcacaactactatgcatattggggcaagatttcgcccagaccgttgcatggagatgagtgcggatcatgcgtgccaccacaactctgatctcccccttccaaagaggatcgtgcccacaagacactctgtgggcccggagaagtccaacagggtcctggggtttccagctctggtgacaagcctctgtcagttctacagagtgcccgtcgcccccagcaaggtaggcgccgggcgaggcatcatagtagcgggcaacagacgcaccgccaccacctccaaagcccctcaactcatctacaaaggctggagcgttgcctacgacacgtggccaactagcaggtag

SEQ ID NO: 80619 - DNA, 162 bp, Glycine max
  Peptide Sequence Number=SeqID_172304
atgtcgatctccccctgcagaaggatcgtgtttgcaagacacccagtggacccagagaagtccaacaaggtcatggggtttccaactctggttacgggcctctgccagttctacggagtgctcgtcgcccccagcaaggtcatcaggccccctactaactga

SEQ ID NO: 80620 - DNA, 1088 bp, Glycine max
  Peptide Sequence Number=SeqID_172305
attgaaaccgatgaaggcattgtcggctggggcgaaccggtgattgaagggcgcgcccgcacggtggaggcggccgttcatgaatttggcgactacctgattggccaggatccggcgcggattaacgacctgtggcaggtgatgtaccgcggcggcttttatcgcggcggcccgattatgatgagcgccatcgccggtattgaccaggcgctatgggatattaaaggtaaggttctgaatgccccggtctggcaactgatgggcgggctggtgcgtgacaaaattaaagcctacagctgggtgggcggcgaccgccccgccgaagtaattgacgggattaagaaactgcgcggcattggtttcgacacctttaaattaaacggctgcgaagagatggagctcatcgataattcccgcgcggttgacgcggcggtgaataccgtagcgcaaatccgcgaagcgtttggcaatgaaattgagtttggtctcgattttcatggccgcgttagcgcgccgatggctaaggtattaattaaagagctggagccatatcgcccattatttattgaggaaccggtattagccgagcaggcggaatattatccgcggctggcggcgcaaacgcatattccaattgccgccggcgaacgtatgttctcgcgctttgaatttaaacgggtactggaagcgggcggggtggctattttacagcccgatttgtcgcacgcaggcggtattaccgaatgctataaaattgccggaatggcggaagcctatgacgttgggctggcgccgcactgcccgctggggccgatcgcgctggcggcttgtctgcacgtcgatttcgtttcacataacgcggtcttccaggagcagagcatggggatccactacaacaaaggcgccgaactgcttgattttgtgaaaaataaagaagatttcaatatggaaggcggcttctttaaacctctgatgaagccggggctgggcgtggaaattgatgaggcccgcgtggttgagttaagtaaaaatgcgccggactggcgaaatccgttgtggcggtatgaggatggatctgtcgccgaatg

SEQ ID NO: 80621 - DNA, 405 bp, Glycine max
  Peptide Sequence Number=SeqID_172306
ggactcgcattgcctcctgagtctgaggttggtccttcagctgcttgtgtcagcacaaaggagagttgtgttgatcccttaaggaacgatccaaacacagtcaaggttggtgttgaggaggttagagatgcatatgctcccattcttgtacccactaaagagggagctgtgggaccggcgaaacctgcagataggccggatcatgatgtcgatgatcacctatatctgatgacattgaccatcccacaactttttctgaagtcgttgcaagttatgtgggatgctactgtgtttggggtgtttaatgacaacttccccttatacataaagcatgaagatgtgtctgaaatagcacacggtggtcaatgtctcaacatctctattttacagttatgggttctgtaa

SEQ ID NO: 80622 - DNA, 354 bp, Glycine max
  Peptide Sequence Number=SeqID_172307
atgaagacctcttcgaaatcgcacacggtggtcaatgtctcagcatatcagtgctacagttgtggattctgccagacaactaccttaaggggattattaacaggtcttgatgatgctccacggcctaaatcaaaggctcctgctaggtggattgtcatcaagtgtaatagacaaaaaggaagtactgagtgtggctactatgtcatgcactggatgtccaacatcattttaggaacttttaggaataactgggaagcgtattttaacgatcctagaccattggagccagagagattaaaggcattgcggatccagtgggcacagtattatctccgagttagagatcagacctag

SEQ ID NO: 80623 - DNA, 276 bp, Glycine max
  Peptide Sequence Number=SeqID_172308
atggcactgaaggccgtgacaggtctgtttctggaaccctcggttaagctaaggagcttttttggtttctggtgcaaggattggcgaattggtggtcacctgaggtacatttcacctgaggtacaatctcgccagcattgtcgctgttgtgttcgaggtagtgttgcttggaaagctgtgtatccattaggttctggtcactattttcctcagttgcttctccttgcatcaaaaggttctgctctccgtttccagcaatgtactgaatgtggatga

SEQ ID NO: 80624 - DNA, 321 bp, Glycine max
  Peptide Sequence Number=SeqID_172309
atgcggggttaccttacggttatccacacctttggtcaaccaggggaaaacgagcccgttgacgcgcggggactaacatcgtcttctgcaccttttgtcgtcctgtcccatgaagtcaagggcaaacgagcccgttggcgcccggagattaacatcgtcctcggcagctttttccgtctgacccgtgagtcatgtgacatgcggggttaccttatggttacccacaccgttcgtcaaccaggggcaaatgagcccattggcgcgcggagactaatatcatcttctgcaccttttgtcgtcctgacccgtgaagtcaggtga

SEQ ID NO: 80625 - DNA, 674 bp, Glycine max
  Peptide Sequence Number=SeqID_172310
tatgtcatgaactcgctcacttcttaaatcatcataattactttatctcaagcgaagatgaagataacagaattatcgaagcgtgggctgataattttggttcaaaaatattcatggtgctgataacctttggggaaaaaacatctgatctatgcaaaaaattcgaggttccagaacatgccggtgacagggttaatttaattggtgacgcatttaaaaaactctgcaatatgttttatcggaatgaaagcaaaaaatatcattatcgcatagaaagaatgatgcatatttgtgctggtatcagtagtttcctccagttttattgggggaggctagatattcaattaacagttgatatctacctgagactgtatgagtcttcaggaatgtacgatataattgaaactgatcttgaatttttcccaccaagcaatgataactttgataaaattatcgagattcattttcctcttcaaaacaatcaacctgcgattacattagggcttaagaaacagtatcggaagtatattgatactgcattcctaaaagatctatccatgattaaagactacaggcgtgtattctatcaaacagcaatagctcaagcagaaaagtatgaaatctcagaaaatttgaaagagtttttcgaagataaattgaaagagctaggctga

SEQ ID NO: 80626 - DNA, 808 bp, Glycine max
  Peptide Sequence Number=SeqID_172311
atgaaactgaacaaaatcatgctggcttctgtaatggcatttggtgtagtagcaggcgctcaggctgcaggtaatggtgcaggtaccgtaaccttcaccggttctattattgatgcgccttgctcaatcacccctgaaaccgttgatcagactgtagaactgggtcaggtatctaaagctcagctggaaaccgcgaacaaaaccggtagctctaacccgcgtcctttccagatcaaactggaaaactgcgataccgcgacgctcaaaaccgttaccactactttcaccggtgccagctcacagtatgacaaagacctgctgggcatgaccggtactgctaccggcgccagcatcgccatcaccgacggttctggtaagaaaatcgcactgggccaggcaacggatgcacagactttacaggatggtaacaacaccctgagcttcgcagccttcctgcagggcggcggtgcttctgccaccatcaatccaggcggaaattatgaaagcgtttatcacttttgccctcagttcagcgttgttgtctcttccgacatcaattaccgatgtgatgcgcgatcagcgcaatgcgacccaggcattttcgctgcgcctgaccaactcggcaaaagccgcggccttgctttcagcattgatgatgcgcaatcccatcagcttcagcactatttaagcagccacaccgtggatgattccggtatggcgctgaactatatcgttgcgaataatagcccgcgcttccgcttatctggtgcgcacattctcagcgtgttaatcagcgttgccctattcc

SEQ ID NO: 80627 - DNA, 237 bp, Glycine max
  Peptide Sequence Number=SeqID_172312
atgtcattgcctagcgctgttaatgtgtcctccattatcaaccgcggagcctctggtgactgggaaaacaagagagggtacatctcttgtggatcagttcaagtggagggtacatccacttggtttttcaaagagaataatggagggtacatcccttgtggatctttggcttgtaaaggattttacaaggttgaaagaaatctcaagaaccataggtttcttggggactggatgtag

SEQ ID NO: 80628 - DNA, 465 bp, Glycine max
  Peptide Sequence Number=SeqID_172313
atgcatgcgttgtatgttggtctcgtcttttgtcatgggaagccagaaaatccatatcaccttcttaactgcacacatggggcactgtgcccccaaatgcgcaacccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 80629 - DNA, 809 bp, Glycine max
  Peptide Sequence Number=SeqID_172314
gcctcacacctattattgcacgaggtttcaatagcaccaatgcgggggtgcttcaaaaggtctgcaaggcatgggagatggtgcaaaagagggacaagaaacttagaggcagtagcaacgggcccatcggcggctaccataggtggttgaaagcctacgcacagggtctggattggctcccgaatttgagaaccactaaggggttggagtttgaaactccggaagaagatgacgaggtacaggccctcaagacagaactcgagaaagcccaaatagtcaaagaaaagttcaagtcaaaagctgttaggatccgaaaggagaacgccaaactgagagacgtaaatatggccaccaccaaggccttagaacaagaaaccaagagggcctgggaccaattgcgagtagacagttttatcttgaaggatgaattgaggatttgcctaaggtccaagagatgcttgtctcagcggttatgcgagagcgaaaccaacatgttagccatcatcagcaagtaccaagaagaattaaatctagccatggcccacgagcacaaagtagtggacgaatatgcccgagtgtacgcgaaaaaggaggccagaggaagggtgattgactcgttacatcaagaagcaacgatgtggatggaccgatttactcttactttgaacgggagtcaacaacttcctcgattgctggccaaggccaaagcaatggcggacgcctactccgcccccgagaagatccacgggctcctcagctattgtcaacatatgatagacttaatggcccatataattaggaaccgctga

SEQ ID NO: 80630 - DNA, 480 bp, Glycine max
  Peptide Sequence Number=SeqID_172315
atgactattattatatatgcattttgggtagaagaaaatttcccatgccgtggaaatggactagtgtgcatgactaggggcaatccaggtgatttacaatcctttgatcctgaaatagatagaaaatttcatagattagttaggcatagtgtgcatcctgatcattttgtgcattttgagcattctgagtattctgttgctggtgattctgaatattctgattttgagcattcgactactaattttcatactgagaacatggctcaacctccccctcgtgagaggactcttagggagatgactgcacctgatttcacttatgaaagcttgtgcattcaatatcctgatttcacttatgttctcaacactggacaaatgcatttgctgcccaagtttcatggtcttgtaggtgaagatcctcataagcatcttaaggagttccatattgtttgttccaccatgaagccccctgatgtctag

SEQ ID NO: 80631 - DNA, 318 bp, Glycine max
  Peptide Sequence Number=SeqID_172316
atggtttggatctatttcactcccctcccggggttcttttcgcctttccctcacggtactggttcactatcggtcgatatcgagtatttagccttggaggatggtccccccatgttcagacagggtttctcgtgccccgccctacttgtcgttaccctagttccacaaacgggatttcgtatacgggactatcacccactacggtcggactttccattccgttctactatcgcgtctgctaaaagtaacaggctgttccatgttcgctcgccactacttacggaatctcggttgatttcttttcctctgggtacttag

SEQ ID NO: 80632 - DNA, 204 bp, Glycine max
  Peptide Sequence Number=SeqID_172317
atgtgggatatgcctattatacgcctcaatattggaagaaaatgcattgcgtttttagtgttttttctggaaaacgcgatgaactcgcttagcgcacctgctgcgctaaaactcgttgagtgcacttattgtgctaagcgagtttatcttttgaggatgaatattcatcctcttgatacagtacctgtggctaagcgaggatga

SEQ ID NO: 80633 - DNA, 239 bp, Glycine max
  Peptide Sequence Number=SeqID_172318
cgtccgctaagcgcaatactcattggctaagcgcgaggaagaatctggaagaagatgagctgtacaagttcgctgagcgcaccgcttcatcatactataattctgctaagcgcacaagcacgaacaaggccacctatttaagcctgaaatcagattttgtgagaggaagaccagagcttgaagaggaagttgttctgagagctttagatgagtttatgagtggttgtgagatcctagag

SEQ ID NO: 80634 - DNA, 189 bp, Glycine max
  Peptide Sequence Number=SeqID_172319
atggactgccccctgtggatgctctggagcatggagtgcaacatctatggtgtgaaaataaaatttgatggtcctacaaatataggagctggaagtggtctccgagtagatgtaggaggaataactagagctgaggaaggtactggagctgtggaagaagaaggagctggtgtctctggtggcactgaa

SEQ ID NO: 80635 - DNA, 875 bp, Glycine max
  Peptide Sequence Number=SeqID_172320
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttagaaatcaagatagaagctcagacttcagagaaaaacagaaaactggacacagacctgcagcttccaactgcttctgaagttcttggcctattgcatcattttcagcctggaagatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 80636 - DNA, 927 bp, Glycine max
  Peptide Sequence Number=SeqID_172321
atggggacgaggggttgcatcagctacaatcccattcttgctataagacaacttggctaccctatgagaggggcgccactagaggatgagctcacgcctgtcatttcacgaggtttcaataagaccaacgtggagacacttcagaaggacaaggaactcaagggcagtaacaatgggcccatcggtggctaccgtaagtggttgagagcccacgtgcaaggtttggattggctcctaagtttgagaaccgctaaaagggaggaagttgaggcaccagaggaagatgaagaggtgcaggcccttagggcagagctcgagcaagcccaaacaatcaaagaaaggctcaaatcagcagctctgaatatccgaaaggagaatgccgaactgagagatacaaatatagctaccaccaaggccttggaacgagagaccaagagggctcgtaacaagttccgaggggctctatggggcagtaacagcgagcttaagctccagagagaggaaagggaccaatcgcgagtagacagtttgatcttgaaggatgatttgaaggcttgctcgaggtccaagagaagtttgtctcagcggttatgcgagacagagaccaacatgttaaccatcatcagcaagtgccaagaagaactaaatctagccatggcccacgagcgtaaagtggcagacgagtatgcccaagtgtacgcgaaaaaagaggctaaaggaagggtgatcgactcgctacatcaagaggcaacgatgtggatggaccgatttgcccttaccttgaacgggagtcaagaacttccccgattgctagccaaggccaaagcaatggcggacacctactcggcgcccgaggagatccacggacttctcaactattgtcagcatatgatagacttaatggcccatataattagaaaccgctag

SEQ ID NO: 80637 - DNA, 720 bp, Glycine max
  Peptide Sequence Number=SeqID_172322
atgatcattgatcaatctctgttcttttcattgactaaattacccagtcaaggtgcaccttttgagggcactattgttgatgactgtaaatttgactattctagtcatgatgctcgtcgtatggtttgtaatggccatgctgaaatgatcgatagattgctggtcggatcattaacctttgattgttgcatcatgcactatattatcgttagaattttgcttccccgttcttctaatttagctcaagcctctaaggaggacttgattttgatgtgggctttccttaccggtcgtcagatcgactgggctcacttggttaggaaccgaatgcataaggcattacaggccaatgcacctcttccgtatcctcaattggtcaccctttttctccgtcattttcaaattcctcttgatgatgaaacttttgttcaagtcaagcgatcctttgctataggtgctggtgcagtcacttcatttggttaccgtaaggatcgtgatggtcaatggctaaagaaggacgcgctacctccacaagaggagcgtactccttctcctcctcctcaacaagatgattcctcggcccttatgaatgaagaattaaattgtcatcatcaaaaagggggagattgtagaagcaaagactttgactttggtgttttgatgatgccatatgatcatgatgttttgatgccttatgaagatgcgattctcaaagtttaa

SEQ ID NO: 80638 - DNA, 627 bp, Glycine max
  Peptide Sequence Number=SeqID_172323
tcaagtgttgaaactcggggtataggcagacgaagggagcctgttcaagcggaacaatattcccaacaaatgatggagcgtcaacacggaatgtattacacgccaacaacattttccgaatatccttcacagatgtatcagtatccttttgcaggtcatcatactgatacttctgagacctcacattcgtttggtggtgttgcggaaacacagcctcatttttcatggcccactatgactccttcacagcggcacgatgcccccattgcaacacccaacgccccatttgctccacaatggaataggctgaggaagcagaagcggggagacaacgcggcggcagaagaaatcctgatcgtcaagcgcgaagatgggatcgaccatgtggcacatcttcacgacatcacggacaccataatgactgattttgatggtttcgaggatgggttaggtttagaggttagtggtttaagggtttatgggttaggtttagagggtttatgggttatgtttagacttgagtggtttaagggtttagggtttggattaagggtttatgggttaggtttagagtttcgtggattaagggttttatggggtttagggtttggattagggtttttagag

SEQ ID NO: 80639 - DNA, 53 bp, Glycine max
  Peptide Sequence Number=SeqID_172324
tggatgactatgaagaacctgatgctagaggacacaggaacacaatgctctga

SEQ ID NO: 80640 - DNA, 327 bp, Glycine max
  Peptide Sequence Number=SeqID_172325
atggggtataggcccctaacgaaggacaaagaatgtgagagccttgtaaccgtggtggtcggaaaagagaagagggtgttcctcgtggacccttgcatattacaagagaacccttttcgggttttgatggacacatccacgaggaaggaggaggatcatcaagaggacaaggatcatcatcatctccatcaaagtagtagagtggtctttgtcgatgtggatgccattttgttcgagcacatgttgtggctcatgcacaatgattgttcttctttgttcaagcttaatttgaaagagattattgacttctacgctcaggatatatga

SEQ ID NO: 80641 - DNA, 1101 bp, Glycine max
  Peptide Sequence Number=SeqID_172326
atggtggatgcttttaggacgcatattatgcaaacgaaggagcttggtacttgcccagtgaggcagattggtggatgctctttcttttacatgaggatcagtaatgtctacattgtcattgttgtcagcaacaacgccaatgtcgcttgcgctttcaagtttgttgttgaggagccttatgaattctctaagttagcacaaattgtgttatatggacctattgagaagagggatgctgttgcattgttccgatcatactttggtggagcttttgacgaggatgcaattcgcaataattttgtactcatttatgagctcctagatggtcttcctggatattgtggaaagtgtaaatcttctaatgtcttcaaaagtgttctgcgttgtgatgtcactgggaagattctcatgaagtgctttctttctggaatgcctgatttaaagttgggtttgaatgacaagattggtcttgagaaagaagcacaacttaaatcccgtcctactaaaagtggtaaaagtatcgagcttgatgatgtcactttccatcaatgtgtaaatttgacaaggttcaactcagagaagacagttagttttgtaccacctgatggtgaatttgaactaatgaagtatcgtataactgagggagttaatcttccgttcaaagtattgccaaccatcaaggaacttggtcgatcacggatagaagtgaacgttaaggtaaagagtgtttttggtgcaaaaatgtttgcacttggggttgtagtcaagattcctgttccaaaacaaacagcaaaaacaaatttcacagttacatctggccgggcaaaatacaatgcttctattgattgtttggtttggaagattagaaaattccctgggcagactgagtcaaccttaagtgcagaagttgaacttatttccacaataacagaaaagaaatcttggactagaccaccaattcagatggagtttcaggttcccatgttcacagcatctggtttacgtgttcgtttcctcaaggtgtgggagaagagtgggtacaataccgttgagtgggttcgttacattacaaaagctggatcctacgagattaggtgctag

SEQ ID NO: 80642 - DNA, 324 bp, Glycine max
  Peptide Sequence Number=SeqID_172327
atgcactatgtgtcggtgaaaacgcgaatgagagagagaaaaaaggaagaaactggattacccgacatcgtcgcgatagaggcggttgatgagaacgtcgccgcggaggttgaggaagtaaatggcggaagcggcaaccggcatctccggtccactttaccggaagatcaatcggagatagtcggagacggcggttccgccgcagatctgtggtttcgagacagagcggaggcgtcgccgccgatttggtggattggattcgttcgtacacgggaaaaggtagcgggtgaatttgacaattcagaattgctgactatgaattga

SEQ ID NO: 80643 - DNA, 471 bp, Glycine max
  Peptide Sequence Number=SeqID_172328
atgagacgaagtgctaggctacgtaggagaatcacatcatttttcttttctaagttccccgatgagtattgtgaagagaatctttggaaaatcttcagcaagtatggtaagatgaatgtcaacattcccaagtttgaaaggccacaagtagctttcaccatagatgaaggagggacatcgtatagaggtcagattaacactaagacaaagacatggaaatcaaggtgtggcaagcaagctcttgaggaggaaaagaagtggtgggaaatggagttgaatattcaaaggagtaatttggacagactcaataactgttgggtaggacacctaatagatctctctttagttgatagattagaagatgtatatgtcaatgagaatgccaaaaagataaagtttaactatttgggggatgacatggtgttgatcttagggtgcacgaaagaatggtttaatgaaagcactaagtag

SEQ ID NO: 80644 - DNA, 162 bp, Glycine max
  Peptide Sequence Number=SeqID_172329
atgactaaaaataagtggagaatggagaattggcgaacagcgctaggcaataaatttatggggctccgaaaaaagtggagaatggagaattggcgaacagcgctaggcaataaattcgcggggctccagactcgttggtggaggacacatgaacagcgctag

SEQ ID NO: 80645 - DNA, 294 bp, Glycine max
  Peptide Sequence Number=SeqID_172330
atgacttttcaatttgaatttctgaagtttcgttattggaacagtagatggaaggtcttgtttccgcacccactgaccatccatatcctttcgataaccaaaggaggcaacaacagcagctccaatagcaaaagagcgtttaaccttaacaaagtgcatttgcctgtaatgccttatgcatacggtagcggattagatgggcctaatcaatttgatgaccggtttgaagggcccacaatagaatcaaatcttcctcagaagcttaagctagatttgttgaacgaggaagcatga

SEQ ID NO: 80646 - DNA, 1302 bp, Glycine max
  Peptide Sequence Number=SeqID_172331
atggttagaacaagagggttaggtcgtgccttagtacgtaggcaacgggttcatgtgactgaggatgttactcagacacttgaggatgtgcctcagttgaatgaggatgttcctcatgtgtctgacgctactccagagatgacaggcgctgtcgatgctgcgaacacagagggagtggctactgatggtagtgagggttcatctgctgctaatgagggattccctggtgggccatgcgacccatcgattttgactggttttgccgagcacgtggcacatagcatctggagtggacaattggtctcccatggtagaaaagtagataaatttgggagaccagcgcctgagatagaaggcatgattgcggccaccggattgagtccactgaccagggagaccagcaccttccacctgctagtaggagagttgacgatcactctggatgacatggcatcactcctacatcttcccatcactggcacgctgcataccttcgagccgctggttacttctgacacggtcgtgcttttgacggagctgcttgaggtcagccctgaggaggctagagctgagacccatcaggctagtgggcctcatgtttggttgtcttggctttgggacgtgtacgagagtaggtgccaggccagatgggacctggcccagacagggggattctcttggggagcggctgcattggtccacttgtacgagcatctgaatgaagcgtcgcagacccctacatggcagatggccgtgctggatatacgagcacttttcgatggtgcatcagctcatatgatggggatcaagggagccacataccgggcacgtatggaagtcctgactgtcacggacgtgtcatggatgccctatgttgagcaccgggcacgggtgcttcgacagttcgggtacattcagaccgtccctccgccgcatgtttgtgattcgttgatgggtcctgatatagatgaccagtggctgcactttttagatcatctagtgcccttcatcacgccgaacgaggacagtgctgagccgagccatccgcctaccccatatgataaggagttcgtcgagccacctatcccgaaggttccagttgcatctgatctccctacgcatttagtggttgactgccaaggatgtgaagcgatggctgaggatttggagcgggtcatcaacctcaggatggtcactgaaggcactaacttatatgacatcatggctcgttgcctgaggatagctacaggtgacgatgcagatggaagtcttaggccgcgacaaagacgatgcataggatag

SEQ ID NO: 80647 - DNA, 477 bp, Glycine max
  Peptide Sequence Number=SeqID_172332
atggctgctgcatctggcatgccagaggaggagacagcgatgtttcccgacaaaagtgtccatcccaggttggatgtctacgtgtgggacatggatgagacccttgtactgctcaactccttgctgaaatcatcatacgctgaggctttcaatggtctgaaggatgtgcagaagggggtggaaatcgggaggacatgggaaaatctcattctacaaatatgtgatgattatttcttctatgaacaaattgaaaattacaataagccttttcttgatgctctggcccaatatgatgatgggagggacctatctgattatgacttcaacgaagatgaattagtttccccacatgatgatgccaacaaaagaaaactggcatataggcatcgagtcattgcccaaaagtacttacaggagattcaggaatcaggattaatagaggaagggagggagagagaatggtcggacagaagatag

SEQ ID NO: 80648 - DNA, 1155 bp, Glycine max
  Peptide Sequence Number=SeqID_172333
atggagatttgtaagactcatatctctttcctaggaaccgaaataggaaacgaatacaacaaaatgaaaccatataaccaaggagtccccctccttacaaaagcctctccttctggaaaaggttatacaacttttgtcctgttatcaggaccacacaaaggtgtttacaccaattttaaagacctttgccttgcaaaggagggtattcaaagcctaatctacaaaggattctattcgaaagaggaagtcgaaaaagccttggagctaaacaccacaaacatgaataaaataaaaaaggcccttgaaccacaaaatactaccatattcataaatatcgaccaaaccaaggtcaaccacaaaacctataaggacacagtgaatccaggtatctctgaaccaataaatggcctgaacttagaaaatttcaagaagatacaaagcctattgtttaaggtgcacaaccgccaaacacaaattcagggtctctacataggcatgcatgcctatttcaaccaaaaattcatatgcaccaacaaaactccatattgtgaagacaaaaccaattgtccctgcaagataaaattcctttttagaaaagccagactagacttggaccagtttaagtcttttggatatgaggacttggcgatttctgcgaaaagattcgagggattcaacccctcaatcaatgaggctataaacctgattcaggcagaaatgatggactacattgccatcaaaataacaacttgcccgagcaactttactactcataattacccatgtcatggtaatacacaataccaatacagcctcatgagggcacaaatacaaggctaccaatggttcttcttagaatcagataaatgtgagttcgatctaataagggaaacctatgacacaaagattttccaaccctcatacaatgggaagttcttcattcctttcccggtctatcacaacaacaagttggtccaattcttccaaaaagaaaagaaagacaaggagatttacgaagctagtggatgccatggccaacaaacccctccttttccatctactgatctctcaatggaagattcatcaaacattttctattctggaactgtccaagaagaagaagatgttactattacaaaatcaataaagacctga

SEQ ID NO: 80649 - DNA, 309 bp, Glycine max
  Peptide Sequence Number=SeqID_172334
atgggtgtctctctccttcttcttgggattgagttgaagttacaacatggtgtctctctccttcttcttggccccactcactccgaacctcttattgcttgtgctgatgcaagtgacataatcgaactttccccttctcaagcctacctcaatcctctcgcttcgcaacgtgccctttcgcgggtgagcgaaggcgaggctcacgggtgcgctttccaaaggaggaaagatgcgcggagtcgccaccaacgtttatttgtggaaaacgtcggaaaaaccgaaggaaaccggtcaaaattaaaattctaa

SEQ ID NO: 80650 - DNA, 570 bp, Glycine max
  Peptide Sequence Number=SeqID_172335
atgactaccttgacccagacatggatgacgttgctgctcagcaacatccagcccatcgatcataattctgacctccctctgttgaagtgtcagctggtgtatgccatcctgacatggatgagcgtccatgtggctcagttgatcgcagatgccatttatttatttgcaggtatgtcgcctaccagacaccctctagacccagataagtctaacagggccctgggttttccaacattgatcacgggtctctgccagccgttcggggttcgtgtcacacctagtaaggtgattcgaccgccgatcacctgggctatcatagaaaagtattgcacgcctagacaggcgcagggtggcgacccgcaggccccagacgcactgccgccacctcctcaggctgacccagctgggtcatttgacacggagcgggcagaggtcgcatggcccgaagattggcccgaggcccaggcaggggaggcgcccgcagaggctcccgacgatggagaggaggcccacatggatgaggagatgacggatatgctcgatttcttgggaggaagcggagccacgtga

SEQ ID NO: 80651 - DNA, 351 bp, Glycine max
  Peptide Sequence Number=SeqID_172336
atggaagagatcaatgcttatcctattcaatgtcatttgaaagataacttactgtggaaagctgatcctactgggatgtactctactagatcagcttataaacttctgtcaaatctaaatagttttgccccagatgggaggaaatttcagcttatttggaaattaaaaatccccccaaaggttgccattttcacttggaggcttataaaggataggctccctactagagctaatcttcacagaagaaatgtggggacttgtggaggcctttggttaatctggggtgtttttgtctgttggtggggacttgtgatgggtttatatgtgttttttgggaggctagcagcatag

SEQ ID NO: 80652 - DNA, 357 bp, Glycine max
  Peptide Sequence Number=SeqID_172337
atgtcttggcaggaggaactagagagaaatcaaaaggcatcaggttccaagtctgatggatgtgcaagacaggttgcttcctatgagtttaccactttaacttgcatcccaggtgtcatcacatatcgtggagctaaaatccagctgagtgcattgtgctcggagggtcctgtggttgactggggggggggggggggacaattcattggaaaatacatgttattgctctctatacgacataattgtaatttcagttctgcacctcagcacttgcctcaattcgggggccaggaaccatgtatcttgcatattatgtctctctatatctttgaagcaaagtggggcccttttctctaa

SEQ ID NO: 80653 - DNA, 315 bp, Glycine max
  Peptide Sequence Number=SeqID_172338
atgatttttgtgagccaagcccaatacaagccaataaagtccttagtgatccacctgaaggttgttagaaaattgcagacactaaaccatacacttgtgagcagaggaaaacaccagccttgtgaggaaaatattgacagatgcggaaaggaccactggaagaaggaggaactaaggccattgacagtgttgaaacactcagaacttgcttggaaattatttctattcttgatacgaaaaagaaggctgcatttagcaaaagtggcacagaaaggaagaaaaaagaagaaattctggagcaggcccaatccatag

SEQ ID NO: 80654 - DNA, 252 bp, Glycine max
  Peptide Sequence Number=SeqID_172339
atgcgcggagttgccaccaacgtttattcgaggaaaacgtcggaacaaccggaaaggtgtggtctacgaactttaagcgtgaaaggttcgggagttgtttttacgcacggggaagaccgaagaacgatgaagaacgaacgaagaacgatgaagaacggtgaagaatcttcacgaaatcgctcactgaaacgtctcagaagtgttacggaagcgcttcggcttcgagagaatcctaaataccaaaaaggctga

SEQ ID NO: 80655 - DNA, 288 bp, Glycine max
  Peptide Sequence Number=SeqID_172340
atgaagaaaagagatacaggccatcaaagtgtgtcattggagaataagacaggagattcgactgtgttgaagataggaaattcggctaaagttgtgataaaacaagacatgaagggaagaagacatacatatgggtttaacaacaataaacgtgagaaggcagagaaggtaagggtggtggatgatgaaactggcgacaaacatcagctggatgaagtcctaaggatgccattcctacggatgccatgtaaaacaaaataccgatgcctcaatcagagaacaatgtag

SEQ ID NO: 80656 - DNA, 958 bp, Glycine max
  Peptide Sequence Number=SeqID_172341
atggatgtctccacgttgacgaccgggatgctgatcgatctttatccctggaaaggcgaaattcgtgagaccgaaagccagcgtctggtgacgacctttacgcttaaaaccgaggtgctgctggatgaagtgcgtgccggcgggcggatcccgttgattatcggacgcagcctgacggcgaaagcgcgggaatcgctgaagcttgcgccttctgaggtcttccgccagcctgcggcacctgcgccttccaccgccggttttacgctggcccagaagatggtcggtaaagcctgcggcgtcgcggggatccgtcccgggcagtattgcgagccaaagatttcgacagtcggttcacaggataccaccggcgggatgacgcgtgatgagctgaccgatctggcgtgcctgacgttttcagccgatctggtgatgcagtctttttgccacacctctgcgtatccaaagccggtggatgttcggctgcatgaaacgctgccgcagtttatcacccaccgtaacggggtggcgctcaaaccgggtgacggcattatccactcctggttaaaccgcatgctgctgccggatacggtaggcaccggtgctgattcccatacccgtttcccgctggggatctccttcccgggcggctccggactggtggcgttcgccgcggcaacgggcattatgccgctggatatgccggaatcggtgctggttcgctttaaaggtgagatgcaaaaaggcatcaccctgcgcgatcttgttcatgccattccgctgtatgccagaaaacaggggctgctgacggtcgagaaaaagaataagcgcaatgttttctcgggccgaatcctcgaaatcgaggggctggaagcattaagtgcagagcagcgtttgaactggccgacgcgtcggctgaacggtcgctgccgcctgcgtgatgcgcctggcggaagagaag

SEQ ID NO: 80657 - DNA, 138 bp, Glycine max
  Peptide Sequence Number=SeqID_172342
atgataacatggattgcatatgatattattggtttacctatagggacgtgtgacttatcaaacaacaagctcaacggaacaatttcatcatacttttcaggtcttgcacgccttcagaaattgaaataccaagaataa

SEQ ID NO: 80658 - DNA, 246 bp, Glycine max
  Peptide Sequence Number=SeqID_172343
atgcgaatcatcctaggtgcgcttgttgatcatgtgagcggagtgttcgtccccttggagtttattgagttcctccgtgtggtagcgttccatctctacaatgcaggcttgaagttggtggagaacatcattgtctatcatggtcgttggagggggattggaattttctgggagtggctctcacctgagaccagatcgtgtgctgaccataagtgtgtgttgaaaaaagacgatggaactcaataa

SEQ ID NO: 80659 - DNA, 162 bp, Glycine max
  Peptide Sequence Number=SeqID_172344
atggcctcacaacataatgatgacaaaggtgataagagtggtgaatgggatgatgaatttagaatgaaaatgaagaaaaaacaagagttgtttggtttagctttaaatattgcgagtattgggactctaagtgttgagactactggtgttggaacttcttaa

SEQ ID NO: 80660 - DNA, 369 bp, Glycine max
  Peptide Sequence Number=SeqID_172345
atggttcctcttgtacaagatattcctactcaggaagaagccggatgccaaccttcgcagcattctcttgtcgttgtcagaagcctcatgtgggtattccttgtctttgatatatcgcttgatatcgaattatcaaggctttccgcgacatctaaattcgatgtacgaaaaatccccgtgccgggtcaattggaacatagatgccagagtggcaagggcatcgaccatctgattctcctctctaagaataaggtgaaaggatatgtcatcaaagtactctatcagttttctgatgtaggcctggtagggtatcaacttatgatccttggtctctcattctcctctcaactggtggattaccaaggttga

SEQ ID NO: 80661 - DNA, 165 bp, Glycine max
  Peptide Sequence Number=SeqID_172346
atgggtattagaaataccaagatgagcgcatgtgcagtttttggtaccccaaaatgctttgatgtaaataacaaatacaccttggaagtacataatctaggaaatggccccgaggaagcttgcctcaaagaggtccaggaaggacaaggcagccgaaggaactag

SEQ ID NO: 80662 - DNA, 399 bp, Glycine max
  Peptide Sequence Number=SeqID_172347
atgggtgaccaagaggagatacaggaacagatgaaagccgacatgtcggctttgaaagagcaaatggcttccatgatggataccatgttaggaatgagacaacttatggagaataacatggccaccgctgtcgctgttagttcggctaccgaagcagacccaactctcccaactaccgtgcaccatccactcccaaacatggtaggacgagaaagaagcacactggggcacatcagcaacccctatttaggatacaaccgagtggcttacccttatagattaccacctaattacacgccgccagtcatgcgtgatgacgcagtcatgtcccttcccccatccttgaaggggctagcctcctcaacagtcggacgatgttcacgaggtcatagagagtag

SEQ ID NO: 80663 - DNA, 477 bp, Glycine max
  Peptide Sequence Number=SeqID_172348
atgaagggaaggcataggtcacatcttagacctcactcccataggagagaaaaggaaagaaagcctcaagaggttaacattaacctcccatacttccatgggaaggacaatgtagaggctaactttagattgggaaataaggaccaaggtcaaggaatcttaggggtgagaccttctaagcccaaagatgataaggggaagacaatagaaaaacaaccccttaaggctagtatgcaagagaagactagctccatgaagtgctttaaatgtcttggaagaggacacattacttctcaatgccccaccaagaaaaccatgattatgaggggccaagacatttatagtagccaagatgaggctactacttcaccttcctctagtaaaagtgaagaagcaaaaggggaagaatctagtgaagagatctacccccaagaagaaggacaacctttaatggttaaggagagtgtaaggaggtaa

SEQ ID NO: 80664 - DNA, 321 bp, Glycine max
  Peptide Sequence Number=SeqID_172349
atgggcctagttttgttagacccgccgagatccctcatgggaggatgtgcggaaaaaagcacaggccatccagaagcaaaacaccgccccccacgtgttgtctctcgtgtgcgtgttgctggagccggtgtcaccatcaagcaatactttggctccgctccacgaagctcctgcatttcctccttcatccctcccgaagaactcgagcagctcactcaacaaatcagggaccagctggaggagtcgatcacagaaaaagtgattgggcagctcatcgcatccttcagccaaatgcagccccagcttcagtcacaaatgtaa

SEQ ID NO: 80665 - DNA, 669 bp, Glycine max
  Peptide Sequence Number=SeqID_172350
cattgtagtgaggaacagttggcaaatttcgcccgattgctcacccataatgaaaaaggcaaaactcgcctctccagcgtactgatgcgcaacgaactgtttaaatcgatggaagggcatcccgagcaacatcgccgcaactggcagctgattgccggagaattacagcattttggtggcgatagtatcgccaacaaactgcgcggacacggtaaattgtatcgggccattttgctcgatgtttcaaagcgattgaagctgaaagccgacaaagagatgtctacgtttgaaattgagcaacagttactggaacaatttctgcgtaatacctggaagaaaatggacgaggaacataagcaggagtttctgcacgcggtcgatgccagggtgaatgagctggaagagctgctgccgctgctgatgaaagacaaattattggcaaaaggtgtgtcgcatttgctttccagccaactgacccgcattttacgcacccacgcagcaatgagcgtacttgggcatggtttgctgcgcggcgcggggctgggaggccctgtaggtgcggcactaaatggggttaaagcggtcagcggcagcgcctatcgcgtgacgattccagccgtactgcaaatcgcctgcctgcgccggatggttagcgccactcaggtctga

SEQ ID NO: 80666 - DNA, 420 bp, Glycine max
  Peptide Sequence Number=SeqID_172351
atgatattgcacgagattagaaggcctaactctctaaaaatagtccccagtggagtcgccaactgtcgcaacctacccttcggcgggaggaaaatgcacggagtcgccaccaacgtttattcgaggaaaacgtcggaaaaatcagaaaggtgtggtctacgaactttaatcgtgaaaggttcaggagttatttttacgcatagggaaggtattagcacctcacgcattcgtcacaagggacgacaacctttaatcaagagagaaacgttaaggcgttggaccattaacgatctcttggtttttgaaagtagagaaacgttaaggcgttggaccattaacgatctcttggggtggtcgacaaaagcggagtttttgctcctacgtatcctcaattgcaatgaggaaatcatacctatgtag

SEQ ID NO: 80667 - DNA, 351 bp, Glycine max
  Peptide Sequence Number=SeqID_172352
atgaaggcgtatctcaaccccggcgctgaaatcgagtgcaaagatgaattcatatatgaagaagagagctgccgggcggttagcaacctacccggcaatgaaagaggtgatcaggcgatgttcaggtatttatgcgtctgcatggataagcgccagtttcgggcgatacaggtctcaatgcacaaccgcgtggcatcttctttttggctaatcggctgcaaggcaataatacgcggcttttcgtcggccagcgtttccagcagttcatccagcgcttcgatatcgcgcacgcggccaaccggatgcttgatttcatcggcgcgctgcagcgcctgcgaaagcacatcatag

SEQ ID NO: 80668 - DNA, 612 bp, Glycine max
  Peptide Sequence Number=SeqID_172353
atgcacatggacaacgcaaatcttcactccccgatggtcggcaaccgccagtattgcatatactggccccggaatggcaagcgcacgcagagtacggcactgctgcgtcagtatggtgagatcagtatgccggaaaatgccaggacattggttgatggcgtctacgaacagaaaatagctgcgccagaagggctacaaacactttctgatattgcttttggcaaagtgcttagccaacgttcgattgcagcacagaatctgcttcgtcacgatctcggttacgaccgcgaagccagcgattttttatgggataaagacagagagttttctacccgcttgggtgaagagagcgtggatgtttacctggcctggctgggtgaagcaggggaattacatccagtcgtcgcagaaggcgattttcgctgggaaatgagccgattatcggtacgcatttcctggtggaggaagcagtcaggtgagttttcactgcccgatgatgaagtacttgaacagtttcgtaaaaaacatcatcgcccggcagctcaggtgatcctggtatcgccggaaggtgaagccagttattacaacaagcagacaggattgggccgataa

SEQ ID NO: 80669 - DNA, 216 bp, Glycine max
  Peptide Sequence Number=SeqID_172354
atgtctcaatggacagacagagccgattggggctgggtcagagatgtaagagaaggccctaggattctcatgagccttagggccttgtatttagtgatgcaatcctatcccgcaagggcattgggtagaagactccaagtagaatgggctagagatccaagggaaggccctagggttctcatgacccttaggatatattttgagcccatggattaa

SEQ ID NO: 80670 - DNA, 225 bp, Glycine max
  Peptide Sequence Number=SeqID_172355
atgggtcatcttagtaaagctgacataagtgagctaaaagcaggcacaatagctcatgatctttctcctagtggctggcttaagtgggccaataaggcacctgttaagcgagtcaggctctattgcagtacaacttgtattttcataaagggccgcaatcccaggctctcccttggcgaaaccatgtcaaccaagtcaaggctaaccctaaagaaaccaagttga

SEQ ID NO: 80671 - DNA, 423 bp, Glycine max
  Peptide Sequence Number=SeqID_172356
atgttggcttggcggctccaacaaaagacttccctccaagtcacctgttgttgttcatctgctcccacgaacgaaactttgagatcatcacaagcaccaatcacacggtataaaaattgtaaagaaaaactaggcagcaagtgtcgaggtcaccctgtcgtgcagaggcaacttcctccccatggtgatcaacctaggtctcaaggaagttccaaaccaagtgacatgccctcaagttcaaggatatccaatatggtcattgcacccccatgtacatacacaacatacatcgccacaatgaaatcatcaacatcaacatcaacatcatcttatctcaatgtcattatcaaaatcaacatcatctcatctcaatatcatcatcaacatcaacatcatctcatatcaatatcatcgtcaacatga

SEQ ID NO: 80672 - DNA, 276 bp, Glycine max
  Peptide Sequence Number=SeqID_172357
atggtgagattctacaatgatacatttatggaaccacatcctcctcaacagccagtcgctacaacggctatgctagaaccacctgcacctgcacttgctgatgtagacatgcctcgacaggcagtggaggcttgccaacggatagcagaaaggttggaacacttgctcaacatgaggatggttactgctagaactgaagcatacaccgtgatcgaggagtgcctgagaatcactaggggtgccactgagcaacagaatgtttatgttcgggggtga

SEQ ID NO: 80673 - DNA, 333 bp, Glycine max
  Peptide Sequence Number=SeqID_172358
atgtcgggggcaaggatgaggagtaaatctatactcccgttgggtttcgggggtggggggaatggggagtcggaggcgggggtgggggaaagggaagaatcaaaagaattctcagactgtgtcgttttgaattctttgacaagggagaagggagacacaaaagaattcaggtggttagtccttcgttcttttggaaaagggagaagagagacacaaaaagaattcagacgagaaccagaaaactttagaaagcttttggcaaaggaagaagaagaagaaattcaagaggatgttcaaagagattcaaaggatgtaaaagattgtaatcaatga

SEQ ID NO: 80674 - DNA, 390 bp, Glycine max
  Peptide Sequence Number=SeqID_172359
atggtgcctaagaattatgatcgaaagctggtaattttgagtgagatggataaggaagtcagtccaacgctgattgatctagtaggatgccccttctgggctagggtatataacgtgcctctaaatctcagaattcaaagagtggtagagagtattgaaaacatgctaagggagataaaggttaagatctcaagggaaaatataagagaaaagaaggaggaaattcaagtagaggtcagcgttgacaccacacacacaaaacctaaagaaagtgcacaacctattgaagaaatggcaggggcaagcttgagtggaggagaggaaggaaggggagaagttggagctaggagggaagaggaagatggagggagagatgatgcaagtccataa

SEQ ID NO: 80675 - DNA, 216 bp, Glycine max
  Peptide Sequence Number=SeqID_172360
atggataacagcttgaaggtaggaaaagatgagaggaaggagagggacatgaaatttaagcctcaaatgagcccactaattcaaaatcaagtccaagattttccactaagtgtgcttaggtgtcatgaggcatgtaaagcatgtaggacatgcacaaagtgtgactatatgatgtggcaatgcggtgtagcaagcaaatgctcacctcccccttag

SEQ ID NO: 80676 - DNA, 138 bp, Glycine max
  Peptide Sequence Number=SeqID_172361
atggaggagaagaaaaagaaacaactgaaggaagctgctaaatctggaagcacttacaccgtcattgattgtgatgacaaaaagctcaaaggtcaatcaaagaatgagtgtaagaaagatagattcaagaaagaatga

SEQ ID NO: 80677 - DNA, 463 bp, Glycine max
  Peptide Sequence Number=SeqID_172362
atggggggtgcagatggtgtgggagtggagatagaaaaggaagtcgatgataacgagacaatttctagggatggaccaagtatcccactatcgcctccattcaatttgtttccaatgtggtcgttttggccaaaagaaggatcactgtgtagaacaggtgggggtggagatgaggctcagtcagggagaatagtggacccaggcagaataatggaaataaatgaggaaggaagcagttttggcaagtggatgattgtccaacggtctatcatgaggaaaaaaggaaaccttacaaaaaagaaggaagatttgggtggaggacagataaaaggaaatgtatctaagattcctgttggtggcaataaattcgggattctggtggaaaataacaatgataaggagatatcattattggataatgggggcattctgactaaaagtgatgatgcagcacgtgcggcag

SEQ ID NO: 80678 - DNA, 1068 bp, Glycine max
  Peptide Sequence Number=SeqID_172363
atggaacgaatgttccctcctaagaagccttcaactatgaattcccatgacaggtccatgtgtgtgcaaggggactcagggcttgtcctcaccactgacccaaagccacgcctccgttggactgttgaactacatgaacgctttgttgatgctgttgctcagcttggaggacctgataaggccactcctaaaacaatcatgagggttatgggagtgaagggtctcaccctttaccaccttaagagccaccttcagaaattcaggcttggaaagcagccccacaaggatttcaatgaccactcgattaaggatggcatgagagcttcggctttagaacttcaaagaaatatcggctcctcttctgccatgattggccgcaacatgaacgagatgcaaatggaggtgcagagaagattgcatgaacaactagaggttcaaaagaaccttcagctgaggattgaggctcaaggaaaatacatgcagagtatattggagaaggcttatcacacactagcaggagaaaacatggccacaaacatgaagggtatgggagctcctctaggcaccactgaaatgggggtcatgaaggaatttggttctctcaattacccttcttttcaagatcttaacatttatgccagtggtgaccaacaacttgatggctttatgccatctaataataacaatgaaactttgtttgtgggtaagaagaggcctaattgcccctatagtggtagtggaaagagtccactgatttggagtgatgatctcaggcttcaagatttgggaacagcttcatcatgcattagtcctcaagatgaccctttcaaaggtgatcataaggttcagatttcaccaccatcaatggatagtgatcccatatcggagatttatgacacaaaaccaatgatactccatggagaaagtgtaagtgatcagaacaaatttgatgcatctatgaaggtagaaaggccttctccaaaaagatcaccacttcaaccagataggactagtcctatgatcaattctagttctgtggcacaaggtagaagctccccatttggttga

SEQ ID NO: 80679 - DNA, 405 bp, Glycine max
  Peptide Sequence Number=SeqID_172364
gtgattcggtcgcccatcacccgggcttttatagagaagtactgcacccagagacaggctcagggtgatgctccacaggccgcaggcgcgccaccaccacctcatcaggcttgcccagctgggtcgtttgacacggagcaatatttacggcatttggttcgccagcaggcagccaaccaccaggcacatgtacagacccatgattgtctttaccagatgagcctcagcatgcagagtcagggcttcgcttctttttcatgccctactccagaccagttcagggcagaggtcgcatggcccagggattggcccgaggcccaagcaggagaggcgtccccagaggctcccggcgatggagaggaggcccacgaggacgaggagatggtcgatttgcttgacttctag

SEQ ID NO: 80680 - DNA, 800 bp, Glycine max
  Peptide Sequence Number=SeqID_172365
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagcctgtctgactcagagacatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 80681 - DNA, 581 bp, Glycine max
  Peptide Sequence Number=SeqID_172366
ccgacaaggaaagtgtcgacgatactgtatgcaaaaagtacgacattagcaaggagaagtgggcccaatttcgtcagactcgcagagacccttcgcgggaggatgtgcgaaaaaaggcacagtccatccagaaacaaaacactgcccatcacgtgttgtctcgtgggggttatgaatatctagaaaacaagttgataaaggagaagaaaaagaaaaaagtggaggaagctgctcaatccggaagcactaacaccgtgattgatcctccatctcctatcagagaacacgtgaagaggaagatggcccgcaccaagaaaactggccaaatgacgtctgagacaacaaaggaaattgctgacaagattgattcgttggaagagcaagcctcacagggttcctttgtcgcccatggacaacaccctggtcgtgtgcgtgctactggagccggtgtcacgatcaagaaatactttggaccggctccaaggacctcctgcacgtcttcctccatgactcccgaagacttggagcagctgacacaaaaaatcaaggaccaattggaggatcaatcacagaaaaagtga

SEQ ID NO: 80682 - DNA, 1122 bp, Glycine max
  Peptide Sequence Number=SeqID_172367
atgcataaccaagcgcccatcaaccgtcgaaaatctacacgcatttacgtcggcaaggtgcctattggtgatggcgcgccgattgccgtgcagtcgatgaccaacacccgtaccaccgatgttgaagcaacggttaatcagatcaaagcgctggagcgcgtgggcgtcgacatcgtccgcgtttcggttcctaccatggacgccgccgaggcgttcaagctgatcaagcagcaggtcaacgtgccgctggtcgccgatatccacttcgattatcgcatcgcgctgcaggttgccgaatacggcgtagactgcctgcgcatcaacccgggcaacatcggcaacgaatcgcgcattcgctcggtggtggactgcgcccgcgacaagaacatcccgattcgcatcggcgtcaacggcggctcgctggagaaagacctgcaggaaaagtacggcgaacctacgccggaagcgctgctggaatccgccatgcgccacgtggacatcctcgatcgcctcaacttcgaccagttcaaggtcagcgtcaaggcgtcggacgtgttcctggcggtacagtcttaccgcctgctggcctcgcgcatcgatcagccgctgcatctgggcatcaccgaagccggcggcgcgcgcagcgggtcggtcaaatcggccatcggcctgggcatgctgctgtctgaaggcatcggcgacaccctgcgcatctcgctggcggcggatccggtcgaagaggtgaaggtcggtttcgatatcctgaagtcgctgcgcatccgcgcgcgcggtatcaactttatcgcctgcccgacctgttcgcgtcaggaattcgacgtgatcggcacggtgaacgcgctggagcagcgcctggaggatatcatcacgccgatggacgtttcgatcatcggctgcgtggtgaacggcccgggcgaagcgctggtgtccaccatgggcgtgaccggcggccacaagaagagcggcttctatgaagacggcgtgcgccagaaagagcgtttcgacaacgaacagatgatcgaccagctggaagcgaaaattcgcgccaaggccgcgatgatggacgaaagcaaccgcatcacggtcaatctgctggaaaaataa

SEQ ID NO: 80683 - DNA, 150 bp, Glycine max
  Peptide Sequence Number=SeqID_172368
atgaaggatgattttgttggtcaaaggaggttgttgtatgaagacattggatcattgaggtctaggttgttgtacgataattgttatgaaggcggtagttgtagttgtggacatgagggttgtggagatgatagttgtggtgaggaataa

SEQ ID NO: 80684 - DNA, 107 bp, Glycine max
  Peptide Sequence Number=SeqID_172369
atggaggccatgaaagagcaaatggccataatgatggaggccatgatgagcatgaaaaagataatgccaatgcggttgcaattgccgctaccagcgctattgctaag

SEQ ID NO: 80685 - DNA, 58 bp, Glycine max
  Peptide Sequence Number=SeqID_172370
atggaatatgagactgctccggcagagatgtcaccaatgagggtggtgccatcaacaa

SEQ ID NO: 80686 - DNA, 569 bp, Glycine max
  Peptide Sequence Number=SeqID_172371
ggcaaggatggacattctcaccctgggtcaaggtttatggtaagttgggattttggctcaaggcttgtagaacgactggacatgatatatgtcagggtgttggtttggccaacgtggtcatattggtgcgcatgatccgcactcgtctctttgcagcggcacgggtgaaatcttgccctggtatgcatagtagctgcgtgatagccacctcctctagttgtgctctcacagttggccctcctccagcatcagggggtgtggatgtggagcccactgaaagtgaggacgcgaagccctctaaaggcgagggggcatgcagcactctgaagtcgaggacgtgtagccctttgaaggcgagggcatgcacccctttgatggcgagggcgtgcggccctctgaaggcgagggtgtgcggccctttgaaggcgagggcatgcagccctttgaaggcgagggtgtgcggccctctaaaggcgagggcgtgcagccctctaaaggtgaggacatgtagtcctctaaaggtgaggacgtgcagtcctctgatggcgaggacgtgtggtcctctgaag

SEQ ID NO: 80687 - DNA, 161 bp, Glycine max
  Peptide Sequence Number=SeqID_172372
agttcgtgtgctcatcgaggtcttggtcaatggtcatgggcacggcgatggttggtgcgacggtggctagcgcaacagtagttggtgctgtggtgactggctggacatggaaggttggaagtgggaaaggggctagcaattcagatgtgagtgagacatga

SEQ ID NO: 80688 - DNA, 404 bp, Glycine max
  Peptide Sequence Number=SeqID_172373
atgcaggaacaatatgttcattatgatgctgaagagatgtttatgcggtgcatgataagaatgcatttacggacacgagagcccggaaaatcatctctccttactgcgcattcgggggcgcagtgccccatgtgtgcagttaagaagatgatatggatctttcgacttcccacgacaaaagacgagacccacatacaacgcatgtgtgacaacatgatgcagatgcgcaaaagcgcaacagggggatgcatcgagtccccagtggagtcgccaactgtcgcaacgtgcccttcgcgggcgagcgaaggcgaggctcacgggtgcactttccaaaggaggaaagatgcgtggagtcgccaccaacgtttatttgtggaaaacgtcggaaaaaccgaaggaaaccg

SEQ ID NO: 80689 - DNA, 1278 bp, Glycine max
  Peptide Sequence Number=SeqID_172374
atggtaagcatttgggacctagctagggtagaagtctccatggaaccaattgcctccctcgcccagtattatgatcagccgttgaggtgcttcatctttggggacttccagctatcaccaatggtggaagaatttgaagagatcctaggatgtcctctaaggggaaggaaaccatacctcttctcagggttctacccctcattggccagaatatctaaaaaagtccaaatctcggcgcaggaattagaccgccaaaagcaagtcgaaaatggggtggtcggaataccgagaaaatgtttggaggcaaaagcaagaatcttggcagatacaggcgagtggaccccgttcatagatattctcgcactgttgattttcgggggagtcctctttccaaatgtggatgggttggtggacctggcagcgatcgacgcttttctcgcctatcacaaccacaaggaaagcccagttgtcgctatgctagccgacctatatgacaccttcgaccgaagatgtgaaaagagcaatacaaggattgaaggaagaatcggagttcttatttcgtgcggaggatttccaaatgttcccttgttggggacgaggggttgcatcagctacaatctcgttcttgctacaagacaacttggctaccttatgagagggtcgccactagaggatgagctcacgcctgtcatttcacgaggtttcaataagaccaacatggagacacttcagaaggtccgcaaggcatgggaggtggtaaaaaagaaggacaaagagctcagaggtaataacaatgggcccattggtggctaccatgagtggttgaaagcccacgtgcaaggtttggattggctcccaagtctgagaactgctaagagggagaaagatgaggcaccggaggaagacgaagaggtgcaggcccttaggacggaactcaagcaagctcaaacagtcaaagaaaggttcaaatcagcagctcttaaaatccgaaagaagaatgccgaactaagagatataaatatagctaccaccaaggctttggaacaagagaccaagagggctcgtagggaagagcacggccggaacaagttccgaggggctctgtggggtagtaacaacgagcttaaactccggagggaggaaagggaccaatcgcgaaccaacatgttagccatcatcagcaagtaccaagaggaactaagtctagccacgggccacgagcatagggtggcggacgagtatgcccaagtttacgcagaccaggagactagaggaagg

SEQ ID NO: 80690 - DNA, 606 bp, Glycine max
  Peptide Sequence Number=SeqID_172375
atggagagaagtatgatagatgctgccagtggtggagccctaggagacatgattcctgctaaagctagaaatttaattgagaagatggcttccaactcccaacagtttagcgccagaaatgatgctatagtcattagagaagtgcatgaggtagccacaaactcatctacatcatctgaaactaagaagcttgaagcttatgctgcaaacatctacaatagacctcctcaacctcagcaacaaaatcagccaccacagaacaattatgacctctccagcaacagatggtcgaatccttcacaacaacaacaacaacaacaacagccttattttcataatgctgctggcccaagcagaccatacgttcctccaccaatccagcaacaacaacaacaacaacaaccccaaaaacaacaaacagttaaggctcctccgcaaccttcccttgaagaacttgtgaggaaaatgactatgcaaaacatgcagtttcagcaagagaccagaacctccattcaaagcttaactaatcagatgggacagttggctacgcagttaaatcaacaacagtcccagaattctgatagattaccttctcaatctgtctag

SEQ ID NO: 80691 - DNA, 588 bp, Glycine max
  Peptide Sequence Number=SeqID_172376
atggcatgtccattggcatgtgttccaaaggatccctcatgtacctccaccaacatttgctcagcctctctggcatccacacatcgaagcagtaccacgtcatggttcctcttgtataggatattcccactcaggaagaaaccagtctccaacttcacaacgttcttttgtcgttatcagaggcctcttgcgggcttgccacgacatctgaatttgatgtacaacaaatcttcgtgtgggcttaaatggaacatggacgctagcatggcaagagcgcaccaatttatggtctttggtctctcattcacccttcaactggtgaattaccaaggccgagtccccatataccttgagcaacttgaccttgaagtcaattgccgcttagatcccaagggcatacggctcatacttagctatgttgtttatgtagttgaaacccaacctagccatgaaagacgtgccgtcaaaccacacaatccatttgtccctgtcttcatcctctatttcttcttcgaacaaggtcatgatgtcataatctgggaattctggatgcataggttgatagtcattgatggactgttgagccag

SEQ ID NO: 80692 - DNA, 459 bp, Glycine max
  Peptide Sequence Number=SeqID_172377
atgccatccaaagctgcaatttttgcttggagactcatcaaagatcgattgccgactaaatctaatttgagaaggagccaaatagagataaatgacagcaaatgtctactttgcagaattcagcaggaggatgcagcccatctctttttcaattgtaccaaatctctagccttatggtgggaatccttagcgtggactggaatagttggggcattccccataatccctaggtaccattttctgcaacaccaaaatgggatgaatggagggaaaagaaacaataggtggaaggatgttgacgaagagaaggacaaggaagaacaaaataaaaagaagattaaggaagtgtcacatgaatgctccttggtgaacaagcacaaggccatttggatgacaaagcctgaggagatcacaaaggaggagtattctgctttctacaagagtctcaccaatgactag

SEQ ID NO: 80693 - DNA, 207 bp, Glycine max
  Peptide Sequence Number=SeqID_172378
atgacaagggctagagcaaggaaagccaaggaagctcttcaacaagtgttgtccatactattgaatacaagcccaagtttcaaggagaaagtccaaggttgtgttgaggaaaaaagcccagagtttcaagaatctcgggatttgaggtcaaatccttttcaagggagagggaatgatgcaatcctaccccgcaagagcattggatag

SEQ ID NO: 80694 - DNA, 606 bp, Glycine max
  Peptide Sequence Number=SeqID_172379
atgaaagataagagggatgaggaagaaaaactagaaaaacaaaagaaaaagaaggatagtaaggccttgtcttcaaagggcaagggaaaggaaaaagaggaaaaggattcttccaagaagattgttaagaaggaaaatcattttgcaacaaaaggtgatattaaaataacactccttcttaaacaatctttctaccttctcctatcaagggaaacatcccttagcaccgccatacctcttgagcttgaggttattccgcaagtaaaggagttgttggatgagggtttggttcgcaagagcttaaatccttatgctttgttggtgcctaaaataggtattattaggcaccaaatccctgataggtggaataatcaacatgaaaataaagaaaaaggtatgttttattccattactttccttaactttttaaatagtgatcaagggcttcccatggaccctaagagaataaaggtcatttttgagtggcctactccaccaagtgttgaggaaagaattaatgagtttcaagaacctctggatttgaggtcaagtccttttcaagggggagggaatgatgcaatcctaccccccaagggcattggatag

SEQ ID NO: 80695 - DNA, 414 bp, Glycine max
  Peptide Sequence Number=SeqID_172380
atgacccaagagctggtagcctgcgaagacaccttacggttatccgcacctcgtcattcatctgcgccctttccggagatgtcagcatcttccggtggagactttttcaagtctcacaagttatctagaactacacacagtcgtgtccgatggcacgcagagacaaattatggtcattctgcacccttttgtcatccagaggcgacgggcccgatgacatgcagagacaaattatggtcattccgcacacctttttgccattcagacacagttgtgtccgatggcacgcagagacaaattatggtcattctgtgcccttcgtcaatcgcggccgacaagcccgttgatacgcggagatttacatcatctttcgcgctcacaagatctgtcatactgacttttgagtcacgctaa

SEQ ID NO: 80696 - DNA, 843 bp, Glycine max
  Peptide Sequence Number=SeqID_172381
atggagatgaagctagagcttagacaatacagtgtcatggggcatatgtacgcctatcacggctacgagaaatttatcatggcaaatatgagtcaaagtggaagctacgcatggggagctgccgccttagtgcatatgtacgataatttgaatgatgcttgtaaaagcggcagtagacaacttgttggatatatcacactattacagcattttccatctattgctaaggcttttacaaattcagagtatgatgaaaggtcaccatgtgcctaccatcgaacctctacaaaggcctctacgaaggcattaccaacatcgatgtatcagaagcgtctagatcgactgacgactgttgatgtttgttggatgccttacgatgaccactgtgcagttcgagagtttgacctcatttcatgtttttctggacgttcaaggttatgcttcgaagttattgacgacaaatggatgcatttctttgactaccttgcaccggtgggccagatttgtgttgttcttggacaatgtgcaccgaactacatggactggttctatatgattttgcatccattcatgaggccgacacagcccggggatccacccagacatccacttgtcatgcaagatgagacatatgtggaatcagatatgcctgagtacccggtggcgacagcagctatggaggaagcacctacacatgcatcttctgatgtggagcagcctagacatgcagtggcttgccatgcaattgcagaaaggttggagtggttgcttaacctaaggatagtgactaaagccacagaaacatacgatgtcatgcaagactgcctaaggattgctaggggg

SEQ ID NO: 80697 - DNA, 498 bp, Glycine max
  Peptide Sequence Number=SeqID_172382
gatggtgtgattcgctctaaggtgcatggtatttctatgatcattgatcaatctctattcttttcattaactaaattacccagtcaaggtgaaccttttgagggcaccattgttgatgattggaagtttgactattctagtcatgatgctcgtcgtatggtctgtaatgaccaggctgatatgactgtcaagcgatcttttgccattggtgctggtgcagtaacttcatttggttaccgtaaggatcgggatggacaatggctgaagaaggacgcgctacctccgcaagacgagcgtactccctctcctcctcagcgagatgattcctcagcccttatgaatgaagttctttcagaattacggggcctccgcacctatgttggcgaacgctttgattatttggatggttgctttgaaggaatggatacctgtatcacacagcttgaagaggatgtgacttatcttcgtcggtgcttcgaccttccaccaccttcctag

SEQ ID NO: 80698 - DNA, 594 bp, Glycine max
  Peptide Sequence Number=SeqID_172383
gaggaatatggccgagagaaattccaaggagcattgtggggtagcaacagtgagctcaagctccgaagagaggaaagagaccagtcacgggtgcatggcatgatcttaaaagaagagttagctgcgtgcgcaagatccaagaggagtttggctcaacacttggaagccacggagcaaagcatgctagttatcatagggcaatacaaggaagagttgaaccagtctgtggcccatgaacaaaagctagtggaggattttgcacaagtgtacgccgaaaaagaagcaagatggagggtgattgatgcattgcatcaagaagcgactatgtggatggataggttcgccttgaccttgaatggaagtcaagacctcccgcgtctattagccaaagcaaaagccatggccgaagtggacgacatgtccgaaagggcatcttcagatgtattgccgaaaaatgggggcgtattctgcggacgaaaagttgttggtccatttctttcaagacagcttggccggagtagctgtagcatggtataccaatctggaagtttcccagatccgatcatggaaggacttggcaactgccttcattag

SEQ ID NO: 80699 - DNA, 288 bp, Glycine max
  Peptide Sequence Number=SeqID_172384
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggggtgtcgcaacctacccttcggcgggagggcgacccgagggctcacgggtgcgtcttccaagaaaggaaaatgcacagagttgccagcaacattttttcgaggaaaacgtcggaaaaaccagaaaaaacatggtctaa

SEQ ID NO: 80700 - DNA, 460 bp, Glycine max
  Peptide Sequence Number=SeqID_172385
ggtagcacccacaagacacccagtggactcggaggagcccaaaagggccctggggtttccaactctggttacgggcctctgtcagtcctacagggcgcccgtccccccagcaagttcatgccatcgtggcataggggtagcgcccacaagacacccagtggacccggaggatcccaacagggccctggggtttccagctctggttacagacctctatcagtcctacagggcgcccgtccccccagcaagttcatgccatcatgacatagagaattccaatagggtcttggagttgccagctctaattattggcctctgtcggttctacggggtgtctgtcgcccccagcaaggtcatcaggcccctactaatcgagctttcatcaagaagaactgcgcccccaggcaggcgcagggcgaaacaccccagcagcctggggacggccgacaacgggcaatag

SEQ ID NO: 80701 - DNA, 357 bp, Glycine max
  Peptide Sequence Number=SeqID_172386
atgggttctcaacctgcctcccctcctcctcctcctccttctcctcctcctcctcctcctgctccttcggacgcatcggctttgccgtttgccacgaagcggacacacaaagcctcacgtctacgatcattgtctactagaccacctggtgttgagagaccagtggtccatgttgatcctgctaccggcaagaccgacggtccccacaggaagaaattaagaatatatttggggattgtggcgcgtgataaggtggacgtcacctacgagaactggaagaaggcggaatttgatatcccagaggctacttacagtaggatgaaaaggaagtcacttcagattgtgggcgagagatag

SEQ ID NO: 80702 - DNA, 153 bp, Glycine max
  Peptide Sequence Number=SeqID_172387
atgtccagaaagagtgtgccgggttacgagaagaaaatgcagctaccgcaagagcccttgaacgggaaaccaagagggctcgcaaggaagagtatggctgagacaaatttcgtggagctttatggggcaacaacagaaaaacgccataactaa

SEQ ID NO: 80703 - DNA, 393 bp, Glycine max
  Peptide Sequence Number=SeqID_172388
atggcacaatgcttcctcattctctccttcctcgttctctccttcctcattctctccgtcggtggcattcttccgtgcacaagtgcttcgccgttgttcttcgtttcgttgcgcctggttaggtccggtgaaggtgaaggtaccagtgttcagcgttgcggtgatcgttggcggcatatgaggtacgcatttgcattgggtgtgcattctggtgtaccgcaagtcgtgcggatcaagttgatccgcaatctacgtacgaatcaacttgatcagcatgttaatttgaaagatacagatcaagttgatacgcaagcaatctacatgcggatcaacttgattcgcaacttacctgcggatcaacttgatccgcaagagacttacggatcaagttga

SEQ ID NO: 80704 - DNA, 1371 bp, Glycine max
  Peptide Sequence Number=SeqID_172389
atgtgccctcattgtgttgttcaagatctgacgagactgcgtagtagcgatagtgttgttctcgtggcacgccctcaatatggaagctggcaaaatgcaagattgctcgccaatgatggaagagcagttgataacaacattgttttggtaaatattcctcagaagcactcttcaaaagtaaaacaactccacagaggaaccaatgatattgttcggtacaaagagaccaaatgggcagtagaatgtgcaaaagctcaagcagaagctgagctttccaatgctaaacagatagtgaaagatcttttctctatgattggggaatctatgtacaaggcaaaagctgaaatgcgagacatagcaccactaaagaagtatgtcaaaccgagaaatgatgataatcagtattcacaagttatgacagaattggaacatgctaagcgggaattgttccaacttaagcttcatgtgggttctgttttggaggagaaatttgaagaacaattggtggttcaattggacaaaatggatgctttgaatgaacttagagacattgaaaaacttcaaaacacaaggaacaaattgaaagaggccattgaagcgatagatgaggcaaaagagctcgaaatgaaattggccacaacattgtctgatattgatatgttgaagaatgagttcaagtttcctacaaaagaagaaatagaggcagcaaagaaagacttggcttccattacaaaacaaggttttaagtttatggcctctatagatgtcacaagaaatcaattgaagcatgtgagtgcagccacgattcatttaaagaacacgaaatcgaaaattggtgcaaaagttcgaaacctcagttacaagctcttgagaccaaaatctaaattagaagccgtgtctgctgcagaggaaaaggccaaatcaatagtgagtaacttgacacaaactcttgataagctcaagtccaaaacaaaagcagcaaaaaaagaaaaagaccttataataaatggagaggttgcagaaatcaaagaagagattaaaaaggccttgttggagataaaggtgagtgaggaaagatttcaaggtgccatgcaggagctacaagcagtgaaatcatcagaagctttaaccttggagaagctcaagattcttagggagaatgccatgaaagacagaattagtaatgtaacaaagccatgtaacaagggtgactggatggtggcctttggcatctgggaatttgaccctcttaagctaagtaatccattccctgataatagaatttcagctcacatttggcagggctatgaaaataaggtagtggcctctaaaatccaaaggtttgttacacagaagctgccttcgatatag

SEQ ID NO: 80705 - DNA, 378 bp, Glycine max
  Peptide Sequence Number=SeqID_172390
atgaccacagattcacctccactccttatgttcccatggacccggtggagtcgccaactatcgcaacctacccttcggcgggaaggcgacgcgagggctcacgggtgcgtcttccataggaggaaaatgcgtggagtcgccaccaatggttattcgaggaaaacgtcggaaaaaccggaaaagacgttgtcgcaacctacccttcggcgggagggcgacgcggggctcatgggtgcgtcttccatgaaaggaaaatgcacggagtcgccaccaacgtttattcgaggaaaacgtcggaaaaaccggaaaagacgtggtctacgaactttgagtgtgaaaggttcgggagttgtatttacgcacggggaaaggtattaa

SEQ ID NO: 80706 - DNA, 888 bp, Glycine max
  Peptide Sequence Number=SeqID_172391
atgagcaaaggccagtgtgttcatttgcaccctttccggagatgtcaacatcttccggtggagactttttcaagtctcacaagttatctagaactacgtaggtctgagttcctcattggaggatacgtagggagcaagagcattgcttttgtcggccgtcccacaatctctgtcatactggccctgaggtcatgtgacatgcggagacaaaatttggtcattccgcaccccttcgccattcagacacagtcgtgtccgatggcacgcagagacaagatttggtcattctgcaccctttgtcatccagaggcggcgggcccgatgacatgcggagacaaaatttggtcattccgcaccccttcgccattcagacacagtcgtgtccgatggcacgcagagacaagatttgtttattccgcacccctttgccattcagacacagttgtgtccgatggcacgcagagacaagatttggtcattctgcaccctttgtcatccagaggcggcgggcccgatgacatgcggagacaaaatttggtcattctgcaccctttgtcatccagaggcggcggacccgatgacatgcggagacaaaatttggtcattccgcacccctttgccattcagacacagtcgtgtccgatgggacgcagagacaagatttggtcattctgcaccctttgtcatccagaggcggcgggcccgatgacatgcggagacaaaatttggtcattccgcacccctttgccatttagacacaagttgtgtccgatggtacgcagagacaaaatttggtcattctgcaccctttgtcatccagaggcggcgggcccgatgacatgcggagatttacatcatcttccgcactcacaagatctgtcatactga

SEQ ID NO: 80707 - DNA, 273 bp, Glycine max
  Peptide Sequence Number=SeqID_172392
atgaatgtcgatatggaggcattgaaggatcaaacggcttccatgatggaagccatgttaagcatgaagagaatgatggacccagggctttcttctaatgctcttttaaaaatgaaatgcgaatgtcccaaatctcattttgtggttatgagaaattctatcagcatgccttcattctctagtttcactaattgggttcctgctagtggccagtcggatgcccttgggcctattaggaagcttagggctgaagtaactagctcgcctgggtga

SEQ ID NO: 80708 - DNA, 1115 bp, Glycine max
  Peptide Sequence Number=SeqID_172393
tactgatgctatcaacaaccctagtagtatttgttcttcttcttcttctgcatcattgccttatagttccggctacaagaaacaactagcctctcctcctcctctagcttcttcatctggcaccagaataagccctgcacttgttttcatctttgtcattctagcaattgtgttcttcatctctggtctccttcactttcttgttagattcctcataaggcacaggtcctcttcttcatcatcaatttctcagtctaataggtaccctgatgacatgtctgaatctgatgatccttaccagaggcagctacagcagctcttccatctccatgactcaggcctggatcaggccctcatagatgccctcccagttttcctctacaaagacatcatagggttaaaggagccatttgattgtgcagtgtgcctttgccagttctcagaacaagatatgctgaggctgcttcccctttgcaaccatgctttccacattgattgcatagacacatggctgctgtcaaattcaacctgtcctctctgtagagggagtctttatgatccaggctttgcctttgaaaacccagtttatgaccttgagggtgtgagggaagaagatggggtttccggaagtgttcctggtgagggtgtttgtgacaacaagcatgcagaaaaccacacaataagtgggaaaagggtgttttctgtgaggcttgggaagtttagaagctcaaatattgttgagggggtggaaacagggggtggaggtgagagtagtacaagtaatttggatgttaggagatgttattcaatggggtcattccagtatgtggttgctgattcagatttgcaagtggctttgtgccccaatagaggtgatggtggaggtgttagtgatagcagtatgagacaattgaaagggagattgaccaattatggaaattcttccactgatgatgttgaggggaaaaaaatcaatattactaggaaaggtgaaagcttttctgtttccaagatctggcaatggtctaagaaggacaaggtttcaatttcacaagaaaaccatttgggtggttctaatgtcactgcagctctgccgtgggtgaatagagctctag

SEQ ID NO: 80709 - DNA, 228 bp, Glycine max
  Peptide Sequence Number=SeqID_172394
atgacttggactctaggattaggtctttcatgcttactggggttagtaattgggattgcagtgcgcccttacatcatccctaatacagaaaggtaccaatccttgccgttacatcgagacatggaagcgttgcctaaccagtctggggaagctagctaccgatgctgttcttcagcaccaaaagcgcaattgctagctgcagttgctcctctgtttacacaatcctga

SEQ ID NO: 80710 - DNA, 891 bp, Glycine max
  Peptide Sequence Number=SeqID_172395
atgcccgtgtgcgtctcttcatctgcgccttcgaaggttctagatctagaagtagctgtgaacaaagaagaataccaagtgtttgaagaactcgggcgaggccattttggcactgtgtttcgctgcttccaacatcgaggactgcggctgcatcaaaatggaggccttggaggttggtggcgtggtggtggtggttgtcgccagcgaggagacggaaaagaagcagcccctggagaagaagtcattgtcatagtcgtcggtgaagaagttgcggagtgcatcgatccggcgaagaagaaggagctggacggcctacgcgccgagatgccggtggcgctggcggaaggagatcgcaaagctgtttccgaacctgttcgggcaaccgtcggcggctttggtgccgagcgattcccacgcgccgcctgtaaattagaagctgaagattggcgtggttctatccggtggtcaggctcccggcggtcacaatattacctgcaagaccttgcagaaggaagcacattgtatggtttcaggggtggtccagctggcatcatgaagtgcaaatacgttgaactcacctcagactatatttatccttacagaaatcaatttaaacaagctgaagaaacagtgcaggagctagacttgggcggccttgttgttattggtggagatgactcgaacacaaatgcatgcctccttgctgagcatttcaggagtaaaaatatgaaaactcgtgtgattgggtgccctaaaaccattgatggtgatttgaaatgcaaagaagttcccacaagttttgggtttgatacagcatgcaagcttggtgtgcatatggaatatccaggggcagggacaagttcaaacacaagggtttggagctgggcttaa

SEQ ID NO: 80711 - DNA, 333 bp, Glycine max
  Peptide Sequence Number=SeqID_172396
atggctggtacattcttccttttgaaaaagcaaaatagtttagagattatgaacgtcattaatttagggacgccacaattttcactctcatcaagcaagtcggatatccagtatgaccacatatcgacctctactccctatggcttagacaaacccagaaaattcctaggcaaatacaacgaatataggcaacagggtgggggactactagcgataatgcatcacaaaaagagaaaaactcttaaacgattttcactctcattaagcaagtcggatatccagtatgaccacagatcgacctctactccctatggcttagagaaacccgggtag

SEQ ID NO: 80712 - DNA, 708 bp, Glycine max
  Peptide Sequence Number=SeqID_172397
atggctccaaagaagcttcttactaaaagggctaggaagaccaccacaggggagggatccagtgcatccctgcaagcagagagtgagtttgacggacaccacttccgaagcgaggagcatcagtgtcgtttcaaagcgatcaaggcgctccggggccaatggatcccctatgatgaagatgctatcaaccaattcctagggtatccgttggtcctagaggaggggcaatgttgtgagtacaccgaaagaaaaagccaggtctcaggttttgatgaagagatcataggccagctactgtgctccccgggacaggactttgcacggagcgtgacgagaaggcgggtgcagatcatgcataatagcatgaccaccttgacccagatctggatgacgcttctgctcggcaacatcctacccagcattgcaactccgagacacctagtggacccagaaaatttcaataggacactgggatttccaactttgatcacagtaccacatgccaagacaagcacagcagccggggtaggaccagcggcagcagctggccgcagacgctccaccgccacctctatagcatctctagagtccatctcggctcacatgcctaattttcaggcaggggcaggtcccacagaggcctcaagggatgaaaacaaagctgaggaagatggagacatggcagatgtgatggatttcttcctttga

SEQ ID NO: 80713 - DNA, 407 bp, Glycine max
  Peptide Sequence Number=SeqID_172398
atgcgacctcgccggaaagcaccgaaaaagggcgagagaagagctacctcgccgaaaaacgtgtggagggacagtgctgacctcgccagatttaaaccacgtcgaaaaaaagcgagaggagagaagtcatccgtcgacgttcagcacccgtcgtccgtcaacggtcgtgctgggagaagcagtcgcgtgaacggggaagggattttgttctctgtagaaagtgctgttgacgaaatcaagaaggacgaaatcaagaaggacgaaatcggaggaaaatggctctttgctacgcttcctcttgatcttgggttaggggagggaaggggaagcgagtttgacttggtcaaacttgaggttgtctctgatgggttgtttgaggtaatcgatgatgatgtggttttaggcat

SEQ ID NO: 80714 - DNA, 240 bp, Glycine max
  Peptide Sequence Number=SeqID_172399
atgacagcggaatggagaaggaagaaagagaggaaaagccacttcaaggagaagatgagtctagaagaagctcaccaccataggaggccatggataagagcttggaggaagaaggagatgaatgaagggagaggaagagaagagcacgaaattttgtgctctaaaagagctctgaaatctgaacccactaatccaagatcaagtccaagattctccactaagtgtgcttcggtgtcatga

SEQ ID NO: 80715 - DNA, 390 bp, Glycine max
  Peptide Sequence Number=SeqID_172400
atgtcgcaacctacccttcggcgggagggcgacgcgagggctcacgagtgcgtcttccatgggaggaaaatgcgcgaagtctccaccaacgcttattcgaggaaaacgtcggaaaaatgggaaaagacgttgtcgcaacatacccttcggcgggagggcgacgcgagggctcacgggtgcgtcttccatgaaaggaaaatgtgcggagtcgccaccaacgtttattcgaggaaaacattggaaaaaccggaaaagacgtggtctacgaactttgagtgtgaaaggttcgggagttgtatttacgcacggggaaagggtgtttcccttgctcctacgtattcctcaattgtgataaggaaatcagacctacgtagttcttctgagaactaa

SEQ ID NO: 80716 - DNA, 625 bp, Glycine max
  Peptide Sequence Number=SeqID_172401
aggactgcaagtcctcaccttcagagggcttcacgccctcgccttcaaaggactacacgtcctcaccttcagaggacctcaagtcctcaccttcagagggcttcacgcccttgccttcagaggacaacacgtcctcaccttcagagggcttcacgcccttgccttaagaggacaacacatcctcaccttcagaggactacacgtcctcgccatcagagggctgcacgccctcaccttcagaggactacacgtcattgccttcaaaggactgcacgtcctcacctttagagggctgcatgccctcacctttagaggactacacgtcctcgccatcaaagggctgcacaccctcgccttcagagggctgcacgtcctcgccttcatagggctgcacgccctcacctttagaggactacacgtcctcgccatcggagagctgcacgccctcaccttaagaggactacacatcctcgccatcagagggctacacgccctcaccttaagaggactacacgtcctcaccatcagaagactgcacgtcctcaccattaaagggctacacgccctcgcctttagaggactatacgtcctcaccctcaagagaactgcacgtcctcgcctttag

SEQ ID NO: 80717 - DNA, 111 bp, Glycine max
  Peptide Sequence Number=SeqID_172402
atgccaaaggaagtgaaatcttatttctctcctctttcaaggaaatcaaagtgcaccggagagaagttcctatggagaaagatacaagtcttcctatggagaaagcggtaa

SEQ ID NO: 80718 - DNA, 684 bp, Glycine max
  Peptide Sequence Number=SeqID_172403
atggaggccataaaagagcaaatggccacaatgatgaaggccatgatgagcatgaagaagataatggaagccaatgcggttatagttgccgctattagcgctgtcgctaaggtgaacccgatgctcccatctggcctcaagcaaatgaatcatccaacctcaaatatggtaggcaaagatttgggaagtacggatgaccccatgatgtgcaaattcaaaacgagtacgccttcccatcatatggcttgcctcccaactatacaccacccaatgtggcatacactctcaatgaaaatctcaataactccactccgatactcattgagaaccaataacctcatcaggcacatatctctcaaaccatggggggagacacatgaaattccccaccacaatctagctgacttcgagccttggctcggatatgccactgaagggaaagcagttggtggtataccctttgaaaacactttggagggccctcagtttcgcccacaaccacaaccattgcattttgcggtgggaagagcccctcctgctatggccgaaaagggaaaggcggatcatctaaaggaaaggctcagggccattgaaggaggtgaagattatgcctttgctaacctagaaaagttgttcctaatacccaaacatggtcattcccaagttcaaggtgctggactttga

SEQ ID NO: 80719 - DNA, 548 bp, Glycine max
  Peptide Sequence Number=SeqID_172404
cactggggccagatggtaagccctcccgtatcgtagttatctacacgacggggagtcaggcaactatggatgaacgaaatagacagatcgctgagataggccaccacttcaagaactctgtagcaccgcctacatacctcgctctgctaatcctgttaccagtggctgctgccagtggcgataagtcgtgtcttaccggcgccacgcttcccgaagggagaaaggcggacaggtatccggtaagcggcagggtcggaacagagagcgcacgaggagcttccaggggaaacgctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtga

SEQ ID NO: 80720 - DNA, 519 bp, Glycine max
  Peptide Sequence Number=SeqID_172405
atggcggaaaacctccacggatttgcttatggaaatgtcacggacgagttacggaagcgtctcgacttggattttcttcacggaaacgattttttcactgatttcaaaaaaataggggaggagctagccacccagctcgcccaggcaagccaagttacttcctccataagcaacctccttctggaggaacatcttggaaggcccaaggtgccaagtacctcgaagcggtcaaacaaaggttgcatgccatcaaacaatggtccccggacgaaattagggtatgacacaacaagtgcaaccaacttggtcacatcaaagaaaattgtccctcaatcgagcaatggcctgagaagaatgagaagaaaagtcatgaagaaagaagatccaagaaggcatatattgcataggatgacaatcactcatcctatggttcggagaaggagatcaaccttctatccaaggactatgagagcgatgacaacatctctcaagaagattaagcaaaaagcaaaagtctga

SEQ ID NO: 80721 - DNA, 537 bp, Glycine max
  Peptide Sequence Number=SeqID_172406
gtcgactctagaggactcggtcgttcggctgcggcgagcggtatcagctcactcaaaggcggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggattagcagagcgaggtatgtaggcggtgctacagagttcttgaagtggtggcctaactacggctacactagaagaacagtatttggtatctgcgctctgctgaagccacagattacgcgcagaaaaaaggatctcagagatcctttgatctttttctacggg

SEQ ID NO: 80722 - DNA, 108 bp, Glycine max
  Peptide Sequence Number=SeqID_172407
atgagggaagatgatgataaggatgaggaagaggaagaggatagtgttggatcaagtggcctcagaataattaagaagggggttgaattaattattaatgtgtcttga

SEQ ID NO: 80723 - DNA, 315 bp, Glycine max
  Peptide Sequence Number=SeqID_172408
atggcagaatcatccaagaagcaaaaaggatattcctccaccaccgctgctgctggccaccgccgccaaggaacctctagagacccacccgcaccagttcctccctttcattcatctcctcggccatctacattattctcctcagttgatcagtgtcaaaggtctttctctattggtgctggtgcggttacctcctttggttaccgaaaggacgttgatggtcagtgggttcgcaaacaagacttgcccctgcctattcctgaagaagtaccccatctcctccaccacaacggggtgattccacttctcttctga

SEQ ID NO: 80724 - DNA, 1056 bp, Glycine max
  Peptide Sequence Number=SeqID_172409
atggcagaatcgtcaaagaaacgaaagggttcttccgcctccgcttcggcttcaagagctcatccttccggagccactagcgcatccacagcaccaattccaccatcattgtcctcttccccagtgttttcttccgatgaacagcagaaacggtactccaatcttttctcatctcattccattatcgaccctaagtttattgatatggaattcttttctgctgaaacctttgattgcattcaagcctttcagaacttatgtcttctaccttttatgtcattacaattgcctatttatcctgaattggttaaagctttttattgtaatcttgaaattcaggacagcactctaatttctgaaatttttgggataaaaatggtcattgaccagtcccttttccatgacttaaccaaattacccagtgacggtgtaccatttgaaggtacactgaatgacgactggaaatttgatttctctgcccatgatgcccgccagttggtttgcaccaacaatgcggatatgaccggacatcttcttgccggagtttctgaggaagatctaattatcatgtgggcctttcatacagggcgtcaacttgactgggcacacttagtcagatatcgcatgcataaggcattgcgattaaatgctccactaccatatccacagcttgtcactctctttttccgccattttcaaattcctcttgattctaaaccttacgttccaatcaagagatcctttttaattggtgctgttgtgattgcttcttttggttaccgcaaagagcatgatggctcttgggtcaaaaagggtgctccacccgctgatgatgaaggcaaccaaccagttgaagataattcctctcttcttcgaaagcttttggaaaagttcgatggtcttcaaacttttgttggtgacaagtttgataatatggaattgcaagttgacatgcggtttgatgccatggaatcaaggatcaccaaagttgaagaagatgtctccttcatccgtacttgctttgatccaccaccaccgcctccatcatcctcttag

SEQ ID NO: 80725 - DNA, 270 bp, Glycine max
  Peptide Sequence Number=SeqID_172410
atgtcaatgacccgacaagcagtctgccggtcatattcgcctggtcaatgcaaaccatgtggcgggcatcatgactggagtaatcaaacttccaatcatcaaacaagggaatcagaccagtgttttgaaacacttgatagcaatcaaatgtttccccatcaaagaattctaggtcaagatatttgggatcaagaatttgacgagattgaaagagagaggagtaccggatacgctgttcatcagggatgctccgatggctccgggacgtga

SEQ ID NO: 80726 - DNA, 348 bp, Glycine max
  Peptide Sequence Number=SeqID_172411
atggttaaggaagagtgtaaggaggtaagtgtctcatcgaagagtttagctaagaaggaaagtcattttgcaataaagacaaacattaaagaaacttcccttcttagacaacctccacatcttctcttttgtaaaaggacacttgttagcactgccatacctcttgagcttgaggttattcctcaagtaaaggagttgttggatgagggtttggttcgtaagagcttaaatccctttgctttgttggcgcccaaaataggtattatgaggcaccacatccctatgataagtggtatgatgaatgtgttgagtggtggaaccctcttttgtaaaatcacccatgcatga

SEQ ID NO: 80727 - DNA, 417 bp, Glycine max
  Peptide Sequence Number=SeqID_172412
atggctacacaccctcgccttcagaggactgcacgtcctcgccttcagagggcttcacgccctcaccttgagaggactacaggtcctccccttcagaggactacacgtccttgccttcatagggttgcacagggctacacgtcctcaccattagaggactacacatcctccccttcagaaggctacacaccctcacctttagatgactacacgtcctcctcttcaaagggctacatgccctcgccttcagaggacttcacgtcctcctcttcagagggctacgcgccctccccttcagaggacaacatgtcatcgccttcagatggctacacaccctcgcattcagagcactacacgtcctcacctttagaaggctgcacgtcctcgcctttagatgactacacctcctcaccttga

SEQ ID NO: 80728 - DNA, 250 bp, Glycine max
  Peptide Sequence Number=SeqID_172413
atgagtctagaagaagctcaccaccataggaggccacggataagagcttggagaaagaaggaggtgttgtcgcaacctacccttcggcgagagggcaatgcggggctcacgggtgcgtcttccatgggaggaaaatgcgcggagtcgccacaaacgtttattcggggaaaacgtcagaaaaaccggaaaaaatgtggtctacgaactttaagtgagaaaggttcgggagttgtatttacgcacggggaag

SEQ ID NO: 80729 - DNA, 897 bp, Glycine max
  Peptide Sequence Number=SeqID_172414
cctcgcccttcagaggagttacacgtcctcgccttcagagggctacacgccctcgccttcagagggctacacgccctcgccttcagaggactgcatgtcctcgccttcagaggactacacgtcctcgccttcagaggactacacgtcctcgcctttagaggactacacgtcctcacctttagaggactgcacgtcctcgcctttagagggctgcacatcatcgtcttcagagggctacaggccttcgccttcagagggctccacaccctcaccttcagagggctacacaccctcgcctttagagggttgcacgtcctcgctttcagagtgctccacatctgcgcctttagagaactcaagtttcttggccacctccctgatttcggaggagggccaactgtgcgagcacaaccaaagagggaggctatcatgcagctactatgcgtatcggggcaagatttcacccagaccgccatagggagacgagtgcggatcatgcgcaccaccacaactccgttctccccctaccgaagtgtcagttgggatcgcgcccataagacacccagtggacccggagaagtccaacaggactctgggttttccaactttggttacgagcctctggatcgcacccgcaagacacccagtggacccgaagaagtccaacagggtcctggggtttccaactctgattacgagcctccgtcagttctacggagtgcccgtcacccccagcagggtcatcaagcccctattaacagggctttcatcgagaagtactgtgtccccagaagcgctactagaaggcaacctagaattggctacgaagaagctcaccacgaagcggtccaggaagggcattgtgacatcctggaatttctacctggaattttgtaa

SEQ ID NO: 80730 - DNA, 281 bp, Glycine max
  Peptide Sequence Number=SeqID_172415
agatcacgcctgcaatacacctagtgaacccggagaagtccaacagggttctggggtttcgagcgctgattacgagcctctgtcagttttacggagtgcctgtcacccccagcaaggtcatcaagccccctattaaccggctttcatcgagaagtactgcactccccaggcaggcgcaaggcgagacaccacaacagcctggggatggccggcagcgggaaggtagtgaaaataccttagatatgcatgtagaaagataccttggatatgcatgtatatag

SEQ ID NO: 80731 - DNA, 114 bp, Glycine max
  Peptide Sequence Number=SeqID_172416
atgggagagtggtgtttggtcttggatgtgcagcaggtggattttgtggccgatttaggggtgacctttgtggatgattgggccttcttggttagaaaggtggttgagtattga

SEQ ID NO: 80732 - DNA, 502 bp, Glycine max
  Peptide Sequence Number=SeqID_172417
catttcaccagttccctaatgagtccttgagtgaagcattggagaggttcgagttgttagatgcttcaataggagggaagataaagttgaaaacccctgaagaggctactgaattgattgagaatatgtctgttgtaccatttatggtgaggctcatgaatcaggtcattgcattcccattgaagagcacactcaggaagttcattacaagggaaatcaacagagacaaggatacaaccaaggaggattttcggggttccaacaaggccacctcaacaagggccaaatatttttcagaggaccaccaaactggaggagacactagctcagtttatgcaagtgaccatttagctgagaagtcattcagcaactttggagctaatatcaagaagaatcgcaaggaagagtgcaaagctgttataacaagaaataggaagcatgtggtggctgaggataaagatgttgttgctttgaagggcactactgataaaaaaagaatgag

SEQ ID NO: 80733 - DNA, 249 bp, Glycine max
  Peptide Sequence Number=SeqID_172418
atgccgccaccggtggccacgccaagaagctcaaaggctcctctcatctctccagtcagtttccttaacaagaatatggtggaaagaatctccattggagcttgtaggcctaggatcttcttcatcaatggattcctttgcttcttggaagatgaatggcagcggaatggagaaaggaagagagagaggagacgccacttcaaggagaagatgagtctagaagaagctcaccaccataggaggggataa

SEQ ID NO: 80734 - DNA, 216 bp, Glycine max
  Peptide Sequence Number=SeqID_172419
actcatcttctccttgaagtggcgtctcctctctctttccctttctccattccgctgtcattcatcttccaagaagcaaaggaatccattgatgaagaagatcctaggcttacaagctctaatggagcttgcaccaccaacccaaagaacgaacatgcatatgcccatttactaattaccatgaacatcaagacctcacgtattccagtgttttga

SEQ ID NO: 80735 - DNA, 135 bp, Glycine max
  Peptide Sequence Number=SeqID_172420
gatgatgattgggatgataaatttagaatgaaaatgaagagaaaacagggtgaggtgcaaaaaaataagttagataggtatttggaggatgatgttgaagatgaccacgctgagtttgacattttgaattggtga

SEQ ID NO: 80736 - DNA, 414 bp, Glycine max
  Peptide Sequence Number=SeqID_172421
atgttgcatgtctccaaatgttacatgtctccagatgctcccattcctgtacccactgatgaggcagttgtgtctctggaaaaaccacctcaaaagtcggatccggaggtcgatgatctgctttatctgatgatattgaccatcccaaagcttttcttgaggccttaccaagttacatgggatgccactgtgtttggggtctttaatccagacttcccactctacataaagcatgaagacctctccgaaatcgcacacggtgatcaatgtctcagtatatcagtgttacagttgtggattctgcatctgactgaaacaagtatgcgagtgggatttctgatctgtatggattcctcgagccacaatccatttagaggtttgggcaatcacagtttgagtctgaaagttacataa

SEQ ID NO: 80737 - DNA, 585 bp, Glycine max
  Peptide Sequence Number=SeqID_172422
atgggaagaaaggagcttcaccaccaagatgaaccttggataagaagcttggaaggatgcttcaatggaggaaaagaaagagagaggggggagcacgaaattgaaggactaaaagagggagagaagtggaactttgaagattgcatcaggaagcaagctgagcaggagacacaaaggtggaaggttgtttcagaaggaaaacatgaaagacaatccttaaaaagcatggttgttaacttgagttcaaggatggatgttttccctgaaatggagacttatgaaccagaaactgagattgaagaagaaaagagtatttctggggaggatagtccaactactcctatgcaaaatcaaactccaagtaaagtagaagctgatgcttttgaaaagatagcatctatcagccagaccttaactacaacaaaacagtccctatggaagatggatcttcatgctcttggaatatcctacaagatcaagaggctgaagcaacaacttgttcttgttgaaaggttaacaagaaggcaagccaatgacgagctagcagaaattactaatgatagcaaagttggtataaaggaatga

SEQ ID NO: 80738 - DNA, 174 bp, Glycine max
  Peptide Sequence Number=SeqID_172423
atgtcgcaaaaattgtctttggagatcacaaaatttcacaaggatttggaacagaaggataaaattttatctgcaatgttgaggaagtctaagctggacactgtagagaagcaaatgctgttgaaggaggtttcagccacaaaaaataacaggacaaaactcaaaggaacctaa

SEQ ID NO: 80739 - DNA, 534 bp, Glycine max
  Peptide Sequence Number=SeqID_172424
atcttgcttaatgagcttgtctcgctaagtgaaactccgcttttagcacttaaccaacatttcgcgccgagagaattacctcctcgggttggaattgtgcttagtgtgcttgtctcactaaacaagttgtctaaaggtgatccaacggttaacgagtccgagatcatggtcttactgaagcaggtttttgggtcgaacttgacatctcacgaatccaacacagggagcgtcactggtggattgaggagtgacgacggttgcactagggagtggggttgtcgcggttgcgagggagtagcactagttgctcatgaggtagtcatggttgcacgagggagtgacgttggtggctcatggggtggcaaggaaaggtggttgccaaacaagaagaaggaaaaggaagaagaagaagaaggaaacagaggaagaaaaagaagccaaaggaataaaaaaatgacggagctagggagtgaaaatggaaaaggaagaagaaggaatggaagatgtggagtttttttttatgagggtgggtga

SEQ ID NO: 80740 - DNA, 552 bp, Glycine max
  Peptide Sequence Number=SeqID_172425
atgtcttcttttctgtctgattctaccatcgatctaggtggcagtgactttgggggctcgactaagcaacccatcatggatcgagatgttatctcgatatgcagttcctcgtttgaggatactcgttatggtgcccctgatagcgaatcctcctcttcaaaaagggtgagggcctcacatcaaactagtgggagttcttctcgccctcgcgaaggggtgcgaccttctgttgctgtcggggagcctatcccgctcacgatgatcctccccccgtctgctttcgggggtgttaggagaagtagcagtggtggagatgtgagggtgtttcgtcacgtgagtgatgacttcccattcttaagggcggcgcttggtcgtccgcccttcttcttcatgtacagatgtttgtttgagtgtgctttgctggagcacttgaatgtggccccttcccaacttcacccaaatagttgggcgatggttcgggcttcgagattctatgtcctttcttcaacatccgacctagtgtgtcggtcttctagttcttctttcaaatga

SEQ ID NO: 80741 - DNA, 258 bp, Glycine max
  Peptide Sequence Number=SeqID_172426
atgatgataacaaaagatgatgacaaaggtgatgacaaaaagctcaaagaatcaagattcaaggatcaagcttcaagaatcaagatcaagattcaagattcaaggttcaagaactcaagagaagacttaatgaagataagtatgaaaaggatttttcaaaaactgagtagcacatggatttttcacaaaacatgtttaccaaagagtttttactctctggtaatcgattaccatattgctgtaatcgattaccagtag

SEQ ID NO: 80742 - DNA, 495 bp, Glycine max
  Peptide Sequence Number=SeqID_172427
atgggaacgaggggttgtatcaattataattgcatccttgccataagacaacttggctaccccatgagaggagcaccatcagaagaaagcatcacgcccttcatcgcatggggttctagtgaccccaatgtgaggatacttcaaggagtctacaaatcatggggcgtggtgcaaaagaaagacaaggagcttagggatgggatcgttggcggctatcataagtggttgaaagctccgacgcaagagtttgattggttcccaaagctaaaggtttcaaacgaggaagaggctaaaacccccaaggaaagtgaggaggtgcaagccttaaaggcggaacttgaaagagcacaagtggtcaaagaaaagttcaagacgacagccatcaaggttcggaaagaatgcgatgaactgagggacgtcaatgtggccatcgccaaagctttggagcgggaaacaaagaggctgagagagaccagtcaagggtcgaaagcatga

SEQ ID NO: 80743 - DNA, 1344 bp, Glycine max
  Peptide Sequence Number=SeqID_172428
ggaaaatttgacatccccgaaggtgacaatgcgaaaaagaagggtcaacaaaaagatgatccttctgctaagtatggtattgatgcagcaacttgggccgaatttgcaaaaaaagaaaatgttgatggctcgccataccccatttctaggcatgtcaagtggaagatgacccgcacaaagcgatatggtcagatgacctctacagcagcccaacaaatatcagacaaaattgcgagtcatgaggacatattgaacactgctattggccgaccggagcatccaggtcgtgtacgtgtggcagggacagatgtgacaatcagccagtactttggacaggtctcatatggctccaacacttcctctacatcaatcactcaacaacaattggctgaaatcatcggtaacttgaaggaagaatggaagaaagaagtagaagaagaaaacaagaacctacaggaagcgtggaggagaaaggtagaagaggaaaacaaatgcactttggagataattaaacaagagttgaaacaagcaatcaaattcaagttatcccaaattgcatcacaacactcacccccactttatccatcggatatacaagtattagctgcacgtgtgagcataaagaggagctgtgtagaagctgacacaaatccattaggtaaagagacttttgatgtgcatgttgataccatggacttgtatgtagttgttgagcagtctactcaactagtggtattgggaaaagtgcatgacaattcatccaccatacataatgtcccttatgtagatgatgcggttagggcagttggcacattcgtggggtggtcgacacatcttgtgaaacccgtatctgatgagtgcctgccgaaactagttaaatctgctgaaatggacaatgtagtggttgcagatgatccattgggagaattggtaaagaacttgtttgatattgaccaaaagtcaattgagttgtcgtgggatggggcgaaatttgggttacctaatgtcaaagatggctttttaatcacacacgcagataagtctgatgttaacatcaagactgcagtgaatagtgcaatgaagacattaaccactactttggaaggaaagccagatcaagccgtgtctcggtggattaaatcaaagagtcatgttcaaactggaggctacgagtgtagatattatgtcatgcattggatgtggtgcatagtgagtggcggtttgaaaaatgaatggaataggtggttttatgatggaacaccgttagacaaagaggccatgacaacacttcacaacaaatgggcggcatattttctccagattaaaaacatggaatttagataa

SEQ ID NO: 80744 - DNA, 255 bp, Glycine max
  Peptide Sequence Number=SeqID_172429
atggaatatctgcctattcatttggcatatgaagctagactcggtggaccagtccaaaatagatggatgtatcaatttgaaaggaatcaaattgcaattgaaactgaaaggcatccaccaatgttatcaatgtttgaccagcaaggtcatctttctgggaatgagttcattcattggttaactgatgatgagaaagactcagtccatgtttatgtgttgattaattgtgctgaagttaagccataccttgagtaa

SEQ ID NO: 80745 - DNA, 213 bp, Glycine max
  Peptide Sequence Number=SeqID_172430
atgtacaagacgagtaatctcttattgaacggtcttggacgtccaaacttaggagcacagctttcaaaatcgccccatgtgtggcatctcttgtcaatgtcaggatttacacgcgattctcctcaaatttcagccagcccacatcaattagaccttgcaccttacgcttcaggccctacaatgctcaatggaacgcccggggcttctccgtga

SEQ ID NO: 80746 - DNA, 477 bp, Glycine max
  Peptide Sequence Number=SeqID_172431
gatcccgttagttgtgatgatttggatgttgaattacctggatgttggggaagcttgggaggattgatggggacccggggatggtgggtttatgcgcgatttgtggatgtggaaaacttgttgtggaccatcgcccgaccgccacctagtaccacatgtgatggagtggtacctggagatatgtcccgggggtcaggagaccttggggacgtcaggcgagctcctggcagtcaacagataaaaggaacaaagaccacaaagcaaggaggcttgtgtggtggctggccagctgtgaatcttgtgcttcaaaaagggaactgggagattgtggaggcctctggtaatcgattaccagtctgtgtaatcgattacacagaggaatgggtcactggtaatcgattaccagagatgaaaagcctaaagatacccctcttacttgaatgtagtggttatgagacgcattgtgttgcggcatag

SEQ ID NO: 80747 - DNA, 291 bp, Glycine max
  Peptide Sequence Number=SeqID_172432
atggctaccattgcattatcaagtagatatgggagcaagttagcatatggcaccggaatttggggtgagtcctacaggctttttgctgcaaaattcctttttggtttgcgctataggtggtgtttgggcattgggcgtgtggtaagcaggcatgtggctgatttggggatggcttttgtggatgattgggtgatgggtaatgagaagggccgatattggttgagcgatgacattgttgggctgacccgcttcgatcctttccctgacgaagaccaaatccgcaaagcttga

SEQ ID NO: 80748 - DNA, 944 bp, Glycine max
  Peptide Sequence Number=SeqID_172433
atggcgcctgatgcggtattttctccttacgcatctgtgcggtatttcacaccgcatatgacaagctgtgaccgtctccgggagctgcatgtgtcagaggttttcaccgtcatcaccgaaacgcgcgagacgaaagggcctcgtgatacgcctatttttatagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattg

SEQ ID NO: 80749 - DNA, 204 bp, Glycine max
  Peptide Sequence Number=SeqID_172434
atggcagctcaagtagcgcccccaatgatggagagggagttgatagcgatgatagtagacacgttaccggtgtcctactatgagaagatggtaggttacatgcctttaagctttgtcgatttagtgtttgccagcaaaaggatcaaagtgggtctaagaagaggccaatttgattgtcttgctttgacaagtaaaaagccttag

SEQ ID NO: 80750 - DNA, 721 bp, Glycine max
  Peptide Sequence Number=SeqID_172435
atggtgaaagttggaactctacgtgccgatcaacgtctcattttcgccaaaagttggcccagggcttcccggtatcaacagggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccaggcgaattggagctccaccgcggtggcggccgctctagaactagtggatcccccgggctgcaggaattcgattcagatactgttgcaaagttgtactcgaaaaacctgacaacaatttatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagg

SEQ ID NO: 80751 - DNA, 534 bp, Glycine max
  Peptide Sequence Number=SeqID_172436
atgtgtgtcataaaatgcctttcaccggggcaggatttctcccggaccgctgtcgggagacgggtgcggatcatgcgcaccagcatgaccaccttgacccagatgtggatgacgttgctgctcagcaatgtcttgcctagtgatcataactccgatctccctctgccgaagtgccagctgatgtatgccatcctgacacgaatgagcgttcacgtggctcagctgattgctgacgccatctatttgtttgcaggtatgccacccaccaggcaccctctagacccggataagtctaacagggccctggggtttccagcattgatcacgggcctctgccaatcattcggggtttcagtcacccctagtaaggtgatccgaccgccgatcacccgggctttcattgagaagtattgcacgcctagacaggcacagggggatgcacctcaggacgcagacgcaccatcgccacctcatcaggccgatccctctgggtcactaggcatggagcgttatctacagcacttggttcgctag

SEQ ID NO: 80752 - DNA, 402 bp, Glycine max
  Peptide Sequence Number=SeqID_172437
atgccgatctccccctgcggaaggatcgtgactacaaggcacccagtggacccggaggagcccaatagggccctggggtttccagctctggctacaggcctctgccagtcctacagggcgcccgtccccccagcatgttcatgccatcgtgacataggtgagtatgcacatctctcaactgatttccgatgtcatctattgtttgtggggatcacgcttgcaagacactcagtggacccagagaagtccaacagggtcttggggtttccagctctgattacgggcctctgtcaattctacggagtgcccgtcacccccagcaaggtcatcaggcctcctactaaccgagctttcatcaagaagtattgcgcccccaggcaggcagagggcgagacaccataa

SEQ ID NO: 80753 - DNA, 276 bp, Glycine max
  Peptide Sequence Number=SeqID_172438
atgtcaggattcacaagtgattctcctaaaatttcagccagcccgcatcaattagacattgcacattatgcttcagggtcctacaatgctcaatggaatgccccgaggcccctccatgacaagcacatgttgcgttcgagtcgtatccacggaaaaatggaggttgaggaaccttggctggggttatggcaacaattgaattatcgagtagatatgggagcaagtcagcataggacaccgaaattaaggtggtgtttggcattggtcttgtggtag

SEQ ID NO: 80754 - DNA, 225 bp, Glycine max
  Peptide Sequence Number=SeqID_172439
atgcgatcattcgctaagcgtgatactcagtggctaagcgcaaggaagaatccagaagaagatgagctatcaggttcgctgagcacaccgctccaggtcatcaagtgcaccgcttcagcttattcactaagagagagaagcgcactaagccaaaatccacttatgcgcgctaagcaattcagatttgcactaagcgtgagagcatggaccaacccacttatttaa

SEQ ID NO: 80755 - DNA, 489 bp, Glycine max
  Peptide Sequence Number=SeqID_172440
atgccaattgatgggactccgaaaaagggtagagaatggagaattgcatctaagcaatgcttgcatgcctgcatggtcgactctagtggaggatgcatgaacgaaaacccgcaattcatgtgggctccgaaaaggggatgcatgaacgaaaacgcaattcatggggctccgaaaaagggtagtagaatggagaattgcactaagcaatcactacgcatggctccaaactcgtgggggggatgcatgaacgaaaatgcaattcatggggctccgaaaaagggtagagaatggagcaattgcactaagcaatcactacgcatggctccaaactctggtggaggatgcatgaacgaaaacgcatttcatgggctccgaaaaaggggtagagaatggagaattgcactaagcaatcactacacatggctccaaactcgtgggtggaggatgcatgaacgaaaacgcaattcatggggctccgaaaaagggtaa

SEQ ID NO: 80756 - DNA, 969 bp, Glycine max
  Peptide Sequence Number=SeqID_172441
atgatgacccgttcgtacatgctggcgtttatgggcaggtcgtggtcaaaccatttagaaaaaccttgccataaatgttacgctcagaaattgaacaacgtttacaggcactggcccctgaagctctggaaattcaagatgacagtgagcttcaccgcggacacgcaggaaacacaggcggcgggcactacaccatcaagcgcgctgccacatgtgtatgcggcggatgccgatgcggttgccaccgtcaacggcaagccaattaaaaaatcctgggtagatttcattttgaaagatgctgaagcacgtaccggacagaaagctaatgacggcatgaaagctgccgtggtcaatgaactggtgggctcagagctcgcttaccaggaagcgcaaaaagcaggtatcgataaacaaccagactttatcgccagtgaagaactggcccgccgcaagttgctggtcaacgctttcctcgctgacttcatcaggaaaaatcctgtcaccgatgccgagaaaaaagaaggctacgagcaatacaaaaaagagctgggtgacaaagaatacaatgcacgtcacatcctggtaaaaacagaagctgaagccaaagccattattgctgacctgaaaaaaggcactgactttgccaagattgccaaagaaaaatctcaggatccaggctctaaggacaaaggtggcgatctgggctggttctctcctgccggcatggtcaaaccattcgcggaagcactggttggcctgaaaaaaggcgaaaccacgcctgagcccgtacagtcccagttcggctggcatgtgatcaagctggttgacacccgtgccctacaagcgcctccatacgaaaaagtacaggaaggcattgagcgtacattacaacaacgcaagcttgaaaaatacatgctgggcctgaaagacaaagccaaaattgacgtcagtggcctcgagaaaaaataa

SEQ ID NO: 80757 - DNA, 465 bp, Glycine max
  Peptide Sequence Number=SeqID_172442
atgtcggctttgaaagagcaaatggcttccatgatggatgccatactaggaatgaggcaactaatggagaataacgtggccactgctgccgctgttagttcgactgccgaagcagacccaactctcccagctaccgcacgccatcctatcccaaacgtggtaggaagagaaagaagcacactggggcacatcaaaaacccccatctgggatacaaccgagtggcttacccttatggattaccacttaattacacggcaccagtcatgcgtgatgacgcgggtcatatccctttccccatccttgaaggggagcctcctcgacagtcggacgaggttcacgaggatcatagagagcatgcccaagaagacatcgattcctactcctcggtcctcgtcgaggggccaacactttacacactacctcaggccaagctcacgggagaacctcgaaacctcccagcataa

SEQ ID NO: 80758 - DNA, 288 bp, Glycine max
  Peptide Sequence Number=SeqID_172443
atgcagtcggtagataaggaaggtcctaaaaagcctaaacccttggtaatacacttcaccagggacacggctcccccaagacctcaacacccatcggcagtgtcgggcggtagacctattccgtttccttacgagaacaaccatgcagttccgtggagatatgcccctctgggcggtaggaaggaagaagctatcgatatcggttcactatcggccaaagtgaccaatatcaccgggctgagtggcataacccgcagcggtcgtgtgttcgcacccctgccctgctga

SEQ ID NO: 80759 - DNA, 336 bp, Glycine max
  Peptide Sequence Number=SeqID_172444
atggcaaagcaaaccccactgtacgaccagcacgtggcgtgcggtgcgcgcatggtagactttcacggctggatgatgccgctgcactacggctcgcagcttgatgagcaccacgcggtgcgtcaggatgccggcatgttcgacgtgtctcacatgaccattgtggatctgcacggcgcccgcacccgcgagttcctgcgctacctgctggcgaacgacgtcgccaaactgacccaacccggcaaggcgctgtacaccggcatgctgaatgcctccggcggcgtgattgacgacctgatcgtttatttcctcactgaagactatttccgcctagtg

SEQ ID NO: 80760 - DNA, 300 bp, Glycine max
  Peptide Sequence Number=SeqID_172445
atggttgagtttagtccaacaagaggaatctgcggacgatgtttgatcaggattaggctagactatcatgaggaatcagggtttaacatttcaagagacaccatagaacacataagcattctgattcaccatcatcaaggtaatccgctactcaattgcctgaagtcgctatcatggcagacgagcaacaccagaggatcacccttgaggattattcaagcagctcagtaccgcaattctttactagcattgcacctcctgaagtgcaagctcacaacatcaactacccgcattctttaa

SEQ ID NO: 80761 - DNA, 183 bp, Glycine max
  Peptide Sequence Number=SeqID_172446
atgccgatctccccctgcgaaagtatcggttggggtagcgcccacaagacacccagtggacccagagaagcccaacaggtccctggggtttccagctctggttacgggcctctgggtagcgctcacaagacacccagtggactcggaggagtccaacagggccctgggggtttccagctctag

SEQ ID NO: 80762 - DNA, 390 bp, Glycine max
  Peptide Sequence Number=SeqID_172447
atgaaccttcgaagaagcgaaagggcacttcgagtcggagtcaacgacattctgggtcataggaaacgccaatccctttgccaaacgaaggtgtaccatttgaaggtgcacttatgttttgatgataacaaagatgatgacaaaggtgattacaaaaatctcaaagctcaatcaaagaatgagttcaagatgttcaagatagaatcaagaacacttcaagattcaagaggaaagttgaagaacacttcaagattaaggaggaaagttgatttcaagaatcaagaatcaagattcaaggatcaagcttccaagaatcaagatcaagattcaagagtcaagagaagacttaatcaagataagtatgaaaaggttttttcaaaaactgagtag

SEQ ID NO: 80763 - DNA, 300 bp, Glycine max
  Peptide Sequence Number=SeqID_172448
atgcatttcggctattttgggcaaaaaacacgttttcgtgaagaaaaatcgagtcgaagtgctttcgtaagcgattctgtggaaattcttcatcgttcttcaccgttcttcgttcattcttcgtcgttcttcagtcttcaaccgaactacgtaggtcttatttcctcatcgcaattgaggatacgtaggagcaaaagccctgcttttgtcgaccaccccaagagatcgttaatggtccaacgccttaacgtttctctcctttcaaaaaacaagagatcgttaaatggtccaacgtcttaa

SEQ ID NO: 80764 - DNA, 210 bp, Glycine max
  Peptide Sequence Number=SeqID_172449
caccggacgagaggaaaccatttcctaactacagtgttaggggtcacgtgcaactccttgagtggagctaggtcaccctacgagactgtggtggcaactacagaatctccaagagaagcaatgacaaaaaaagatgcaaagaagatggcggatagggtacctgggaatggccgctttgatgacggcgacggaggacatcagtgtaggtga

SEQ ID NO: 80765 - DNA, 594 bp, Glycine max
  Peptide Sequence Number=SeqID_172450
atggctgagaaggcaaagaaaagactggaagaagctgcccagtctggaagcactgagggcatcattgaccctccatctcccttcagacgccacgtgaaatggaagatggcccgcacgaagaaaactggacagatgacgtctgaggcagcaaaagaaatagctgacaggattgattctttggacgagcaggcgtcacagggatcgtttgtcccccatggacgtcaggatatcctgactgctgccattgggcgaccagagcaccctggccgtgttcgtgctgttggagccggtgtcaccataaagcaatactttggatcagcttcacgaacatcccgcagttcttcctccatgcctcttgaagacctagaacagctgacccaacaaatcagagaccaactggaggagtcaatcacagaacaagtgactcgaaagatgatggaatccttcagccagatgcagtcgcaggtttcagtctcggatgcaatcacagggaattgcactacctccagagccagaggttggtccctcaggtcctcgtgtcagtacaaaggagagttgtgttgctccctcagggaacaatccagggatgggtga

SEQ ID NO: 80766 - DNA, 342 bp, Glycine max
  Peptide Sequence Number=SeqID_172451
cgcggccagcgactggcggtggctgccgctgaaccggtcattgctgttgcacactgcgcggcggccgcggaaatcgacgaggctcaggttctcatcttcctgccgtgccaccagccagctgcgatagcgcagatcatggcagccaggcgcatggagaaacgtgcccaccagtcgttcgtgccactgcatcagcctgcacgccgcgcttcgccagcagccgcgtcagcacgtcccggaaaggtattacgcagatggataacgcgctgttgccagggtgcgaatcccggtagagaccatacggataccacaccgccagcggcagcgtgccaaacagctgattaa

SEQ ID NO: 80767 - DNA, 459 bp, Glycine max
  Peptide Sequence Number=SeqID_172452
tctaacagggccctggggtttccgccgttgatcacgggcctctgccagtcattcggggttcccgtcacccccagtaaggtgatccgaccaccgatcactcgggccttcatcgagaagtactacacgcctaggcaggtgcagggtgatgcacatcatgccgcagacgcaccgccaccccctcatcaggccgatcccgctggatcactaggcatggagcgttatctacagcacttggtttgccaggaggcggccaaccaccgagggcaagtgcagatacatgagtgtctctaccggttcaacctcaagcagtttggggctgaggtcgcatggcccggagactggcccgaggcccaagtaggggaggcgcccgcaggatcccccggtgaggcagaggaggcccatatggatgaagaaatgactaacttgctcggtttcttggggggaagcggagccacgtga

SEQ ID NO: 80768 - DNA, 438 bp, Glycine max
  Peptide Sequence Number=SeqID_172453
atggcgcctaccaggcaccgtggagacccggataagtccaacagggccatgggattccccgcgttgatcacaggactctgccagtcgtttggagtccccatcgcacctagcaaggccgcagacgcgccgccacctcatcaagctggtccagccggatcgtttgatacggagcagtatttgcgacatttggttcgccagcaggcggccaaccaccgggctcatagccagggttttacttcttttccgtgccctactccggatcagttcagggcagaggtcgcttggcctggagattggcctgaggcccgagcaggagaggcacctgcagaggcacctgcagaggcaccagcagaggctcccaacgaggcagatgaggcccgtgaggacgaggagattgccgatttacttgatttcttgggagggagcggggccacatga

SEQ ID NO: 80769 - DNA, 894 bp, Glycine max
  Peptide Sequence Number=SeqID_172454
atggcgcctaggaagttgagtttcccccaagacagttatcggacttcaaagaagccaaaaattgagcaacattcacaaccttcgaatgctaaaaaaatgcaacaaagtaggggcagttcatcgggaaacatcagcaacaacaacccaagccggatctttcataggactcggaccaattccagtaggggatacacacatacaattcctaaggacatgccctgctgcttcaagccaactgtggacatgaatcttacatttaaggagacacgggtttgtgcttatgtgttcaaccctaatgtggacccgagcgggaacgaaattttatatagggaaggaaacaacttgggcacacgaaaaacctttcagtcgttgtgtcccaataagccagtaagggaggagataatactattcatggctttgaaggttgcttatagccaactctactgcaccaggagtgtttggtgtatgccaccagcctttgcggtggacgtcattaatggatgtccagtggaaactcttattcaacattatggaaaggattggatgccaccattttccaacttgaacctaaccaatgtcatgctgagtgttctagaaattgtgtttccaacacaagaattcgttattggctttgatggaatggattgttgggatattgcggaagccagaggaatcccaaattgtggatccagtgagaaatctgcattatgggtcctagaatggatgcaaatggaggagttatttatcagcctcttgtatggagtgctagaagaaaaggcagtcagaatgaaggtggcaatgatcctgctgttagggacacacaaccagcacaagggagacttgattagaaatgcagagcacaaatggcatgactgtatccatgccaaacactga

SEQ ID NO: 80770 - DNA, 417 bp, Glycine max
  Peptide Sequence Number=SeqID_172455
atgcaaaaggaaaactacaatcgactaaggcatacccttcttcaggttattcacgtaggaggaaagggaggttgcggatctggcgatctgcccccaaagctccaccaacctgggatttctttcgtcctttgtttcaatcgtcctcaatggacacaacgctcttcttcgatcgttttactgcgacgaagacaacgctctgctcgaatcgcgacttctgctacgtttttcaaaagattgtttcctttgcttttgaaaaaacctttcgtaattgcattgtctcgggtagtgtatgacagggaaagcaaaacagttgtcaagggatgctttgaaacttcaaaagcgcgtggggggatagcagacacacaagtcgaggcatccatttactaccagttgcaaggaaaaaataaggaccgttag

SEQ ID NO: 80771 - DNA, 208 bp, Glycine max
  Peptide Sequence Number=SeqID_172456
cgaggataactatcactacaacgagtcttcactctttccaaaggacctcttgatgcaagctccattggagcttgtaggcctaggatcttcttcatcaatggattcctttgcttcttggaagataaatagcagcggaatggagaaggaagagagagaggagatgccacttcaaggagaagatgagtctagaagaagctcaccaccatag

SEQ ID NO: 80772 - DNA, 1191 bp, Glycine max
  Peptide Sequence Number=SeqID_172457
atggcatatgtatgtatggataatttgttatgtgatgaggtgtggctttcaaagtcttcaaatacttttgaagaagttagtgaccctgttgcactaaagagttatgaaaatgaagagtttgaagaggcttttgcagtgtgtctagagaaggaggtctctttcttgcccgaatctgactacacaaagtacttacactccaacaatttgatttttcctaggtgtagagttattcaatggtttatcaagtgtagaagtcgctttaatatttcttttgggacagtcttcttggctgttaattatcttgatcgctttgtatccatttgtcaatgccatgattgggaatactggatgcttgaattgatttctattgcatgtttatcaattgccataaagttcaatgagatgtcagcactttcgttgcatgaaattcaggtggagaatttggactactcattccaatcaaatgtaattttgaaaatggagctgatcctgttgaaggtgttggggtggcgccttaactctgtgacaagtttttcttttgtagaaatgctaagtgttggtttcttggaacctcatcttcatgagaagtttatttcacgagtcattgatctccttatccaagctactttagatcagaaaatgctggaattcaggccaagcattgttggtatatctgcattgtggtgcactctagaccagttatttccaccaaaatcagacacttacattgcttatattatgagtatcttaaaccaaagtcagaaggatgatatcatcaagtgccataagttgatggaaacacagacttcaatgcgttgtgaaaatcaccattgttactgccctttaagcccaacaacagctttctacatcggttctaacgacctttctacatcggttatgacgcgtggtggtaactcggggtcgttgaatcacaacatcggttttatgaccgtctttgaagggtggcttttccacatcggttgtatagctacaactgatgtagaatgcgtaggtttctacagcggttctaaggctgaaaacggtgttgaatggaatggatacgaatggaaaggtttctacatcggtcttcaatcaactgatgtagaatttgaagagtttttacatcgtttatcgcctaatcgatgtagaatgaggatattttctacatcgtttataattgaaccgatgtag

SEQ ID NO: 80773 - DNA, 756 bp, Glycine max
  Peptide Sequence Number=SeqID_172458
atgcctaaccttagtccactagcattaatggctgtttcctctggtttctcggagtggaagaattcggaagctgctgttagatgcaaaagattcaaaagttttacgcataagtctccaaatgtggcaggtggtgcaaaggcatttgaggtagcttccaagtttttccatggaatcaatgttgagttcaccctctataaacaaagctcaatcataaagggtgagacaatatatccatgggttaaaactgtcataacaacagaagaggaaatcaaagtgcaccggagagaagttcctatggagaaaggtacaagtcttcctatggagaaagctataagtcaccaccttctagtttcactactcgattggagaatctctacctcacgatctcttttttctcttagaaccatcatgtcacaatctgatcattcctctgcttttaccacacccagattagttctcaagaaggttttggccaaatctcaacatgaaggggatggagctgttgttagaagagggattggaaggagcgagttgaagaacttggatcccttcctaatgttggatcacttctcagtatctcccccagcaggatttccggatcatccacaccgaggttttgaaatcgtcacctacatgctagagctagctggcattcttttggatactgcgaatctaagggaccctcgttgctcctctaaagataagtacatggcttcattattgatcaatggtgctcctataatcacaaggtattga

SEQ ID NO: 80774 - DNA, 495 bp, Glycine max
  Peptide Sequence Number=SeqID_172459
atggctctgaagaagcttccagccaagaggttgagaaaagatgccgctggagagggttccagggaggcctcacaggtggacatggattttgatgggcacaagttccagagtgaggaacaccagcgacgctttgagaccattaaaggctggtcgttcctcaaagagagaagagtccagctgaaggatggagagtatgctgagtttcaagaggaaattgcatggaggcaatgggctcagcttgtatcacccatggctaagtacgatctcgagatatggatccctttcgataaggatgccattaatcaaattttggggcatccattggtcttggaggagggccagcgctatgagaacagccagaggaggagccaagccttaggtttcgatgaggaggctatcagccagttgttgtgcgtttcggggcaggactttgcctggagtgtagcggggagacgggtgcggatcatgcgcaccagcatgaccaccttcacgtag

SEQ ID NO: 80775 - DNA, 1053 bp, Glycine max
  Peptide Sequence Number=SeqID_172460
atgtcgctaagcgataatgttctaggaagacatatacttcctgagaagaaggtagaaaaataccatactgagctggacgagtttaaggctgaattggagaggcgtaacttccataaacacctcaccaatttagttgacaacagcatagatctagctttggtgaaggagttttatgccaacctttacagctccgaagggccttcaccaaagcaagtcagggtcagaggccacttggtgaagattgatgcagatagcctcaacacctttctagagacacctgtggtactagctgagggtgaaaccttacatgcatattccaaatactgcaagttgcccactgatattagagaaattgaggttgccttatgtatcccaggttgggggtttgctttgaatgttgaaggccaccctgggaagattctcaagaaagatttaacaaatcttgctcaagtgtgcagtgttctctcatactccaacctggctcctacttcccacacctcggacctgacagtagatcgagctaggctgatctttggcctagtctctcagatggacatgaatgtgggagctctcatctctagtcagattacatctatggcccagtctaactcttctagacttgggttccctgctcttatcattgctttatgtaagtccaaaggggttgcttctgacagcctagtcttcgaacgcttgagcccgatcattaacttggcatatattaggaaaaactgttggaaccctgatgatctgacagttactatcagaggggccaggagagcaaggacaaggtcagctgaggccccttccacatctacagctcctcctccagcacgtaccctagcagctccttctgccccagttcctgcagattttcaacgtcttgaagccatgtttcaaagcatccatcaggggcagattatcttattacaaagtttacagatggtggcacctccagtctctattccttcagtagagcagtttaatgagtgggtagcctggcccgaaactcagtcttctcttcacagggaagatgaaggtcccacagcccag

SEQ ID NO: 80776 - DNA, 292 bp, Glycine max
  Peptide Sequence Number=SeqID_172461
acaaatggttacaccacccagctctcctcctcctcctcctcctactggtgcagcatcacagtcaccatcaaccttgaagcggataagaaaagccacacggctaagatcattggcgactagaccaattggggcacagagaccgctggtccatgtcgatcctgcgactgggaaagccgacagtccccatagaaagaagttaagaacatatttggggatcgtcgctcgtgataaggtggatgtcacatacgagaattggaaacaagtccctgctgctcagaaggatttgatatag

SEQ ID NO: 80777 - DNA, 272 bp, Glycine max
  Peptide Sequence Number=SeqID_172462
atgactgttgcagacagtattaagacaactcttcctaagatcgataatgctaaaaagtttatgggattagtgagagagcgctctcaaacagctgataagtctcttgttggaacattaattagtacattgactaccatgaagtttgatgcttcgtgtactatgcatgaacatgtcactgagatgataaacattgcaacaagacttaagaccttggaaatgactgtgaatgaaaacttccttgttcagtttattttgaactcattatcgtctaa

SEQ ID NO: 80778 - DNA, 1444 bp, Glycine max
  Peptide Sequence Number=SeqID_172463
atggcacgtactcctgacaagattaagtctattgatggatcaagagaaacccttaaacttgctgtaaggatcacggatctttggtttgttgggactcctaacaagtctgagcaagctgaaatgggagatgaaatccatgctctttgtaaggcagaccagctaaattcttggaaagattatttgaaggaaaattccacttatgtcatgcataattttaaagtgatgaagaatgatggtcaattcagagtttgtgagcatcaatataaattagtttttactggagttactgttgttaggaaatccaatttagatgaccttccttttaaggaatttagatttgttgaattttccaatgtcattgctggcgatttccaagctggcctgttggttgacattattggcatcgttgatgatgctcttccaccatgtctcataaaaaaataccaggcctacttgaatgagactgaaaatgatggtccgatggttatcattttgacacatgctagaatcaaagaagggcagggatcttatccatcttcagtgagtaaatcgttgaaggcctcaaaattattgattaatgaacctgtattggaaatccaagaattcagggagaggctttcagatttaggtattgaggtcaggccagttttgacacctcacggtcacggaagttcgcaactttcagggtcaagccagctatcatcaaaggatgcatttctttcaaaagttgaggcaaaaacgatttctgagatcaacgccatttcggaggatattgtttgtgttactgttggcacaattagcataatagtaatggataatcattcatgttgctatccagcttgcattcaatgccacaggaaaactgacatagaggcagcatcattcacatgcggatgtggaaaagagaatgatcaacttgtcctgaggtatagacttgaagtgatggaccgcgaatgtgctgagttgattggtcaatcaacggatgaagtcaatagggccaaaatagaagagggtgatgttgatctaaatgcttctcctctagcacttgatagactgttgggtcatgtccttgcttttaaggtcagggttcaatcaaagttcaggaatgttgttgttcttagatactcaaatgaattagatttgatcaatgatgtgctggacatgctgcctgatactgagaactaccaacatgcaaagagatctaattccgcaaaagccaagatcaacaggaaacgtatcatgcagcagaagcgacatcctcagactcagtcaccttcacatccaactatggactgcacttcacaatatgcagaatatgatttgattgtgtctgactcatcagagggtgtaaattctgaatccacacaaggttctaattctaatttttttactaagaatcagcattgtgaatccccggccaatcatcctgcaatcaacactgaag

SEQ ID NO: 80779 - DNA, 372 bp, Glycine max
  Peptide Sequence Number=SeqID_172464
atggcagtggaatggagaaggaagagagagaggagatgccacttcaaggagaaaatgagtctagaagaagctcaccaccataggaggtcatggataagagcttggaggaagaaggagatgaatgaagagagagggagagaagagcacgaaattttgtgctctaagagagctctgaaatctgaaataattggacccaaccttggcccatggggtcagaaatctaccctaaggttcatgagaaccctagggccttcttcaatagctctagcccaatcctcttggagcctcttgctcatggctctagtgaatggtccctccttagggaggattgcatcatcggtttttggtatttatgaagttgctcatatttga

SEQ ID NO: 80780 - DNA, 384 bp, Glycine max
  Peptide Sequence Number=SeqID_172465
atgcatcctcggtgtccctcaacctctggaaatttcatgacaattttaaggaaatatgggcctcttttacaatggaacgtcgttaccctggaccctggcattggtgataggagcattgttcgaccatggtatgtctttctcaatgagagcgacttcgatcatggagatgaagtgtcattctactatcagtgccatgaaaaaaattgggaaattgtgattaggagacaaaagcactgggagaatagcgaacagattaaaggtcgttttttcaaagatcagctaagccaatttaggtgtgaatgtgtattaggagcggatcacttgatacaggctatggagatttggatgacgccacttccagtgaaggaagctaagtcagggtag

SEQ ID NO: 80781 - DNA, 171 bp, Glycine max
  Peptide Sequence Number=SeqID_172466
ggtacatctacttgggttgttgtaactgagaacaagagagggtacatctcttgtggatcagttcaagtggagggtacatccacttggttgttcaaagagaacaaggtgaatggcaaaggaatggagaaggaagagagagaggagacaccacttcatggagacaccacttga

SEQ ID NO: 80782 - DNA, 348 bp, Glycine max
  Peptide Sequence Number=SeqID_172467
atgtataaccagcaggagttggctcacaataggccaatcatatctatggagcattttcttgaaaaagtggcctggcctgaagctcagcttccattggagaaattccatgaggttgttcctcctgagcccgcaccagcaaggactgagccgataccagctgaaccacaacctccagtagtggatgcacctccttctcttgagcttgaaatattatctcctccaccagctccagctccacctttgataatcatctctgatttatcatctgatgaagatgctgcccctcttgattcaccatcttgcaacatagatgatggttctgacttttctgattggatgaactgctga

SEQ ID NO: 80783 - DNA, 171 bp, Glycine max
  Peptide Sequence Number=SeqID_172468
atgagctatacaggttcgctaagtgcaccacttcatctcactaagcacacagcttcagttcatctgctaagcgagaaagatgcgctaagccaaaaatcactaacgtgcgctaagcggtccataaatctgcagagaccagagcttgaagcaggagccggtttgagagcttga

SEQ ID NO: 80784 - DNA, 174 bp, Glycine max
  Peptide Sequence Number=SeqID_172469
atggatgagaagagaaagaaaaaactggaggaaactgctcaatctggaagcactgacaccgtgattgatcctccatctcccatcagacgacacgattcgttggaggagcaggcctcacagggttcctttgtcgcccatggacgtcaggatgtattgactgctaccattgggtga

SEQ ID NO: 80785 - DNA, 51 bp, Glycine max
  Peptide Sequence Number=SeqID_172470
atgcagtggaagtttgtgatgacattgcttagaggttggagtgccatctga

SEQ ID NO: 80786 - DNA, 267 bp, Glycine max
  Peptide Sequence Number=SeqID_172471
atggagcagtatcaacggcatatggttcgccagcaggcggccaaccaccacaggcaggggaaaggctccactcattttgtatgccctaccccagagcagttcagggctgaggtcgcgtggcctggagattggcccactgaggagggaaccagacccgcaggatccccgggcgaagcggaggaagcccacatggatgaggatatgaccgacctgctcggttacctaggagagggcagagccacacgaccaaggtcgccgcacttgtga

SEQ ID NO: 80787 - DNA, 474 bp, Glycine max
  Peptide Sequence Number=SeqID_172472
atgcttttcattggttgcattgctcattgcattccttaccgaatgcgtgctagagctagagtaatgggtgaagtagacgaggtgaaagagtggataaaggccgacatagaggccctgaaagagcaaatggccacaatgatggaggccatgatgagcatgaagaagataatggaagtcaatgcgactgcagttgccgctaccagcgttgttgctgagaaccaacatgccttccttccagatggcttgcctcccaactatgcaccacccaatgtggtgcacactcctgataagaatgtcaataactccactaccatactgccttgcctcggatacgccactgagggacaagcagttggtggtgtacccttgccaaacactttggagggccctcagcttcgcccacaaccacaacccttgcatttttcggtgggaagagcccctcctgctatggttgaaaagggaaagttcgattag

SEQ ID NO: 80788 - DNA, 393 bp, Glycine max
  Peptide Sequence Number=SeqID_172473
atgggtgaagtagacgaggtgcaagagcagatcaaggtcgacatagaggctctgaaagagcaaatggccacaatgatgaaggtcatgatgagcatgaagaagataatggaggtcaatgtggctacagttgctgctaccagcgctattgctgaggtggacccgactcccccatttggcctcaaccaaataaatcatctcatctcggatatggtagggcagagaggtaaagaattgggaagtgcaggaagcgcccattttgtgcaagttcaaaacaagcatatgttctcgccatatggcttgcctcccaactatacaccacccaatgtggcacacgctcccgatgagaatgtcaataactccactcacatactcattgagagccaacaaccttga

SEQ ID NO: 80789 - DNA, 336 bp, Glycine max
  Peptide Sequence Number=SeqID_172474
atgaagctaaaggtagaaaacaaaaatgaagctaaaggcagaagaaggaacaaaaacgaaattgcaattagaagtagaaaatcgaaaaatgcattcacgtcaacagacttagaagcagtagcaactctaggagaagaacctcaatcttccgaggcgtcttctagctttcctattccagggcaatctcatacagatttaattgaagaagttattatggctgaagagccaaaaagagtgacccgggaagattactcaaattccgctgtgccgcaattcttttccagtatagagcggctagagttcaggcacaaacaatcacttaccctccttctttga

SEQ ID NO: 80790 - DNA, 144 bp, Glycine max
  Peptide Sequence Number=SeqID_172475
gaaaacaatgtggatgatctaggagatgaaagagaaggaggaactggtgcaggtgggtttccagaggttccttggtggcaatggccagcagcggtggtggtggaggaagatccttttcacttctttgatgattctgccatttga

SEQ ID NO: 80791 - DNA, 135 bp, Glycine max
  Peptide Sequence Number=SeqID_172476
atgggttttgctggtggtagtggtagcaaacccactactttctcaactcagatcacttgttacaagtgtgacagaaaaggcatattcaaagagattgcctatatcccaagaagaagcagaatggtgggggtctga

SEQ ID NO: 80792 - DNA, 972 bp, Glycine max
  Peptide Sequence Number=SeqID_172477
gtcgactctagagggctgcacgtcattgcttttagggggctacacggcctcaccttgagagggctacacgctcttaccttcagagggcttcacgtccttgccttcagaggattgcacgtcctcgactttaaagggatacatgccctcaccttcagaggattgcacgtcctagccttcagatggcttcacgtccttgccttcaaagggctacacgccctcgccttcggtgggcttcatgtcctcgcttttagaggactgcatgtcctcaccatcagcggagtacatgtcctctccttcagaaggaccgcacgtccttgccttagagggctacacgccctcgcattcagtgggcttcatgtcctcgcttttagaggactgcatgtcctcaccttcagcggagtgcatgtcctctcctttagagtactacatgtccttgccttcagaggagtgcacgtctacgccttcagaggaccgcacgtcctcacctttagagggctacatgccctcaccttcagaggatatcacgtcctctccttcagagggcttcacgtcctcgccttaagaggactacacatccttgcctttagagggctacacgccctcgccattagaggactgcaaatcctctcctttagagggctacacgtcctcgccttcatagggctacacgccctcaccttcagaggattgcacatcctcgtctttagtagagtgcacgtcctcacctttaacagagtgcacgccctcaacttcagaggactgcatgtccttgcctttagagggcttcatgtcctcgccttcagaggactacacgtcatcgccatcagagggctacacgcccttgcctttagaggactacacgtccacacctttagagggctacacgcccttgccttaagtagactgcacgtccttgccttcagtggactacacgtcatcgcctttagagggctgcacgtcatcgctgcttag

SEQ ID NO: 80793 - DNA, 273 bp, Glycine max
  Peptide Sequence Number=SeqID_172478
atggaggaaatgaatatgcacaaaataacaaggggggggggggcacccctaagggcaaagggtcactttggggcagttgcagctcgcccaggcgagctgaaaattagtgctaaagcaataagcttgcctaggcgagctggagctcgcccaggtcataagcatattaaggagtatcatgtagtgtgttccaccatgcaaccacatgacattcatgaagattatgtgaagatgaaaacacttccattctctttggatgatgtggctaaggactag

SEQ ID NO: 80794 - DNA, 372 bp, Glycine max
  Peptide Sequence Number=SeqID_172479
atggtgcagttatgcttagcccgatgtttcccctgcatgttcattcaaaagctaaaagttggcatcctacccttcattctcgattacaaggaagattacccttggcacaagtggaaagacctggtggatcgttcggtcctgccgaccaaccctttttcggagcccatgaattgcattttcattcatgtgtcccccacctttgagtttggagccatgcatagtgattgcttagtgcaattctccattctcaaccctttttcggagcccatgaattgcgttttcgttcatgcgtcctccaccttcgagtttggagctatgcgtagtgattgcttagtgcaattctccattctcaacctttttcagagcccatga

SEQ ID NO: 80795 - DNA, 606 bp, Glycine max
  Peptide Sequence Number=SeqID_172480
atgaagcacttcactgacaccctcatcagtgccaacataggaacaaaagctggtaccgggccccccctcgaggtcgacggtatcgataagcttgatttcttaacagcagtgctggagaagccagcctctctcataaccctgctaacactagggtcatcaaggattgatatgatgaggtgttccagctcaaccttgatggtgagcagaggctgttgctgctggtgctcaatgcagccccttctctgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 80796 - DNA, 183 bp, Glycine max
  Peptide Sequence Number=SeqID_172481
atgcatacaaagcgatgcagtgttaaaagggtccagaagttagaagctgagcttaacaagcttgaatctgaagctgaactatcgggtctgaaaatcaattttgctaagagtagattcggagctttcgggatttctgatcaatggaagcatgatgtagcaaagtacttgactgcagctgcttaa

SEQ ID NO: 80797 - DNA, 252 bp, Glycine max
  Peptide Sequence Number=SeqID_172482
atgtcccctcctcccttacgggttagcgttttgcctaacttgaacctacttaagttagaattagtaaaagaaactgcaaacgcaaaggatactgggctgtcttgcagcgacgtcctctgcttgtttagcgccgggaaggggcaacgatcagtcggtcgtgaccctagccctacttgcatccgtccctatgtacctgcaagtaagaaacaacaaggtgtggcaaatcttgaccgcgtcgttgtcttaccttga

SEQ ID NO: 80798 - DNA, 177 bp, Glycine max
  Peptide Sequence Number=SeqID_172483
atgcccctcattgccccagtgaagggcttagagctgggaacctattgggtgagaacttctaatctgcccctaggttcgcttgagaagcaagatgttttgatgatgctaaaggatcaagtgcttctaagttttattcaagacaagaatccaagaatccaagaaaatcaagatatatga

SEQ ID NO: 80799 - DNA, 939 bp, Glycine max
  Peptide Sequence Number=SeqID_172484
gcccttcgtgacctcagtcaaactaggagttacgcatggggagtaactacgctggtgcatatgtacgaccacctgaatgatgcttctatcagcactagtcgacagcttggtggttacatcacactgttgcagtgcaggatatacgagcactttccctcagtcacggagtccactactgatccggactacgacgaggattcactgtgcgcctgtaggtggattgctacgaagaagaccgtgaagagcatacgtacaccaacgtacagggagcgcctggaccgactccggattccaaatgtctgttggatcccatatggggagcaccgaccggtccgagacttccatatgatttcatgttattccggtctactgcgttgggggcccgttgttgtgtattaccgactagagagggtcatgcagcagtttggatacacccagaccattcctgctccacctgccaattcatgggtgtcgtttgatgatatacacgataggtggatgcactattcagaccatatggctgcaacaggtgacaattgcgttgtgccagggcaatgtgccagtgactacatggactggttcttctgcattttgcattcgttcatgacaccgggccagccttcagatcctcgggcagatggtcatgctacgcagcctagagttgccactcaggatctagacacagatatccgtccggtcatggagccagcaacaccgtcgacatctgcaaggtccgatgtggccgagccgagacatgcagtggaagcttgccatgcgattgcggagaggttggagagccatctcaacctaggggtggtcacgccaggcacatcgacacatgagctgatcgaagaatgccttaggattgccaggagtgtcacacaagacgagctagtatatgttagttcccgatgcaggcagcgcacagatcagtcgtag

SEQ ID NO: 80800 - DNA, 429 bp, Glycine max
  Peptide Sequence Number=SeqID_172485
atgttgctaagtggcaacgccatctatatctgtgtaagagtggtcatgttggtgcacatgatccgcactcgtctctttgtaacggaacgggtgaaatcttgccccagtatgcatagtggctatacgatagcctcctcctctagttgtgctcgcacagttggccctcctccaggatcaggggggaagaggaccttaaattctcttaaggtgcggatgtggagcccattgaaagtgaggacacgtagccctctaaagtcggggacgtgtcaccctttgaaggcgggggcgtccggccctctgaaagcgagggcgtgcagcccactaaaggagaaggtgtgcagccctatgaaggtgaggacgcgtagtcctctgaaagcgagggcgtgcagccttcttaaggagagggtgtgcaaccctttgaaggcgagg

SEQ ID NO: 80801 - DNA, 114 bp, Glycine max
  Peptide Sequence Number=SeqID_172486
atgcggaagctgagatcaatggaagcggaatggagatggaagaaagatgattggagatgccacttcaaggagaagataagtcaagaagaagctcaccaccataggaagccatag

SEQ ID NO: 80802 - DNA, 421 bp, Glycine max
  Peptide Sequence Number=SeqID_172487
atgcatagggtaagaagttatccagcttcagtgagcaattccttcaaggcgttaaaactattgattaatgatcctatattagaaattcaggaatttaaagagaggcttttagatttaggtgttgaggtgagtgagttttgctacttggcgatcaagcaagctcacaagtttcaagggggagacgatgtttgtgttacggtggggactattagcaaaatagtcatggataaccattcatggtgttatccagcctgtgctcaatgtcataggaaaactgacatccaaacaggaccattcacatgtggatgtggcaaggataatgatcagagtgttctgaggtatagagttgaagtgatggttacccaaaacaatgagagtaacaaatttttgctctgggaccgtgaatgtgctgaattgattg

SEQ ID NO: 80803 - DNA, 1395 bp, Glycine max
  Peptide Sequence Number=SeqID_172488
atggcttctagaaaacgcaaaagtattggttcaagacccacaacacaatatgatacaaggagattttcctccatagatgcttggaaccggtacacatacaatgtcttggggagaaacatcttgcctaagaggaaggtagaactctatcacactgagctagatgattttaaaattgaattggagaggcgtaatttccataaatgcctcaccaatttggttgatgggagcatagacttggctttggtgaaagagttctatgcaaacttatacaactttgagggaccttcaccaaagcaatccagagtcagaggccatttagtgaagattgatgctgacaatctcaacacattcttggagacacctatggtattggcagaaggtgaaactttacccatatactccagatactgcaggttgcccacagattacaaagagattgaggctgccttatgcataccaggccgagggttcatcttgaacactgagggtcatcttgggaagattctcatgaaggatttgactactctagctcaggtgtggagtgttctctcatactccaacctggcccccacatcacatacctctgatctgatagtggacaaagctaggctgatctttggcctagtctctcgcatggacatgaacataggagctcttatttctggccaaatgacttctatagccctgtctaacacttttagagatgggtttcttgctctgatcaccgcattatgtagagccagaggggttgtctctgacagccttacttttgagcgccttagcccggatctaacagtttctatccgaggggctaggagggtgagggcgaggccagctgagcttccttccacttctgcagctcctactccaacatccacttctgcagctccttctgtcccagctcagacagattctcagcgctttgaagccatgcttcagagcattcatcagggacaaatcattttattacaaagtttactgatggtgatgcctccaggatctattccttcagttgagcagtttaggcaaatggtagcctggcccgggacccaaccttctcttcacagggaagatgaaggtcccacagcccaggtaccgcagcatgtggaggatgagtcatttgaggcgaccatccccgagccatttgttataggggaggaggcaggtgagacacaggtgagacaggtagtcgttgccactcctaagagatcccttgaggccacttcagagcctcctgcaccagtggtggacctacccaagaggacccaaccagaggacccaaccacaccagtcttggctatggacatttctccttcagctactcaagtacttcatctgacagatgaggaggatgttcagacaaaggacactcaggaccagtcacaggagttctaa

SEQ ID NO: 80804 - DNA, 396 bp, Glycine max
  Peptide Sequence Number=SeqID_172489
atgggtgtcaagtacctcgaagtgggaagtaaagataagacactaatttcgttcgagtggaacaccattcgaccggtcaatctccgcgctagcggaacctgcaaaaattttgaaaatgatcagcatcgaatgaccaacatcatcctgatgctgccgaatttgttcctcttggttgacacaaggcgcagaatgaccataatttgtctccgcgtgccatcggacacgatcgtatctggatggcaaaaggtgcggaatgaccataatttgtctctgcgtgccatcggacacgatcgtatctggatggcaaaagacacgattgtctctgaatggcgaaaaggtgagcggaatgaccataatttgtctccgcatgtcatcgagctcgccgcctctggatga

SEQ ID NO: 80805 - DNA, 504 bp, Glycine max
  Peptide Sequence Number=SeqID_172490
atgaagctgtctctggctgttacggccttgagctggagcgcggtcagcatcagtttctgtttcgcgtggataaaccctgcgccgatgccacctcacttccgctcagaactgatgatcgtcaccttcaccgccgacgcccattccgtagcgattcgcctgccggcgctgaataaccgccgcgaacgcagcctgtttgataaatcgttgaattttcagctgattgatgagcgtggtaatgaaatagccagcattcgcgatcggttgccgggtgagagcagcggcaatgttgaacaggcgatgatcaattacaaccgtacggcgcaggcggccagcgtgccgcgctttgcgctgcaggcggccagcgtaccggacgccagtctcagtctggatatggtatggcaggacgccagtaatatgcccgcgctgcaacgctggctgcagcgtgttgatgccgccacgcggcagcgttttatcagttgggtgaaaaccctacgcgcaagttga

SEQ ID NO: 80806 - DNA, 183 bp, Glycine max
  Peptide Sequence Number=SeqID_172491
atggtgaccaaaggttggagctttaatggaggcttcaatggagaggaagaagaaagaaaaagcaacgtcagggagagggagaaagcttctgaaattttctgtcgatccctcgcgtttctctgcgcccgccggggccagttttcgaaagtaggcaatataattatatcaaaatgctcagaataa

SEQ ID NO: 80807 - DNA, 486 bp, Glycine max
  Peptide Sequence Number=SeqID_172492
atgagcgcacctctgggcgctcagcgcaacttcctctcggtgggaattacgtttagcacgccattcgcgcttagagagagaccccaagttgttattttcagaatcccaacggtcggactgtggcaacatatcctaggaagcttcagacaaaatttgaagacgatccaacggcaggcccttcaaacattcattacatggccaacaaatcttgtgaaaattgtgtcacaaaagtcttatattactccaaagaaactacctgaaccagttcaaagggcaaataatgtttttgaagatgatcctttgcatcagttgattaagagcctatatgacatttacgagaagcctgttgagttgatgtgggattccaataaattttggattccaaatgtagatgcatccttcttcttgacatattatgatgtaaatgaaataatagaaggtgacaaatgtttgaacatagctatactacaattatggatgatgtaa

SEQ ID NO: 80808 - DNA, 891 bp, Glycine max
  Peptide Sequence Number=SeqID_172493
atggcttctaggggagggaactcatattttgaaaagtcggttcagttagtgttaaaggaaccaatgaatgatatggaccacgctgatggctttagtggagaacctatggatggcaggatagaggatgatgcacttcatgatttgtttagtgcaaaaaggaagatgcggttcatttctgaattagagcttaaagttcaaacacttcagacagagacaaccacattgtctactcagtttaccaaattacagggaacggtgaaaaccttggccgcaaaaccatggctgaagaagattcagcaagcaagacctctcatttccatggttaacaaggttgcctctctatctacccccatggcagcacccaacgtcgatgtcagaaatcttgatctggacctggcgttagaaagggtttcaactgtgggaagatgtcgctttattgccaaatccccaaactcaaaggaattgcagaagagtggtgttcatcatgcagtaaatccacaaccttatagaggcattttcggttctaatggagagaagtatgcaagagatgtccaagatatcattaactttggaacttctggaaatgaatgtcctgagcaaagggggggtatcattgaattggctcctggttacttgctagatgtgtacaataccattaaaaaagccagaggactttttactactgatgaggttcaggctggctttggtcgcattggtagccatttctggggatttaaggcccacaattttgttcctgacatagtcacaatagctaagataacttttctgttggtgtcggggacagatgtagctacaattggagtcatagtgtggttatggagaattcaagatccttcatgtagctacatgaaggatcttggatcaaagtag

SEQ ID NO: 80809 - DNA, 1161 bp, Glycine max
  Peptide Sequence Number=SeqID_172494
gactctttggaagagcaaagcaggcagggcagcattgtgccttcgggacgtgatgatattttgaacatggctattggaagaccggagcatcctggtcgtgtacgtggggctgggataggggttacaattatgcagtactttggtccagcatcgcgtcggtctaccacttcatcaaacatcactgtagaacagttggctgatataattggtaacctaaaagaagaatggcaaagacaggttgaacaagaaaacattaaaagagaggaggtgtggatgaggagggtagaagaggaaaaacagcgcactatggacacatttaaaggacaaatacaagaagctatcaagttggagttgtcacaaattgcatcacaacattcagccccacttcagccaaatgatatacaagtattagcagcaagggtaagcacgaagggaagctgtgcagcaacagagacaaatgcattagctaaaaaaccctctaagttgaatggtgacaacgtcgggctgcatgtaactgccgagaactccaacaaattagtggcagtgggcaaacagtgcgacagttttggcaccatccacaatgtgccctatgctgatgatgttgttcccgtgagtatggtggaagttatttttggtgatgcggaggttccaatccctacatcagaaataaagtttgtcaaagaagctttagagaaggatgtgagctcaccattgaagactgttgaggaggaaaaggtagctgaggttattgatccattgggagagttggtgaagaacttgttcgacatttaccaaaggcccgttgaggtgtcatgggatgtgcgagcattggttatggaccattgtatgggttccttgaacctcagtgtatccacaatgcaagcagtagacgtcaagagtgtgaaaattacattggaaggcgacaatgtagtggtttggttttgttctttgaagaagaagccggatgctgccatcaagggtgcagtaaacagtgcaatgaaattagtcaccaaaactgcagagggaaagccacctcagcatgggcctcagtggattgaagcaaagagtcatgttaaaacaggaaattacgagtgtggatactatgttatgcaatggatatggtgcatcgtaagtggtggattgaaggatgactggattcac

SEQ ID NO: 80810 - DNA, 912 bp, Glycine max
  Peptide Sequence Number=SeqID_172495
atggaggaagggggaagctcaattaccttcactgtaccaaatttctcaaagacactcttcaaatcctcacgtgagacaacatccatgttgtccttggttgaaggtcgaatcggtagggttagtgtcgagcgagtggaagagttgaagggcttgttggaggttgttgttgtgtgcgtgaaaggagatgatggtgttccaaatgacgatgtttcgggaggtggggaggaaggggaggttgagggcagtgcaggacttgagggtaagggagaagaggtgaaggaagctcttgagaagcagaacaacccaaggaggtttggtggtaggtcaaaatcgaaggaggacgtgatcccttggagaaatggtggacagtgtcgggtaaaccctaaagtcattggaaggttttccagtacaggatgtcagtggaactgcttggtcgataaagacactggacaccatgaagtttgctatgatgatgaagacaaccacaggattgtcttggttgatgcccttgaagtccctgaggtcgtcgctcacgctgttgttcttggtgtctttctctgcttcgattttctgctcttcttctatctgcttcctagttcatgttctgctcctctggatgtcctcatgcccagtagtctccagtgttgtgaccaatactgcggtgataccagcaatgatcggttgcgactgaccttagcctgggaagtttcatttggggtagccgcatgggtacctccagagagattaatgcttgtctggcttgtgcctcttattcgacttgtgcgagtcgggcttgacttcattctggaatctggacatttcttccatctggatgtagcccttggttcattcgcacagttcatccatgctaccgagtggttttttgcagaggttgtctatgaacttgctagg

SEQ ID NO: 80811 - DNA, 558 bp, Glycine max
  Peptide Sequence Number=SeqID_172496
atgttctttccatcaggtggggttcagaaagatattgcagcttcagggtttgttccatgcaactcggactccaaggattgcctggatatagaggatcatgcagtcaaagtcttggacacttttgagcagtccaatggagatgacaccatgcttgagcagttatctcttgaggaatatacactgcaggcttttgagatgttaattgcacaggaaatgccagactcagtttaccatgaaaccatgaggtctgaggacaataaaccaatggaatcagagagcaacagtgttgacagagcagttgcaaatctcatgttcaacaagatggaaattaacatactagatcttccccttacaacactagtaaacttgaagcaagaagtaattggaacttctatccaaggtctagctgtatccatccagctacatcttgattttgattggaatcttagcaatcaagtgaagagtaactttcagggtagtctttgtgagaagcccaaaagcagcaagaaatctgaaggggggatcttcttatcttgggataagcagcagtacatctaa

SEQ ID NO: 80812 - DNA, 501 bp, Glycine max
  Peptide Sequence Number=SeqID_172497
atgggagccgatacaacaggaagcaagacagggcacagtagctacaagcaaagtactacctgcaatttgcattgcaataaaggacagaggcaggatcaagcagcgcagcaacaaaagaggagttggctatggcgcaggatgtcgtctaagaaaaatctgggtgaaattgagagttctggctcaatgtcgtctcattctgaaagattttccgatgatcaggtatatcccacccaaactactccgtctccagaaggcacaaagattactgctgctcttttaaactctagtgccaaagaagatttggcaaagcagcatgctaaagttgcggaagaagctgtctcgggctgggagaaggctgaaaatgaattattgattcttaaacaacaactcgacaatgcaaaacaggaaaactcagttcttgaagaccaatttagtcatcttaatgatgcactcaaggagtgtatgagggatcttcaacaagctaaagaagaacaagagtaa

SEQ ID NO: 80813 - DNA, 144 bp, Glycine max
  Peptide Sequence Number=SeqID_172498
gtgaaaaagaggctaagttttgaaatgccaaaagtgccttcagccagactcagcgcaagactggcgctaagcccaattccacttacttacgctaagcgtgagggtggcgctaagcgtaaggtcgcaaattctaagcctatttaa

SEQ ID NO: 80814 - DNA, 810 bp, Glycine max
  Peptide Sequence Number=SeqID_172499
atggaaggaaggaagaacaggagttcttatttcatgcggaggatttccaaatgttcccttgatggggacgagggttgcatcagctacaatcccgttcttgctataagacaacttggctaccgtatgagaggggcgccactagaggatgagctcgcgcctatcatttcacgaggcttcaataagaccaacgtggagacacttcagaaggtctgcaaggcatgggaggtgttgcaaaagaaggacaaggaactcaggggcagtaacaatgggccgatcggtggctaccgtaagtggttgaaagcccacgtgcaaggtttggattggctcctgagtttgagaaccgctaaaagggaggaagttgaggcaccggaggaagacgaagaggtgcaagcccttaggatggaactcaagcaagctcaaacagtcaaagaaaggttcaaatcagcaactcttaaaatccgaaaagagaatgccgaactgagagatataaatatagctaccaccaaggctttggaacaaatgaccaagagggctcgtagggaagagcacggccggaacaagttcagaggggctctatggggcagcaacagggaccaatcaggagtagacagtttgatcttgaaagatgagttgaatgtttgctcaaggtccaaaagaaacttgtctcagcgattatgtgaaacagagaccaacatgttagctatcatcagcaagtaccaagaagaactaaatctagctacggcccacgagcatagagtggcggacgagatgcccaaatgtacgcggagaaggaggctagaggaagggtga

SEQ ID NO: 80815 - DNA, 498 bp, Glycine max
  Peptide Sequence Number=SeqID_172500
caagatttgcttcttggttgatcattggactcaaaagactaatcgcttttgggttcattgcaagaagtgggtacaacttcatggttgttatcactggactcaaaatactaaccgctattgggttcattgcaagaagattttacaaggatagtagaaatctcaagcgggttgcttggggactggatttaggcacagaaggaaattccatggtagctgccattatagaatctaaaaatctatctactatgtctcttgccacattatttgaagaattgcaggaacatgagttagaattgcaaagactcaatcaaaatgagaaagagcaagcaaatgtatgcttaatgaccaagaatcatgaaagcgatgagcaggagcccttgaagaaaaagtggtacatagacaatggatgctctaaacacatgaagggagatgcctcaaagttcacaactatctctcctaagaaaaacgggcatgtaacctatggcgacaacaatagag

SEQ ID NO: 80816 - DNA, 372 bp, Glycine max
  Peptide Sequence Number=SeqID_172501
tcgttcggggttctcgtcacacctagtaaggtgattcgaccgccgatcacccgggccttcatagagaagtattgcacgcctagacaggcgcagggtggcgcaccgcaggccccagacgcaccgccgccacctcatcaggctgatctggctgggtcatttgacatggagcggtatttacggcatttggtttgccaacaggcggcaaaccacagggcgcatgtgcagacccatgacagtctctaccagctcagcctcagtctgcagagccagggtttcgctccttttccgtgccctactccagatcaatttagggctgaggtcgcatgtgatggaagcttgcttgtggagattctatggaggctggatctttga

SEQ ID NO: 80817 - DNA, 528 bp, Glycine max
  Peptide Sequence Number=SeqID_172502
atgactaggggcaatccatgtgatttacaaccctttgatcctgaaatagatagaacctttcatagattacttaggcatagtgtgcatcctgatcattctgtgcattttgagcattctgagtattctgttgctggtaattttgaacattctgattttgagcattctactaataattttcatactgagaacatggctcaacctacacctcgtgagaggactcttagggagatggctgcacctgatttcacttatgaaagcttgtgcattcaatatcctaatgaaggtgaagatcctcataagcatcttaaggagttccatattgtctgttcctccatgaaaccccctgatggagtggcaaaagattggttgtactaccttgctcccaggtcaattaccagctgggataaccttaagagggtgttcttggagaaattctttttgcatctaggaccactgccattagaaaagacatttaaggcattaggcaacttagtggagagagcttgtatgagtactgggaaagattga

SEQ ID NO: 80818 - DNA, 191 bp, Glycine max
  Peptide Sequence Number=SeqID_172503
gggcagggtttcgctcctttgcgtgccctactccagagcagtttagggctgaggtcgcgtggcccagagattggcccgaggcccaggcaggggaggcgcctgcaggatcctcgggcgatgtagaggaggccctcatggatgaggagatgacggattttctcggttttttaggagggagcagagccacatga

SEQ ID NO: 80819 - DNA, 551 bp, Glycine max
  Peptide Sequence Number=SeqID_172504
gaagttgagaaatttgagaggtcaactccaaaaattgaagggctagtcgctgccactagattaactcctttgatagtgtgttcaatagacactggcgatcggggagttatatccacttttgtcgagaggtggcacaagaagactagcagtttccatcttccagtaggagagctgaccatcacgttggatgatgtggcgtcactacttcatcttccgatcataggcgccttccatagcttcgagcttctgcatgtggacgaagcgatgattatgttggtggagttgctagaagctaagactgcacaatacacttttcgagacttggctcagagtggaagctatgcatggggagctgccaccctagtgcatattgttcatgagagcgtgactgatgaaaagtatgatgagacgtcaccacgtgcctgccagtggcttactatgaaagcatattcgaagggattccctgcatcaacgtaccagacacgtatagatgcactgacaatccctgacgtatgctggatgccttatggtgagcaccgaggagttagggc

SEQ ID NO: 80820 - DNA, 498 bp, Glycine max
  Peptide Sequence Number=SeqID_172505
atggctgagatgcagagagtggttgtggctaatatttatgctccctgtgatttagaaggggattttaattgtatcaaacatccctctgaaagattgggtaacaatcatagtaattcaaattctaatctgataactgaattcaatgattggctacacgatatggaggctgatgatatcccctgtgtggattatcacaaggtggtgagggattgctggtctgaatctcaacctacagggtggggtggatatgtgttgaaatgcaaacttcagaccctcaagcaaagattgaaaaactggagtaaagaaaactttggagacttgggtaacaaagtcaagcagattcagcaaaagctaaatgatctggagaactctctatcagcacaaccttttgatcagcaaatccaggagctcaagaagactcaagctgatctttgggaaaaggcaactatccatgagtcctttcagaaggagaaatgctgtgaggggactgctgattga

SEQ ID NO: 80821 - DNA, 487 bp, Glycine max
  Peptide Sequence Number=SeqID_172506
ggatcgcgaccacaagacacccagtgagacccagaggaagcccaacaggagccctggggtttctagctctggttacgggcctctggatcacgcccgcaagacactctgtggacccgaagaagtccaacagggtcctggggtttccagctctgattacgggcctctgtcagttctacggagtgcctgtcacccacaacaaggtcatcaggccccttaccaactgagctttcatcaagaagtactacgcccccaggcaggtgcagggcgagacaccacaacagcccgaggatggctgacagcgggcaaccgacgcactggcgccacctccagagcccctcagctcatctacaaagactggagcgttgcctacgacccgttgccgaccagcgggcgaccaagtccaaagctaaagataagcaaaagtactaggtctgtgaccgacaagtcatcatgcatccagctcaacacgttaaagaagcgctcctag

SEQ ID NO: 80822 - DNA, 273 bp, Glycine max
  Peptide Sequence Number=SeqID_172507
atggactcaaggatcacaaaggttgaagaagatgtcaccatcattcgtgaatgccttgatttacctccaccaccaccagattgtcatcatcaaaaagggggagattatggaagcaatgtcttccaaggttattttgatgatgccaaagaatcaagagttaagaaaattccaaagattcaagaatcaagtttcaagaatcaagattcaagaataatcaagatcaagattcaagactcgagattcgagaaacaagagaagactcaatcaagataa

SEQ ID NO: 80823 - DNA, 234 bp, Glycine max
  Peptide Sequence Number=SeqID_172508
atgaatgctaaaaccgatttcccaaagaaaggaaagggggaagtgggaagaaaaggaagaaatgaaaagaaaagaaagaaaaagaataataaaaaagaaagaaaagaaagattcccgatcgaagatcgaaaggaagtgaaaatggaaaagatcggaggaaaacagagtaattctcgatcaatgaaagaaagggaatggaaagtcttcagaccagataaattttcggaaaaataa

SEQ ID NO: 80824 - DNA, 294 bp, Glycine max
  Peptide Sequence Number=SeqID_172509
atgctggaaagttttaaacaacaacaagaaatgttagttctagaattgtacatagaaaaagatgtggctggtggttcaatgtttcattctgcaaattcgcttacatcatgtgaaatttatttatctaatgatgagccacaaccgccaacaaatatgagcaatttacatcttcacgaagatgatgatgatgattattttgtgtctaactcatacgttgaagagtctttagacgaagatgacagtgttgacggtatatctgatacagacaatgaagtccccgagatgattccacca

SEQ ID NO: 80825 - DNA, 489 bp, Glycine max
  Peptide Sequence Number=SeqID_172510
atgatacgcggagataccttacggttatccgcacccttttgtcatccagagcagatgacaagcagagaccaagtttggtcattctgcacacatgatacgcggagataccttacggttatccgcacccctttgccattcagacacagtcgtgtccgttggcacgcagagaccaagtttggtcattctgcacccatgatacgcggagataccttacggttatccgcacccttttgtcatgcagagcagatgacaagcagagaccaagtttggtcattctgcacacatgatacgcggagataccttacggttatccgcacccctttgccattcagacacagtcgtgtccgttggcacgcagagaccaagtttggtcattctgcacacatgatacgcggagataccttacggttatccgcacccctttgccattcagacacagtcgtgtccgttggcacgcagagaccaagtttggtcattctgcacccatga

SEQ ID NO: 80826 - DNA, 1356 bp, Glycine max
  Peptide Sequence Number=SeqID_172511
atgttcacagcctggatgcattctaacaaaatatgttcttatggacgggatcttacatatcatcaatatatctcaagatttgtttatgtcgcccgcaaaagatgctggcaaccaagaaaacaagggaatacaataggcagactcatatgggtcccaccttcagctggtgaactgttttaccttagagtgatgctatccactgccaaaggtgcacagtcttacaatgacatcagaacagtcaatggtctggtatatcctacatttagggaaccatgttttgcaaaattctttctaggtaatgatcaagaatttattagtgctttacgggaagctaataattggggtactgcacactacctaagaaaattatttgtcaagcttttatttatgaacaccatggacaaaccagaatatgtttggcaacagacatggcaatggatggcagatgatatcatattcaatcatagaaaacaagatgagcaaaaaactattgtcgataccattatgtctgtggttaacactcaatcagctgcagtttactttctctatggatatggtggaactggcaaaacatttgtttggacaaccttatcatctggtatacgctccaatggtggaattgtttgtacagttgcttcaagtggaattgcttcattactattgcctggtggtcggaccgcacattccaaatttgctataccagtccctgcaacaaaaaattcaacatgcaatattcatcaaggcagtgagttagctgaattattaaaggttacaaaactaatagtttgggatgaagcaccaatgtgtcacaaatttgcatttgaggcactagataaaagtcttaaagacatcatgcaaaacaatcttccttttggtggaattgcttcattactattgcctggtggtcagaccgcacattccaaatttgctataccagtccctgcaacagaaaattcaacatgcaatattcatcaaggcagtgagttagctgaattattaaaggttacaaaactaatagtctgggatgaagcaccaatgtgtcacaaattttcatttgaggcactagataaaagtcgtaaagacatcatgcaaaacaatctgccttttggagggaaaattatcgtttttggtggagatttccgacagatcttgccaattgttccaaaaggtaatcgctcagacatcatccatgcaactataaatgcatcatacatttgggaccattgccaaattcttaaacttacaaaaaacatgagattgctatcaaatgctctccaacagcccaacaatgaagaactcaaacaattttcactttggctacttgacataggagatgggaaaaattggataatataa

SEQ ID NO: 80827 - DNA, 210 bp, Glycine max
  Peptide Sequence Number=SeqID_172512
atgagtgaatggattgtcatcatcaaaaagggggagattgtggaagcaatgccttccaagattattttgatgatgccaaagaatcaagagtcaaacaagtttcaagaatcaagaataatcaagatcaagattcaagaatcaagattcaagattcaagtaaagaatcaagactcaagattgaagaatcaagagaagactcaatcaagataa

SEQ ID NO: 80828 - DNA, 120 bp, Glycine max
  Peptide Sequence Number=SeqID_172513
atgcaaccggaagaaacaaagcaaccggaagaaacaaagcagaagaaagcgaaaggcattccggaagaaggttcttccggaaacttccggaagaaggttcttccggaaacttccggatga

SEQ ID NO: 80829 - DNA, 240 bp, Glycine max
  Peptide Sequence Number=SeqID_172514
atgagttgtacaggttcgctaagcgcaccacttcatctcactaaccgcaccgctttagttcatccgctaagtgagaaaggcgcgctaagccaaaactcactagcgtgcgctaagcggtccataaagctttgcatgtctagggtttctagagagagaaaggtccaagttacagagaattttgagaggtgtgaagatctgcagagaccagagcttgaaacagaagccggtttgaaagcttga

SEQ ID NO: 80830 - DNA, 552 bp, Glycine max
  Peptide Sequence Number=SeqID_172515
atgatattagaggacgagttgaaggcttgtcaaaggtcgaagaggagcttgaccaaacagttgagtaggatggaagagaatatgtggacaatcattgaccagtataaagagaagttaaacctagctgccaggcatgagcaaaggctagaggatgagcacacaaaagtatcgactctgcaagcgggaaaggaagcaagaaagaaagtgatagattcattacatggagaagctatgatgtggatggatagattcgctttcaccctgaatgggagtcaagagcttccaaggctgttagccaaagccaaggaaatggcggacgtgtactcaagtctcgaggaagttcatgggcttttcgattatttagtcgtagtcaaagtaaacgtaataaccaaaaggaatgaacgcgctttatggcacccctatcaaacccatgccaaaactaaaatcatgagtgagatagaagaagtgaaagagcaaatgaaggccgacatggaggccatgaaggatcaaatgtccagagacaagaagctcttaatgcattttttccaataa

SEQ ID NO: 80831 - DNA, 291 bp, Glycine max
  Peptide Sequence Number=SeqID_172516
atggatgctcattttgaaggcatggatacatggattactcagcttgaagacgacatgggtttcattcaccgttgctttgatccaccggatattgtcatcaacaaaaagggggagattgtagaagcaagatattttgatgttttgatgatgtcaaaggataaagcgcttctcaagttttattcaagacaagaatccaagaatctaagaaaatcaagatatatgatcaagttgatctctagaatcttaggaagaagtttccaaattgaaaaagcaaaaggtttggccaaataa

SEQ ID NO: 80832 - DNA, 291 bp, Glycine max
  Peptide Sequence Number=SeqID_172517
atgcacaatttgactcatgattttaaatctttatgtgataatcttaaagcaagaaaacacattttggatgagctcaacagcactggtcagaaacaccaagtatatatacatattcgtgaaccggaaggggatattttaatattcatgactggacaggatgacatagagaagttggtatctaagttagaagataaggtgtgcgtatttagtcctccacctccaaattgtagacgaatcattgttgcaacaaatattgctgaaacttccttgactgttgatggtgtagtgtaa

SEQ ID NO: 80833 - DNA, 948 bp, Glycine max
  Peptide Sequence Number=SeqID_172518
gctgccgtcccttgggacggacgtgtggggtgctaataccttccccgtgcgtaaatacaactcccgaacctttcacttaaaagttcgtagatcgcgtcttttccggtttttccgacgttttcctcaaataaacgttggtggcgactccgcgcgtattcctttcgtggaacacgcatcccgcgagtcacgcgtcgccctcccgccgaaggcatttgaagcaagaggcagcaaacatgatgaagaagattggccttctttaagctgcaaaacgtccctcaggaagttcttgggggaagggttgggggcttgctccattgaggaactgcaatggatacaacaacagttggagaggagtttaagtaatgttagagccagaaagatagaagtagtggcaaattatcaaggggacagttacatgggcaaaccagtgaggataaattgtcaaaaggcgattctgatgatgaaatgctcagctctgttctcaagacctttgtctactagccctaatcagttagacggtgacaaaataacaggagctaccaatcataaatccgtgaattttgagggaagcctgttggttcagcacctattcaaggaccacagaagatgtagttacatgatagccaatgcactggataaggatggtaaattcactactgcccaagtctctcgaaaacttaagcagcttggtttgtatcttcctctgcccaaggatggtaaattcacttctgcccaaggatgggaatgccattacatcaatgctgaatatttgttgagcgagcttggtcatttgaagaaagaaagtgccaattggaataacactctgggagatgaagaaattggttcatccccagcaaaggtgtggacacaggatatcaaaaacaagcttgatgttattaaaggctttgcacctacctttggcagtaacagtgacaaagatgatcataa

SEQ ID NO: 80834 - DNA, 487 bp, Glycine max
  Peptide Sequence Number=SeqID_172519
ggatctagcagctcaagttttacttctaatgatggagagggagatgataacaatgatagtcgacacgctaccagtgttctactatgagaagatggcgggttacatgcctttaagctttgtaaatttagtatttgctggcgagaggatcaaagtgggtttgagaagaggcaaatttaactatgctactttgatgaataggaagcctgaggcaaatggagagaataagaatgaaggagaaactcatgctgtgacgctcgctcctacatggccaaatttcccactagttcaacaatatcaatactcaaccaatatcagtccttctcattacccaccactctaccagctaagaacatccaatcatcaacaaagtgatactgatgcaatcctccctaggaagggaccaatcactagagccatgagcaagaggctccaagaggattgggctagagctgctgaagaaggccctagggttctcatgaacctcaag

SEQ ID NO: 80835 - DNA, 354 bp, Glycine max
  Peptide Sequence Number=SeqID_172520
atgacccctactcatgatacacttctgtattacaacgggaggtggaacatgccacgccaaaacaactttgtaggttacgcgttcaccggaaagaatccaaaaaaatttgacattccttcaggatgtaccattgatgaactgaaggatttgataaagcaagttgcacctcaatggattccccttgatggaattcatgaatcacaaatggtaaagcgattgttttttcgacaaccaggtcattttgagtattcagacaaagttatcaaatttgaaattattgagctcaaaactaacgatgatgtgctgaaggttatggaaatagaagacgatgtggctacatcgctacaggattga

SEQ ID NO: 80836 - DNA, 1932 bp, Glycine max
  Peptide Sequence Number=SeqID_172521
atggaagccagttttagttccttgaataggcaaaaattgagaacaagatggagtgagtgggttgaggaccctaagagggtcatagaagaagtgaagaatttttttgaacaaagattccaagatgaaaatgagagatgttgctctttagatggggtagcttttgaaagaattacttttgaagaaagttgtgggttgaaatctttctttgaagagagggagaagcggtgtggggttctagtagtgacaaaagcccaggccgggggttgtcattcctcatttattactttaatcccaaaggttgaaaatcctcaaagtcttaaggaatttagagcaatctcgttgtttggttgtatgttcaagattgtagctaaggaaaagtatggtggttggaggggccttttgaaggaggagtcattgaggggtgcatctatttggtggagggaccttaggaaagtttttaggggagaaaaccaaatggagtggttcaatagtttagtcgagtggaaggcgacaatgcttacgatcatggttagaaccagaggtttaggccgtgcctttgctagggttataagcagaggcatgggtagacaggatgagcatcatgcagatgatgttccctggcggtgtaggcctacggcatccacccgtaggcaatggatacatgttgttgttgctgatgatgttcctcatatgactgaggatgttcctcagatgactgcggacgtagttgcgcctggtgtagagggcttagctggtgatggtgctgagggctcacctgctgatgatgctgagggattcccaatgctgacttcgtttgccgaccatgttgcacatagcatatggactggagaggaatgtcctaagttgaagttggtctcccacggaagaaaggttgagaaattttggaggccaacgtttgagattgaagggttagtcactgccacaggattaactcctttgatagggtgttcagtagtcaccggtgattcgggagttatatccgcttttgttgagaggtggcacagggagactagcaccttccaccttctagtaggagagctgaccatcacactgggtgatgtggcatcactcctccatctaccgatcacagactccttccacaactttgagcctctacctgtggacgaggcagtcgtgttgttgatggagttgcttgaggtctccggtgaggaggctagagctgagacgagtgggggctatgcctgggtagctgtcgcgctggtgcatatgtatgaccagttaaatgaagcttctcagaccactacacgacagattgctgggtacctgactatattacagatatatgagcactttcctagtgtgcatgactgtgtcactgatgatggctacgacaagacgtccccacgtgcctctcggtggcttactacgaaggctcatatgaagggaataacaggagcgtcgtaccggacacgtttagatgctttgacgatcattgacggtcagcgtaggtggggtcctattgtggtgcatgttcgaccaaagagggtggtacgaaagttcgggtacattcagaccatccctctgccgcctgttagtgcttccttgtcatatgaggatatagacgaccggtggatgcatttctcgaaccatctagcagctgtgggtgagatttgtcttgtgtctggacatccacctaccccgcagcatgaggaatacgtcgagccaaatatcccggaggttccagtggcatctgatccccatatgcatgcagtggtaagattagttggttgtgaagcgatcgcagaaaggtttgagcgtgtgctcaacctaaggatggtcactgaaggcacagagttacatcagatcatggaagattgcctcaggatcgctaggggtgacacctcagatggaaatgttagggcacgacaaagacggtgcacagatcattga

SEQ ID NO: 80837 - DNA, 180 bp, Glycine max
  Peptide Sequence Number=SeqID_172522
atgaagaacaagattatgggccaaggaaatagtgcttatattgtcacaatgaacgacaagaaccatgccacaactgtttgtttctttggccaccaagaaacaaggttaggtccaaagaacacacaagcaccagatgtagatctcctgtcatccggatcagaggctcaatcagcatcatag

SEQ ID NO: 80838 - DNA, 297 bp, Glycine max
  Peptide Sequence Number=SeqID_172523
atgaatgagagtcttgtgagacacaactcaaagttcaacttctctccctcttttactccttcaatttttgtgctccccccttctctttctctcgctctttcttttcctccattgaagcatcctctccaagcttcttatccaaggcacattcttagtggtgaagctccttcttccaaggcttattctagtggttggcgcctcttctcacctcttctccgttgtcttccgctgcacctccatggtggaaaatcaccattgaaggacctcattgaagctcaaagatctagcctccattga

SEQ ID NO: 80839 - DNA, 435 bp, Glycine max
  Peptide Sequence Number=SeqID_172524
atgcgttccagagctagagtaatgagtgaaatagaggaggtgcaagagcagatgaaggctgacatggaggccatgaaagagcaaatgaccacaatgatggaagctaggatgagtatgagaaggatgatggaggtcaatgcggctacaattgttgctacaagtaccaccacagaattggacccgactcacccacctggccttaatcaagtaggcgaaccgttaggaagtacgggcagcccccattttgtgcaagttcagaataagcattccttccaaccacatggcttgcctcccaactatacaccacccaatgttgcacacactcccgatgagaatgtcgacaactctgctcccatacccattgagagccaacatccccaatttggtcatgaacaagtctctcaacccatggggaagacacctgaagcaccctga

SEQ ID NO: 80840 - DNA, 426 bp, Glycine max
  Peptide Sequence Number=SeqID_172525
atgaggggtggaggttgcacagtagctcgcccaggcaagttggttactttagccttaagcttgctagtgggcccaggggctgaaaaatgccccaaacgtgacccttttgccctccttttgggctattttgcacatttccttctgaaacatttaaaaaccttatggattacacgacaattggtgttaagaagctcaattcggttggcaagaatccaaatgtttgcaaatgatcatccccagatgaaattaggggtgggagacattgatggtatccgcaagacaacagactttgatagtctaggaaaagtaaagaaagcagatgaccatgattgtctctgcatgacgacagactttgatagtcttgaaaatgccaatggacttgatagttggtcgacagccggcaagtgcaccagatcgcgcaagtag

SEQ ID NO: 80841 - DNA, 312 bp, Glycine max
  Peptide Sequence Number=SeqID_172526
atgaagaacgtcgaagaacggttgaaagcttgcgagattcctcacggaaaacgttacggaaacgtttcggaagcgcctcggcttagattttcttcacggaaacaatttttccaagcaaattcgaaagagagagaagggaggtggttgccgcccagctcgcccaggcgagctcagctcgcccaggcgagcagggttgcttcctccagaagcaaccgccttctggaggaatcttctggagggcccaaatgggcctgggtgctatttgcacccccatttttactaagtacacccccctctgctattttttggtga

SEQ ID NO: 80842 - DNA, 291 bp, Glycine max
  Peptide Sequence Number=SeqID_172527
atgacggacaaaagaaatgttttaggaaaaaataatgaggaaacaagaagttattttacatggaatttgaagatggaatgtgtattggctgatatacttagagataaaggaatttgggcaacaagggtgacggaggttggaaaagataatgtcaaaaaccgtatcaaattatggaaatcatggtatgatattgtatatagactatctatgcaaaaagaaagaaaatcacgcaagagaaatgatgtgtataaacaagtagaggacatgttggtcttcctaataggtgcctga

SEQ ID NO: 80843 - DNA, 297 bp, Glycine max
  Peptide Sequence Number=SeqID_172528
cggataagtggcccaactcattctgccacaaaggtttatgtgagaagaaatgaggtgttgagaagtaatggaaaggcccaacaatttaaggaaccagttgtggactcaaactcagtttctaaaattgattccatgccttcaatacaacaggacccaatagagctgcaatgtgctcttttaaaggaaatgggcttgacttatagggaagatgccaataaggttaaggggcttatattggatacggaaaatagagatgatatgatggcagctgagaggggaattaaaaaagatcaatag

SEQ ID NO: 80844 - DNA, 756 bp, Glycine max
  Peptide Sequence Number=SeqID_172529
atggaggtcgatagagaagagttgcccctggacgtgcaccgaaacactagcacaaaggcgatgacactcaattttgtgaccttttttgaccaagatccgaagtggggtgtgaaggctgatatggccttgagaggagcccacatcttctgcaattcgggtaatggatccgaaaagggaggatcctctagcagatcatcatcttcctccgcaatgaggcctttcttgtggcgcggcgccaactcatcaggagataagtgtttgaagggaacggacaacgatttggatggtgtggcaaaaagggaaatgacggatgtggaatttggtaggatggtggcacgagagaaaaaggaagaggcttttcgcaagaagaacgtgaaaggtcgcgaaacttcttctcctgcaaacgagccaagcccacggcctggactagtgttagtggctataacgcccccgtggggtcatcgtattgagacagcgcaaaacgggcctccaaaggacgcaatggtcaagcgacatggaatgatactcaaaaaattgggtaatgttaaagatccaactcaatggatccgacccatcaaaatgaggtacttcaagcttcatgcgatgaaggttgttggaagcggaaccgatgtgagaagagagctggttggaggtaagttttgcaatggcatcctcaatacggtccatattgaacttggagcgggtagagtcagccatgaaggaaactcaatgaaagcaccggatgatatgaattga

SEQ ID NO: 80845 - DNA, 525 bp, Glycine max
  Peptide Sequence Number=SeqID_172530
gcacccttagacccagataagtccaacagggccctgggatttcccgcactgatcacaagactctgccagtcgttcggagtccccgtggcacctaccaaggtgattcggccgcccatcacccgggcttttattgagaagtactgcacccagagacaggctcagggggatgctccacaggccgcgggcgcgccaccaccacctcatcaggctggcccggctgggtcatttgacatggagcagtatttacggcatttggttcgccagcaggcagccaaccaccgggcacatgtgcagacccatgattgtctataccagatgagcctcagcatgcagagccagggcttcacttctttttcatgccctactccagaccagttcagggcagaggtcgcatggcccggggattggctcgaggcccaagcaggagaggcgcccccggaagttcccggcgatggagaggaggcccacgaagacgaggagatggccgatttgcttgacttcttgggagggagtggagctacatga

SEQ ID NO: 80846 - DNA, 186 bp, Glycine max
  Peptide Sequence Number=SeqID_172531
atggaagaagatcacaagaagactctcaagtccttagattttacaaatgcaaccaacttggtcacatcaaagctaattgtccttcaaatgaagaatgacctgagaaaagtgataagaaaagaaaaggagatcaatcttctaaccaaggattatgagagtgatgagaacatttctcaagaaggttaa

SEQ ID NO: 80847 - DNA, 373 bp, Glycine max
  Peptide Sequence Number=SeqID_172532
atttacggtgaagttagtaggtcatttgttgtgaggtggaaagacgtacttgaccgtttatggcatttcattgacaaggatggaaatttccataccgttgtctacaaccaagatttggacaaatcagctattatagcaaggtggacaacactaagagatttttatcacttgaccggagatcatcaagtgtcgttaactcattatggtgtatctcactccgcacaaagttacctgcagcaacctgacaaaggctggacttatttgcatttagaggacgttgcagaatgtcggcttgtgttcaatcactggagaaagatagttaaaattggagctggatggaaatacttttgtgaaaccctatccttcaaagctg

SEQ ID NO: 80848 - DNA, 576 bp, Glycine max
  Peptide Sequence Number=SeqID_172533
atggccctgttgacggagctacttgaggtcaccccaaatgaggctatagctgagacacgtcaagcaggtgggcctcatgttcggttgtcctggcttcgggacatgctttcagggacctggtccacttgtacgatcatcttaacgaggcgtcgcaggcccttacacggcagatggccgattacatttcactacttcagtgctggatttacgagcactttccgtcggtccatcgatgtgtcgtcgatgatggttatgttaaggctagcccacgtgcctgtaggtggcttacggggagttcggagctataagttgatctcctcgtacacgggccaagtcagatggggtcagatcattgtctacattcgaccagagagggtggttcggcagtttgggtacattcagaccgttcctccgccgtcgatttcgcacctttttgtgacgccgacggaggagactgctgagccgagacctgcgcctccccctccccctcatgatgatgacttcgtcgagccacctgtccccgaggttccagtcgcgttggatctccctacgcattctgtggttgattgcacatga

SEQ ID NO: 80849 - DNA, 354 bp, Glycine max
  Peptide Sequence Number=SeqID_172534
atgtttatttcattcgggtacggcctcgaccagcccataagacacctagtggacccggaaaagtccaacagggccctgggtttccagctctggttatgggcctctgtcagtcctaccgggtgcccgtccccccagcaagggatcgcacctataagacactcagtgaacccggagaagtccaatagggtcttggggtttccagctctgattacgagcctttgtcagttctacggagtgcccattgcccataacaaggtcatcaggcctcctactaatcgagctttcatcaggaagtattgcgcccttaggcaggcccagggcgagacaccacagcagacaggggatggccggtag

SEQ ID NO: 80850 - DNA, 1179 bp, Glycine max
  Peptide Sequence Number=SeqID_172535
atggccacacttcctagctcacctccttctcctcctgagtcaacaacacctttttcactgtttacgttgaagaagacaagaaaagcaacacgatttagattgttggctactagaccagctggggtggagagaccagtgattcatgtcgatcctgtcactggaaaagccgatggtctccacaaaaagaaattaagaatatatttggggattgtcgcttgtgataaagtggatgttacatatgataattggaaacaagtccctgtcactcaaaaggatttgatctgggaggatattcagattgtaggagagcggtggaggcagtttgagtcatatttgacctccaaatggggcctggcacacgacagggagtgtgaggatgacaaagtatgtgagaagtacgacataagtaaagagaagtgggcccaattttgtcaaagtcgtagagacccttcatgggagtggaagatggcctgcacaaaaaaatcaggtcaaatggtgtctgaggcaacaaatgaaattgcagagaggattgattccctagaggagcaggtctcacagggaagctttgttgctcatggacgtcaggatgtattgattgctaccattggacgactagagcaccttggtcgtgtctatgctgctggagctggtgtcacaatcaaaaactactttggactgacttcaaggggcttttgcacctcttcgtccatggctgctgaagacctagagcagggaatcgcactgccttttcaggctaaggttggtccttttgttgctcatgtcagcacaaaagaaagttgtgtcgatccctcggggcatgacccagaaatggaagactcagacaaatgtggattgtatgttgatgacagtcctccccgactagttgctcttagaagagtttatgaggggtcgatgactatccataacgttcctttgggcaatgatcaagtgaaggttggtgttgaggaagtccgacatgctgatgctcgcgttcctgtacccactcaagaggttcagttaatggggcagacacttaacaccttccttatttggccgacacatcttgtaaagccttttttagaacagaataaacaagtagctaagggactgacaaaacctatagatatgttggatcctgacgttgatcccctgtacctgatgatattgaccatcccgtag

SEQ ID NO: 80851 - DNA, 531 bp, Glycine max
  Peptide Sequence Number=SeqID_172536
atgaattgtgttttcgttcatgcgtcctccaccttcgagtttggagccatgcgtagtgattgcttagtgcaattctctattctcaacccttttttggggcccatgatttgcgttttcattcatgcgtcctccacccacgagtttggagccatgcgtagtgattgcttagtgcaattctcaattctcaatctttttcggagccccatgaattgcgttttcgttcatgcgtcctccaccttcgagtttggagccatgcgtagtgatttcttagtgcaattctccattctcaaccctttttcggagcccatgaattgcgttttcgttcatgcgtcctccacccacgagtttggagccatgcgtagtgattgcttagtgcaattctccattctcaacccttttttggggcccatgaattgcgttttcgttcatgcgtcctccattttcgagtttggagccatgcgtagtgattgcttagtgcaattatccattctcaatctttttcggaaccccatgaattgcgttttcgtttaa

SEQ ID NO: 80852 - DNA, 501 bp, Glycine max
  Peptide Sequence Number=SeqID_172537
ggtacatcctttgtggtacaagtagagggtacatctacttgggttgttgtaactgagaacaagagagggtacatctcttgtggatcagttcaagtggaaggtacatccacttggttgttcaaagagaacaagggagggtacatcccttatggatctttgcttgtaaaggattttacaaggttgaaagaaatctcatggacaccatgcatagtgattgtgaaaggggatctagagccttcaaatagagagaaaaatgagagagaaccaagaagaagaaggagaaaaggaaaagtagagccaaggcgctacagagttgtgacgtggatcacttccttcatcatttctcttgttagtcttgtgctctacacaatgatcggttccaagtgcaagggatcgacttgggataactgtcacaccctaatttcgtctggggaccattgtttggtggcatgcaaccttcacatgaccgcctcgaggtacttaacactcatcgttaagtaa

SEQ ID NO: 80853 - DNA, 573 bp, Glycine max
  Peptide Sequence Number=SeqID_172538
atgggttctccacctgcctcccctcctcctcctcctcctcctcctcctcctcctgctcctgctccttcgaacgcatcggcttcgtcgtctgccgtgaagtggacacgcaaagcctcacgtctacgatcgttgtccactagaccacctagtgctgagagaccagtggtccatgttgatcctgctaccgacaaggccgacaatccccacaggaagaaattaagaacatatttggggattgtggtgcgtgataaggcggaatttgatatcccagaggcttctgacagtaggacaaaaaggaagttacttcagactatgggggagagatggagacagtttaaattagacctcacgaggaaatgggcccttgcagccgatcaggacggtgtcgaggacactgtctatgtgcgcaagaaggcacaagccatccagaagcagaatattgcccctcacgttttgtctcgtgggggttatgactatttggagcaaaagctcctggctgagaagacgaagaagaagttggaggaagttacacagtcaagaagtgttgatggcgtcatcgaccctccatccccg

SEQ ID NO: 80854 - DNA, 1323 bp, Glycine max
  Peptide Sequence Number=SeqID_172539
cccgcttaccgccgccggaggcagggtatcgacgttcaccgtcgccgtgatgttgccggtgctgacgttacccgccgcatcggtcaccgtggtgctcagcgtgtgcgcgccgttcgccagcgtggcggtggtgaagctccagctgccatcactccccgcggtcacagaaccaatggcgctggtaccgtcgtagatggtgaccacggcacccgcttccgtggtgccgcgcagcgttggcgtggtatcgcgcgtaaaggcgccgttcgccagcgtcaccggcgtaccgctgatgtcatcaatgatggtcagcgtactggcgaccggcaccacggtgtcgacgatcagcgtggtcgacacctgcgggctgacgttgcccgccgggtcggtctgcgtcacgttcagcgtgtggctgccgttgctcagcgcgttacctaccacgaagctccagctgccgttgctgcccaccgtggtggtgcccagaaatgtggtgccgtcgtacaccgtgatgcgcgcgcccgcctcgccattgccgctcagcagcggcgtgctgtcgttggtgacgccattattcggaatggtcaccgccgtgctgccgttgttgttgagcgccagcagattggtgatggccgccggtgccgtggtatcgatgatcaccgtggccgcggtggtaccgctgacgttacctgcggcatccgttaccgtcaccgtgatcgggtgcggcccgacgctcagcgctgccagtggcgtgaagctccagctgccgtccgcctgcacaatcgccgtgcccagtgccagaccgttgtccagaatggtgacgcgtgccccggcctccgccgcgctgacgctgccgcgcagcgttggcgtggtgtcgttggtcgcaccaccgttgacgatggtggcaccggtcgcatcattaataatggtgagactggtgttcgctggcgccaccgtatccacggtgaggttaatcacctcggaacggggactgacgttgcccgcgctgtcggtcaccgtcacgctcagcgcatgggcggcattgctcagcgtcggcgagacgaagctccagctgccgctggcgttagcctgcaccgttccgagcagcgtgttgccatcgtaaaccgtgacaatcgcgttcgcttccgccgtgccctgcagcgtcggcgtgctgtcgttggtgactccgttattaacgatagccacaccggtgacgtcgttggtcagcgtcagtccggttgccgccagcggcggcgcggtgtcgacggtcagcgcaagggacgctgcgggaaccgtaattgccggccgcatcggtggccgtcacgctga

SEQ ID NO: 80855 - DNA, 153 bp, Glycine max
  Peptide Sequence Number=SeqID_172540
atgatcctttcatcatggcagaacaagctaaacaggcccatggctactccacctgcctcgcctcctcctcctcctcttcctccttctcctcctgcagtagcatcgcagtctctatctaccttgaagcggacacgcaaagccacacggctatga

SEQ ID NO: 80856 - DNA, 423 bp, Glycine max
  Peptide Sequence Number=SeqID_172541
atgaaaggtcggattaagatttcgttctctaccgaaaccgcaagccaagttgaaagtagtttgtggtggctaaaggtggctgtgggtaatggagaaagagcttggaacattggaaatggttttggaagaaagaaaggagaagagatggcgttttttcctaagctacttggaccacaaggctcaaaacgcacaagtgagcaatgctctcgggaacggaaatgtcgcgcacactccaaacatcttctcagagatcccaacggtgagatcgtggacaagtgttctttgaagatgcaaaccaaatttcgagaagatccaacggttaaggaaggctgggcagtgtttttaccaagacagcttcatgtagcttccttgagaagcttcattaagaggcttcctcgagaagttttctcgtggcttctttga

SEQ ID NO: 80857 - DNA, 165 bp, Glycine max
  Peptide Sequence Number=SeqID_172542
atggaaaaaggggaggaggttgctgcccagctcgcccaggcgagctgggttgcttcctccagaagcaatccaacttcgaaaaatactctgatagacccacttcaaaatttcaaaattgctattcgcaccccctatttagatatgttcaccccctttctttcgtaa

SEQ ID NO: 80858 - DNA, 330 bp, Glycine max
  Peptide Sequence Number=SeqID_172543
atgaagacccttgatgaagcaatggacttaattgaaagcatggctgctagtgacattgccattctaagagatcgagcccacattcctaccaagaagagcttattagagctaacctcacaggacgctctgttggcacaaaacaagttactattcaagcaactagaggcattaacagaaacactcagatgtataatttgtggtggagctcatgattctggatgttgtatccctaatgaagagcaaattgcaaatgaagttaattatatggggaatcagtccagaggaaatttcaatacaagaggatttccaggatttcaaaacaaccagtag

SEQ ID NO: 80859 - DNA, 369 bp, Glycine max
  Peptide Sequence Number=SeqID_172544
gggcaggatcaccttgggctaccttctggagtagagacaaaacatgaacggcagaaaccaatcaaggtacttaaggacgaacgcgggcggggatggggtcacgaccgaccgatcgttgcccttctctgtgcgaaacaagcagagaatgtcgctgcaaggcagccccgaatggccccgaggaagcttgcctcaaagaggtccaggaaggacaaggcggccgaaggaactagttccgctccggagtacgacagtcaccgctttaggagcgctggcgccggcgaatgggcaccactggttactcctatggccaagtttgatccagaaatagtccttgagttttatgccaatgcttggccaacagaggagggc

SEQ ID NO: 80860 - DNA, 717 bp, Glycine max
  Peptide Sequence Number=SeqID_172545
atgaggaagaaaatcatagatccctcctccgggaagaagttctgcggcatccggcagcgaccgtgggggaaatgggcgacggagatttgggatctggcgagaagaatgtgtctctggttgggaacctatgaaactgctgaagaagctattatggtttatgacgataccattattcgtcttcgtggctctgatgcattaacaaacttcatgttgccgcaaagagattctccgtctccactgtcggtggtggcagagactccaacggagttccgaagcaactcgagcaaagaaaaattcgagtctcaacagaaagtagaagaagtgttgagagaatgtgagggtgaaactgaaacgagtttgttcgaggaaacaaaggaggagaatctgaatctacttcatcagtcccagatgttgggtgaaacggtgttgttttcctcggaggaagggttcagtgatgaaagtagtatcacgttggcaaactggctcatagatttcgacagagcgtgcccatcaccatcctccttgtgccaagtggacgatttcttccaagacattttgttagcttctgatcctgtcactactacaaatatgggagacgctgagcatgggaccgccaccgtggcgtttacagcgacgccgacagggactcactccatgtggcgtctgctaacgaggccatccgaagcggaccgccaccagcgcagctcagttacctaa

SEQ ID NO: 80861 - DNA, 267 bp, Glycine max
  misc_feature (174)..(174): n is a, c, g, or t
  Peptide Sequence Number=SeqID_172546
atgaaagcagtcattaggtacttccaagaatggacccgggaaggttccaggcaatttgtgaaattccaggacatgccgaaaaaccaaaaaaatattgatgcacaatcccacccaggcccacttgggccctccagaatattcctccagaaggctgttgcttctggaggaagcaanctggctcgcctgggcgagctgtgcggcaaccacctcccctattttgctataaataggggagcaagtgaagaagacaagggttcagccccttag

SEQ ID NO: 80862 - DNA, 285 bp, Glycine max
  Peptide Sequence Number=SeqID_172547
atggagtgtaccttcccgcttgggaccggacctcgtcctttaaccttagttggggctggtgcccaagtggtaacaccactggtgattgtcttgggagatgatgagaaggagaagaacaagagagggtacatctcttgtggatcagttcaagtggagggtacatccacttggttgttcaaagagaacaagggagggtacatcccttgtggatctttggcttgtaaaggattttacaaggttgaaagaaatctcaagcaccgttggttgcttggggactggatgtag

SEQ ID NO: 80863 - DNA, 111 bp, Glycine max
  Peptide Sequence Number=SeqID_172548
atgaagagatgcatgatgcgatcaaggaaaccagacatggtacaaagatacacaccaagaagtaacaacgcagcaaaggttatatatatatatgagaaaaacaacgaataa

SEQ ID NO: 80864 - DNA, 423 bp, Glycine max
  Peptide Sequence Number=SeqID_172549
atgggctcaaaaatctaccctaaggttcatgagaaccctagggccttctttagtagctctagcccaaggctcttggagtcttctatccaatacccttggggggtaggattgcatcaggtggcctggcctggagctcaaccctcaattgtgagaaccggtggaagctttgcagctcaggcacctcaacaggagagatccaacgaggctactgctcctcctgagcctacacctgcacaggttgaaccagtgccagctgatccacattctccagtggcagatccatcttctcccaaacttgaagcagctcccccatcttcacctattattatcatctctgaagaccctacaaagtcaacacctggagaagttgttgctctctctgattcccctattttccatctgatagataaggaggagtcatag

SEQ ID NO: 80865 - DNA, 467 bp, Glycine max
  Peptide Sequence Number=SeqID_172550
tgcgaagaaaagataaggagcttaaaggaagtagcaatggcatcatcggcggttatcacaattggttgaagtctagaatgcaagggataaagtggctcccaaagctaaaaagtctaagtggaaaagaggctgaaattcctgaggaaagtgaagaagtgcaagctctgaaagcggagctcgaaaaggcaagagtggtgaaagagaagctaatgacggcagtcactaaggtcaggaaagagaacaagttccgaggggctctatggggcaacagtaacgagctcaagcttagaagggctgagagggatgaatcgaggatggaaagcatggtgttagaaggcctaggatcttcttcatcaatggattcctttgcttcttggaagatgaatggcagaggaatggagaaggaagagagagaggagacgccacttcaaggagaagatgagtctagaagaagctcaccaccatag

SEQ ID NO: 80866 - DNA, 324 bp, Glycine max
  Peptide Sequence Number=SeqID_172551
atggccaaaatacaaggcccaaaagaaggaaaaacctattttaatatttacaaagaagagtggacccaaccttggcccatgggctcaaaaatcaaccctgacgttcatgagaaccctagaaccttcttcagcagctctagccaaatcctctcggagtcttctatccaataccctcgagagtcttataaactagttgtcgcaacctacccttcggcgggagggcgacgcgagactcatgggtgcgtgttccaagaaaggaatacgcgcggagtcgccaccaatgtttatttgaggaaaacgtcgaaaaaactggaaaagacgtga

SEQ ID NO: 80867 - DNA, 423 bp, Glycine max
  Peptide Sequence Number=SeqID_172552
atgccttccaaggttgttttgatgatgccaaagaatcaagagttaagcaaattccaaagatttaagaatctagtttcaagaatcaagattcaagattcaagaatcaagtttcaagaatcaagattcaagaataatcatgatcaagattcaagactcaagattcaagaatcaagagaagactcaatcaagataaggtacatcctttgtggtacaagtagagggtacatctacttggggattgttatactgagaacaagagagggtacatctcttgtggatcagttcaagtggatggtacatccacttggttttttcaaagagaacaaaggagggtacatcccttgtggatctttggcttgtaaaggattttacaaggttgaaagaaatctcaagaaccgtaggttgcttggggactggatgtag

SEQ ID NO: 80868 - DNA, 251 bp, Glycine max
  Peptide Sequence Number=SeqID_172553
atgaatgtcttgtttagggctgttcatgtgtcctccactttcgagtttggagctcaacttcatgattgcctaagtgcggaccctcaaggcaatcctccatactccacctttgttcagagcaccatgaatatccgttccttcgccaaggcaggacggacgaaatcagtgtcctatctttgctttcctcttatctccgatgagaggcttgcgcgttccgtgaaattccgtaatgtggcggaagtcgaaaagag

SEQ ID NO: 80869 - DNA, 330 bp, Glycine max
  Peptide Sequence Number=SeqID_172554
atggtcgagcaagaagaaagggaagtgaagccacaccaagaggaaacagaagttgtaaacttgggtgttggtgaagaaagaaaggaagtcaaggttggcactggtatgctcgcaaacatccgagatgaattgattacctctaaatcccaagtgctccccagtaaagcagaagctgaggaggatgaagcccgagatgtccctgaagataaaagaagaaattcaacactggattcttggtcgtatctcgatacccggaataggttaccaacatggtgccagtccctaaaatggatggaaaggtgcgaatgtgtgtggactatcggtatctaa

SEQ ID NO: 80870 - DNA, 636 bp, Glycine max
  Peptide Sequence Number=SeqID_172555
atggttgaagctaaagtccctgaggagagaaaagaagtgcaagccttgaaagcagagcttgaaagaacgagagtggtcaaggaaaagctcaagacaacaatcactagggtcagaaaagagtgtgacgagctaagggatgtcaatgtgactatggccgaagcgttagagcgggaaccaaagagggcccataaggaagaatggagcaggaacaagtttcgaggggctctgtggggcagcaacaataagctcaagcttcgaaggaccgaaagggacgagtcaagggtggaaagcatggttttagaggataaattgaaggcttgtcaaaggtcgaaaagaagtttgactgagcagctgagtataacagaagaaaatatgttgacaatcattgaccagtataaggagaaggtaaacctagttgctacccatgagcaaaagctagaggatgagcatgcaaaggtatcggctctgcaagtggaaagggaagcaagagagagagtgatagaatcattgcatggtgaagctatgaaatggatggataggttcgctctcactctgaatgagagtcaagagcttccaaggctattagccaaagccaaagcaatggcagacatatactcagctcctgaggaagtttag

SEQ ID NO: 80871 - DNA, 549 bp, Glycine max
  Peptide Sequence Number=SeqID_172556
atggctaacaagcttcaacttatctttaggctcaccgatccaaacatggctagctacctcgtccttataggaccaaagcagtgtcaaatccctagggcctcctccaaatggcaatctgatgatatggttgtgctgcctgctgctgctattgtcaagctacatctgcatcacaatgcgttgacacagtcacatgaggaggacaagggagaagggaagggagagataaggaagtttggacgaaggtggaataagaaggagaaacgagaagaaggattgggcggatggggaagagggaagggggggcaaatttacccgccattgccattggcggcaaggctgaacccgccatacccactggcggcaaaggtggaaagaggagagtgccgccaggagcaggagcgatataagccacgtaggagggagagaggacagtgtcgccaatgcaaatggcgacacccaagctacgtgggactcgcccacagtgatggcgagatagggccacgtgggactcgcccacagtgctggcgagacaggccaggcttcacgtga

SEQ ID NO: 80872 - DNA, 238 bp, Glycine max
  Peptide Sequence Number=SeqID_172557
gaaaagatccatctggatattggaggagatcatagccatcaaggagagcttcaacttgttgtttccaattaggataattgttgggaagaagtttggtgacattggtgaaagtgatgcaagcaaggggtttggatggctcatgggggttgggaatgaaggagttgttgtcggccatgggaggcaagggtggggaacgacgtccttaattgaagaaatagggaatgggtggatcgtttag

SEQ ID NO: 80873 - DNA, 402 bp, Glycine max
  Peptide Sequence Number=SeqID_172558
atggcagcgcagttgatccatgatcgtgagaccctcgaaggcaatgagaggtgccgattccgtggcacaattcggctcactgctacttcattagtacatccggaggaacccgcacacacacttcagcagcctgtggagtggataccacctacacctactccatatcgactagtggagccagttcaagtgatagaggtgtcatcctctgaagaagatcttgaagaggacccagaggagttacctcctgaacctgctgtggatgcccttgacttcccagaggatgatgaggacccactccctgatgttgattctccagaggatgttatgtcagcatctgaggcagactctacagaggagagcggccctagagggacagcaaatagtgatgactcttcatcatag

SEQ ID NO: 80874 - DNA, 288 bp, Glycine max
  Peptide Sequence Number=SeqID_172559
atgtctatacagaaagatttgtatagtcctaggactgcttccatggattttatgggtgagttggctcgaaaacacaagaaagaaaatcttcaaaaatttattcaattcattgttgaaatttttagaaggtatgatgaagcttctgtagaatacaagccctatagacaaaaagatggtgctcttcttgctattggggcactttgtgacaaattgaagcaaatcgagccatacaaatatgaacttgagtgtatgttggaattttctattccaataattaatgtggactaa

SEQ ID NO: 80875 - DNA, 330 bp, Glycine max
  Peptide Sequence Number=SeqID_172560
atgaattttgcagtgaaaaagcctgtagaattcaccccaattccagtgtcctatgctaacttgatcccatatctacttgataattcaatggtagccataaccccagccaaggttcatcaacctccatttctccgagaatacgattcgaacgcaacgtgtgcttgtcatggagaagccccggggcgttccattgagcattgtagggctctgaagagtaaggtgcaagccattggtctgtttgctcaagcgacctatgctcttgagtttggacttccaagaccgttcaatcagagattactcgtcttgcacgttggtgtgggggtgccataa

SEQ ID NO: 80876 - DNA, 469 bp, Glycine max
  Peptide Sequence Number=SeqID_172561
ggttgagacaaggagaccctttggctccattactctttcacttagtgggtgaaggactgacagggctaatgagggttatacgaaccggctctccacgcaatcgagagaattttgctgctgtcttgtggtcactatgcaccggagatccactgcaattaaaactagcgaaagaacatggtgtagaagcagcactacaggagttgttagaaaatggaactgatagagctaagataaaagctggaagcatattggaactcttgcagcgaatggaagggggacctgctatcaagtcagcagcaacaacagaaccaggtagtcaaaacggaaagaaattggaaggtgggagcaacggcggatgggagtggaagctatcttggaggatggctctttttgatggtgaaattcaaatggcagataatttccttggagaactatcacagcagcagattcagccaaatagggaggatag

SEQ ID NO: 80877 - DNA, 318 bp, Glycine max
  Peptide Sequence Number=SeqID_172562
atgcctctttccatgtgcgtgtcacttggagagatagagataatgcccacacctgacttcgttgtcatagacattgaagaggatgttaacattcctcgcattcttggccgcccattcatgtctactgcgagctgcgtggtagacatgggaaagaagatactgcagatgggcatagaagatcagaagatcagctttgatttgttccatgagtacaaagatccacttagccaaaatgtctgtcttaaagtgcatgtgatggaggaaaagagacctgagaagaaggtccttgaagtaggaactcttttggatcctggataa

SEQ ID NO: 80878 - DNA, 363 bp, Glycine max
  Peptide Sequence Number=SeqID_172563
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagttcatcaagtcaaggtcaagtatggaagtaaccagcttgcaaaaattagggcaaaagatgaatcgagttacatcgctcctttgtctactgccaacacatga

SEQ ID NO: 80879 - DNA, 459 bp, Glycine max
  Peptide Sequence Number=SeqID_172564
atgaccacgttggtctatacttgtcaatcggacttggggtctccgaatggtgaggtgcggataaccggaaggtgtctccacctgttgccagactcttgggtcatgatagcaaaaggtggggtggtcgacaaaagcggggcttttgctcctacgtatactcaatttgtgatgaggaactcagacctacgtagttcttgcaaaatagtaggaaacactgggtccaacaaaatagaagaaaatcactcaaagtgtatcaatctcacacatcgtgttagcagctcaacagtgagtgacccttctttcttaggagaccccaccgttcctccttccgagggcaaggatggaaattctcatcctaggtcaaggtttatggtgagttcagattttggctcaaggcttgtagaacgactggacatgatgtatgtcagagtgttggtttggccaacgtttcaaggataa

SEQ ID NO: 80880 - DNA, 474 bp, Glycine max
  Peptide Sequence Number=SeqID_172565
atgcgttcgtgggtgaggggtcagtggattcccattgacgcagatgccctcagccagttcttgggtgacccgctagttttggaggaaggccagcaatggaggcgggtgcggatcaagcgcaccagcatgaccactttgacccagacatggatgacactgctgctcaccaatgtcttgcctatcgatcataactctgatctccctttgcctaagtgccagttggtgtatgccatcctgacacggatgagcgtccacgtggcccaggtgattgctgacgccatctatttgtttgcaggtatgccacccaccaggcaccctctggacctggataaatctaacagggccctggggtttccgacgttgatcacgggcctgtgccagtcattcggggttcccgttacccccagtaaagtgatccgaccgccaatcacttgggccttcatcgagaagtactgcatgcctaggcaggcgtag

SEQ ID NO: 80881 - DNA, 444 bp, Glycine max
  Peptide Sequence Number=SeqID_172566
atggaagtatcagttggtctgtgccattgtgacatagggatcgcccccataagacaccgagtggacccagaggagtccaacaaggccttgggtttccagctttggttacgggcctctgtcagtcctatagggtgcccgtaccccctagcaaggtcatgccatcatgatataggggtcgcgctcgcaagacaccttgtggacccggagaagtccaataggttctacggagtgcccgtcgcccccaacaaggtcatcaggccccctattaatcgggctttcatcaagaagtactgtgccccccaggcaggcgcaaggcaagacaccacagcagcttggggatggccggcagtgggcaatagacttaccgccgccacctctagagcccctcagctcatctacaaagcctggagggttgcctacgacccgtggccgaccagcaggtga

SEQ ID NO: 80882 - DNA, 403 bp, Glycine max
  Peptide Sequence Number=SeqID_172567
atggccagaacacgaggtttaggtcgtgcgataggtaaagttgtaggcagagatagacctgctgatgaggatgctgctgatgttcctgagaggcgtaggcctactgcctcagcccgtaggctacgcgttcatcagatgactacggagggacgtgatatggctgaggacgtcgctgacatgattgacgatgttgatgatgctgctgagggattccctggtggtccacgtgacccgtcagtgctcacatcatttgctgagcatgttgcacatgctgtttggagtggacgtgaacgtcctgatttgaagttagtgtcacatgggagaaaggtgacactgattgggaggccagtgcctgagattgaaggcctggtggctgccacaggcattaagtcaactgatagat

SEQ ID NO: 80883 - DNA, 480 bp, Glycine max
  Peptide Sequence Number=SeqID_172568
atggccccgaggaagcttgccttaaagaggtccaggaaggataaggcggccgaagggactagttccgctcctgagtatgacagtcaccgttttaggagcgcggtacaccagcagcgcttcgaggccatcaagggatggtcgtttctctgggagcgacgcgtccagctcagggacgacgagtatactgatttccaggaggaaatagggcgctggcggtggacatcactggttactcccatggccaagttcgatccagaaatagtccttgagttttatgccaatgcttggccaacagaggagggcgtgcgtgacatgaggtcctgggtaagggatcagtggatcccgttcgatgcagatgctatcggattttgcccggactgctgcagggaggcgagtgcgaatcatgcgcaccaacatgaccaccctgacccagatatggatgacgttgctcctcagcaacatcctgcccagcgatcataa

SEQ ID NO: 80884 - DNA, 387 bp, Glycine max
  Peptide Sequence Number=SeqID_172569
ttaggccaccacttcaagaactctgtagcaccgcctacatacctcgctctgctaatcctgttaccagtggctgctgccagtggcgataagtcgtgtcttaccggcgccacgcttcccgaagggagaaaggcggacaggtatccggtaagcggcagggtcggaacaggagagcgcacgagggagcttccagggggaaacgcctggggggcggagcctatggaaaaacgccagcacgcggccttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtga

SEQ ID NO: 80885 - DNA, 255 bp, Glycine max
  Peptide Sequence Number=SeqID_172570
atgtcgactattgtattttctattcaatccctgaataatatttggatgatgtctattattgatgaggacatgttcaagagcaacggcaatgatccacttgaaggacttggaggacctatgacaagggctagagcaaggaaagccaaggaagctcttcaacaagtgctgtccatactatttgaatacaagcccaagtttcaaggagaaaagtccaaggttgtgagttgtatcatggcccaaatggaggaggactaa

SEQ ID NO: 80886 - DNA, 669 bp, Glycine max
  Peptide Sequence Number=SeqID_172571
atggctcccaatcgcactcagctacagaatatgtttaagaaggaagttggtaggctgcatgccttccagcttcgcggacttagtattcgccggggaaagaatcgaagtagggttgaaaagagggaagttcgattacttttctccacaagtgccaatgctaaaataatcagagcaactggggcaaaaaggaaggaaggagatacccatgccgtcacttcagcgcccgcatgggtcaaacccccgcaaacctctcatggtacacatcagtacgcgcaacatcatccaagcttttcagctcgtgccgggaacccctccaattcagcgcccgtacagcctagagtgccagcccccatcccgagggaggctccccaaactccagctccaaccacgactcgctcggccgacaatgcccactttggtgccggtcccaacgcaatgaggaactttcccccgaggccaattccagaatttaccccactcccaatgatgtacgaggacctcttgccgtccctcatcgctaaccaaatggtcgtaataaatctcgggaagatctaccaacccctttcccaaagtggtatgatcctaacgcaacttgcacgtaccatgggaataccccgagccattccatcgaaaaatgcctggcccttaaatacaaggtccaacatttga

SEQ ID NO: 80887 - DNA, 264 bp, Glycine max
  Peptide Sequence Number=SeqID_172572
atgcttgccgcccagctcgcccaggtgagccaggttgcttcctccagaagcaacagccttctggaggaatcttctggagggcccaacaccttacaaggaccaaacaaaggtcgcatgtcatcaagcaaaggtccccggacgaaattagggtatgacaagctccagcaacaagctttttgcaaagcttacggtaagatcagggacctagccatggcagaggtctccgcagaggccattgcctccctcgcccaatactatgactag

SEQ ID NO: 80888 - DNA, 580 bp, Glycine max
  Peptide Sequence Number=SeqID_172573
gatcccccgagtccagcattggccaaggaaagggaagctttcagcagggaagctaagtgtgaagtatgcaattctgcacaggattggagctgcaaactgggttcccaccaatcatacttccactgttgccacagaatcatttgctgtcaaattacccattgccttccctactgtattatgtggcattatgttgagtcagcatcccaatatgttaaactacactgactctgtgatgaagagagaatctcctctatccctgcattacaaactgtttgaggggacacatgtcccagacattgtctcgacatcagggaaagctgcttcaggtgttgtgtccaaggatgccttgattgcaggacacatgcaagacagtggcattgatgatggtgaagcagctgaggaagaagaagatccagctgagcaagaagaggcagctgaggaagaaggagaagcagctgaagaagaagaagaagctgctgaggaagaggaagatgcagcagaagagacagaatcagatgatgattctgaaggggagttgtatgacgttgagggggagactgctgctgctgatgatgactga

SEQ ID NO: 80889 - DNA, 432 bp, Glycine max
  Peptide Sequence Number=SeqID_172574
atgtctaaacaagcggatatggattatgaaaatgaagaagcatgtggtgcaaatgaaccacatgttgattgttcggatgcgttcaatacttctcaggtgtttgagtgccgagaggatgttttgtggtgggctcgatccgttgctcatgaaaatggatttgtggcggtgattttaaggtcggatacaaacacaggtagtagaggaaggactacatttgtgttaattggctgtgaaaggagtggcgagtataagtgtaggaaaaaagaatttatcagaagagacactgggactaggaaatgtgggtgtcccttcaagcttcgttgcaagccagtggttggaggagaaggctggatggtgaagttgatttgtggagtgcataatcatgaatttgtcaagtcattagttggatccatatgcgaggcgattgactaa

SEQ ID NO: 80890 - DNA, 482 bp, Glycine max
  Peptide Sequence Number=SeqID_172575
atgcgtggcatgcctcctgttcgtatcttaactgggatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccaggcgtttcccctggcggctccctcgtgcgctctctgttctgctttcggtttaccggtgtcattccgctgtatgccgc

SEQ ID NO: 80891 - DNA, 459 bp, Glycine max
  Peptide Sequence Number=SeqID_172576
atgcgatgcttcactttcagagatttccagctagtactcatgcttgaggagtttgaaaagattgttggatgccttctgggaggaactaagcctttcttccctttgggacactcttcgtccatacctagattatctaaagtgttaggaattccgatgattgaacttagagagaaggagatgaataggaatggagttaagagcttcccgaagaaattcatggaggataaggcgggagaatgtgcaagtaaaggatggcgggggcctacttgtccattagaagatttctgcatggcgcctgataagagcaagattaattgggaggagcttttggctagcttgacaggctcaacaatttgttggttcccaaggtgggaggaggtgcctaatgtgttatgtcgatgtggagttttccctaacctccctctgatgggaacaaagggttatgtcaactattgttga

SEQ ID NO: 80892 - DNA, 282 bp, Glycine max
  Peptide Sequence Number=SeqID_172577
atggatctcaacggaaaagtcattactaatgacgataataaaaagattcatgacgctgttaatacacttatttttacaatagcccaacactatattggcgatccaaccctttggaaagatagatctgccgaattattatcaaatcttaagtgtagaattttagcagatttgaggtggtatatggataccttcctaactagagtttacaccagagaagatggtcaacaacctttctggaaagaaaaatttctagccggccttcaaagattattaggagataag

SEQ ID NO: 80893 - DNA, 482 bp, Glycine max
  Peptide Sequence Number=SeqID_172578
atggtgaaagttggaacctcttacgtgccgatcaacgtctcattttcgccaaaagttggcccagggcttccccggtatcaacagggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgacgacccgctctcgccgcggaagcagctcgagcagtccaccgacagccgacgggttcgggactgggacccccgtgcccagccctcagagccaatccttttcccgag

SEQ ID NO: 80894 - DNA, 312 bp, Glycine max
  Peptide Sequence Number=SeqID_172579
atggagcctggaaacacatacttttcacatgagatgcgaagagtgcactattattcttcaagatgcatttgttttattaggtctccgtgtggatgtgtcaccattaattgggctgatttatgtggagaattgttaggggtagaaaggtttacaggtgcatggatcctaagattcattggaggtgtcttatttgttgacaaaggcagtaacaaagttttcctaagagagatgtgcagcgccaccgattataaaattaaatcaattggaggtggctgtgacggaaaaatcaacatatcggcaaagatgatttga

SEQ ID NO: 80895 - DNA, 939 bp, Glycine max
  Peptide Sequence Number=SeqID_172580
atgagtcgtcgcgttgccactatcaccctgaacccggcgtacgatctggtcggctacacgccggagatcgagcgcggcgaagttaacctggtcaaaaccaccgggctgcacgctgcgggtaaaggcatcaatgtcgccaaagtgctgaaagatctcggcatcgacgtcaccgtcggcggcttcctcggtaaagagaatcaggacggctttcagcagctgttcagcgaactcggcatcgctaaccgttttcaggtggtgcagggccgtacccgcattaacgttaagctgacggaaaaagacggcgacgtcaccgacctcaacttctcgggctttgacgtcacgccccaggactgggaccgcttcaccgccgactcgctgacctggctgggccagttcgatatggtgtgcgtcagcggcagcctgccagcgggcgttgcgccggacgcgttcaccaaatggatgagcgatctgcgcacccactgcccatgcatcatttttgacagcagccgtgaagcgctggtggccggtctgaaagcggcaccgtggctggtaaaacccaatcgccgcgagcttgagatctgggccggccgcaagctgccgacgctgcaggatgtgattgacgccgcgcaccagctgcgcgagcagggcattgcccacgtggtgatctccctcggtgcggaaggcgcgctgtgggtcaatgcctctggcgaatggatcgccaaaccgcctgcgtgtgaagtggtcagcaccgtaggcgctggagattcgatggttggcggcctgatttatggcctgctgatgcgggaatccagtgaacacacgctgcgtctggcgacggcggtggcggccatggccgtcagccagagcaacgtcggcgtgaccgatcgtacccagttggccgcgatgatggcgcgcgtcgacttacaacccgttaactaa

SEQ ID NO: 80896 - DNA, 630 bp, Glycine max
  Peptide Sequence Number=SeqID_172581
atggccattgatttctattcttatgtgaatgcaaggggattggagcaacatgagcagagacagctggagttccatgaggagccgaatgatttatgtcaattgtcagatttaaagtcagatgattctagagtggagttgtctgcggaagctgcgctacaggcaaagccaaaaagactagataaatatgtgaaacaaacctcaaaatttgttggagaagagggtgcttcccgtaatattggaggtcacacaaacaatgatgatttagggaaaattgttgatatgtcagatttccaggaaagcgaagatgctgattggaccaggacacgagatttgattaagactggagatagagaagatgtggaactagtaagctgcaataccaaagggttcattgtttcttttggttccttggcaggatttctgccataccataatcttgcttccaagtggaagttcttagcttctgagtcatgcaaaactcaggcacctattacaagttttgatgctgaaattaagaacttgtctcctgattctcctccatctctggagattgatggtaaagttgaagatagaatttcaccagatatgaaattggaagatttgctaaggatttatgatcaagatagttga

SEQ ID NO: 80897 - DNA, 603 bp, Glycine max
  Peptide Sequence Number=SeqID_172582
atgagggtctgcgtgtgtgtgtttctgtgtgtctgtgtgtgtgtgtgtgtgtttctgtctgtaacctgccccaagacacaacagacagttgtgcatacagcccttacccttaactatgttttgaagagtttgattgctttgtggtgtgaaagcaacaatattgagctaccaaagaggcaagggaactgtagaacaaagaaatgtggtggcaacagtaagaaggatgttgttactgctattttcaacctatctatttatcagggaaataaaccaagagctgtaaaagttggtatagtagccccactgatacaatttttgaaggatgctgggggtggaatggtagatgaagcagtagctattatgacaatccttgcaatccaccatgaaggcagggtagcgatcggtcaggccaagccaattcatattcttgttgaggttatacgaaccggctctccacgcaatcgagaccatgctactgctgtcttgtggtcactatgcaccggagatccactgcaattaaaactagcaaaagaacatggtgcagaagcagcactacaggagttgtcagaaaatggaactgatagagctaagataaaagcttga

SEQ ID NO: 80898 - DNA, 1557 bp, Glycine max
  Peptide Sequence Number=SeqID_172583
atggaccaattgagaattgatgtggattttccaagtccagatgcagcttcacaagtgggactactgcataaggaaattgttagaaaagctatgatttacaagttgtatcaagttgatgaagaaggagatgctgataaatttggtgaggagttgaagcaacaatgtgaggaaaataagctacgtttgcctgatgtttttgataaagtcaccctaacaggtgattcactgcttcatgtggcagcagatttggggcaagaaaggatggtggagatgatttgtgatctctttcctgtgcttctaactaggagaaatgtaagaggcgacactccacttcatattgctgtgaggtccaagaacactagtatggtcaacctcattctttcccaatatgccacaaagaagtcaacacatgatgagatgaaagataaagagataacaagagaaacaaatgaatgtggggatactcctttgcacgaggctgtctacagtggggatgttgatgtggttaaagatattttcgaccaggataaggatgtagtccattgtttgaacaagtcaaagagatcaccactgtgtttggcagtggtgaatggtaatgagcaaattctcaaacttctgttgcaaattccattacctgcggaccagccgctttcacagtgtcgtcgaagttctccactccacacagctatacaacatcaaaaagaagaattcttggaacttgaatggcccattaatccttatattgtcctcaatcaaaagggtcaaaacattcttcacattgcggcaaagaatggaagaggtggtgtggtagaatacctactaagaaattgcaaaacttatgatctatctataacccagaaagactatgatgggaacactccattgcatttggcttccaaaaatttatttccggaaattatccacttgattacagagtattataggactggtctgaatctcacgaataaggacggtttaacggctcgagatatcagtgagacctttgaacatccaatgttgcgtaaaagaaagcctggaaaagacatccgtgaggcatttttgattgttgcagcgttgttggtgacagtgtcatttgcagctgcttttactgtaccaggaggtgtatatagctctgatgacccaaaccctaaaattagaggaactgcagtttttgctcgtaaaccattattctggatattcaccatcttcaatatcataactatgtatagctctgcaatggcatgtggatttctgtctctgggaatatttcttcagtctgaattaactctaacaattcaaccttcgttcttatatttgtcaagtgcctttttcacagcaccagtggcgtttatagctgctgtagttctagttgtggccaataaccgtttactcacaattgttacaagcgtcattggatgcttgctcactttctacaccgttcttttaatgctactttcactactagtatctccactagatggaacttcgacgactaaagcaaacaaggacaaggacaaggacaatggattagaagagcatgtgcaacaaggcaattga

SEQ ID NO: 80899 - DNA, 576 bp, Glycine max
  Peptide Sequence Number=SeqID_172584
atggatcctgatcatttgaaatttcctatcgaagatgatgcaagctggaaagagagacgcagcaagaggatggaggaactgaagaacacacaattctcaggtcaagatgcagctttagaccctggactactgcataaggagcttgttggagagaaaactattctgatttctgagttgtatgaggctgttgatgaaaaaggaaatgtggataactttgttgatgtgttgaagcaagaatgcagacaaaggaaattgaatttgtctgatatctttgaacaaagaaatgtaagaggtgacactccacttcatgttgctgtgaggtccaagaacactactatgatcaacctcattctttcccaatatgcattagtgaagtcaacacatgatgatgtgatgaaagatatagagataacaagagagaaaaatgaacttggggacactcctttggatgaggctgtccaaagtggagatcttagtgtggttgaagtcattttacaaagagataaagatatggtccatgaattgaacatgtctaggtgttcaccactgtttttggcagctgctagtgagaattga

SEQ ID NO: 80900 - DNA, 513 bp, Glycine max
  Peptide Sequence Number=SeqID_172585
atggctactccacccagctctcctcctcctcctactgaagcagcatcacaatcgtcgtctaccttgaagcggacacgaaaaaccacacgactcagatcattggtgactagaccagctggggcagacagactggtggtccacgtcgatcctgcaaccggaaaggccgacggtccccacaagaagaaattaagaacatatttggggattttcgctcgtgataaggtcagcgtgacatacgagaattggaagcaagtccttgctgctcagaaggatttgatatgggaggatattcaagataaatttgatatccctgaagcatctgacattaggacaaaaaagaaagtacttcagactgcgggggagcggtggagacaatttaagtatgatttgacatcaaaatggacacttgcagccgacaaggacaatgtcgatgaaactgtttacgaaaaatatggcattagtaaggagaaatggacccaattttgtcagagctgcagagacccctcgtgggag

SEQ ID NO: 80901 - DNA, 207 bp, Glycine max
  Peptide Sequence Number=SeqID_172586
atgatattgcacgagattagaaggccttactctctaaaaacagcccccagcggagtcaccaactattgcaacctatccttcggcgggagggcgacgcggggctcacgggtgtgtcttccaaggaaggaaggcgcgcgaagttgctaccaacgtttattcaaggaaaacgtcagaaaaaccggaatgcgtgtggtctacgaactttaa

SEQ ID NO: 80902 - DNA, 207 bp, Glycine max
  Peptide Sequence Number=SeqID_172587
atgaaaacacacaaaaagatgataacaaaagatgatgacaaaggtgatgacaaaaagctcaaaggtcaatcaaagaatgagttcaagatattcaagatagaatcaagaacacttcaagattcaaatcaagaatcaagattcaagagatcaagatttcaagaatcaatattcaagagatcaagattcaagaatcaagagaaggcttaa

SEQ ID NO: 80903 - DNA, 138 bp, Glycine max
  Peptide Sequence Number=SeqID_172588
atggaaattcgaatggataaaagctataatttgtttgacccattcattggtgcacataatgtaaggcagtgtattatgtgccatatccagcaacaagaagggacaaacatggttgatatgtcatcaggtggtgtttga

SEQ ID NO: 80904 - DNA, 336 bp, Glycine max
  Peptide Sequence Number=SeqID_172589
atggagattcctgagaatcgaaggtggatgtatcagaggttggatgataataaacgttggacaaatgagtttagagaaggagtgtttgaatttgtacaatttgttattagtcaggacatgtttcaaatgcaaggagaacgaacaaggtgtccatgcaagaaatacaaatgtaaagttttcaagtttgtggatgggtcaatgacaagtcccgtgaatttgttgagaaatatcaacatcgtcgagatgaaatcttacaacattcgacagaggaaggcacatctacacaggattcccctaacactgctacttctgttaatgataatgaaatatatttga

SEQ ID NO: 80905 - DNA, 300 bp, Glycine max
  Peptide Sequence Number=SeqID_172590
atgcacaagcttcagtggctaagcgcgaggaagaatccagaagaagatgagctgtcaagtttgctaagcgcaccgcttcaggacatcaagtgcacgacttcagctcatccgctaagcgaaacaagcgcgctaagccaaaatccacttatgcgcgctaagcgatccagatctgcgctaagcacaaaagcacgaacaaggccacggtcattcaatagtgggaactggtctgattctaaagtccttgatagtacgggactaagttgttgtgctatcacgaggaatcagggtacaagaacttag

SEQ ID NO: 80906 - DNA, 207 bp, Glycine max
  Peptide Sequence Number=SeqID_172591
atggcacgcagagacaaaatttggtcattctgcacccttctgtcatccagaggcggcgggcccgatgacatgcggagacaaaatttggtcattttccgcactcacaagatctgtcatactgactttggagtcacgctgacgggcggaaatacccgagtggttatccgtataaacattcttttgctatctgtaagacagaacgcttga

SEQ ID NO: 80907 - DNA, 597 bp, Glycine max
  Peptide Sequence Number=SeqID_172592
atggaaacaaggggttgtattaattattatcccgtacttgccataagacaactaggctatcctatgagaggggcgccatcggaagagggtatcgcgcctttcatcgcacgaggctttagtgacctcaatgcaaaaatgcttcaaagagtccgaaaagcatggaatgcagtgcaaaggaatgataaagagcttagaggaagcaacaacggtgttattggtggatttcaagtgaggaagaggctgaaatccctgagcaacaacaaactcaagcttcgaagggctgaaagggacgagtcgagactggaaagtatgatattagaggacaagttaaagtataaagagaagctaaatctagctgctagccgtgagcaaaggctagaggacaatcatgcaaaagtgtcagtcatgcaatgggaaagggaagtaagggagagagtgacaaattcattacacagagaagctatgatgtggatggataggttcgctttcacattgaatggaagtcaagagcttccaagactattagccaaagccaaggcaatggcggacgtgtactcggctcccgaggaagttcatgggcttttcgattattgttag

SEQ ID NO: 80908 - DNA, 906 bp, Glycine max
  Peptide Sequence Number=SeqID_172593
atgaaaaaagccgatttatatatccgtgtgtcaactgatgagcaggcagataagggatactcgcaaagagatcaggaggaacgattaaaacgttattgtgaaaacaataacattaaagtaggtcaaatcatttatgaagattactcagccaagacttttatcaggccagagtggattaaattactggatatgctaaagaaaaaaagctcaaaaacggatctgctgctttttacaaaatgggatcgcttcagcaggaacgctggcgatgcgtatcaaatgattaacatacttaggaaaattaacgttgaaccgcaggccattgagcaacctttagatctttcaattcctgaaaataaaatgatgctggctatatatcttgcagcaccggaagttgaaaacgacaggcgcgctctgaatacttattatggaatgcgccgtgctaaaaaagaaggcagattaatgggaagggcaccttatggctacgctaacagaataacggagaacggggaaaagtatgtaatcccgaaggaaccggaagcttccaatatgaaatgggcatttaatgaaatgtccaaaggcgtttattcagcgagccaaatcatggatatgatgaacagaaaagaaggaaagtcagttaagataagtgcctttcttgcaagtttacgcaataccgcatattgtgggaaaatttacgtggagcaattcaatgaagaggaggctcattttgttaaaagtattcatgaacctttgatcagtgaagaactattcgaaaaagttcaatgtataatggatggaaatgtgaatccagccagacctaatgtaaaagtactgtctgacgataatttgccattaagaggtttccttgtgtgtccggaatgtggtcatttgatcacagggatcctctag

SEQ ID NO: 80909 - DNA, 579 bp, Glycine max
  Peptide Sequence Number=SeqID_172594
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttcgctgttcctctatcctccaccctcaaatattatccggagccccatgaaatgcttatcattcatgcatcctccaccatcgagtctggagccccacgaattgattgcctagcgttcgctgttcatgctatcctccgttacaagcacggagcctctggtgactgggaaatatggctttttgttattttcccgatcggttccttcgctaaacat

SEQ ID NO: 80910 - DNA, 591 bp, Glycine max
  Peptide Sequence Number=SeqID_172595
atggaatcgagagctccaagtgggccatttttggtaagcagaaactggcgatgcgggatgaaccggaagctgggttacggtgcccaactgcgcgctaacctagaccccacaaagggtgttggtcgattaagacagcaggacggtggtcatggaagtcgaaatccgctaaggagtgtcctgcccaccctggaaacggctcagccggaggtagggtccagcggctggaagagcaccgcacgtcgcgtggtgtccggtgcgcccccggcggcccttgaaaatccggaggaccgagtgcctcccacgcccggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactggtacggacaaggggaatccgactgtttaattaaaacaaagcattgcgatggtccctgcggatgttga

SEQ ID NO: 80911 - DNA, 390 bp, Glycine max
  Peptide Sequence Number=SeqID_172596
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttggattgtgcaaagcctgacccagaagtgagtggagacactgaaaagaattttgctgagctattgacagaagaactcaagcttcaggagagccaagctgtggaaaatcagcaacgtgctgacatggcattgcttgaggcaaaaaagattgcatctcagtatcagaaggaagcagacaagtgtaattcaggaatggaaacgtgcgaggaggctagggagaaggctgagttgagggtaccgagctcgaattcgtaa

SEQ ID NO: 80912 - DNA, 357 bp, Glycine max
  Peptide Sequence Number=SeqID_172597
atggtcaaccaaacattcataatagattcaagtctctttgtagaagcaaagcttcatgatgaatcaagattgattcaaagatgttttgatgataacaaagatgatgacaaaggtgatgacaaaaagctcaaaggtcaatcaaagaatgagttcaagatgttcaagatagaatcaagaacacttcaagattcaagaggaaagttgaagaacacttcaagattcaagaggaaagttgatttcaagaatcaagaatcaagattcaaggatcaagcttctaagaatcaagatcaagattcaagaatcaagagaagacttaatcaagataagtatgaaaaggttttttcaaaaactgagtag

SEQ ID NO: 80913 - DNA, 171 bp, Glycine max
  Peptide Sequence Number=SeqID_172598
atggggtggttggagtaccaaggaaatgttaagaagcaaaagcaagagtcttggcagccaatctatatgacaccttcgaccgaagatgtgaaaagaatagtgcaaggattgtttgctgtactctggccctctacgtatggttggtttcacaccttttctaccaagaggtga

SEQ ID NO: 80914 - DNA, 240 bp, Glycine max
  Peptide Sequence Number=SeqID_172599
atgttggtgcgcatgatccgcattcgtctctttgcagcggcacgggtgaaatcttgccccggtatgtatagtagctgtgtgatagcctccctctctggttgtgctctcacagttggtcaccctccaatatcagggggtgtggatatggagcccattgaatgtgaggacacgcaaccctctaaagtcggggacgtgtcaccctttgagggcgtccagtcctctggaggggaggacgtgtag

SEQ ID NO: 80915 - DNA, 120 bp, Glycine max
  Peptide Sequence Number=SeqID_172600
atggtattgctgatgaatggaagtggaatggagaaggaagatgattggagatgccacttcaaggagaagatgagtcaagaagaagctcaccaccataggaagccatggataagagcttga

SEQ ID NO: 80916 - DNA, 378 bp, Glycine max
  Peptide Sequence Number=SeqID_172601
atgggtgaagcagaggaggtgcaagagcagatgaaggccgacatggaggccatgaaaaagcaaatggccataatgatggaggccatgatgagcatgaagaagataatggaggtcaatgcagctgcaatagccgctaccagcaccattgctgaggtggacctgaccccccaatatggcctcaaccaaataaatcatccaaccttagacatggtaggttttagaaggcaaagagttgggaggtacgggcgaccctcatttagtgtgaaaaacaagcatgccttctgtcataccctaatttcgtccggggattattacttgatgacatgcaacctttggttagccgctttgagatacttggcgtcctttgttgcacaataa

SEQ ID NO: 80917 - DNA, 204 bp, Glycine max
  Peptide Sequence Number=SeqID_172602
atggtagccataaccccagccaaggttcctcaacctccatttttccaaggatacaactcgaacacaacatgtgcttatcatggaggagttttagggcattccattgagcatttgacctgcgctcctgagtttgacttccaagtttgttcaatcagaaattgctcgttctacatgtttggtgaaggtgctgtaaacgacgagtaa

SEQ ID NO: 80918 - DNA, 96 bp, Glycine max
  Peptide Sequence Number=SeqID_172603
atgttgatgatgttaaaaatgcactgtgatgatgttatgttgttgacctggttggatatccctggtgggagaaatagaatggttaaagagttttaa

SEQ ID NO: 80919 - DNA, 322 bp, Glycine max
  Peptide Sequence Number=SeqID_172604
gttgtacatcgaagaaaatcctccccacctagttgccctaggaagactttataagagatccacaatcgttcacaacattcctttgtttcatgatcaagtcaaggttggtgttgaggaggttagagatgcagatgctctcattcctgtacccactaaagaggttaagttagtggggcagacacttaacaccttccttgcttggtcgacacatcttgtcaagcgtttatcagaacagggagctgtgggacccgcgaaacctacaattaagtcggatcatgatgtcgatgatcccctatatctgatgacattgaccatcccatag

SEQ ID NO: 80920 - DNA, 240 bp, Glycine max
  Peptide Sequence Number=SeqID_172605
atgggggttcactgttatcaagcaagtcggagacctagcatgaccacagattcacctccactccttatgttcccatcgacccgatggagtcaccaactgtcgcaacctacctttcggcgggagggcgacgctggactcacgggtgcgtcttccatgaaaggaaaatgcgcgaagttgccaccaacgtttatccgaggaaaacatcggaaaaaccggaaaggtgtgatctacgaactttag

SEQ ID NO: 80921 - DNA, 2796 bp, Glycine max
  Peptide Sequence Number=SeqID_172606
atgattcagaacattgatatgagacttgaatcgggaacttgcaatgtgtgctcagctccttgttcatcttgcatgcatcttaaccatgctctcatggggttaaaggctgaagagttttctgatgaaaactgtcgcataggagaggctaattctatggatgaggataatgaatattctcttaggagcagagcttgtgaaagctcacagcacactgtcagtgaagcaagtaatatgcagagtgtgaattcaagtcatgacgcactgtctgaaaatgctgacagtagacagatcatactgaataagtatcaggattccaagcatttagaaggtcttgatgacaacacttcttgtattagtagagccagtgatgctaatttagtgaacgatagccatcaaaggaatgaagagagaataataatgaatgtggaaagggattcattttctcatgtcccagaaaagttgtcagaatgctccattgagaattctagttcatcattgaccaaagagagggaacctgttgtttctggcgagaaatatattgctgttattgagagtacttctaagatttcactaaaagtatgtcctaagtcagaagcagatactgatgtctgtgatgctaacaatgaagatcctaaatatgcagttcaagacggacagtgtgagaaagctcaagagctggttaaatcccctggcaagcaggaacctcaatctgatgacgagagtgatgaatcagatgttgtggaacatgatgtaaaggtgtgtgacatctgtggagatgctggtcgtgaggatctacttgccatatgtagtaggtgcagtgatggtgcagagcacacctactgcatgcgagaaatgcttgagaaagtccctgaaggggattggttatgtgaagaatgcaaagatgcagaggagaatgaaaataaaagactggatgttgacgacaaaaaaatggttgaagttagttcaacctcacaagtttctggcaaaagactctctgataacattgaagtagctccagcagcaaaaagacaagctcttgaatcaagtataggatcaccaaagacgtcaagtcccaagagattagttccactgtcccgagaatcttcatttaagagcttagataaatcaaaagtgaagcctggtcttctgatgcctattcgaaaccactctggtggtattgatacagagattgctcgctctccttccattggtccccggggtcaaaatccaaaaggtatgctgttgaagtctaattcattcaacaacttaaattccaagccaagagtcaaacttgttgatgaagttgttccccccccaaaaaaagggggtaatgaacatacttcaaagaacatggagatgcctgctcgggtgactggaaaatctacattattcaaatcctcaagtttggggcgatcaaatgcaactgaatcaaaagtgaaaatgctttcgccaaagtctgcaactactcaggatttgaaaggatctagacatctaaaagaatcaggtgcatttgacaggaaatttccatctaggattgatcgtcctgtggctagtttggttgtttccactcctaagggtgatcaaaagcttacacctcatgctgaaagcagtaaagcttcagcaatgaacaacaatcgagagttgaaggttaaccaggatggaaaatcatgtgcattaccaaggtcaatgagtaatataagccggaaaagtttggagcctcaagttagttcagagagaacatcaacccgtgttgatgaaactcaacaggatgtgctgtctcaatcacgggagacagcaaatcaggttgagagaagcagagatagttctagtgatcgtggaaggccagctgttcctacttcaaaaaacccattatgtcaaaaatgtaaggaatttggccatgctttggaatgttgtacagctggttctacacaggaatctggtgctgaaatatctgtcactgcctcgagtagttcaaaagaggagatgcataaagacaatatattgaaagttgcaatccaggctgctttactcagaaggcctgaaatttacaagaagaaagaagtatcttatcaaactgacgaggtttctacctcaggcacagagttgaattgtgaagtgacttcaaaagaccaagttttggtttccagcacactgaagaatagcatatctgctgatgaaacccaagaacaacaagaaatccttgagaattctacctcagattcttccaaatgttcatctgccaatgatttgaagcaacttaactcttgtccaactgactttcggtccaaaccaggaaagtcagattccattggtcttgcagctggaaagcctgtagtgagagacttgtctgataaagctgtgacaatgtccagtgttcctttgaagatgttggcctttcctgaatatgaatacacctggcagggtgtctttgaagtgcatagaaatggaaagcctcctgatttatatactggatttcaggcacatctatcctcttgtgcttctcctaaggttcttggggtagtgaacaagtttctacccaaagtttccctcagtgaagtttctcgcttgagcatgtggccttcacaatttcttcatggtggtgttagtgatgataatattgctctttacttctttgccagggatgttgaaaggcaagcatatggatattattcttatattgacagtgtggaccatgaaatgcaaaagtttcatttttctttgttgcaagagttaaccttttacttatgctctgtcacagttatgagagacactacaagggtctattggatcacatga

SEQ ID NO: 80922 - DNA, 2610 bp, Glycine max
  Peptide Sequence Number=SeqID_172607
atgacacttgctgccactgaccccctatctgaaatagtttggtctccagataaaggtttgagtcttaaatgtgctgattcaagctttgctcataaaaatagttctcttcttcgggatgttggaacaagctgtatggtttttgctccgccacaaaattttactggcggcagttctaccactgataaacctttagatgatgattttctgaaacctatagcagttgtatgtgccaagagtgatattgctgaagcagatgctcctactatgcctcctacaggtgattcaggtgtcaaggccaagtgtaaagcctatgaagaagatgatataggatctgttggtaataaggagaaagtaaacaccgcagcaacagcacctaatttgcctaatgaacaaaatgggaatctaacgaacaattgggaaaagattaccggtgatcaagccaacagtggaactgataaagtatctgggatagagggaaacagaatttctgctatttcaggccaagctgaccaagggccatttgatcatttattacttcaatcagatgaaaataaacctagcatggaccaaaatccttctccagggagacattctgatggaagcgtaaatattggtcttgaaaaaaaggctgtagtaactgatgatgatttacatactgcagttgagcctataattgaatacagaggctctggtgctcatgagactaatttagcatcctccagcaagaatcctttagaaaaactggaatatagtgcagagaatgatttgcaaactttcaactgtgaagctgcttgtgctggaacaagcagagttaatgttagtgagactgaaaacaaatttcaggacactgaaatgatgctaccatgtgataagattcttccagttttgcattctccatgtcatagcagaattcatatggcaataaacaaaggcaaggaaaaatccttatccgatggggatgcaaatgtaatgttatcaagggaggagaatgacagccattcaagtgttgagagctgtaacagtactggctttttttcaacaggtaagaagagacgtaactttcaacaacagttgataattgggagtaaaagagtcaaaaagcaaattgaagaatcttctggtcccaaatcctatgttaaacaggataactcgttcatgaactggatttcaaacatggtgaaaggactctcaccatcaattcaaaatgattcaaacactttggctcttacccttgcaaatccagatcatcataatctacagcctgacgagaaacttatcgcatgcaatatgaatcaagatcctgagccaaaaaatacaggattcaaatccatttttcagtccatatgttgtccaagcttgaagaatgtaggaacgagaatgtctcatcaagaaggaaagagtagtcaggatttagtgccaggtaacatggaacatggaatagatgctactccaataacctgttgggcagaaaacaatagcctttccaaactgtgtttgcaatcaaataagtttgaagtatctactgggggaaatgatgccggtctgtcctcgcagcctaagattaaacctctaaatttttttaactgtcatgaaagcagcaaaaacaacccagtggagactaaaaattattccatcttgggccatagtaaggacaaggaagaagtggcatcacattcatcttcaaccaaacaaaatacagataataatgataacatcgattctaatgtgctatgtgatagaaaggaagaagagaatatctgtcacagaagagataatctgggaagtctgtggataactcgtttttctccaaaattcactgctcccttgagagaacaacctgccaatgacacagaggtctctactgatcttaaggaagataagggaaataatgatcataaatcaatgtatttgttcaaacccctttcatcttccccaggattcagaaatttagagccaacggcttcaatgtttggaaggagatttggtgccatcaaacaaatcataccaacaaatgcaacagatactaccacacaggttaatatgttgtgttttttttgtggaacaagaggacatcaactctctgattgcttagctattgcagaaaacaagttagaagatctccagaagaatatagattcatatggaggattggaagaacatcattgtctatgcatcaaatgttttcagcccaaccattgggcaatttcatgtcccacttcaatctcaactaggaaacatgaactgaaagctaatgccttggtcaatgattgtggaaaacatttaatctcgagcaatgaagggagtgccaggctgctgactgatgaggatgaccgagttttatctggaggttctattaatgatgaaacagatcaacgagcaggtcaaaatattaatttgaagtggaaatcaaatgaaattataacccataaggtagggtgcaatgcatcattcaagaaataccgtggtttgagttcagaggaaaacaaattcagagaaaatcctacattatctccatccaaattggctgaaaggcagatttcacaggtgccaaaggaaatatttgaagcagtaaaaaagcttcaattgtcccgcaccgacatcttgaagtaa

SEQ ID NO: 80923 - DNA, 1788 bp, Glycine max
  Peptide Sequence Number=SeqID_172608
atggcttcttttcttcttcgccgcaaccgcaacctattcgctcgctctctactcggaaataaggagccttttcgtccatactttcagttaaagtttctaagtttaggtggtgctgcaaacaaggtgcacccatatagcagcagcaatggtcccatcagaaatgattttactgatttgacttgccctcatacatggtatccacaggcccgaaggaaacatcgcagggttatcctgcatgttggtccaacaaatagtggtaaaacacatcatgctttgaagcaacttgagtcaagtgcttctggtgtatattgtggtcctttaagattgttggcatgggagatagcaaaacggttgaacaaggcacaagttccttgtgatctcattacaggtcaggaaagagaggaagttgacggtgccaatcataaggctgttacagttgaaatggctgatctatcagctgattatcaatgtgctgttattgatgaaattcaggcaattgtattactaattgagaattggagtaattgttttatgactgaaacatctgcatttgaggaggaattgatggcattgtgggctttgatgatagggtgtactacaaggggatattcatttacacgtgctttattaggaattgctgctgatgaacttcacctttgtggtgatccagctgctgtgccccttattcaggagatattgaaaattactggtgacgagattgaggttcaattttatgagagactgtcacctttagtcccactgaatgttcctcttggatctttctctaatgtaagaaatggtgattgcattgtaaccttttcacgtcaggagatatacaaattgaagaaaagaattgagaaagaaggaaagcatctttgttcagtggtttatggatcactgcccccagagactcgaacaagacaggcaagcatgttcaatgatgctagtagcgagtttgatgttcttgtggccagtgatgccattggaatgggtcttaatctaaacatctctaggatcatattttcaaccatgaagaagtttgacggttttgaggtgcgggatttgagtgtacctgagatcaaacagattgcagggagagctggtagatatggatcaaattttcctgtaggagaagtaacgtgcatggatgaagaggatctactcttgctccattcatctttgaattctccatcacccattttagagcgtgctggcttacttcctacctttgatctgatgtatatgtattcacgattacacccaagaaatggtttctatcaaatactggcgcattttcttgaccatgcgaaattgtctgaaaattatttcattgtcaattgtgaacaattactgaaagtggctgctgttattgatgagcttccccttggattacatgagaaataccttttctgtatcagcccagctgacatggatgatgaaatttcatctcaaggcctaacacagtttgcagagaattatgcaaagaaaggccttgtcaggcttcgagaaatatttacaccaggatcactcaaagtgcccaagacgccagctgctcttaaggagttggaatccatccacaaggtcttggatctgtacgtttggttgagctttcggttggaagaatctttcccagaccatgagctggccgtatcccaaaaggccatttgcagcatgttgattgaggaattcctagaaagactcgggtggcaaaagccaatggctagaaggttggcttctcataaaatgtcaagtcccctattatcccaacacatgaggaaatgcctttaa

SEQ ID NO: 80924 - DNA, 255 bp, Glycine max
  Peptide Sequence Number=SeqID_172609
atgggcatcaaagctgctgatgaagatcccattgtcagatttcatcgttctgggttgtggttgatcccaattggtccaaagcacgatactttatggttttctggaattttgttccttgaagtggtagttgatcaagttcgttcacttgtcgctcccaatatcaaattgtctgaacagctgaaacaagttctcaaaactgatcaactggagttgtgtccaatttggcaggtacaagacatggtgaaacaggcctga

SEQ ID NO: 80925 - DNA, 369 bp, Glycine max
  Peptide Sequence Number=SeqID_172610
atgaaacaaataggcatatatgatcaactggcaaaggatactgaagagtgcacatcctcatcttcggacacaagcacgatgcagttggaaaagcaaggaggacaaacgcaaagaaaaaagctaacagaacaagctcgaagaggttctgaacagataggaaggttgcagtttgaggtgcagaacatccagtatattctgctcaaactggctgatgtgaagaacaacaaatgcaaaaacaaaaactctagaccaacaggaaaaatagcagaaggcgccgtaaggggtgtgtttgtggatgttcaaggccttcaactaatgaggactaagtcagatacactagtaaaattgaaggtttgtcataagaaataa

SEQ ID NO: 80926 - DNA, 333 bp, Glycine max
  Peptide Sequence Number=SeqID_172611
atgggcataatgaccattctgggaataggcatcgatcataatattccaggtaacgacatctcgatgagacactttatcaaacaccaaacgggcatccatgatgcgtccacatgcatcatacatggcaatcaaggcagtctgaataaatgggtcagcgtggaagaagccgaacttggaagcgaggccgtgaatctccaagcggagactgaaggcagaaagtttagagacggacttgaacaatggggggaagctgaacctatcgagagggcggtgtggggccgcgagagaattgacggttggagaaacgggtgggagaagagggagagggcgtag

SEQ ID NO: 80927 - DNA, 786 bp, Glycine max
  Peptide Sequence Number=SeqID_172612
atggcattttctagttcctcaccatctataccagaaaaatacaagaaactcgtatcatctttcttctgttctccaaagctattcgccaatttcacatccaaagtgttgtgtgaaactgaggctatgatgagtccaacctacatacttgacaccaagcccttctctggcttgaagaacccttttcggtcagaaacaaacagccccagaaccccagttggtgaacacaagcgttgttgggataagttggattcaaaggggcttgttgatgctcttggtgaaataacatcaaagtcacaaagcagaatgattctgtttggatcccagctcaagattcagaatcatcctcccctgcctcatgcaacactttctcctaaatctgcttttgggtgtgccaattcagcttttgaaacctccaaatctccgagagttttctctgctagtgaaatggacctttcagaggactacactcgagtgatttcccacgggcctaaccctagaactactcacatatatgataactgcatcgttgagagtggttgttttgatgttggatgctcttcttctcccttggaaaatgtgtttcttcctcctcacatcagctatccctccgagagcttcatgagcttctgtttttactgcaacaaaaatcttgggcaggatatggacatctacatgtacaggggtgagagggcattttgcagccgtgaatgccgtaaccagggaatgctgttggaggaggggatgatcaaattggaaggtggagatatgtatatgggtcatagttga

SEQ ID NO: 80928 - DNA, 3309 bp, Glycine max
  misc_feature (125)..(125): n is a, c, g, or t
  Peptide Sequence Number=SeqID_172613
atgaacaaggatggagctcaggtgcctccactctcacagagggagaagtttaattcggacgagtccattagggttcaggggaagaatggtgttttgaaggtaatggttaataagaagaaggtggntggtccatcagaacagtattatgatcatcacaaacccttggaaagcaggctaaggttgaagactgaagagatggctaagaggttgaagactgaagaggctgccaagaggttgaagactgaggggacttccaagaggaatattccaattcgtccttcctcatacatcgataagaaacctgttgataaaccagcattacataagaggccagagaagaaaaggatagcatcaagaaaatcattgtcaagcaaggatagtaagggtgatgagggggattcagataacagtgacacatcattgaatccaagaataagaaatactgaagctcgtaagtctgtgaaaaaaataatctctgaggatgagcagactcctgtgcaccaaaaaaccccaaccacaagaacaaaagaaggaaaactcaagcgtggtagtggtacagaaaaacaaaaactgcgggaacaaataagggagatgctgctgaattcaggttggacgatagactatcgacctcggaggaacagagactacctggatgctgtttacattaatccagctggtacagcctattggtctatcatcaaggcctatgatgctcttcaaaagcaattgaatgatgatgctgatgaggtcaagcccaaaggggatagttcttcttttgctcctattgcagatgaggttctcagtcagttaacaaggaaaactaggaagaaaatggagaaagaattgcaaaagaagaagaaaaggcatgatagtgaaagtgatagtgaaaaagagcctcaaaggaaaagatctgccagcaacaagcataatatgaatagcatggatagtgatagctacgaggagaaattaagctcctttataaaacagggaaataagtcaatgaaaaacaaaatgtttgaaaatacctctatcagtgctcgctctaaaatccagaatgctacccatcactcaagtgatggaatagaaaaatcattatttggatgtgatcctcatatacatggacggaagagtaaaaaacatggaagatgtactttgttagttcgcagttctaacaaaggatcaaattcagaatctgatggctttgttccatatacgggcaagcggacagttcttgcctggttaatagactctggaacagtagagttaagccaaaaggttcagtaccgcagacggaagaaagtcatgctggaggggtggatcacaagagacggcattcactgtggctgctgtagtaagatcctcacagtttcaaagtttgagcttcatgcaggaagcaaattgccacagccacatcacaatatatatttggaatctggagtttctcttctacagtgccagatagatgcatggaatagacaagagcatgctgaaaaaattggtttccatgcagtggatattgatggaaatgatccaaatgatgatacttgtggtatttgtggagatggaggggatttaatctgttgtgatggctgtccatcaacatttcatcagagctgcttggatatacagatgcttcctcctggtgaatggcattgtccaaattgcacctgtaaattttgtggcatagccagtggaacttctgataaagatgatgcatctgtgaatatcctacagacttgcatcttatatcacaactcttgcactaaggagatgaatacccttcctaataaaatcaattcatcaagcctttctttttgtgggaaagagtgcaaagagctttcggaacacttgaagaaataccttggtaccaaacatgaactagaagcaggtttttcatggtgtctcattcatagattagatgaagactcagaggcagcttgcaggggacttacccagagggtagaatgcaattccaagttggccattgcactgactgtgatggatgaatgctttttacctgttattgatcggaggagtgggatcaatttaatccgtaatgttttatataatagtggatcaaactttagtcggttgagctatagtggcttttacactgctattttggagagaggggatgaaatcattgctgcagcatctatcaggttccatggaactaagattgcagagatgccattcattggaacacgccatatatataggcgccaggggatgtgccgccgacttttttctgccattgaattggtaaaccttgaagctatggccctttgctctctgaaggttgaaaaactagttattcctgcaattgctgaactcacacatacatggacaacagtttttggcttcacatatctagatgaatcactcaggcaagaaatgaagtcactgaatatgatggtcttccctggtatagatatgttacagaagctgttagtggaacaaggaaaccgtgaaggttctgagaaaatggaaaatggaaacaacgattttatcaagaccaaaatgggaaataggtcagatatgggtttttcaactccacaaggtcctcgtggaagtgatgatgttagttcaaatcctgctaatgagacaaatgatgaatgcagcgatgcttctcaagaactatacaaccaagttttggttgatgggattatctgttcccaatctcattctgaggaaatgatgtctgatccaatttcagataaatgtgattctccttctagaactagtcacagtgaactagaaatgaagaataaagtagcggctgctcctcctgtcgatagattagattcttctaccaaatgtcaatccatttatccaattgacagtcacccagtagatattctgaaagttcaagctttggttcaggaaactgcttgttctgatccatgtccagcagaagaaaaccttgacaagaagtgtcactcatccactgccatgaattgtgattcatcggagcttgacattaatccagtgttggattctgaaatggcagacaatactctgcctactaaagaggtttgtatgaatgatgttcttgaagttgttccttccgggaatatatctgaagataatattacaaaggggaataatcgaaatgtagatgaatccagttctgctctcaatcatgctgatgagagtttattccaagtaggatctgattccaacggtgaaattgggtgtgagaatgaaaaggatttacttttaaacccgggagttgcttcaaatgaaacagattttgatgaaagtggcgtaaatgcttccggtgatagttccgagactgtcatagtctaa

SEQ ID NO: 80929 - DNA, 363 bp, Glycine max
  Peptide Sequence Number=SeqID_172614
atgccttgggatatctgttgttctgaacctgggttttgtcgtgactgtgtttgcagcctttgttgcaaaactgtttcttcagcttatggtggctatagttatatcaagtgcaaggtgaacgttggtgggggcatctgtggccatgtttctcatatggaatgcgctcttgaatctctcttggctggcaaagttggaggaagtattgggctagatgcccagtaccactgccgacactgtgatgggaggtctgttattatttctcaagttaataatcttctacaaacatgtagagctgctgatttggatgatgagattcggaataagattttgaatcttggtgcttgtctcttgcgtggttcatag

SEQ ID NO: 80930 - DNA, 336 bp, Glycine max
  Peptide Sequence Number=SeqID_172615
atggaaagagaagagattggaaaaatccacgatgtgttcctagatgcatctcgtcgcaccttaaaacatgccgtattaatatatctgagtggctggttgcaagtagtgatgtttccaattgatagattgtcatcccatcacgtggcttccgcaaccaccacgttctggatcatgcaactctacctgatgtacaaacgcatcattaagaactattttggctccgttgagaaaacggaggaggcaagaataaggaagaaagaacctatattggcaagtataggtgttatccgtggattaaggactcaattagaagcaaaaacgttggatatgagataa

SEQ ID NO: 80931 - DNA, 231 bp, Glycine max
  Peptide Sequence Number=SeqID_172616
atgcagcttgtggaatgtgtgatggaacgtactcttcttgtgagtggaatgcatctggaaccaaagcttcttgagtggagagatgagggattgcagccaccccatttggtgaagtgggtgtggctcatgcaggcacacgaggctttgtttcttgttatttccacctgttcctctagggtgccttacaagagtgaagacaatactcaggaatgtcttggtgactcagcttag

SEQ ID NO: 80932 - DNA, 739 bp, Glycine max
  Peptide Sequence Number=SeqID_172617
atgggtgcggggctccgcgagaagcaccattgggagctagaaaatctgacactaacctcacaacctttcaaaacattgaaattcttcacattagctgttattcaatacatcaagaaaacatcattatatctattggcaaaaggtggatgggttatgcttttcagtgttgcggttgggactctcggcatagtgctgatgacccttggttgcctccatgagaaggtatttgtattcagtcacccacatgctctagctacttgcggtacttgcactgccgctctatctgcgggacacgctgcctggagcatcgccaggaagactttcgagacaaagggatccccaagccaagatccatcgtcgccatcttactcgtctgagccgacgagtaagatggcggtgatggatcttggccttggggatcccttgtatcaaaagtcttcctggcggtgggtccaggcagcgtgtcccgcagatagagcggtggtgcaagtagctagagcatccgtgcaatgtggccgagttgatttgaaaagtgctccatatgatacgacacaattaagtagaagtgcttcttggcttgataaaaactgttctgagtttgggccaccattattccagtcagtatatgattcacaggttccgcttagcagcattttgcctcaagttcagctggaggctattctatggggtattggaacagctataggggagcttcctccttactttatctccagggcag

SEQ ID NO: 80933 - DNA, 2004 bp, Glycine max
  Peptide Sequence Number=SeqID_172618
atgctgtccaatcatttccaaaacggcatcgaaacggcgaggctcgtttggtcgcggattcctaattcggaagaatcgcagctcctcgacgacgccgttggcatccttaagaagaacgacggaggcggtgtcgagagccttgactatgaagtcattgagaattttgcttatcgtgaggaacaggcgcagagggggaagctgtatgtgagctatttgctggtggtgaaatggttctttgccttgctcattggcatttgtacaggacttgctgctgttttcatcaatattgctgttgaaaattttgctggctggaagttctcagtgacatttaatataattcagaaatcatatattgctggatttgttgtatatgtcctgatcaacttggctttggtgttttcctctgtatatattatcacacaatttgcaccagcagctgctggatctggtattcctgaaatcaagggttacttaaatggagttgatattcatggcatccttcttttcagaactctaattggaaagatatttggaagcattggttcagtgggtggaggccttgctcttggtaaagaaggtcctcttgtccatactggtgcttgtattgcttctttgcttggacaagtaacctgtggatgtgcagctggagttgctgcagcatttagagctccagttggtggtgtattgtttgctttggaagaggttacatcttggtggaggagtcaactcatgtggcgtgtcttcttcacttcggctgttgtggctgttgtggtccgagctgcaatggggtggtgctctttattcaaccaacttacactttatattaccacttggcgtcgaaatcatcttcacaagaaagggaacagggtcaagattattgaagcatgccttgtatccattttaacatcagccatttcatttggcttgccacttctaagaaaatgtagtccttgccctgattctgatcctgcatctggtattgaatgtccaagacctcctggaatgtatgggaattatgtaaattttttttgtagcaaagacaaggaatacaatgatcttgcaactattttcttcaacacacaggttatgttttatgcgttagctgtggtcacatttggtactgctgtgccagctggtcaatttgttcctggtataatgatagggtcaacatatgggcgtcttgttggcatgtttgttgtaaaatattacagaaagctcaacattgaagagggaacgtatgctttgctgggagctgcatcttttcttggaggctcaatgcggatgacagtatctctctgtgtcattatggttgaaatctcaaataacttaaaatttttacctcttattatgcttgttcttcttatatcgaaggctgttggtgatgcttttaacgaaggtatctatgaggagcaggctcaattgaggggcattccattactggaatcaagacctaaatatgagatgcggaatatgacagcaaaggaagcctgtggtagtggaagggtggtctctttccctcgtgttgttaaggtttcagacgtagtttccattctgcggagcaacaaacacaatggttttccatcaaaggttgatttccagcatagccctttaccctctgatcctagaggtgggggcagatcaattaggcatgattctggtgaatttgcaaagcctgtttctagtaaaggaatatgtattgatgatatacatttaagttcagatgacttagaaatgtacatcgatcttgctccgtttttgaatccctcaccatatattgtaccagaagatatgtctttgacaaaggtatacaatcttttccgtcaacttggtctacggcatttatttgttgttccccgcccatcacgtgtgcttggtttgataacaagaaaagatttgttgattgaggacaaggaaaatgtgaatacgttagagcttcagtcaactagtgtaaggtctctgatgctttactcactttacttcctatacagttttttcaaattctaa

SEQ ID NO: 80934 - DNA, 207 bp, Glycine max
  Peptide Sequence Number=SeqID_172619
atggtgagcggagaggggaagtgtagcaagcccgaagtggaggttggggtgcagcacgtgacttgcacggaggatgctgcggctttcgttgctcttgccgcggccttggatttgagtatcgacgcttgcaagttgttctctcagaaactccgaaaggagttgaggcatgaggatgtacagttaggaaattatttggcatttgcttag

SEQ ID NO: 80935 - DNA, 978 bp, Glycine max
  Peptide Sequence Number=SeqID_172620
atggctgtaactgtaaggagggtacttgcctttgcttcttcctcttcagccccttttttcaatctcaatcaaaatgcaaacttgcgctatattctcccttctcctcgtcatctctccgcattttcagttgattccattttgcggttgacttgcgtttcaagcttagaggatggttctgttgctgataaatttcacaagtggcataatggaggtggcactctccacgagtcagcttccattgactccacagcactcgtagaggttggcgctgtagttcattcagagtctattgttggtccaaatgttcgtataggttctggaactattgttggcccttctgttacaattgctcattcaacaaacatagggtataatgttgcacttagtaattgctgtataggtgattcatgtgtaatccacaatggagtctgcattggtcaagatggatttggattttacgtggatggtgacggtaatatgataaagaagcctcagatgttaaatgtaataatagggaacaatgtggaaattggtgctaacacctgcattgacagaggcagctggcgagatacagttattggggacaattcaaaaatagataatttagttcagattggccataatgtagtaattgggaagaattgtttgctttgtggacaagttgggattgcaggttcagcaaccataggagattatgtgactatgggaggaagggtagcaatacgagatcatgtatccatcatatcaaaggttcggcttgctgcagcaagttgtgtaaccaaggacatcaaagaacctggggactatggtggctttccagctatttcaattcaccaatggcggagacaagttgccagtagatgccaggctctggaaccatcagatactaaacctgttcttgtttctgcttacaccaggggtagaagcaaggatatgtcccatgtacagtggaaccaagaatctttcaaggtgttgtag

SEQ ID NO: 80936 - DNA, 2211 bp, Glycine max
  Peptide Sequence Number=SeqID_172621
atgtttgattctcaccctcacttgcttgatatgtcaccaccccacaagactacttgctctgagagtgatttggcaaagccctgcagagatgatgagtacgagaccaaatctatcactgacaccatggacgctccttctggcgacgaccaagatcccaacccgcgacccaaaaagaagggttaccgccgccacacacagcgccaaattgaagaaatggaagccttcttcaagcagtgtcctcacccggatgacaagcaaagaaaagagctgagccgtgagctggggttagagcctttgcaagtcaagttttggttccaaaacaagcgcacccagatgaagactcaacatgaacgaaatgaaaatgctattttgaaggcagagaatgaaaagcttcgcgctgagaacagcaggtacaaggaggccctaaccaatgctacatgccccaactgtggaggcccagctgctcttggcgaaatgtccttcgacgagcaacacttgaggattgagaatgctcggttaagagaagagatcgataggatttcaggaattgctgccaaatatgttggaaagccagtgacttcttcgtactccaacctctcatctctgaataacaaccacgtgcctgtcggtaactatggatcacaatcaggcacggtaggagaaatgtatggaggcagtgacctttttaggccactcccagctcctgctgatgctgacaaacccatgattgtggagcttgctgttgcagctatggaggaactcacaagactagctcaggctggagagcctttgtgggtcccaagcaaccaccattctgagattctaaatgaagatgaatacttgaggactttccctactagaggtttaggacccaaacccttgggcttgagatcagaagcttcaagggaatccgtggtggtcatcatgaatcacattaaccttattgatatccttatggatgtgaatcaatggtcaactgtgttttgcggtattgtctcgagagcattgacccttgaagtcctttcaactggaatagcaggaaactacaacggagccttgcaagtgatgtcatctgagttccaagtcgcttcaccacttgttcctactcgtgagaactatttcgtaaggtactgtaagcagcaaccagatgggatatgggcagtggtggatgtttccttggataatctgcgacccagtacaatctcaagaagccgaagaaggccctctggttgtttaattcaagaattgccaaacggttactccaaggttacatggattgaacatgtggaagtggatgatagagcagtgcatagcatatatagaactctggttaattcgggcctggcctttggagctaaacgctgggtagctacattagaaagacaatgcgaacgtcttgccagttcaatggccaacaacataccagcaggggacctctgtgtgataacgagtgctgagggaaggaaaagtatgatgaagctggcggagagaatggtaatgagctattgcactggtgttggtgcttctaccgcgcatgcttggacaacgctctccgcaactggatgtgatgatgtaagggtaatgacaagaaagagcaccgacgaacctggcagaccccccggtatagtgctcagtgctgccacttctttttggcttcctgttcctccaaagagggtttttcatttcctacgtgatcaaaactcaagaaatgagctgatacaatatatccaattgaattctcagtgggacattctctccaacgggggtctagttcaagaattggcacatatagcaaatggtcgtgatcccggcaactgtgtctctttacttcgagtcaatagtgcaaattcaagccaaagcaacatgctgatacttcaagagagttgcacagattcaactggctcatatgtagtttatgctcctgtggatattgttgctatgaatgttgtcttgagtggaggggatccagactatgttgccctgctcccctcgggctttgctattctacctgatgggcctcctgcattaaacggtgggcccatacatgatgttgggtctggaggttctctactcacagttgcattccagatcttagttgattcagccccaactgcaaagctatctctgggttcagtcgccactgttaacagtttaattaagtgcacagttgaaaggatcaaagttgcagtcatacgtgacaacaccacctga

SEQ ID NO: 80937 - DNA, 675 bp, Glycine max
  Peptide Sequence Number=SeqID_172622
atggcaaattttccaccgtgctgggaactgatggtggaggcggctagggtaacggggtcggcggtgccgggaagggacttcaaagcggtagccgacggcgttagagttgttgggctcgcgccaggcttcaaggcggccccatggcttccaggtgccgtctccgtcggggcggataatgagccaggcccccgggttggagcggctgacccgctgcgagccgggggaggggacgaacggcgtggccatggaggcggcggcgaccggagagccggacaagtcgtgaacggtgatggaccatcctttacgctcggcggcgtggttggcgttgagcgaagggaagtgagccttgtccttgtccctgaagctgaacttgcaagtgaaaaccggttgcttgacgtcgccttttatttggaaaacctgcgggctgcactccgggagagccaaccgttgtggaaggtgcaggggcgtgactcggccaaggtgagatcgaggggtattgaaactttgcccaatagtttggcggaggtgaagacgcaggagggagtggtggggctccttgtagacggagatcttcatcaggggcttcttcgaggctttcaagatttgggctttggagaaatcaaaggagcgcgaaggagtgaggtgtggtcgagtctgatatcagagggacactga

SEQ ID NO: 80938 - DNA, 378 bp, Glycine max
  Peptide Sequence Number=SeqID_172623
atgaaactggccaaatacaggctaaaggcccaagtggagaaggacgaaggcccaagtggagaaggacaaagcccccgagtggagaaggatgaaggcccaaaaacttttggcattttgataaaatttggtgagattttctctctgggttccttgttgaaccaatctcagacttatcaaggtaatccttgtggcgtctgtccagacttatcttccttcaccggaagtggcgtctaccctgacttatcttccttcactggaagtggcgtctaccctgacttatcttccttcactggaagtggcgtctacccagacttatcttccttcactggaagtggcgtctacccggacttatcttccttcactggaagtggcgtctaa

SEQ ID NO: 80939 - DNA, 3258 bp, Glycine max
  Peptide Sequence Number=SeqID_172624
atggcaaccgcgtctcagtcccaccgttacataggccctccctccgtcggacccggaccgggcgacgctcttaaccgcatcctcgccgacctctgcacccgcggcaatcccaaggagggtgcttctcttgctctgaagaagcatctagaggaagaagctcgtgacattagtggcgaagccttttcgcgtttcatggatcagttgtatgacaggatctccggccttttggacagcagcgacgttgccgagaatctgggagctctgagggctattgacgagttgattgatgtggcgcttggggagaatgcttctaaggtctccagattttccagctacatgcgtattgtcttcgacaccaaacgcgatcccgagattctcgttcttgctagtagggttctcggtcaccttgctagggctgggggagctatgactgctgatgaagtcgaacgccaggttaaaattgctctcgattggcttcgaggaaatagagtcgagtaccgtcgatttgctgctgttttaatcttgaaagaaatggcagaaaatgcttcgactgttttcaatgtccatgtgccggaatttgtcgatgctatctgggttgctttgagagatccagcgttgccagttcgtgagcgggctgtggaggcactgcgagcttgccttcgtgttattgaaaagcgtgagacacgatggcgcgtgcagtggtactatcgaatgtttgaagcaacacaagatggattgggtaaaaatgcacccgtgcacagcatacatggttcactgcttgccgttggagagcttttgaggatggctgaatacactggaaatactgttggagataggtgggtgggtgtggctggctacaggctgataggatccagagtggtcatctacagatacagatacattatccctcagccatgttcagagcagaaacactgcatcctccatctgcttgcttccactgaatggttcattcaagaagatgaccttattcctttgctgccaaatggaccaagcatcctcctaattgggggtctgctatcaattcatgtctctggttgtggttgggcaggaatactggcgacaccacaagatcgtgatagtgggttcattgctctgggagagatggctggggcactggatggggaactaatacattacttgccgacaataactactcacttacgtgaggcgattgctccacgtaggatcaaaccttcacttgaggcattggcttgtgttggaagtattgctaaagcaatggggtcagcaatggaacctcatgtacgtggacttttggatattatgttttctactggcctttctactgtacttgtggaagcccttgagcaaataagtaccagcattccgtctctgctgccaaccattcaaggccgattgctagacagcatatctatggttctttctaagtcgcattatcatttggggaggcctgcacaaagcgtgggtagagggataataataaatgtccctcaacaagtctcagagcttaatggttctgctcttgtacaacttgctttgcagactcttgcccgttttaactttaagggccacgaactacttgaatttgctagagagtcagttgttgtctatttggatgatgaggatggagctacgcgaaaagatgcagctctatgttgttgcagattgattgcgagttctttctctggtatggcatgctcacattttggttctagcaggttgactcgatcaggggggaagcgccggatccttgttgaggagtctgctgtacagttagagaaagctgttacattgaatgatgcagttaataggtttaaaatgcagttagtaggtcgtgtaacatatactgatgcacttgttgagaagcttctcatttctgctgttgcagatgctgatgttactgttcggcattctatctttacttctctccatggagatagaggttttgatgagtatttggcccaggcagacaacctgagtgcagtatttgctgctttaaatgatgaggattttgatgttagagagtatgcaatttctgtggctggaaggttatcagagaaaaatcctgcatatgttcttccagctcttcgtcgccatcttatacagttgttaacttacttagagcagagtgcagatagcaaatgcaaagaagaaagtgcaaagttaattggttgtttgataaggaattgtgaacggctaatacttccatacactgctccaattcataaggcactcgtggccagacttgttgatgttaatgccaatactggaaccattagtggagtccttgtaactgtgggggatcttgcgagggtgggcggttttgcaatgaggcaatacattcctgaacttatgcctttaattgttgaagctttattggatggagctgctgtctccaaacgtgaagtggctgttgctacactaggtcaagttgtgcagagcacggggtatgttataactccatataatgagtatccacaattacttgggttactcttaaaattactgaatggtgaactagtatggtccaccagacgtgaagtattgaaggttcttggcatcatgggtgctctggatcctcatttgcataaacgaaatcaaaaaaccttgccagggcctcatggagacgtcacccgctctgctagcgattcaagtcaacagattcagtctatggatgaatttcccatggacctttggccttcttttgcttcatcagatgactattactccacggttgcgattaattctctcatgcgaatattgagggatccatcacttgctagctatcacttaaaggtggttgggtctcttatgttcatattcaaggttttgcctgatctttttcatactgttcgtacatgtgaagatagtttaaaggactttataacatggaagcttggaactctggtgtctattgtgcgccagcacattcgtaaatatttgcaagatttgctatctttaatatctgaattttggtcagcattcactcttccagcaccagctcgtcctggtcttggctatccagttcttcacctggtggaacagctttgcttggctcttaatgatgaatttagaacatatcttccagttattctgccaggttgtattcaggtccttagtgatgcagaacggtgcaatgactatacttatgttcttgatatccttcatactcttgaagtgtttggtgggccaaaagatgtgatgcacctaatcatagtcaaaaaggtggaaatggggagtgagtgggcaaaaatgtga

SEQ ID NO: 80940 - DNA, 270 bp, Glycine max
  Peptide Sequence Number=SeqID_172625
atgggtgttccttatgtcacctatccgcaaaaagcagataaaagtctcatgtcacctgtctccaacgaacatgtaatcaaagaacttaatcctgtagcagttactttaccttcaatctcaagtgtagaccttcccaattttccaccttcctcccatgaaaagccaacttcaactcgcaacaattgcagttccccattgtttacatgtcaatgttgtcagccttcaaagttgagggacttcttcctcatcaccaataacctgtctatctaa

SEQ ID NO: 80941 - DNA, 1959 bp, Glycine max
  Peptide Sequence Number=SeqID_172626
atggccctaaagaaaggattttccctagttaacatcaatacttggctagtagttctacctcaaataattgccaggatacactctaataaccatgctgtgagagagttgatacagtcacttttggttcggattgggcaaaatcatccacaggctctcatgtatcctttgcttgtggcctgtaaatcaataagcaacttacgtaaagctgcagctcaggaagttgttgacaaagttcggcagcatagtggtgtactagtggatcaggcgcaacttgtatcaaaggaactgatcagagttgccattctttggcatgaaatgtggcatgaggcactggaagaagctagccgtttgtattttggtgagcataatattgaagggatgctaaatgtgttggagccattgcatgaaatgcttgaagaaggagcaatgaaaaacaacgtcaccataaaggagagaatatttattgaggcttatcgacaggaattattagaggcttacgagtgctgtatgaattataagagaactgggaaagatgctgagctgacccaggcttgggatatctattatcatgttttcagaaagatagataaacaacttcaaagtctgacaactttagacttggagtctgtttctccagaattgctagaatgccgcaatttggagcttgctgttcccgggtcataccgtgctgatgcaccagtggttacaattgcatcatttgcacgccaacttgttgtcataacatctaagcaacgacccaggaagttaaccattcatgggagtgatggtgatgattatgccttcttgttgaagggacatgaggatttacgccaggatgaacgagttatgcagctttttggtttggtgaatactctccttgagaattctcccaaaacagcagagaaagatctgtctattgagcgatatgctgtaattcctttgtctccaaacagtggtttaattgaatgggtcccaaattgtgacactttgcatcatcttattcgggagtatagagatgccagaaagatcactttgaatcaggaacacaaatgcatgctcagttttgcacctgattatgatcatttgcctcttatagctaaagtggaggtgtttgaacatgctttgaacaatacagaaggaaatgacctagcaaggggtaaggctgcgtacaacatccctcccccataccttcgcatagcgaagagcctctgggcaatggggtacgaagaagttggttaccttcttggtttaggtgatcgccatccgagcaatcttatgttacaccggtttagtgggaagattttacacatagattttggagactgttttgaagcatcaatgaaccgtgagaagttcccggagaaggttcctttccgcttgacaagaatgcttgtgaaagccatggaagttagtggtattgagggaaacttccgctcaacttgtgaaaatgttatgcaagttttgcgaacaaataaagatagtgttatggccatgatggaggcctttgtacatgatcctctcataaattggcgtctttttaacttcaatgaagttccacaaatgtctatgcttaccagcaatcatgtacctcctgttgtaaatactgaggaatctgccccgaatagagagcttccccaccctcagcgtggtgcccgtgaaagggaacttctacaggctgttaaccaacttggtgatgctaatgaggttctgaatgaacgtgctgtggttgtcatggctcgcatgagtaataagcttacaggacgggatttttcaacttgttcttcagtatcaaacaactcccctcagcatgctgtggaccatagcagtttaatttctggagacactcgtgaagttgatcatgctttatctgtgaagttgcaagttcaaaagttaataatccaagcttcctcgcatgaaaatttgtgccaaaactacgtagggtatggtctcttaacttag

SEQ ID NO: 80942 - DNA, 1881 bp, Glycine max
  Peptide Sequence Number=SeqID_172627
atgaaggtttggagatgggtggtgagtttgatgttagtggggttactgcccgtgtcaacaatgggtcgattcgtggtggagaagaacagcctgagagtgacatcgccggagaaaataagagggacacacgacagtgccattggcaacttcggaatacctcaatacggtggtagcatggccgggaacgtaatttaccctaaggataacaaaaagggttgcaaagagttcgatgagttcgggatttccttcaaatcaacccccggtgctcttcccaccattgttctactcgatcgcggaagttgcttctttgctttgaaggtctggaatgcccagaaggctggtgcttctgctgttcttgttgccgacgatgttgaggagcccttaattactatggacacccctgaggaggatggctcttccgccaaatatgtggagaacataactataccctctgctctcgtcggaaaaagttttggtctaaaattaaaggatgcctttagtggtggcgatatggtcaacttaaaccttgattggagagagtctgttcctcaccccgatgatcgcgtcgagtatgagttgtggaccaacagcaatgatgagtgtggtgttaagtgtgatatgctcatggaatttgtcaaggatttcaagggtgcagcccagattctagacaaaggcggttacactcagtttacaccccattatattacttggtactgtcctcatgctttcactttgagcaagcagtgcaagtctcagtgcataaatcacggtagatactgtgctccggatcctgagcaagacttcaccacaggttatgatggcaaagatgtcgttattgaaaatttaaggcagctatgtgttttcaaggtggcaaatgaaaccgaaaagccttgggtgtggtgggactatgtcactgattttcaaattagatgccccatgaaggagaagaagtacaataaggaatgtgcaaatgctgttattaaatcactgggtctcaatacggaaaagattgaaaagtgcatgggagatccagacgccgatactgataatcctgttttgaaagaagagcaagatgcccaaattggaaagggatcgcgaggtgatgttaccatattgcctactcttgtggtcaataatcgacaatatcgaggaaaattggagaaaggtgctgttctaaaggctatatgttctgggtttgaggaaactactgaaccagctgtttgcttgagcagtgatgtggagacaaatgagtgtttgacaaacaatggtggttgttggcaggataaagcagctaacatcactgcatgcaaggatacattccgtgggagagtatgtgaatgccctctggttgatggtgtacaattcaaaggagatggttatacaacttgtgaagcaagtggacttgggcgttgcaagataaataatggaggctgttggcatgatgctcaaaatggacatgcattttctgcttgtttggataatggaggggtcaaatgccagtgtcccacagggtttagaggtgatggtgtaaaaaattgtcaagatatagatgaatgcaaagagaagaaggcttgtcagtgccctgactgtagctgcaagaatacttggggaagctatgactgcagttgtagtggagatcttctgtatatgagggaccacgatacctgcataagtaaaactggcagtcagggaagatctacctgggctgctttttggttgattttacttggcgtagttatgattgctggtggggcattccttgtgtacaagtacagaataaggcaatacatggattcagaaatcagagcaatcatggcgcaatatatgcccttggacagccaagcagaagttccaaatcatgtcaatgatcaaagagcatga

SEQ ID NO: 80943 - DNA, 1524 bp, Glycine max
  Peptide Sequence Number=SeqID_172628
atggaggaagaggaagatgaagtgggttggtgttcttctgattcgggcgacggcgacggcgacgacgatatcgaagaacggaaatctcagaatgtggatgccttgctcaggggcaacctcgtggtgaagagacaatcgttgctaccgcgacttctatcagtatcgcaaggagcggctgtttgtagaaagcccttcaaacctccatgctctaaatctcatgcttccgcttccgcttacaatcaagaccttactcgtaagctttccgctcgcaaaaggtttgttccctggggttcttcctctcctattcctattcctattcctagatctgccttagacgactccaaattcaatgttgctgttgctgttgctgatgttgccgaggagctcaagccctctttgcctcccgggattgatcctctcgtattgtggcaccctcaagactccgaggatgctaatgctaattttaccaccataacagttgatccgttgcttgttcgttaccttcgtccacatcagagagaaggggttcagttcatgtttgattgtgtctcaggcctgtctaccacaccaaatatacacggatgcattttggcagatgatatgggtttggggaagacattgcagtccatcacattactatatactctactttctcaagggtttgatggcaaaccaatggttcgaaaggccatcattgtgactcctaccagccttgtcagcaattgggaagctgaaatcaaaaagtgggttggagaaagagttcctcttgttgctttatgtgaaagcacaagggaagatgtcatctccgggattgacaattttacaagtcccaaaagcaatttacaggtgctcattgtttcatatgagacatttcgaatgcattcgtcaaagtttagctctactgactcatgtgaccttctcatatgtgatgaggctcacagactgaaaaatgatcagacgataacaaaccgggcattggcagctctcccctgcaaacgtagaattttgttgtcaggaactcccttgcaaaatgacttagaagaattctttgcaatggttaactttactaatcctggaatattgggtgatattgcacattttcgacgttactatgaggcaccaattatttgtggaagagaacctgctgccactgcggaagagaagaagctaggtgctgaacagtctgctgaattaagtgtcaatgttaaccgggttaagcgggcaattactgaagaactgaagcaatcaaagattttggcctacataacagctctcaaaaagttgtgcaatcatccaaagcttatctatgataccatacgaagtgggagtccaggaacttcaggttttgaggactgtatccgattcttccctcctgaaatgttatctggaaggtctggctcatggacgggagggcatggagcatgggttgagctatcagggaaaatgcatgtcttagcaagattacttgctcatttacgtcagagaacaaatgaccgcattgtccttgtctcaaactacactcag

SEQ ID NO: 80944 - DNA, 3297 bp, Glycine max
  Peptide Sequence Number=SeqID_172629
atgagtttagactcgtctcgctctggtaattctaaacgaagtttctctaattctatatcctccaacgattacattaagaagaagaaaaagaagaagacaacccccaaccagaaaaccctaggcgctgcttggggctcaaagtctaattcccgaaaacccgccttctccgattttgccagttatatgacagagaagaatcggaaattacacaaccagtttgaagctcaggcttccacctcatctttgactttaagtgcctctctattcagtggagtttcaatttttgtcgatggtttcacgattccttccaaccaggaactgcggagctacatgctaaagtatggcggaagatttgagaattatttctctagacatcgtgtaacacatatcatctgcagtaatctgcctgatagtaaagttaagaacctcagagccttcagtgcagggttgccagtggtgaaacccacttggattttagattctgttgctgctaatagactcttgagctgggtgccttatcaacttgaccagcttgctaataaccaaccaaaactgtcagccttcttcacattgaaaagtagtaaaatgtcagaggatgcttatacaaatgacctttgtcaagtagtatcagatattgaagattcatccatgagggttggccgatcagattcagaagatagacactcatccaaagttggggatatgagtgaacttagcgggcaaattagtactgaatctgatgatactatacctgagaatactaatgcaattatgatggaagagctaactagtgttagagagcatgcaggaggaagcaatgctgctactaaagatgagagaaatgtcaaaggtgaacttgaacccgctcatcaagcaccttctacatcatttagtactccatgctcagatgagctgaatgtaaaagaatatccaaattcttcaggcactaagccttctaaacagtgtcattctactcttgcagaccctaattttgtggaaaactatttcaagagctcacgactacattttataggaacctggcgaaatcggtatcgaaagcgttttcccaccttgtctactgggtttaacaatgaaagtgctaataatagtgcctctgatatttctcataattcagtcattatccatgttgacatggactgcttttttgtctcagtggttatcaggaaccaccctgaattgttgggccagcctgtagctgtatgtcattcaaataattcaaatggaactgctgagatttcctctgcgaactacccagctcgtagtcatggtattagggctggtatgtttgttcgagatgccaaggcgctttgtccccatcttgttatctttccatacaactttgaagcttatgaggaagtagccgatcaattttatagtatattgcatcagcgttgcaagaaagtgcaggctgtaagctgtgatgaagcatttttagatgccacagattcagaggttgaagatcctgaactcttagcttcatctattagagaagagatctataagaccactggatgtacagctagtgctggtatagctggaaatatgcttatggctcgtattgctactagaactgcaaaaccgaatggtcaatatcacataactacagaaaaagttgaagatcatttatgtcaactcccaattaatgcacttcctggaatagggtatgtcttacaggagaagttgaagaaacagaatgttcacacgtgtggacagttgcgcatgatttccaaggcttcattgcagaaggactatggtatgaaaacaggagaaatgctgtggatttatagcagaggaattgataaccggttagttggaggctttcaggttaatatgaataccatcaccagtcattgtacatttgaaaatgatcggttgtgctatgctctacagcagcatgatgaaagtaagtctgttggggctgatgtaaattggggtgtgagattcaaagatataaaagacggttgtggagtgcaggggcgcactttcactctcaagatcaaaaagagaagaaaaaatgctgatgaacctgcaaagtttatgggctgtggagactgtgaaaatttgagtcactcagtaacgattcctgttgctactgataatgtggaaatactccaaagaatagtaaagcagttgcttggatgtttttacatagatgtgaaggagattcgaggtattggcttgcatgtttccaggcttgaaagtgcagaagcttctaaacaaggtcatgacaagcagaacagggatagcacttgcagtcgtgcttgtagagatttgccagggtcttcagtagaaatggacaataaaatacctaataaccaagcaagtaccaacccaatttcaacaccccctcctttatgtaaccttgatgtggaagttatacggaatcttcccccggaagtattttcagaattaaatgaaatttacggagggaagttaattgattatattgctaacagcaaaagcacaagtgagaattctagcccttcaggcaactcatttttggagcaagcaataaaaaaggaagaggaactttcctattctaagccggttcctcaaaacaatccattatcaaaaaataaggcaaagcagaatgaggcaggcacaggtgaaggtgaagcagtaccatattcagtgtgtggaccctatttcaaggttactcaccattcaagttttgaaaaagatgatttattgccttcttcttttagtcaagttgatggttcagtgtttcaacaattgcctgaggatttgaaagctgtcattgttgagcagcttcctgcacacaggagggcagagatttgctccaatgttgttgtggcccctcctcttgaaaaccattcattgtcagtaggcattgaaatttctgagaattttcctggatcaagttatcatgacaacttatgggccgggaatcccccaaattgggttgggaagtttaaagttagcagttgcttaatgttaaagaaacttgcagaaatgtattacaaatcagggttgactagcacattatccttagttttgcaccaaattatatctgaattctatgagctaaatctggcccagcagttttctgatgaaactgttaacattatgtgtgagctactgaggcagtatatcaaagtgaagatagaaagagatattgaagagatttatatttgttttcggcttctgaaaaggtatagctacagcctactttctctttcaccatcagctatttatcaatcgaacaaaatggggcaaaaacaggcagggcacaggcaatattttaatagaatgtaa

SEQ ID NO: 80945 - DNA, 312 bp, Glycine max
  Peptide Sequence Number=SeqID_172630
atgtggtattggaggaataaacaggagtatgagagtgattctgtgcaacctttcaagccatatattcatattttacagcattgtactgattatggcaatgtgggaagggtagatctgagcacaagacagggtgatctagtgaaggaactatttgtcaaatggaaagctccttttgacggatgggtggtgataaatactactgatggttctgttaaaaatcaggaagggggtgcccttcatggtctcaagatggcgtatgagaaagggtttcaagcggtggagctgcaaatggattcggaggcagtggtctag

SEQ ID NO: 80946 - DNA, 1668 bp, Glycine max
  Peptide Sequence Number=SeqID_172631
atgtactcgaatctgttgagaggatatgcgcaagactcaaacttgctctgcggaagagcaattcacgctaaattaatcatagggtcgattcctttgactctttttgttcaaaaccatttgctgaacatgtacgtcaaaattggagatcttcattcgggcctcaaagtgtttgaggaaatgccccagaggaatgtggtgtcctggtctgctgtgatggccggttgcgtccaaaatggctgtgcttcggaggctctttggttattcagccgtatgcaacaggagggggttacaaaaccaaatgagttcacatttgttagtgctctccaggcctgctctttaactgagaccgagaatgtgactctagcttaccaaatttattcattagttgtgcggtcaggacatatgtctaatatcttcttactcaatgcctttttgacagccctagtcaggaatggcagattggcggaagcctttcaagtttttcagacaagtccaggcaaggacattgtgtcatggaataccatgatagggggttacttgcagttttcttgtggccagattcctgaattttggtgttgcatgaaccgtgagggtatgaaacctgataacttcacatttgctacctccctcactgggttggctgctctgtctcatcttcaaatgggaactcaagttcatgcacaccttgtcaaaagtggttatggggatgacctttgtgtggggaactcactggctgatatgtatataaaaaatcataggttggacgaggctttcagagcttttgatgagatgactaacaaagatgtgtgctcttggtcccagatggctgccggatgtttacactgcggggaaccaagaaaggcacttgcagtcattgcacagatgaagaagatgggtgtaaagccaaacaaatttaccttggcaactgctctaaatgcttgtgcgagtttggcttcactagaggaagggaaacagtttcatggcttgaggatcaaacttgaaggggacatagacatagatgtctgtgtagataatgcacttctggatatgtatgcaaaatgtggatgtatggatagtgcatggggtctttttcgatcaatgaactgctgccgttctgtcatctcatggacaacaatgataatggcatgtgcacagaatggtcaatccagagaagctcttcaaatttttgatgaaatgagggagacgagtgtagtgccaaatcacatcacctacgtgtgtgttctttatgcatgtagtcaaggtgggtttgttgatgaagggtggaagtacttttcctctatgactaaagactgtggaatcttccctggagaagatcactatgcttgtatggtgaatattcttggcagggctggacttattaaagaagctaaggagttaatcctaagaatgccgtttcagccgggtgcgctagtttggcaaacattgctcagtgcttgtcagcttcacggggatgtggaaactgggaaacttgcagcagaacgtgccatacgacgagaccaaaaagacccgtcaacctatttgttattgtctaacatgtttgctgaatttagcaattgggatggcgtggtgattctgagggaactaatggagacaagggatgtacagaaattaccaggatccagttggattgaaatcgaaaagatttaa

SEQ ID NO: 80947 - DNA, 762 bp, Glycine max
  Peptide Sequence Number=SeqID_172632
atgactcttgatctttttgctcaattgtgtcgggaacgaaggtaccctcacttgaggcttgacggctctacatcaatcagtaaaaggcagaagttggtcaactgctttaatgatccatccaaggacgaatttgtttttctcttaagcagcaaggctggtggttgtggactcaatttgattggtggaaatcgacttgtcttgttcgatcctgattggaatccagcaaatgataaacaagctgcagcaagagtatggagggatggacagaagaaaagagtttatatttatagatttttgagtgccggaacaatagaagaaaaggtctaccagcgtcagatgtcaaaagaagggctgcaaaaggtcattcagcaggagcaaaccgatagccttgtggcacagggtaacttgctttcaacagagaatcttcgtgatttgtttacttttcatgagaacatcaagtcagagattcatgaaaacatgcaatgcagtcggtgtcaaacatttgatggccctcgaagcactgaagcccagtcaacaataacagatagtgaatctgatgaagaaacctctgatattggtggatttgcagaaattgctggctgcttacagaatttaaaaagatcagaaaagcaggcacctggacctgtggcctataagggagacaagagccccaataataaagttaggatggacaccacaaggagaggccttgataagtccagggtgaacaccacaacaaaaggtctccttgataagttctag

SEQ ID NO: 80948 - DNA, 804 bp, Glycine max
  Peptide Sequence Number=SeqID_172633
atggaaagtggagggaactcccttccatcagggtcagatggtgtgaagagaaaggtttcatatttctatgatccagaggttctgaagcctatggctgctaaagatagggacctttgcaagttccatgctgatgattatgtggcctttctgagaggcatcacccctgaaacgcagcaagatcaattgagacagctgaagaggtttaatgttggcgaagactgccctgtatttgatggtctttactctttctgccagacatatgcaggaggttctgttggtggtgctctaaagttgaaccatggagtatgtgatattgcaataaattgggctggtggtctacatcatgcaaagaagtgtgaggcttctgggttttgctatgttaatgacattgtgctggctattttggaacttctcaaaatacatgagggatgggtcattaccaggggctggattaatgtcttggctaagcttcccatgtcagaaccgccagacctgggtgctcagacaatggctgatgttagtctggaattagaaatgggaatgaagattggtatttcacctcaattccagaaccacaacaagcatcagaccaggcaggaggaggaactgaagctatttagagactacacagattggtctggcttgatcatcatgcttcaaccaatgggaccctggattggggcctttgggcattggggagaggaagctacatgggaggatgttcaggtgatccatgagcagtttcctaacttcaacctcgaggacaaggttcagcaaacaaggggagatattgttatgacttag

SEQ ID NO: 80949 - DNA, 1401 bp, Glycine max
  Peptide Sequence Number=SeqID_172634
atgggaacaaaggacctgacttttgtccaattaaaccaattaattggaagaaaaactggaggaatatcagtttatccattcacatcatcagtgcggggcaaggaagatccatgtagtcacatggttattcgaggcaaagccatggctggacatattgaagacctttatgacttggttaattctgttcttcaagatgtccaatttacagatcaacagcgtttcaaacaatttgtttcccagagtagagcaagaatggagaaccggttaagaggaagtggtcacggaattgcagctgcaaggatggatgcaaaactaaatgcagcaggttggatgtcagaaaagatgggaggtctcaggtttcctttgtgtgccaaggcttcctgcaattttcacaccaagggggcttcttcttcaatcaaggacttcaagttccagcttgaagctcattcgctgcctcctgatgttgtgggatttggaactccttcggttcccccagacctgtttagtctgaattataattcctggtgtttacttctgtatttctcgattattcgttctagttaccttgaattcctccgaacacttgaagagagagttgatcaagattgggccgatatctcatcatctcttgaggagatccgcaaatctatattttccaagcaaggctgcttgataaatgtcactgctgataggaaaaaccttgcaaagacagaaaaagttctgagcaaatttgttgatctgcttcctactagctctcccattgcaacaactacttggaatgttagacttccattgacaaatgaagctatcgtgattcctactcaggttaattacattggaaaagcagccaacatttatgatactggttatcggcttaatgggagtgcatatgttatttccaaatacattagcaatacatggttgtgggatcgtgtacgtgttagtggtggagcttatggaggtttctgtgattttgatactcactcgggagtgttctccttcttatcttatcgtgatcccaatttgctgaagacacttgatgtatatgatggaactggtgacttcttaagagaactacaaatagatgacgacactttaacaaaagccataattggaaccattggggatgtagatgcgtatcaacttcctgatgccaaagtatgttgcggtacttactgggtatcacagaggaagaaaggcaaaggagacgtgaagagatattatctactagggactagtcttcctgaatgtgttgtgttgagacaatttgaaatattttgcaaggttacgcctccttattgtccttgcattctgttattcacttatgtggcatctccagaggatgtagatacggccaacaaggaccgtcccgacttctttcaagtgaagaaagccctttag

SEQ ID NO: 80950 - DNA, 1401 bp, Glycine max
  Peptide Sequence Number=SeqID_172635
atgcttcgtcaccattcgtcaatcttctcgcggattttgaagtcttcatttcgcaatgggtggcacgacgagtctctgcttctacattacctatccaatgggtggcacgacgacgcgcgaaacctcctccaaaattcctccggaggtgacctccactcgcacgtcgttcgctggacctcgctactctccaacttctcccgccacggtttcgtggccgaagctcgcacactcttcgacataatgccctacagaaacctcgtctcttacaacgccatgttgtccgcgtacctccgctccggcatgcttgacgaggcttcccgcttcttcgacaccatgccgaagaggaacgtcgtgtcttggaccgtaatgcttggtgggttctcagatgccgggaggatcgaggatcgaggatcgaagatgcgaagaagatgtttgatgaaatgcctgagagaaatgtcgtttcatggaacgcgatggtggtggcgtttagaggaagcgatgatggtttttgaggagactccttataagaatgtggtttcatggaatgctatgatcgcggggtatgttgagagagggagaatggatgaggcaagagaattgtttgagaagatggagtttaggaatgtggttacttggactagcatgatatctggttattgccgtgagggaaatttagagggggcttattgtttgttccgggctatgccggagaaaaatgttgtttcttggactgctatgattggtggctttgcttggaatggcttttatgaagaggcattgttgctttttcttgagatgttgagagtttctgatgcaaagcccaatgatgagacctttgtttctcttgtttatgcttgtggtggttgcgaagaggtcttgttaggatgtactctggatttggtcttatggactctgcacacaatgtgtttgaaggccggtcagctggaaagagctcaagagttgtttgacatggtacctgttcggaacaaggttgcgtccacctgcatgattgctggctatcttagtgctggccaagtactaaaggcttggaatttgtttaatgacatgcctgatagggattccattacgtggactgagatgatttatgggtatgtgcagaatgagctcattgctgaagccttctgcttgtttgctgagatgatggctcatggtgtttctcctatgagttctacatatgctgttctatttggagccatgggttcagttgcttatcttgatcaggggcgacaattacatggtatgcagttgaagacagtgtatgtatatgatttgattcttgaaaactctctaattgcaatgtatgcaaaatgcggggagatagatgatgcatataggatattctctaacatgacaacatccctcccccataccttcgcatag

SEQ ID NO: 80951 - DNA, 2199 bp, Glycine max
  Peptide Sequence Number=SeqID_172636
atggatttggaggggaagaaaggcgaagatatggattcgctatttgaagggatggtgctgtttaaccctgccgaagagaaagacaatggtagtgatgattctctcacaatctcaagttgttcgcaatcacaaccccttgatgagaatctcttctctgacctcacgcttgtggtagatcccctccaaaacctagaagtagctgaggccgagcgcgatctccaatcgagacagggtcatgcccccgccagaaggagaaaacgatctggcttgaggataggatatggtagagacgccttttcttccaacgatccgcctcacactccttctccgctcccccaacctatttctgatagtgacagcgtaggcgatgctgatgctgttcgtgtccgggacacggacacggacacggacacggaaacccttccctccatcaccactgccactgccactgccactgatgatcctgttactgtcactcttactcaaccatctaatgaatcagagaatcagaatcggaaacaccaacaatcatctactgaatcttcctcggcagagtttcggcaacttaagtccagcatacatgacaagcttaaccatgccactcaactggtcaaatctgcttcttctgcccgaaaggattccatcaggaacagaagaaaaaccgttgagaacgctaatcttgcttccctcaaacacatggaactcgaaaagcaattggaagaagcctgtgaagctgaagatttcgaaagggctgaaaaggttagcgacgacctttctgctgccgagaaggagaaacaagctttcgccaattcattgagagaagccgatgcctttgtcgatgctttagatctaaaattgcagcatgccctcgactcgcagttagctattgaggaacaatgcgcaatcttactcgaccattatgcaacgaatgctttaaataatgcagatttttccatgaagaaagcatcgtcagtgtattcaaaagaaatggaccaatggctttcatcatctgaagccttggaggttaaaaagatggagttggagattgaatcacaatttatgaatgaagctcgtttagaattgaataataccattgagcattcaatccaaaatgacaaaagagaaaaagagattctttgtaaaagaaaggatgtgttaatgggtgaattggaacaacttcttgctttagttaaacagaaagaaatggagatagcagacaatgactctaatttagaagcggtagagaataagataaataaagttgtctctggatttaaagagatgcagtcaagcattgatgtcaagtatgacaaattgcaatctgtccttgctcaagttaaattagagactgaaactttggttctaaagaaggaagaaattgataattttctcatccgggaagaagaaatgggagcaagacttagagaatttgttcggatttctacagaggaagctgaaggataccgcaaaattgttaaactaagaagaagtttgatgtcatctatattgaagtccagggaggacaaactgacactttcaaagaaagaggaaaagctttctggagatgtgaaattgtttcaacaggaggtttctgccgcaagagcttccttgcaggaactatcttcaagaaagtcaagcatccaacaagatatagcatcctttaagcagaggattgttttcatagataaaagagtcccagaattagaagcggaaaagaaagttgctactactgcaagaaatttcaaggaggctgcacgaatagctactgaggcaaagtcactgtgtgttgaaaaagagagcatccaaataaacatggatatggctacattaaatcttgagaagcttgaagaagaaatcaatgacacccttaataaattacaggagactgaggggatgattttattgaaggagaaagagttggcaatggtcagataccaaaagctacttttggcagctgctactgctagagctgaaaaagctgctgctgtagaaatgggtgatgtggaagaagctaatctcctacttgctgaagccgaggcagcagactgtgatgctgagaaacttaaatcaacttacaaatttgaggcagaagacttcactgatctacaaagacatttaatttcaatggatcttgtttcgcatcttgatcagaagcaactggaagaattagctgtgtcacttcgtctatttactggctga

SEQ ID NO: 80952 - DNA, 339 bp, Glycine max
  Peptide Sequence Number=SeqID_172637
atgggttttgaagaaatgaggttttgggaggactgctggctcatggaacaggaacctttaagggcgaaatatcccagattgtataatatatcctgtcaacagcagaagcttatccaggatatgggatgtcactctgcaaatgtttgggaatggaagcttgaatggagaagacacctttttgacaatgaggtgcaagcggcagccagtttcttggatgatatctcgcggggtcatattgatcgttggacatcagactgctgggtttggaaaccagaacctaatggccaattttctacaaggagcgcataccgtatgctactagaaggaccagcagcctag

SEQ ID NO: 80953 - DNA, 201 bp, Glycine max
  Peptide Sequence Number=SeqID_172638
atgagtaggagacttctgtcaaggattacgatgcttgtggagattacaattgccaccattggaggatactttggaaattggaagaaaggaatgttgagggatgaaggagtcttcgacatctacattggttggttggtcagcggtggtgattgggtgggcgaagacagagaacggatcagaaatcttataaatgggggttga

SEQ ID NO: 80954 - DNA, 966 bp, Glycine max
  Peptide Sequence Number=SeqID_172639
atgggagaaaatgatgaatctggtggagaagatggtgagcatactgatcctttaagtagtatggatggtgttggtgaagaaggtgatttattcggaggtggaggttctgggaatgaagaacatggtaaaattatcataaatgctttgattgatatagtagacatcgtcatgaagaatttagaggctgatgttgttaaaagattggattttggtgatcttgaggctgcatatgagttttactattggtatgcaagaatcaatggagaagataggggattgacaagtgaaacaagaaagcgtgaaccaaagaaagaaactaggtgtgattgcaaggccaagtttcgtgttcatgtagacctccattgtcagtggtctataacagagtttactgacctacacagccacgagcttttggaggacagtttatgttccatgttaccagcacataggcggatgactgtagctgatattttgctaattgaaaactttagaaaagttgggataaggcctcctccaattcttggggcatttgcgaacagttcaggtggatatgataagattggatgcaatgatgaactacttgaagaattgcttgctgattatgatgtacccaaatttgaagaattatggatgcatatgctgaatcagtttgagttgcaagaaaacaagtggatgaaagagttgtatgagaagaaaaagatggaaattgaagctgattttgattctgactatggtgttgttactctacaaagtggtttgcactcattggagaggtcagcttctaaggtattcacgaagacgatatttcatatgtttaggtgtatgttgataagagcaccaacagtgatgaggttggcagaagttgcacatcggcatgatgatgactataatcacattgtagatttgcttgctgctgaactgaaaaagttgcgagtaaaacatgggaaccaatctgttgctgaataa

SEQ ID NO: 80955 - DNA, 1593 bp, Glycine max
  Peptide Sequence Number=SeqID_172640
atgttgatggttctgatgaacatctttgcattccttgtcctcttgatcttcttccaaatcgtgcaaatttcatatataaacgagggggtgttacaagacggtcttgtccatataaatgtccgtggagctagagctgaagagactcaaagccatgtacacagaatgtactttatgggacctaatacttttagagaaccctggcatcttccttactcacccccccatgctataattgagattgtgtatgaggatgcttttaataggtttattgatgaaatcaactcggttgctgcatatgattggtgggagggatcagtgcacagtatactttctgttgttgcatatccttgtgcttggtcctggaagcattggcgacggagagtcaaaattagtcgccttcaggaatatgtcaagtctgaatatgaccattgttgtctacgctcctgtcgatcacgggctttgtacaaagggatgaaggttggggcaactccagatttaatggtagcatacattgatttttttcttggtggtgatgagaagcgattagacattgtatcaattatacagaagagatttcccatgtgcataatttttggtggggatgggagctacatggcaccttataatcttcacaatgatacactgttgaccaacctccttggtcagcatgtcccagcaactgtttggaatcgcttggtagctggactcaatgctcagttacggacagtaaggcatggatcaattcgtactgcactaggtcctgttgtcgattggataaatagccatgcaaacccccaacttgagtttcatggagttaaaattgagcttggatggttccaagcaacagcttctggttactatcagcttggtatcgtggtagcagttggggattatacccttcttgatttgcaccagtctgatacttgggttggcacagatgaattaatgaggaaaaatgtggcacatggaagaaagaatgttaagcagctgcagcatagttggccatacataagcaattcattatctcttaaaaggataactggaggaattaatggtggcctaataaatgatgctaccttaaaatcattggactttcgaagggactttttattcccactttctctactattgtgcaatactagacctgttggtcgtcaggacactgtacagttgctgattactttgatgcttttagcagatctttctgtcactctcctcatgttgcttcagttctactggattgctcttgcagcttttctttctgttctactcattcttcctctctctctactttctccatttcctgctggcctgaatgcattattcagtaaagaacctagaagagcttcactttctcgagtatattcactgtggaatgctacttctttatctaatattggagtggcttttatttgttgtctccttcattatgcactatcccactttcaccaccctgatgagacaagcacacgggatcgcatggcaggagaaatgcgacttgataatcaaaagcatcagagagaagtacagagaaagcaagctggaggaattttgagttggcttatagagatccatgttgaggagctatattaa

SEQ ID NO: 80956 - DNA, 477 bp, Glycine max
  Peptide Sequence Number=SeqID_172641
atgttgtggttgcgaaggacgcttcaccgccacgggacgacctcgaacgatagcttcgtagacgtagttgtgactccctttgtcgaggagcttgcggtcggagaagccattggtggcaacttcgagaggacacaaaattggaggttgagacagcggattcgactctacaagaaaggtagaggtaccccatcatcaattcaagtttgtggctttctaatgaatgaatcaaggggtgtcggagatgaacatagaacaaggattgcaaaaatgtgcatctgtttcatccatggtgtcgcagaggtagttggtgtcgagggtcatggctacgttgatggtggcagagggagaggagccacagtcctcgccggcggggtcctcccgaaagagagggagctccggggaaagatgactgacatcaataatttaacggtgttaaacaattttaacagtagagatctattgggaattaaatggtaa

SEQ ID NO: 80957 - DNA, 411 bp, Glycine max
  Peptide Sequence Number=SeqID_172642
atgggaattttcaaaaaattgttgggtgatcagcaaatctactggtgcccaaagcaactccgaagcctgacccatgaaattaactacttcgagaaactgtcatttaagggtgatccattggactatgttatttcgatcccatttttgcgcatgaatgcccttaacaaaaaagcatttccggtagtggtacatacacaatggaaagttttttctattacgttaagattcctaggaggctttagctgcaatctgggttctatgggtatattgcattcgaaattgtgggcaattcttcatggtgttcagctggctagggaaggtgggattttcaaattaaagattcattcagataaggaggaggctatccttcttactgttgatggctgtgaggaggagcatggatgcttttag

SEQ ID NO: 80958 - DNA, 897 bp, Glycine max
  Peptide Sequence Number=SeqID_172643
atggtaaaaacgaagaactactggcagggaggagtctgcttggcgtttgctgatgaggttatgctggctgtatggaaagtcaaagaagagcgaggaggcgtcggatccaaatcggaggtaacttccgttgatcggaagcgaatcaacgacgtcctcgataaacagcttgaacgttcctcgccttccacatccagagccgccgccatcaacggcaaggaccgctcctcctcttccctcttagccgccgccaaggactcccgctccgcctccgtcaccgcccctatctccaagaattccaacgcttccgacgaggaatctgaaacagacagcgaggagtctgatgttagtggctccgacggagatgacacatcgtggatctcgtggttctgcaatttgagaggaaatgaattcttctgcgaggttgatgacgattacatccaggacgacttcaacctgtgtggattgagcagtcaagtgccttactatgattatgctctggatttgattttggatgttgaatcgtcccatggtgacatgtttaccgaggaacagaatgagttaattgaatcagcagccgagatgctttatggtctgattcatgcccggtacatattgacaagcaaaggaatggctgcaatgctggacaagtacaagaactatgattttggcagatgcccacgagtttactgctctggacaaccttgtattccagttggtcagtcagacatccctaggtctagtactgtgaaaatatactgccctagcttattttggaactacatttcctcatctgttcttgatgacttatggacaactaaagccacagaaaccatcacagagctatgtcccgagagtttttggcttcaaacttcacaagccctgaagctgaaattttaa

SEQ ID NO: 80959 - DNA, 1755 bp, Glycine max
  Peptide Sequence Number=SeqID_172644
atggttcaatttcacgaacgcataatcacagagcttctagaagacaccaatggcggcctggttgttctctcctcaggcctttctctctccaaactcatcccttctcttctaattctacacttctcatctcaggggcacgctccttctcctctcacagtcctccacttccctcaaatccaaaatcgccttccacctcaaaaccctaaacccccaattctaccaaattcccgccgaaatcaccgccgacctcctggcgctccaccgccacgcgctctacacctccggcaaagccttcttcatcacgccgcggatcctaattgtcgacctcctaaccaacaagttacctacctccaagatcgctggcataatcatcctcaacgcacactcgctctccgagacttccaccgaagccttcatcgttcggattttccggtcgctcaaccgcggcgcgtatgtccgcgcgttatccgacaagccgcacgcgatggtgtcgggattcgcaaaggagaagcggacgatgaagtgcctgcacgtgcggaagctgtacctgtggccgcgatttcaggtgtacgtgtcgcaggagctggagagggacccgccggaggtggtggatataagggtgccgatgagcagacgaacaaggttgacgtcgaggattcgacggtggagaatggattgttcaagtcgttcgatgagattgtgaggagacagttggatccaatttggcacaccttggggaagaagactaagcagctcgtgtcagaccttaagactttgaggaagctgttggattatctagtcaggtacgatgcagtaacttacttgaaatatttagatacactgagagtgtcagagagttttcgatcggtttggttatttgctggggcaagctatcagatatttgactatgcaaagaagcgtgtttttcatcttgtgaaagcagatggtgtgaaatttaatgagtcaagtaagagtgtcaaaaacaaaaagagaaaaactacgggtgatgacaaagacattgaagaaggaggtacatcaggggcctatatatacacaagcttgttggctattttaggaaatagggacgatttattgtcacaatataacctcattggttcaccccactttaccttcatgtcctccaatataatcttcagccatagaagttcacaaattccttggaccattgctcgaaactctgcttcagcactagatctagctaccacactttgtttttggctcttccaagtcactaggttttcaccaaggaagtctgctagtgatattggtgatgatgtgacaccaaatagcattatatcaaagttgtctttgcttgctctacactttccccgactaagaataatctggtctcgaagtttgcatgctactgctgaaatatttgcttcactgaaggcaaatcaagacgagccagatgaaacaaaagcaatcagagtgggtgtcccctcggaagaagggattgtggaaaatgatgtgagggctgaaaattacaatacatcggctgtggagtttctaagacgacttccaggtagcttggcagaacttgcacttcgtcctgtagagaagctagcggaattaatgggtggtcataaagcagctcggactctaagagattttctagatgctaaatacccaactttgttgtactatcaatttattcaagtcttctgttatttcgattctacatcattggattatgatggcaatccattgggcactgctacgcgtacccagtga

SEQ ID NO: 80960 - DNA, 501 bp, Glycine max
  Peptide Sequence Number=SeqID_172645
atgcaacaactactcatatgggcagtacttgctgcatttggaggaaacaacataggagtagcttttaaatggcataaaacatctagcagattgtgcaactacaaattccaccatgacaggagtgtggaagaaaacttatgcttgggtctcaagttagtttggcagagattatcttgtgaaagatacacatacaattttaccccttgggggactgttatagattatagattatgctttcagactgaatttgaacttagccagtcaagcttaaataaaattccttttttgaagagtcaggctttacagaatctgaaggaagaaagagatgccgctgccagacaaacgagacagctgcaacaggaactggacatgctgaaaagacgaagaaaccgaagaagtgatcctggcttttccttcacctttgccatttttgtgggtctccttggagctttacttggctttctaatgaaacttttattctcttctccatctacagaatga

SEQ ID NO: 80961 - DNA, 1170 bp, Glycine max
  Peptide Sequence Number=SeqID_172646
atggattcgatcccatgccttcagggcctcaattcccaatcccaggttcccagttcgtggtcctcgctttcgtgcccttctgagcctccggatattgggaattggttctcaagctatgaatatcgatcacccggtccggattcgaattttagtgtcgaagattctgctttcagcgaagaagaaacccagagagacggtgaagaagaagaagaagaaaatgttagggttcaaggtgaaggggttgctggggagaatgtagtacaatgtatcagaacttgtgttaaagaggataatcatagcgaagatcagtgcttgaacacgcctccagacatcagaaactggttctcgagctatgtttacgagtcacccgagtctgatacaagtagtctttttagagatgaagtttctgaagagaatgagtgtgggaaggagaggtttgattttgaagtagtaaaagaagatgaaagccggtttgagaatgtccactctaaagggcgtgtggaccacaatagctcttctaataaaaacacaaagggtgatgatagtgcagaaatgaagacaaattcaactactgttgatacttctcatctggaaaagattttgcagccatgcctgcaagataagacactgcaacaacataatcttggtccaacgaagtacaaggaggcattgggccttaatcacaaaagtcctggttgtgatccagaaggacatctgatgtccctggatactgatagaagtgtaatgaaacctccaaagctgctacaaaagaatgatactggagaatcaaaaacaaaaggtgaaatccaacatgacaagaagcttgacttgagtgcaagggtagcaaaaaacttttcagcaagaagttcaacttgtaccagcaataaagaaaacgatggttttgtgacgacaaggaggaacagctacactggaggaaatgatgaaagttcttgtaagaaagcagaaaagataatattagcaggagcagttccattggcatgtgaaaagcaaggtgttacaaagagaaaggcattaacagaagcaacaaatgttaaacaatataatgtcatggggataacagggaaatggcaatgcccacagaaacgtaaacctgatgttggacctgctatgaaacaacttaggctcgatcgctgggttcgtagagtttga

SEQ ID NO: 80962 - DNA, 547 bp, Glycine max
  Peptide Sequence Number=SeqID_172647
ggggaagtttgcggcggagatccgggacccgaacaagcgcggctccagggtgtggctcgggacgttcgacacggctatcgaagccgccaaagcctacgaccgagccgcgtttaggcttcgcggctccaaagccatcctcaacttccccctcgaagccggtgccgatgaccgcaaacgccaaagggaagagcaagaggaggagcccgcggtggaagtcgtcaagagggtaaaagtagaggaatctgacgttagtcgtattaaggagactccgttaacgccgtctagttggttagggttctggggtggtgattctaacggaatcttcaccgtgccgcccttgtcaccgttatctccccacccggcgttgggttttccacagcttatggttgtatggaacaatatcagaaatgtgaaaatagcaagaaatgcatgcttgaagttgaaggtagttatggcaggaagtgttatcggaaaaggcgaggttcagagatctccgaagattgccacgattatggaaacagaatcccagaagatgcgacctaaataa

SEQ ID NO: 80963 - DNA, 1380 bp, Glycine max
  Peptide Sequence Number=SeqID_172648
atgcgttggtttccgttgagtacaacttcaaactcggagagagaacggaatagagagaacactactcgtgcttcggtgtatctcaatgtatatgatcttactcccataaacaattacctttacatgcttggccttggaatttttcattcgggtatacaagtgcatgatattgaatatggctttggggcacatgaatatccaagtagtggtgtgtttgaggtggaacctagaagctgccctggcttcatctttagacgatcagtgttgttgggcagcactgatatgtctaactcagaatttcgatatttcatagagcgcctgtctgcaaaatatcatggagacacttatcatcttattgccaaaaactgcaaccattttacggatgaagtttgccagcatctaacaggaagtcctatccctggatgggtaaatcggatggctcgtgtagtgtggtttaagcttttaggttctttctgcaattgtcttctgccagaaagcctccaggttgctgcagttagacatctccctgaacgtgttgcatttgatgatgatgatggatcaggatctgatggcctttctgcatccattgagagtgaagaagatgagcccaatcaccattttttaacttcaccaaatggtgatgttgcctttctaaaggaaaaaccatctcaagtgatgggtgcattcatcttccttttcctcttgtgtgttttctgcttccaaagtaaggtgacctatgctacaaggtgtggagatgcaggccctgaaatccactatccatatcagataaaaggtcaacagcaacagcataagtcccttcctggttttgagcttctttgcaaagacaacctcaccactatccactttccatcttatggtgatttggtagtgaagtccatttcctatgacaccaaaaacattcacctccttgaccccaaaaactgtgcccatcatgtctttctcaacctcaatctctccctcacaccgttccactatttttatgttctgaaaaactacacatacctcaattgctccaccacccttccacatcctctcgtggaggttccgtgtttaagtgcttcaagctatcatgtatacacagttgaccctgcagtgcctgtgccgggttcatgtgatggagtcaaaaccgtagccattccttttgcatatagcccttatctctcagacaaaagtcttggtcttagattaacatggcacttgcgtgaacctctagacaacgaagcagcagtgaaccggactagagttataggctctagcatctgtgttttcgtgatggccatgctattgcttataagcatgaaggttcgtggtgccacgaggaacctccatcagaaagaaggacagttattgcagagctaa

SEQ ID NO: 80964 - DNA, 2268 bp, Glycine max
  Peptide Sequence Number=SeqID_172649
atgaacgtgaaaggaaaagtagtgagaaatgaatcacgtgtggaagatgagaggaggaaaagaaaagaagaaagaaatatgaaatatgaaatattcagttccgattccaatgttatcacgttttcttcttttggcacgttgaaaacacaacttaaccacataaagcatccactattctattctaattgctgttactgtaacacaacacaatcttcattcatcactgaaaccaaagccacaagctgcgacatcagaaagacattggcgagaatggaagacagtattgaccacttggctttcgagaggaacaaggcgcagttcgatgttgacgagatgaagatcgtttgggcgggttctcgtcaagactttgagctttccgatcggatttctcgccttgttgccagcgatccggccttcagaaaggatgacagaaccacgcttggtaggaaggagttgtttaaaaacaccttgagaaaagcagcttatgcatggaaaaggatcaacgagctccgtcttaatgaacaggaagcttataagctcagatcctttgtggatcaacctgcttttacggatcttcattggggaatgtttgtgcctgctatccaaggacaaggcactgacgaacagcagcagaagtggttgcctctagcttataggatgcaaataatcggttgctatgcccaaactgaacttggtcatgggtccaatgttcaagggctagaaacaactgcaacatttgatcccaaaacagacgaatttgttatccataaccccacattgacttccagcaaatggtggcccggtggattgggtaaaatatccacccatgctgttgtttatgcccgtctaattattggtggtgaagaccatggagtgcatggtttcattgtccagctgcggagcttggatgatcacttgcctctttcaggcataactattggtgatattgggatgaaatttggaaatgcagcatataacaccatggacaatggagttctaagatttgaccatgtacgaattccaaggaatcaaatgttaatgagggtttcacaggttaccagagaaggaaaatatgtacactccaatgttccaagacaattagtttatggtactatggtaaatgtgagacaaaaaattgtagctgatgcatcggttgctttgtctcgagcagtttgcattgctacaagatatagtgctgttagaagacagtttggatcacataatggaggtctagaaacacaggtgattgattacaaaacacagcaggctaggctcttcccattgctggcttctgcttatgctttcagatttgtgggcgagtggctgaaatggctttatatggatgtgacgaaaagattgcaagctaatgatttttcaacattacctgaggctcatgcatgcactgctgggttgaaatccttgactactacggcaactgctgatggaattgaagaatgccgtaaactatgtggcggtcatggttacctttgtagcagtggtctccctgagttatttgctgtttatgttcctgcctgcacgtatgaaggagacaatattgtgcttcttttacaggtggcaaggtatctcatgaagactgtttctcagctgggctctggaaataagcctgttggtactacagcttatatggctcgagtggaacaactgatgcaatatcactctgatgttaaaaaggctgaggactggttgaagcctaatgtagtgttggaagcatttgaagctagggctgctaggatgtcagttgcttgtgctcaaaatcttagcaagttcactaatcctgaggagggttttcaagaactagctgctgatttagttgatgcggcagttgctcattgccagttaatcgttgtttccaaatttattgagaagttgcagcaagatatccctggaaagggagtaaaaaagcaattagaagttctttgcagcatttatgctttgtttctacttcataagcatctgggtgattttctttccactggctgcattaacccaaaacaaggatcacttgccagtgagcagctgagaaacttgtattcacaggttcgtcctaatgcaattgcgcttgttgatgcatttaactacactgatcactaccttggttcaattcttggacgttacgatggaaatgtgtatccgaagttgtacgaggaggcatggaaggatcctttgaatgattcagttgttcctgatggctttaaagagtatattcaaccgatgcttaagcagcaactacgtaatgctaggctgtag

SEQ ID NO: 80965 - DNA, 1167 bp, Glycine max
  Peptide Sequence Number=SeqID_172650
atggaaggtggtttttttacaccttggaagaatgagccttggcaggagttagcttcagaggacgtgaaggaaagtgagcaattgatatcgttgccacccttggctgagccaccgacaccccgtgaacctatggagttcttatctaggtcatggagtctctctgcctccgaaatctcaaaggctctctcagagaaacaaaagcaaactttcctcgataacaaggccccagacacattgcccgaacctatttccgctcctcaattagcaggagggaagatgatagtatctggaaattgtcgaaggatgggtgcgattgggaaatggttacatcagaagcagtacggcattacgaacgtttccgttaagaagaaagaccgggcgcgcgtggaaaacgcgcgtgtgcattctgcgctatccattgcggggctggcctctgcggtggccgctgtggcggcaacagaggaccctcgcggtggctctcgttctaaattggacgttgctctcgcttcggccacgcaactcttggcttcttattgcgttgaaatagcggagatagttggcgcggatcgccagcgcgtggcttccacagttaggtctgcggttgatattcaaacgccaggagatctaatgactctcactgctgcagctgcaacaggagatgcagctctgacagcgagaatgccaaaagaagcaaagaaaaatgcgtcaataagtccgtatgataaagtgatagcggaaacgcaatggcttcgtgcgtttgacggtcagatgttggaacgttatcctccgtgcctgggggatttgttgcagctcacagaaaaaggtgctttacgatggagacatgtccatgtttatatcaagaaatgtcaggttaaagttaagatcaaaagcaagcacgttggaggagccttctccaaaaagaacaaatgtgtggtgtatggagtctgtgataaagataatgcatggccatatagaaaagaaagggaagcatcagaagagctttattttggcctgaaaactgcacaaggtcttctagaatttaagtgccagaacaaactccacaagcaaaaatgggttgatggaatagaatttttacttcgtagggtcaactctgtcgaagcaacagagcattctctagaatttttaagtattagtaccagtacatga

SEQ ID NO: 80966 - DNA, 1686 bp, Glycine max
  Peptide Sequence Number=SeqID_172651
atgggtgtggagaagttgagcttattatcgacgacgaacctcgccgtgttagctcaagcgaacaacaaatgcagtagcaggaagcacgtgtgttggagatcatccacgacgccgtttcatctgcagcggaagccgatctcatggtctgtgttgtgcggtttcatgctatttgggttgggcctcatttctctcttgacgggccacatggtctctgatctcgaatggtactctcaccgtcgctctctctactctacaatggatgggagctatcgtgcgccaatcgatgtttggaaatcccagtattctaaatattactacggatgcagtgtaaggggacgcgcttatgctcctgctgtgcctgagtggatgtcgaatggctacttgcttattggtactagtggaggattgaaccaacaaagaactgggataacagatgctgttgttgttgcacgaattcttaatgccacactagtagtacctgagttggatcatcattcttattggaaagatgacagcgacttcatccatattttcgatgtcgattggttcatttcttatctcgcaaaagatgttactattgtcaaaagagttcctgataagttcatgcggtcaatggagaaaccaccatatacaatgcgcgtcccgaggaaatcagagcctgattattatcttgatcaagttttgcctatacttttgagacgacaggttgttcaattgacaaaatttgactacagacttgcaaataaccttgacaatgagctacagaaactacgttgccgcgttaattttcatgctttgagatttacaaaacctatacaagaacttggtcaaataattgttatgagaatgcaaaagatggcgcggcgtttcatagcagtgcatttgaggtttgaaccagatatgctagcattttcaggttgttattttggtgggggagaaaaggagagacgcgagcttggtgaaatcagaaaaaggtggacaacattacctgatttgagcccagatggagaacggaagcgagggaaatgtcctcttactcctcatgaagtgggtttgatgctgcaggcacttggcttttcaaaagatacatacctctatgttgcgtcaggagaagtatatggaggggaagaaactatgcagcctctcagagatctttttcccaacatctatacaaaggagatgctagctgaggaagagctgaaacctttccttccattctcttcccgccttgctgctattgactacattgtttgtgatgaaagtgatgtatttgttactaacaacaatggtaacatggccaagattcttgcaggtcgaaggagatatatgggtcacaaaagaacaattagaccaaatgcaaagaagcttagcacgatattggcaggaaggcatcaaatggactgggatacctttgccaaaaaggttaagtcatgccagagaggattcatgggagagccagatgagatgagacctggtcgaggtgaatttcatgaatttccaagttcttgcgtgtgcaagagaccatatgtggatgaagaactcagcaaagagcttattcctcctcgaatggaattagaagaggcaggacatgaagttaacttgaaccatgaggttatcgggagggggggaatcaagagttatctcgctctgttaatgccaacggaacgtcaattgaaaattgaataa

SEQ ID NO: 80967 - DNA, 1812 bp, Glycine max
  Peptide Sequence Number=SeqID_172652
atggacgaaccgaacgaagcacaagacaacagagaactctacgcgctcttgaatttgtctccagaagcttccgatgaagaaattcgcagagcgtatcgtcaatgggcgcaagcctatcatcccgataaataccaagctcctcacatgaaggatattgctacggagaactttcagcgaatatgcgaagcgtatgagattctttcagatccaaataaaaggcaaatatatgatatctacggcatggaggggttgacctctggtttggaacttggtccaaagcttaatggagctgaagagatcaaggcagaactcgagagattgaagaggatgaaggaacgcgagaaaatggcggcgcattttcaaccctccggtacaattgtggccaatatgtctttgccacgctatctagacggaaatggcatgctcagaggcttttcttctttgttttctcgtctgattgtgtattttattacgtttatgagtatcagaatggctatgacaagtgaaatccagtctcagttatcaaagcgtaatgctgttacgattggtggtaatttagcagtgaatggagaggaaggcggtggagctgctactgctgtatttaggcatcatctttcagaagtttcgtcagtagaggttgtggcctcagctggtctgcgtgcactaattggggtgcaaacaactcgtaatctatcatcacactcagctgcaacaatgggcatagcactgtctctgaaagacggttcattgaatctttcaaatttatggacccgccaactgtcagaaacagcaagtggacatatagagcttgctttggggccacattcatctgtaactgttgggtggcaaaagaaagatcagagaaggtctgcctctggagaagtgaaggttcttttgagacatcagttcattatactcatcgtttttctcctaaatctcttggctgcattgtgggaagagttgggagaatcgaattgtaaggggaaaaagattaggaccaagttagagctgttacagttgggatatttgaagcaggggcattcttcccttgaggttgaagtcggtggtgggaggaagctatccaaattcagctcggtacgctggttgtatataataggaattcagggtatttcctggaaatttgagctgtatcgtgggggtcagaagttaattattcctatatactatgtaagtggttcgtttatgttctcgattgtgaagatgctcggaagatctatgtatatagaaattttgctgacaagacatctgaaccctgtgtttgctactggagcatttgtcgttcctgcatctctttactttgttctaaagaaactttttattaaaccttattaccttagaaggaataaacagaaggctctggaggagaaggagaaaacttctgctcaggttaaggaagcacgagctacagcagagaaagctcagaatttacaacaaaatgtggctaataggaaaagaaacaagcaattagaaacaggtggactggttattatgagagcactatatggaaatcagagaattttgaacaacttaaagtcatcaagtgaaacaagttttgaattaacttcagaagtcattgatgttacaatacctttgaattttctagttaatgattctggccaactcaagcttcatgaaggtgtaaaaaaatcaggcatcatgggtttctgtgatccatgtccaggaagtcctaaagacttgtatgtagagtacgtctatgctggcaatcaatacagggtttgggctggtgattatgaagaattacagatccctcagggcagccacaggatataa

SEQ ID NO: 80968 - DNA, 783 bp, Glycine max
  Peptide Sequence Number=SeqID_172653
atggaattcgatcttagtatgtatttttctctagctagtcttaatatgtgcaattcatcagcctgccaatatattcgatattcgctgacattatgtgtgaaacaggtcagtcaccatccaactctcattgcctgccactgcgaaggtagaggatggaagttttgggctgacagcaacatccattcaaagttttggggaaggtcaattcagcttgacccagtgggtgttctgaccctagagtttagtgatggtgaaatatttcagtggagcaaggtcaccaccacgatctataatcttatccttgggaaaatatactgtgatcatcatgggagcatggatatacgcggtaatcgtacatattcatgcagactcaagttcaaagagcagacgatccttgatcgaaatcctcgccaggtgcatggatttgtcgaagatgtaacgggaaaaagagttgccacattatttggcaagtgggatgacaacatgtattatatgagtggtaatataaatgtcaagcctaaagatttcacttcagcaaacgcatccttgttgtggaaaaggactatgccatctcccaatctcacccggtataatttgacaccatttgccatcactctgaatgagcttactccgggactgaaggagaaactcccgcccacggattccaggctcagaccagatcaacggcatctagagaatggggaatacgagaaggccaatttggagaaacaaaggttggaaaagcggcagagaatgatttgtataaggataggaaacttttaa

SEQ ID NO: 80969 - DNA, 1705 bp, Glycine max
  Peptide Sequence Number=SeqID_172654
ggtaccagcagaagtgacaagatcaaccacgcttcgtgcccttcatgatatggtagagacggtggtaggacaaaacaatgctgatgcagccaacaatgtgagcaagtggaccggaactgtttacatcttctctctagtgggtgctttcctcagtgattcttattggggaagatataaaacttgtgctgtctttcagggtctaatgtccttatccctttcatcatacctattcttgcttaagcctaaaggttgtggtaatgaatcagttaattgtgggaaacattcaaaattggagatggggatgttctacctctcaatctatcttgttgccttggggaatggaggttatcaaccaaatattgccacatttggggcagatcagtttgacgaggagcactcaaaggagggtcacaataaggtggccttctttagctacttctacctagcttttaacattggccaactcttctcgaacaccattctggtctattttgaggacgaaggaatgtgggctcttggtttctggctgtctgcaggctccgcctttgctgcattggtcttgtttcttgtatgcaccccaaggtatagacacttcaagcctagtggcaaccctctctccaggttcagccaagtccttgtggctgcatcaaggaaatccaaagttcaaatgtcatcaaacggagaggacttattcaacatggatgcaaaggaggcttccaacaatgccaatagaaagattctccacactcacgggttcaagttcttggatagggcagcgtttatatcttcaagagatctaggggaccagaaagggctcggttacaacccctggcgtctctgtcctgtaagtcaagttgaagaagtgaagtgcatactgagactacttccaatctggctctgcaccataatatactcggtggttttcacacaaatggcttcactttttgtggagcaaggtgctgccatgaaaaccaaggtttccaacttcagaataccaccagctagcatgtccagctttgacatcctcagtgtggctgttttcattttcttttaccgtcgagttcttgatccgtttgtgggaaaacttaaaaagacagattctaagggacttacagaacttcagagaatgggagttggacttgttatagctgtactggcaatggtttcggctggattagttgaatgctataggctcaagtatgcaaaacaaggatgcatccactgcaatgactcgagcactttaagcatcttctggcaaatccctcagtatgcatttataggagcttccgaggtttttatgtacgtaggccagttggagttcttcaatgctcagacaccagacggcttgaagagctttggaagtgctctttgcatgacatccatttcccttgggaactatgtgagtagcttacttgttagtgtggttatgaagatatccaccgaagatcacatgccggggtggatccctggaaacctcaacaaaggtcacttagatagattttacttcctcttagctgccttgacatcgatagacttgattgcttatattgcatgtgcaaaatggtacaagtctatacagctagaggcaaacactggagagattgatgagccagaatccccagagcttacacaagaacttctgtccttaatgcttggtattctcgtgaacaaacaaagcaatcaaggaccattgatgtggggatag

SEQ ID NO: 80970 - DNA, 258 bp, Glycine max
  Peptide Sequence Number=SeqID_172655
atgaagaatgggaaaggaagcaataaaagaaagagaagaacaacaatgagaggtgaagatatcactgtctgcacgatatttatagagagagagagtagtagtagtatatggaaagagtctgggtgttcgttaacacggccacaaaggaccacactccacacaacggagagcacaaaattagccaaacacattctattttcttaccccctcaccaagcccggtgttgtagaaaaatcattccatagcattagaaggtaa

SEQ ID NO: 80971 - DNA, 2436 bp, Glycine max
  Peptide Sequence Number=SeqID_172656
atgggaagccccaacacaagaaccagctcctcgtctgattccgaactcccttgctctaattacattccggtacccgatggaccccactctcccgcagaaccagctcgaagagaggtgattgtaatcttttgtgggttgctggtgcttgtgtccttggtggctttcaatggttacagctgggcgcattcaaatggacatgatggagatcatcatcatgcgtcatcatcattgccaacaacgttgttaacagtaacacccaatgaattggaactgagccccgacacagtgccatggtcaacatggcagacgacgctttcacgtggcgtgtctgcaggggtctcggagaagtccagctggctattcaacagcaacaatgggaacggggaatcgtatccttggaacaatagcatgctgtcatggcagagaacagcttaccatttccaacctgagaagaattggatgaacggtccaatgtactacaaagggtggtatcacttcttctaccagtacaatccaaacggtgcagtttggggtgacatagtttggggacacgctgtgtcaagggacatgattcactggtttcaccttccacttgcaatggtggctgatcaatggtatgacaaaaacggtgtgtggacaggctctgccaccatcttacccgatggtcaagtcatcatgctatacactggttccaccaacgagtcaatgcaagtgcaaaaccttgcataccctgcagacccctctgatcccctccttgttgattggatcaaataccctgcaaatcctgttctattcccaccacctggcattgatgccaaagattttcgtgaccccaccactgcatggatcacctctgaaggaaagtggcgcatcagtattggttccaagcttaacaaaactggcattgccttggtttatgataccaatgacttcaagacctttgagcgtgtggagggagtgcttcatgttgtccctggcactggcatgtgggagtgtgttgactttttccctgtatctagcaagggtgaaaatggccttgatacttcaatcaatggggagaatgtgaagcatgtggtaaaggttagcttggatgatgatagacatgattactatgcactcgggacttacgatgagaagaatgttaagttcacacctgatgacttcaacaacgatgttggtattggactcagatatgactatggtatattttatgcatccaagacattttatgatcagagtaaggggaggagagtgttgtggggttggattggagagtctgatagcgaatacgctgacgtggccaaaggttgggcatcagttcagggtattccaagaacagtggcacttgataagaaaactggtagcaacttaattcaatggcctgtggcagaggtagagagtttgagattgagaagcgacgagtttcaaaatttgaaggtgaagccagggtcagtggtgccactagaaattggaacagctgcacagttggacattgtagctgagtttgagatagataagaaggccttggagaagacaggccagtccaataaagagtataagtgtagcactagtggtggatcaactgagcgtggtaccataggaccttttggtcttctagttttggcagatgatgatctttctgaatacactcccacttacttttatgtcgtcaaaggaagccatggacaacttaaaacttccttctgctctgatcaatcaaggtcttctctagcaactgatgttagtaagaaaatctttggaagctttgttccagtactaaaagacgaaaagttgtccgtaaggatattggtggaccattctatagtggaaagctttgctcaaggtggaaggacgtgtgtaacatctcgagtttatccaacgaaggcaatctatggagctgctagattgtttttattcaataatgctactgaggccactgtgactgcttcagttaagtccttccccgttgtgtgccaaactaactccaacagagatcatcgtcaaggaaatgtggtttcggccacgttggcggctgcgattattgccttcagctctgacatgtctgcccttgctgatctcaacaaatttgaggctgaaatgaggggtgaatttggaataggatcggctgcgcagaaagcagtgcatgtcaatgaaaatttcagagccaatttcacagctgctgatatgagagaatctgattttagcggttcaactttcaatggtgcctaccttgagaaagctgttgcatacaaagcaaattttccaggtgtcgatttaagtgatacattgacggatcgcatggttctaaatgaagccaatctctctaatgccattctccttagaacagtcctcacgcggagtgaccttgggggagccatcatcgaaggtgctgactttagtgatgctgtgttggatcttcctcaaaagcatgtatga

SEQ ID NO: 80972 - DNA, 673 bp, Glycine max
  Peptide Sequence Number=SeqID_172657
gttgttttggcagaagatcgggatggttagctctggcaagtatcccaccaatgagcaggttgtagttgagatcaatggggttgcaatgtcgttcgtgcgaagcggtgggtgcaatccaaggattgatgattcctatagtccgacattttccgcgcaagctgaaataattgacgatgaagctgtccccattctcgatgggcttacgctctacgggcccaagaaagggaaaatgggtaaggatctgagcgaggaacaagtgtcttccatgaaggaagccttctctctattcgacactgacggagacggtcggatcgctccgtcggagctggggatcctgatgaggtctctgggaggtaacccgacgcaggcccaactcaaagccatcgtggctgaagagaacctcacggcccccttcgacttcccccgattcctcgatctaatggccaaacacattaaacccgaacccttcgatcgccaactccgcgacgccttcaaggtcctcgacaaggactccaccggcttcgtcgccgtctccgagctccgccacatcctcaccaacatcggcgagaagctcgagccctccgagttcgacgagtggatccgtgaagtcgacgtcggatccgacggcaagatccgctacgaggatttcatcgccagaatggtcgccaagtaa

SEQ ID NO: 80973 - DNA, 231 bp, Glycine max
  Peptide Sequence Number=SeqID_172658
atgccactagtccttggaaacattggttctggaagcacgagtcaggtcaggaagtggaacatgaatagcacaagaaaaaccatgatttttgtgagccaagcccaatacaagccaataaagtccttagtgatccacctgaaggttgttagaaaattgcagacactaaaccatacacttgtgagcagaggaaaacaccagccttgtgaggaaagtaaggcaagccagatttga

SEQ ID NO: 80974 - DNA, 216 bp, Glycine max
  Peptide Sequence Number=SeqID_172659
tcgcgctcagcgccacaactcgcgcttagcgcgttcagatcgcgcgctgggcgcgccatgcacgctgggcctgtgcttctgttggatcgggcgctgggcgtctgtacgtctgttggatcgggcgctgggcgcctagctgggcttagcgcgcgtaacggtttccgccgcgcccagcgcctccagttagttgctcgcttagcgcctgatgcgcgctga

SEQ ID NO: 80975 - DNA, 762 bp, Glycine max
  Peptide Sequence Number=SeqID_172660
atgtctcaacggagaagttcgccggtggttgtcgcccggaagaataagccgccgcatccgtcgccgtcgccccgtcgtaggacgaagagcaagtcgaggcctatcaagatcctgaagcgctgttcgtcggcgcctctactttcacgccgtgataacgacgatggtgacgttgaccttgacggtgacgaccattattcgaggacgagcggaggaggctcgtttttccgccctaaaaccttttcggatgcctttctgtcttccccttctcccttttcctctccacggattcacaccaaacaggggtacaagtacgacaaagaagcaaaggtggtagttaatgtgaccgttgagggaagtccagggccagtccaaacgatggttaaactggggtccagtgtggaggatactatcaagcgtgtggtcgataaatatacagaagaaggcaggagcccccagatcgatgctaatatggcttcttcattccaattgcatcactcctatttcagtctccatagtttggacaaatcagaagtcattgcggatgtgggtagtagaagtttttatctgcggaagaataatgatgcatcatctactttgacttcttcatttcattggggaagtgctcccgaattagccacacatacttccactccatccatagcaaatcctccgttgttgatcccatctttcattgcccgcaggatttgcaaaattgtcagaagagctcaccgcctttggaagattttggtttgctctcagtga

SEQ ID NO: 80976 - DNA, 549 bp, Glycine max
  Peptide Sequence Number=SeqID_172661
atggctgatctatttgcatggcttatctccttcttcctcctcattgccttacttgtcctcgttatgtaccagctaatgtgcctggcagacctagaatttgattatataaatccttatgactcttcagctcgaataaatatggtggttttgccagaatatattacgcaagctgtcctgtgctgcttctaccttcttaccgggcattggattatggcactcttctgtcttccttatctttctctcaatctccgattgtataggcaaggaaggcatttggttgatgttactgagatattcaacctgctctcttgggaaaagaagcaacggctcgtcaaactcttctatcttgttttcacccttttcctctctgatgatttacacatcattggattagtaactgcagtgcttgcttgtattatggagtgctgcaaactcccagatgtgtgtggtagggaacagttaattacttgtcatattgctatcctgattaacgtgtactttagggggggggaaattcaagggagagattgtcttttgaaggaagattga

SEQ ID NO: 80977 - DNA, 558 bp, Glycine max
  Peptide Sequence Number=SeqID_172662
atggagcgcatgagactcttattcatctttatttctattttgttcaatgctacaactctgagtggtgttgaacttcttgttcataactactacaaggagaagtgtcccttagccgaagacatcgttagacataacgtggaagtggcagttttaaaaaatcctcgtttggcagcctctctacttcgcttacacttccacgattgttttgtcatgggatgcgatgcatccgtgcttttggacaacgtggagggcatgacaagtgaaaagttggctggaccaaatctgaactctttacgtggatttgaggtcatagacaagataaagtatttgcttgaagaagaatgtcctattactgtttcatgtgctgacatccttgccatggctgcacgtgatgctgttgaattgagaggaggaccaagatgggaagtcttgcttggaaggaaggatgctctcgagtcaagtttcagtggagctaacatattaattccggctccaaattcatctttggaggttctcatagataattttaagcaacaaggcctcgacatagaagacttg

SEQ ID NO: 80978 - DNA, 1383 bp, Glycine max
  Peptide Sequence Number=SeqID_172663
atgatttcaagtggtctgaaactgaagcacttccgcaatgttgattcgctcttccattttcccaaatccaaacccccaattttactcccatgctgcccaaccatctcttctccatgctccattcgtttcaattcgcatttcccataccggagcaccaaagttcccctaaaatgtgcaccactcccctcttcagattctctgccacctgatctttccgatgccccgacccagacggagcaaaattccatgtcaattctggagattctgaagcaatcaaattcatacctgcctcatgtactcattgctagtatactgctagctctaatctacccaccttctttaacgtggttcaccagcagatactatgcacctgcactaggttttttgatgtttgctgttggggttaattcaaatgaaaatgacttcctcgaggcatttaagaggccagcagaaattgtcactggttattttggccagtttgctgtgaagcctcttcttggatatctgttttgcatgattgcagtaactgttttaagcctaccaacaacagtaggcgcaggaattgtattggtggcttgtgttagtggtgcccagctttcaagttatgctactttcctgacggatccacaaatggcacctttaagcatagttatgacatcactgtccactgcttctgcagtgtttgtcacaccactcttactactgttgctcatagggaagaaattgcctatagatgtaagaggaatggtgtacagcattacacagattgtggtagtacctatcgcagctggcctgcttctaaatcgattctatcctcgtatttgcaatgttattcgaccatttttgcctccactatcagtactggtggcatctatctgtgctggagcaccactcgcctttaatgttgagactatgaaatcccctctgggagttgctatcttgttgcttgttgttgcttttcatttgtcatcttttatagctggttatatcctcagtggatttgtcttccgtgattctcttgatgtgaaggcactgcaacgaacaatttcctttgagacaggaatgcaaagtagcctgcttgccttggctcttgctaataagttctttgaagatccaaaagtggctattcctccagcaatttctaagaggaaagagagacataaaacacagctcttgaaaggtatggatatagggatacatattactacaaattggtccatcttgtattctagtgagcatcggttctgcttactaggagggaccgatggcagtcgtagtgataatgctgaggtttgttacctgcaacttagtggattcggtgataggcagctttcaaaggaagagattttagtagaaagagtagcaggaaatattaaatgctaa

SEQ ID NO: 80979 - DNA, 2160 bp, Glycine max
  Peptide Sequence Number=SeqID_172664
atgaagttaaataaagaactcaaaggcacacactgtaatgttctgctgctgagaaacaacttaaatttgagtccagatattgctgaagtctcacaggagaaattgctttcattggttgctgaacgattaattgattcaaatagtaatgtgaataacaaagatgcaggctatgttgaaaatcaacaacagaacattgctgatgcaattgacttactccctaggcttgctactggaattgatgtaaatataaaatttaggagaataggtgattttgaattcactcgagagtgtgccatatttgatctgctggacattcccttgtatcatggctggattgttgatcctcaggattatgacactgcgaatgcaattggatcaaaatcctataattcccttatgggagagcttgtctctcttgaaacactaaacatggaggtccatcataaaaataatccagaagaagattgtgttgattttgtggctgcaacaactgctactcttggagttccctctcccagtctttcaaaagccaggtcgtttgatgattcttctcattctatttctgataatatactaagaaaaggtgatctagaagaagaggcagagttgttgagagtcttgaaaatgtccgaggatgaaagtgatcctgttgtaggtcacatgcatggaggagaaatttctgtcagtatggatagaaaaatgtgtaatgacgaggttataaatatggattgtggagataaattaggaaatagctctggtgctggtaacagtaactttcatgagcatggcccagagccttccttatctgatgattgtgctgcttctggcaaagaccacagcgaacagatatcttctacttctacactgggagaggcagctaattcatccttaaagactgataccataagtgaccttcatcaatcaacttatacgggacctgaagaatcttttgacctgaatgatgtgattgagaagaacagccttgatgcattggttcagaatgagagtgaagttatcccttctcctgaaaaacactctgtctctttgtttgagtgccgtgcagatttttctggaggtgatggaaaagtccatgatcaatccactcctacaactatagatcatgaagttgtaggtgaatctcatggacctgatgccacaggattatcattctcatcccctggccatacaaattcagattcatctagtgtcagatatcatcaaactgatgtttctggagcattgacttcaagtgttcaagggagtgagcccatatatgaaggagaggaatgtgtattggatacaagaactggaaattttgaggatcgtgaacctgtttatgaaggtgaggtggtacttgcagaacaggctgacagaagcaccttagttgctcctgatctaagagctaaggatgaacttactccagaacaaggtgaattgatcaagagtttcttgaggaataatgccagccagttgacattttatggtcttttctgtttacaagatgggcttaaagagcgtgagctgtgtgtttttttccgtaacaatcatttcagcaccatgttcaagtttgagggtgagctctatcttctagccacggaccaaggttacataaatcagcctgatctggtctgggaaaaactgaatgaggtcaatggtgatacattgtttatgaccggtaatttcaaggaattcaaggtagaaaaccatgaaagtagtacttgggatgagaacaatgctctgaccagcactgccgactatcttgccagcatagatagtgcaacacatgcaggcttagatatcaattctgatctccaattagcaatagccttgcaacaacaggagtttgagcagcagccaccacgccagaataattcacagccgcaatcatccattagtggtagctctagactggtcacaggtccccaggtggcaagaaacactggaagacattcatcttcatcaacatctgcatctcccagcactttaagtagggagttaaagctcagtcggctcaggtttaccattgccatttcacctaatttagctttgggtgctgatgctagtggagttgtagaagcctgtgtgtcacaaagtcatcggcatcaggttatgttcgagttccctaccagatttgacggctcatttctggaaggatgttaa

SEQ ID NO: 80980 - DNA, 531 bp, Glycine max
  Peptide Sequence Number=SeqID_172665
atgcacgtagctactacaaccaactgttccttcacaaagttgcggttgcggacataccaaaaggagacagacacttgtgatttcttagttcttacattacatatggctcatttctgggaggaggctcacaccatggacatgctcaaccatctacttggaggaaaaatcaaagcacacgtgtccaaagctggaaccggtgattcctatgttacggtatctgtggccggtgccgtgattgccagaacttttgtcatcagaaacagcgagaaccctgtttggacgcagaatttcaatgtccctgttgcacatcttgcttctgaagtccactttgttgtcaagcacaattatgatgtgggttctgagattattggagcagtgggaattccagtggaacagttatgtagtggtacaagagttgagggcttcttccccatccttaatgatactggaaaaccctgcaaggatagatcagtgttgagtttatccattcagtacacccctgttgaaaaggtctttatagccatggagtag

SEQ ID NO: 80981 - DNA, 837 bp, Glycine max
  Peptide Sequence Number=SeqID_172666
atggcaaacagaagagatccacgtgggcacacacttgatgcagttcacaagacatacaaggttgaggaagatgctgccgttgttgatagtaaaatcctacaatattgtagcatagacaaaaaagagaagaaatcagttggtgaaatggagcaagaatttctacaggcactgcaagcattctattatgaggggaaggctattatgtcaaatgaggaatttgataatcttaaggaagaactcatgtgggaagggagcaccgttgtgatgctaagttctgatgagcaaaaatttctggaagcgtctatggcttatgtgtctggaaaaccaatcttgagcgacaaagagtttgatgagttgaaactcaggctaaagatggaagggagtgaaattgtggctgaaggtccacggtgtagtcttcgtagtagaaaggtttacagtgacctgtctgttgactatttaaagatgttcttgctgaatgtcccagcaactgtggttgcactaggattgttcttcttccttgatgatgtgactggatttgagatctcatatctgataaagattccagagccttttagtttcatcttaacttggtttgccgctattccctttattttgtggctggctcaatcgatcactagggcaattgtacaagattttctgattttaaagggcccttgtcccaactgtggtactgaaaatacctctttctttgggactatactgtcggtttcaagtggcgattccaccaacaaagtcaaatgtgaaaactgtgaaactaaaatggtgtatgattcaaaaacaagattgattacattaccagaaggaagtaatgcttaa

SEQ ID NO: 80982 - DNA, 855 bp, Glycine max
  Peptide Sequence Number=SeqID_172667
atggacgaatcattcactccagcaccaccacctcctccaatgtccctttctcggcacgatcacgtccaacgaatgataaactcgaagcgctacaagtcaccttcgaaaacaatatactccgacaggttcattccgagcagatccggttccaatttcgatctcttcaatctaccttcgccgtcgtcgtcagaggacagttgcagttgcagcccctacagcaccgcgctgcggagggccttgttcggaccagacactcccgataaatttgaaagccctaatatattccgttacaaaacggagactcgaaagtctatgtattctctctcacccaccccttttacttcccaggatgatcttctccctggttatgacaacaatcataaacctcccaagcgtcctcgcaagattcctccctcctcttttaaggttttggacgcccctgcgctgcaagacgatttttatctgaatctcgtggattggtcatccaacaatatcttggctgtggctctggagaactctgtttatttgtggaatgcttctagcagcaaggtaactaaattatgcgatttggggattgacgattcagtttgttcagttggctgggctccacttggtacctacctgtctgttggatcaaacagtggtaaagtccagagtggatgggaagccatgggaaatagccatgaaggtggccaattagttgataaacatcttgtaggtcaactaagctttgtcagggagctatattggtgtacaaacgcattcatggggagcatctcactccatttatctgtttccaacatgtatcacactctttgcttgtgttgggcacttaactttcacgacacgtattaa

SEQ ID NO: 80983 - DNA, 750 bp, Glycine max
  Peptide Sequence Number=SeqID_172668
atgaatcaaaagatagaaggagatcaaagattcaacagaaaagggaagaataacaattttggaagaagtgcaacaatggctaccagaactcatttcaatacaatgcaaatgatgtatgacactatttacaaggccttacagaaggctgggcttgacaatgagtatgaaccacaagactacttgaatttcttttgccttggtaatcgtgagatccctgacaatgaaaatgttgtaaatcctacagaagaaaacatgcctcgggcactcactaaaaagaaccggagattcatgatttatgttcattcaaaaggaatgatagtggatgatgaatatgtgttactggggtccgcaaacataaaccagcaatccatggaaggcaccagagatagagacagagcaatgcgggcatatcagcctaatcatacttgggcaaagaagcaatctaaacctcgtgggcaggcaagatttataaacttacaagtgctttcttgtgacaaaattttggagggaattgtgcatggttatagaaggtcattgagtgagtttaactggagacaatatgcagcagaagaggtaactgaaatgaaaagtcatctattaaaatatccgcttgaagttgattcaaagggcaaagtgaagcctctttttggctgtgaggcattcccagacgttggtgggaacataagtggcaccttcaccttatcaggactcagaaaatatcgccatctgatcatatatgtgagttcttaa

SEQ ID NO: 80984 - DNA, 3537 bp, Glycine max
  Peptide Sequence Number=SeqID_172669
atggcggaaaggcttgcctactgccataggcaacttatgaagggaggcctgcaatggcagcaacataggccgcaatggcacgagaatatctctgttttggagataaatgcagccgggcaggtcactgggtcaaatttgggattgccaaatgcatctgatgagtgtgccacatgtggcactaaagacaaaaagttctgtgaagctaatgaattaagttctcgtgttttggattgcctgaggatctctaaggcaagattctcagctctaaatcctgataaaaccccaaatagtatttttgctgatatccagcaaagaaagattggagaaaatgctttcaattcttctggtttaagatggataaaagatgtggttcttggaaaacgcaatgacagttcattccgtactgtggttgttggtgatccagaccttgagcttagtgaaattggtataccttgtcatattgctgaaagtttgcaggtttctgagtatgtgaataggcagaatagggagaagctgctttattgttgtgagctacacttgttagagaaggggaaaataaatgtctgcagaaagggtagtatagttcatctgtataaaaaggaagatctacaaataggtgacaaattttataggcctcttgctgatggggataaagtgctgataaataggcccccttctatacatcaacattctatgatttctctcacagttagggtccttccaatatcttctgtagtgtgtattaacccactctgttgttccccactacgtggggattttgatggtgattgccttcacgggtatattccacaatcggttactgcaagaattgagcttaatgagctggttgctttagataggcaattgattaatgggcaaagtggtagaaatcttctttcactttcccaagatagtttgactgctgcatatttgctaatggaagatggggtccttttgaatgtttatcaaatgcagcagcttcaaatgctttctatttctaacaaaagattaatacctcctgcagttgttaaagctccctctagtaatagctcactttggaatgggaagcaattattcagcatgcttttgccgtatgattttgactattcttttccttcagatggtgttgttgttagtgatggagagcttgtatcttcttctgaggcttctggttggttacgcgattctgactacaatgtttttcagagtcttgtggaacattatcaagggaagactctaaactttttgtatgcagcacaaaaagttctgtgtgagtggctgtctatgacaggttttagtgtttcactctctgatttgtacctttcttctgattcgtatgcacgggaaaacatgatagaggaaatcttttatggcttacaagatgcagagcgggcttgtaatttcaagcagctattgttggattattattgtgattttctgtcaggaagtcttcaagagagtgaaaatgctatcactgttaatgcagatcgtctgaattatgaaagacaaatatctgcttctctcagtcaagcgtcagttgatgcttttaggcaagtttttcgcaatattcaaagtttagctgataaatatgcatgcaagggaaattctttccttgcaatgtttaaggctggaagcaagggtaatttgctgaaattagttcaacattccatgtgccttggcatgcaaaattctctggtccgcttgtcatacagactaccccgtcatctttcatgtgctgactggaatagtcaaaagtgggttgattcaatccagatgtcttctggtacccttgaatctgttcagtcatacattccatatgctgtagttgaaagttcttttttaactgggttgaatccacttgaatgttttgttcattcagtgacaaatcgtgatagctctttcagtgaccatgcggaccttcctggtacactgacacgtagacttatgttcttcatgcgtgatttgtatgatgcatatgatggaacggtgagaaatttatatggtaatcaacttattcagttttcttatgatattgaagaggactcttcatgcaataaaggtttccagcagtatgctttaggtggtgaatcagttggggctatttctgcctgtgcaatttctgaagctgcatacagtgctttgggtcaaccagttagtctactcgaaacatcacctttgctgaatttgaaaaatgttctggagtgtggttcaaggaaaagaaatggtgatcagactgtgtctttatttttgtctgaaaagcttggtaaacagagacatgggtttgaatatgcagctttagaagtcaagaattatttggaaagattgttgttctcaaacattgtttctaaagtgatgataatattcaccccacatgacagcaggagccaagaaaaatacagtccttgggtctgccactttcatttagacaaggaaattgtaacaagaagaaaattgaaagtgcattctatcattgactctctctatcagagatattactctcagagaaaagactcaaaagtctgttttaccaatttgaaaatttcaagcaggaagtgttctgctgattccatggttaaggaaggtgaagacacttctatagataaagaagagggtgatgattgcatcatggtcacaattgttgaaaactctaagaatcctatacaactggattctgttcgggacttggtgataccttttcttctaggaacagcaatacaaggatttctggatgtcaagaaggttgatattctctggaataatcagtcaaaagtaacaaattctcgtaatggtttttctggtgaactgtacttgagggtaactttgtccagcgagggtagcagaggaagattttggggtgtcctcctaaagctttgtcacaagataatgcatataattgactggacacgaagtcatacagataacatcaatcatttctcatcagcatatggaattgatgcagggtggcaatactttttcaatagtttggcatgtgcaacatctgataccggcaagtccatccttcctaagcatttgtgtcttgttgccaatagtctgtcatgtagtggagagtttgtaggattaaatgctaaaggcatggcactacaaagaaaacatgcgtccgtttcatcaccatttgtgcaagcatgctttgcgaatccaggtagttgctttataaaagctgctaagtctggagccacggataatctccagggcagcctggatgggttggcttggggaaactgtctatctatggggacaagtggaatgtttgatgtcatatattcagagaagggacatcaggtagctaagtctgtagatgtgtatgagctgctagaagccagttttgacaagccgaacaataaaattggtactcatttgcacaaatattcatctgacaaatgcggttctgagtttaggcataaaaatggttatgccttgaaagagggaaaacagtggaaaaccattttaagaaattttgtgacagtaaatgatattcagaagctgacttttgcatcgaggtgcatattgaacaagtaa

SEQ ID NO: 80985 - DNA, 969 bp, Glycine max
  Peptide Sequence Number=SeqID_172670
atggaaggatccctctttgatgtccatagggccgaaccatcccaacaaccaattgtggcagcaccaccattggatatgaaacgggcggagtcatcacagcagcatgtgagagctttaaatacccagtttgcaagttgggttcaaacacaactaaagaatcatcctgatgagctttgggaagatggtgtcagagattacttagatcatgcttcaagcattatggtaattccttacatggtagctgatcccatatctagtagtactattacttctgtggctgtgcatgctgcagaaaagtttagtgatgttgtcaactggctcaaagcaaatgccactaaggcagaaaattcggctgctgatgctagtgctgctttttctgggaaaaagctcttgcctgaagtaataatcaatgaaaataaatcttctggagaaaaaactgggtctactcctgttagtactgctacaaattttactagttcttggagccctggattattttcaaacagtcaaggcatttttggaattgaaaatgagttggagcagcctagcagcccatcagttaagaagtcagaagagaaaggtgtagtagttgtacatgaagtaaagtgcaagctttatgtgaagtcaagtgatccaggagataaagatgcatggaaagataaaggaatgggccaactgtctattaaatgcaaagagggtgtcagcaaggctaccaaagagtccaaacctacaattgttgttcgaaatgaggtaggaaaagttcttctcaacgccctgttgtatccaggaatcaaaacaaatctgcagaagaactctcttgttgcaatattccatacttcgggtaatgctgacggaagtggtggagataacgatagtgttgttgcacgtacattcttgatccggatgaaaacagaagatgatcgaaataaactggcttcaaccatcaaagaatatgctccaatgtcttga

SEQ ID NO: 80986 - DNA, 441 bp, Glycine max
  Peptide Sequence Number=SeqID_172671
atggcgtggaaatggatcgtgcgaaggacccgcgaatcaaagcccttcttccttgcattcgccaccatatgcggcgtcgttccgggcgtcataggctatggcgtcatgcaactcactaacacccgcaacgagaagctcgaggcgagccctggtgcagcggtaaagttgtgccttggtgacttgttggtcatgggttcgaatccggaaacagcctctttgcatatgcaaggtctatttgctttaattatgtatcagatgatggggcaagtcaataaagagaggctggcagagtacctaggagagctacagcggaaggaggataccaatgatcgctatgttgctgctctaagaggagagactttaaccagaaaaccttatgtgagaatccaaccgattccagagcacattgacaccaaggcaaacaaggagcagaaaaattga

SEQ ID NO: 80987 - DNA, 1029 bp, Glycine max
  Peptide Sequence Number=SeqID_172672
atgaaaaggtatggaccaatcttcaagaccaacttggttggacgaccagttgtagtatcaacggaccctgatcttaatcacttcatcttccaacaagaggggcaagtgttccaaagctggtacccagacacattcacagaaatctttgggcgacaaaatgttggctccttacatgggtttatgtataagtaccttaagaacatggtgctcaatctgtttggtcctgaaagccttaaaaagatgctcccagaacttgaacaaacaacgtgcagaacattagagcagtggtcatgtgagaacagtgttgaattgaaggaagcaacagcaaggatgatatttgatttgaccgcgaaaaaactcatcagttatgattcaacaaagtcctcggagaatttaagggaaaactttgttgcatttatccaaggactcatctccttccccctagacattccaggaacagcttatcacaaatgcctgcagggtaggaaaagggcaatgaagatgctgaagaacatgctgcaggaaagacggagaatgcaaaggaaagagcaaacagatttctttgactatgttgttgaagaacttaagaaagagggaacaatcctcactgaagcgatcgccctggacctcatgtttgtgctcctctttgcaagctttgaaaccacttctctcgctctcacttatgccataaaattactctcggacaatcccgtagtgctcaagcgattacaagaagaacatgaagccatcctcaaacaacgtgaagatcctaactccggagtcacgtggaaagaatacaaatcaatgacattcacatttcagttcataaatgaaaccgtgagactcgcaaatattgttccaggaatcttccgaaaggcactgagggaaattaattttaagggatatacgataccagcaggttgggcagtgatggtgtgtcccccggctgtgcacttgaatccagctaaatatcatgatccccttgctttcaacccatggagatgggaggtgcgtctaaggcatgtttga

SEQ ID NO: 80988 - DNA, 768 bp, Glycine max
  Peptide Sequence Number=SeqID_172673
atggccaccacaaggtcatcttccgaggacatcgtcgattccacgccgctgctcgccaattccggcggctcctccgacgagctcacctccggccgcggtttttcgcggcgacagcggctacggcaggcggcgcggttcctccggcgggcgagcgggcgccggatgatgcgcgagccgtcgatgctggtccgggaggccgcggcggagcaattggaggagcggcagagcgattgggcgtattcgaagccggtggtggttctggacatcgtgtggaacttcgcgtttgtggttgtggcgggggccgtgctggttttgagcgcgagcgaagcgccgggcatgcctctgaggttgtggattgtagggtacgctatgcaatgcgtccttcacatggtttgcgtttgcgtcgagtataggaggcggaggaggcagcaacgcgccgccgcctcgtcagtgcaagacagggttgggagcagcagtggaaatttgagtgtatcttcgagggagggttctgcttctggctcggcgcagtatgtgtcgttgggccaactcgatgacgagggtactagattaagttatgatgtagcaactgtagccttctcttatcgaaagcttgttgaatttcaagagctccaaggcttaggccgaagtgtttggcgtttccttctccgtgcccactcaagggatgtgactgagtgtatttcagatttcagcctcggttttcttaggccaagattgcctattgggattggatttggaattcagccttga

SEQ ID NO: 80989 - DNA, 522 bp, Glycine max
  Peptide Sequence Number=SeqID_172674
atgggagaagaggtgtctagcaaaaccgaaccagagctacactgtgtggactctgttcctgaagagcataattcctctgttcaggaaaaagaattggagaaacctgaacctccaaacgacaaggtcactcctccttctccagctgctgctcaagaggttgcagatcatgctagtaaaaaggacacagaggagtcacttgacaaagatgctatgcttgcaagagttgtaacagagaaaagggcatacaagagactctctgctgttggattttgggaggatagcaagaaagcatcagtagaggcacaactcaagaaaatcgaggaaaacttggaaaaaaagaaggccgaatatgttgagaaaatgaagaataaagttgctaaaatccacctgttagcagaagagaaaagagcagttgttgaggctcagaagagggaagaatttatcgacttagaggagacagcttcaaagtttcgtagccgtggagatacgccaaggagattctttgcatgctttagtggctag

SEQ ID NO: 80990 - DNA, 1422 bp, Glycine max
  Peptide Sequence Number=SeqID_172675
atggctagtaacacaaacaccaacaacagcaacaagaaggagaaagaccttgagtttttctttgaggaagatatcaacgaattgggtgcacaacaaatggatgctgaaactgccaagttagagagtgagagtagcagcagcgatgacgagggaaatgatacaacacgccgtcactctttcacttctcagcaatggcctcaaagttacaaagagacaacagattcttacacacttgccgcaactccaaattttgaatcaattctacgagttccaagtattatatattccagttttgaaagtcgttcaaagaataacttggacatagatggaaagactccttttctctctggtcacgaaggcattactcaatcaacatcgtggaaggaaggtttagtgcaaaaacatttatctggtgaattacccattggtcgtgagtgcagctttcttcaaacagttttcaatgcgactaatgtgatggctggagtcggtattctgtctacaccttatacattgaaagaagctgggtggatgagcatggtgttgatggttctttttgcagtcatttgttgttatacagccacccttatgagatattgctttgaaagcagagaaggaatcactagctatccagatataggagaagctgcatttggaaaatatggtcgtattattgtctcaatcatattgtacactgaattatattcatgttgtgtggaattcatcaccttggaaggagacaacctcactgggctattcccaggaacatccttagatttgggtagttttcggttagactctgtgcacttgtttggaattttggcggcacttatcattatccccactgtttggttgaaggatcttcgtataatctctattttgtcagctggaggagtttttgcaacactgttgattgttgtatgtgtgttttgtgttgggacaataaatggtgttggattccatcacactggtcaattggtcaattggagtggcattccattagctattggtatccatgggttttgctttgcaggacattcagtttttccaaatatttatcaatctatggcagacaaaagacaatttactaaagcactaataatatgttttgtattgtctatcacaatatatggaggtgttgcaatcatgggatttctcatgtttggtggtgagactttgtctcaaataacattaaatatgccacgagatgcatttgcttccaaggttgcattgtggaccacggtaattaacccattcactaaatatcctttttaccacaaactagttttttatgaatgccatcaaaatgaacatgacttgatcaagttcaggaataattttagtctgcttttccttaactatacgcaaatatgctttgttgatgaacccattggcgagaagtctcgaagagttgctaccagatag

SEQ ID NO: 80991 - DNA, 1054 bp, Glycine max
  Peptide Sequence Number=SeqID_172676
atgggtaaaaagtttgagggttgggagtgtagtttgcagtgcagtgggaacctttcgcctcaggcacactatccgatgaggaggttggaagaagaaggaagagattcagagggcaagaaagtggttttgagcgttatgggaatgagttgcgctgcttgtgccggatccattgagaaagccatcaaacgcttacctgggattcgagaggccgttgttgatgtcttgaaccataaagctcaggttctttactacccacaaatgcttcacgagcagaggatacgtgaggccatagaagatgccggatttgaggccaaagtcatggaagaggactcgaaagacacctccactcaaatatgccgaatacacgtacgaggcatgacttgcacttcttgctcctccaccattgaatctgctctgcaatcccttcatggggtgcataaggcacgagtggccttaacaactgaagaagctgaagtctgctacgaccctaagattgtcacccacaaccacttcatgagtgccattgaagaaaccgggtttgaagccgtactaataagcacaggggaacacataaccaagattgaacttcaaattgatggcattaaaaatgagcaatccctgaatgtcattgaacgctctctccatgaacttccaggtgttgaaaccatagacatatatccagacatcaacaaaatttccatcacttataagccgtacatgacaggaccaagaaccttcatagaagtcatagaatccacaggctctgggtgttttaaagcgattatattcccaaatgatggaggaagagaagcacaaagacaggaggaaattaatcggttcttcaagttattcatatggagtttggctttcaccattcctgttttcttgacatccatggttctcatgtatatacctggagttaaacgtgttttggatatcaaagttgtcaatatgttgaatattggacttctcttgaggtgtgaatttgctaccccggtgcagttcatcatagggagaaggttctatgttggggcatataaagcgttgcgcaaag

SEQ ID NO: 80992 - DNA, 4428 bp, Glycine max
  Peptide Sequence Number=SeqID_172677
atggggaagggaaaacctaggtctgttgaaaaaggtgtggtaggacctagtttgagtgttacatcctcgactatacctttggggcctgtgtattaccctactgaggatgaattcaaggatcctttggagtatattttcaagattagacccgaggctgagccttttggtatttgtaagattgtgcctccaaagagttggaaacccccttttgctttggatctagactctttcactttccctaccaagactcaggccattcacaagctccagtctcgccctgctgcctgtgactccaagacctttgacttggattactctaggtttctgagggaccactctggtaagaagtccaggaagagggttgtgttcgagggcgaggagctcgacttgtgtaagctattcaatgccgtcaagcggtttggtggatatgataaggttgttgatggaaagaaatggggggatgttgctcggtttgtgaggcccagtgggaagatttcggattgtgctaagcatgtgttgtgtcagttgtaccgggagcatttgtatgattatgagaatttttataaccggatgaatcaagggatggctcagcgttgtaagaaaggtgtgcatgatgaccacaagattgaccatggggtgcaacctgtggtatccaagaagaatcacaagagtgttgatggttcaaaacataaggatagtaaggtgcaaaaagaagagcatgatcagatttgtgagcaatgtaaaagtggtttacatggggaactcatgctattgtgcgacaggtgtgataagggatggcatacttattgtctttccccaccattggagcatattcctccgggaaattggtattgtttcaactgcttaaattctgacagggacagttttggttttgtgcctgggaagcactatacattggaagcttttagacgcatagcggatcggtcaaggaggagatggtttggatcaggacctgtttcaagggtgcaaatagagaagaaattttgggaaattgtggagggattggttggtgaggttgaggttatgtatggaaatgacttggatacatctgtctatgggagtggtttcccacgtgtaactgatcagaaaccaaaatcgattgatgacaaattatgggaagaatacacaactaacccatggaatcttaataacttgcctaagttgaaaggctcaatgcttcgagctgttcatcacaatatcactggtgtcatggtaccctggctatatattgggatgctattctcatccttttgctggcattttgaggatcactgcttttactcaatgaattatctacactggggagaggcaaagtgctggtacagtgtgcctggtagtcaagccagtgcttttgagaaggtgatgaaaaacagtcttcctgatctttttgatgcgcaacctgatctgctttttcaacttgttactatgctaaacccatctgtcttgcaagaaaatggagtccccgtctacagcatacttcaggtttcatttagcttgcttatctttgtctttgacgtgttacttctcattgatatttgccaggagcctgggaattttgttattaccttccccagatcttatcatggaggtttcaatcttggtttaaattgcgcagaggcagtcaattttgctcctgccgactggctaccacatggtgcttttggagctgatctatatcagcagtatcacaaaactgctgtcttgtctcatgaggagcttctttgtgtagtagcccagtatggggatgttgatggcagagtgtcttcttatttgaagaaggaattgtggagaatatcagataaagaaaaatcttggagagagaaactttggaaaaatggtattattaaatcttcacgcatgggtcctcgaaaatgtccccaatatgtgggaacggaagaagtaggatttttttcaacctatggatccagcatgcattatatgccagcaatatctctatctctctgctgttttgccatcaacaattcatcttccaccattgcatcaatgtcaaagccaaagaaaaatgtgaacgtatcagaaaaccagcctgtccctggaaaagaggatatgggctgtctgtttatgtcttatcactgggaacacctttgtgagtgcaaaactgtaaaactacgtcttctctatcggcattcacttgcagaattgtatgacttggcattttctatggacaaatatacttctgaggacaaagctgagtgtagtagtgtgaaaaggaagccttcatgtcttagtgctttgaccaaaaaggtgaaaggtggctccattacttttgctcaacttgctacagagtggcttctgcaatctagtgctattcttcagaatgtttttttgcatgatgcatttgttactgcactaaggaaagctgagcaatttctttgggctggttctgagatggattctgttcgagacatggtaaagaatttgattgaagctcagaagtgggcagaagggataagagactgcataacaaaaattgagttatggttgtgtcatcgggattctaatgtcaagaaagttcatttagaattcattgatgagttactgaaatttactcctgcgccatgcaatgaacctctttatcataaattgaaggactatgcagaggaagctaggttgttaattcaggatattgatactgctttgtcaatgagttcaaatatgtctgagttggaacttttatactccaaagcttgtggcctacccatctacatgaaagaaagtaagaaattggaagggaagatttcttcaaccaaggcatggctggataacgtcagaaagtgcatctcagcaagacagcctgctgcactacacattgatgctctttacaagctaaaagcagaggtatttgtggatcttcaagttcaactcccggagatagacatgcttctgaatctattaagtcaagtggaatcttgtagtgctcaatgtcatgatatgctagaaggtcatatgaatctcaagaatgttggtttgctgcttaaggaatggggcagtttcgcagttgatgtaccagagctcaagcttctaaggcaataccattcagatgctgtttcatgggtttctcactttaatgatattttagggagagttcagatgcaggaaaatcaacataatgcagttgatggattgaagagcatttttgaagaaggtttatctttgaaaattcaagttgatgagttgccattagttgaggttgagctgaagaaggctaattgccgggaaaaagctgtgaaggcacatgatttgaagatgcctttggaattcattcagcaactgttgaaggagtccactgtgcttcacattgagggagagaaacaatttgtcaacttaactggtgtgcttgctgttgccattccttgggaagaaagggctagagagatgctttcacatgaggctcctatttcggactttgaggacatgatcagagcttcagaaaacatatttgttattcttccttcacttaatgacatcaaggatgctttatcagaagctaattcctggttaaggaattcaaagccatatttagtctcttctatgtgtgcttcaaattctgtgcggaaagttgaggacttggagatgttggtttctcaatcgaagcatcttaaagtatctttggaagaaagaggaacgcttgaattagttttgaagaattgcagaatatgggagtatgaagcatgttctgtactagatgatgctcggtgcttattggataattctttgcctgaaataaacagtggtttaacttgtaaagtggaagatttgattgaaagaatccaatctgctatagcatccggtgtatcacttggttttgacttcaatgagatttcaaaactccaagcatcttgttctacactgcaatggtgcaaaagagccttgtctttctgcaactgctctccttctttagaggacgttttggaggttgcagaaggtctttctcattcctctgtttctggtgctctgttgaaagtattgattgatgggtttgaatggcttaagaaagcattagaggggatttctggacctcacaattgtagaagatgcaagttgactgacatacaagatattcttactgattatcagactattaatatgacctttacagcagtaaaatgtcaacttgaagatgccattggaaaacataagttgtggcaggagcaagtgcaacatttttttggtctaagccctagagaacgttctttgtcttccatattgcagctcaagtatccaggagtatcaaagcttattcgttcatctgttgcgatgattatgattgaaaaagtgaaagctttcacaattgttgtgaagcctttaccaagaccagaggttgtgaaatgcttgaatgccttaacccactcagctggtctatatttatatagccttagggagtaa

SEQ ID NO: 80993 - DNA, 1602 bp, Glycine max
  Peptide Sequence Number=SeqID_172678
atggtgaatcgtcgacgcctcacccgggtggcgacgagcgacgatgaagacgaggcaccgcgtccacaacgcacgcggaagaggatgaggcttatcgaggaagataacgatgatgacgagaatgaagaagagaaacaacaagaggtgccggaactgcctcagcctgcggaggacgctaagcctcttggcgaacccgttagggtttcgggaaaaggaagaggaaggaagaggcactatgattccttcgagttcgatggcatccaatatattctcgaggatcctgttcttcttgtacccgaggagaaaggccagaagccatatgttgcaattattaaggacattacgcagtctatcagtggcaacgtgaaagtgacggggcagtggttttatcgtcccgaagaagccgagaaaaaaggtggtggaaactggcaatcgtgtgataccagggaactgttttatagtttccaccgtgacgatgttcctgcggaggctgttatgcacaagtgtgtggtacattttgttcccagacacaaacagcttccaaagcgtaaggatcacccggggtttattgtacagaaggtgtatgacactgtggaaagaaagctctggaggctgagtgataaggattatgaggatattaagcagcaagagattgatgtgcttgttgagaagactctgcaacgtattggtgaactacttgaccttgagcctgaggaagcccctgatgacgatgaggatcaattgaaaaatagaaaaagcttaaggagaaagagtgtttcacctcttgatgtttcaaaggaggaagaagaaactcttaagagtgaacaacatccaaagtctgaaacaccagcgggttgcataactaatccctcagagtattatcggatattggtagaattcaatgcactaactggagatagccatcgagacaaatggttggagaggttgcttcaacgcattcattacatgtgtgattctaatgatagcaaagaaagggacaaaggattaggaaatgtcaattctgatgaaatcaacggtggaagcaagcatagaagttcagagtcagcaaatgtctgtcaagataaggttcagaagagttccaagtcttttatttggccagatgctggtgtttcagccatggttgctctcgaaaaagcttctcatgatgctctctcatcagattctatgaagtacaaccaaaagttgcgccaattagcttttaatttccagaaaaatgcagtgttagcacgccgtctattaagtggagagttggagccttcaaaaatattaaatatgacacccaatgaattaaaggaatcgagtctacttactaaaggcataggggtggagggtttggttgctgaggaaaaaaccaaggaggagcctgacaagatccagcacttgcaaatgacagatgctcgctgctcaaaatgcatggattgtaaggtggccttgagagagattatccaagctggaaataatgaacgttatcagctggaatgtgtttcctgtggtcattcctggtatgcctcccgggatgaggtgtctatgctgaccatagatgcatcagattctaagggaaacataggcacagcgctatag

SEQ ID NO: 80994 - DNA, 504 bp, Glycine max
  Peptide Sequence Number=SeqID_172679
atggggtggttacagcatcataggttttggagacatccttttaccaggaatgctggtggcattctcactcaggttttatttcctccctcctttctaccccttatcccttgcatgacttatgtcaacccaaaacttgatttgaatgacaaggtccaaattttatggattggaatgttgcttcagcctgtttatcaggaattttgctttcacaattataaccagagaaggtacgattggctggcaaacaagagccttagaagtggatatttcttgtgggcaatgtttgcatatggctttggtcttttagttacgtacgtggcactaaacttgatggacgggcatggccaaccagcactactatacatcgttccatttacccttgggaccctgatgacattggggcggaagcgaggagatttgagggttttgtggactagtggagaacctgaaagaccctgtccacatataagactcctacacagtggagaactaaactgtgaatga

SEQ ID NO: 80995 - DNA, 282 bp, Glycine max
  Peptide Sequence Number=SeqID_172680
atgaaactggccaaatacaggctaaaggcccaagtggagaaggacgaaggcccaagtggagaaggacaaagcccccaagtggagaaggatgaagagtttctctctgggttccttgttgaaccaattatcagacttatcaaggtaatccttgtggcgtctacccagacttatcttccttcattggaagtggcgtctaacctgacttatcttccttcatcggaagtggcgtctatcctgacttatcttccttcaccggaagtggcgtcatccaaaccttcgtag

SEQ ID NO: 80996 - DNA, 531 bp, Glycine max
  Peptide Sequence Number=SeqID_172681
atggcctcacaacaacacatcgagaagatgcagctccgccagaacttccgcaatctctggcactctgatcttttgagtacaattcaagctgacaccccttattgttgcttttctctgtggtgtgcaccgtgtgtatcatatctgctccgcaaacgagctctttacgatgatatgtcaagatacacatgttgtgctggttacatgccctgcagtggtcggtgtggagaaagtaaatgtcctgaactctgccttggtgcggaggctttcatgtttgtccttcaacaacttgcctgcatattttctattattgctttaattgtgggaaatagtgaaattcgacaggcttctcaattgctatcttgtttggctgactttgtctactgcacggtgtgtgcttgcatgcagactcagcataagattgaaatggacaaacgcgatgggaaatttggaccccaatcagtaatgggtgttccccctgttcaacaaatgtcacgctttgatcaggcagtccccccttttgttgggtattga

SEQ ID NO: 80997 - DNA, 408 bp, Glycine max
  Peptide Sequence Number=SeqID_172682
atgtcttggcggcatcagacagcaatgtcagaggagattagtaatagggactttggaggtggtgatgcgtggtggctggtggccaaacgcaatgccacattcttacatattgttgaaaaagaatcaagaatattgtcaccatctagtcaactctcattgataattatcctattcccaaatgggcaagaggtgatattaatgtcttcaccggtttttctcgcaagtgaagtaacttctccccatcaatctttttctacctcaaatttaacgctacttgcaattctgaaacatgctttaaacgcatacgcggaaataaggctaagtgatggacccctccagcaagctagcgtttattattggttaatggatctcatatgcgtctacatgctcctctctactctcaaatag

SEQ ID NO: 80998 - DNA, 1353 bp, Glycine max
  Peptide Sequence Number=SeqID_172683
atgaaagagagaaagacaggcataaacacggtgagaaagagggttggatggtggttaggagaaccaagtatcttgaggatttttgcaagacgggacaaagtgaaggaaatcattattgctccaagatggaacaagagtgggatgagatatggttttgtgaaatttatagaggtagaggactctaaaaggttggagcgacaagttgataatattttcatcgggtctttgaaactgtatgtcaatctcccaaggttccaaaggtcaagaggatttgaagaacagagggaggttcagggtcaaagaaatcactatgaggagggagcaagtcaaaggaacaagagtactcaaggatatgaatataggtatccctattcatacgctcaaatagtgagcaaaaagggtcctggtggtgtaagatggataaaaatacaaggcaaggaaagagatgatgggcggagtagtcaagacttaaaggttcatgatatcaatctggttcagaatattcacgagttgtttatcactaaagggtttcaatcagttaaactgagacacatgggggataatttcatgcttcttacaccattggatggtctggagatgaaggaaattgtcaagggccctgaggattggttgaaagaagttgttgaggaaataaaagctcaagacgtgtgccatagttgctgtggtgttacgaggtttatggaaaatggcaatggctcatatattaggagtctcgacttggagtttacttccagtgtatcaaagtgttcatctgatgctggtaggtggttagatgcggacaaggtggtccgagatgttgttccggtatcggcgatgagggaatccaatcttcaacacgtagggggtgtagtagacacagtctcacaccaaactggctgtgaaggtacaaaaggagaccaacatagcggaaagggcaatgatgaccatgatatatatcgtgtgatggagaatggagttgtacatcttaaccttgtagacacgcaacatcaacaggtagaagacacagtgcatcatgagaaccctaagggtatagatgacatgtcaaaagtgttattgcccaacattgagccttgtatggtgaatgaaagtgttgagaagggaactccattaaaagctcgagatggagcgagtatggtagtgaaatattgtgaaaattatggtaccagaggaggagttagactctgtgacagagagattgagttatttaacttgagaaataactgtgcaagacaggttattgaagctacttttgaagctaacgtagtgggggttaccaacatggagaaagatgtagatatgcaaggcaaatcaaacttggctgcttggagatag

SEQ ID NO: 80999 - DNA, 380 bp, Glycine max
  Peptide Sequence Number=SeqID_172684
ttggaacctcttacgtgccgatcaacgtctcattttcgccaaaagttggcccagggcttcccggtatcaacagggacaccaggatttatttattctgcgaagtgatcttccgtcaccagtggcttctgtttctatcagctgtccctcctgttcagctactgacggggtggtgcgtaacggcaaaagcaccgccggacatcagcgctggcaaggcgcgtcccattcgccattcaggctgcgcaactgttgggaagggcgatcggtgcgggcctcttcgctattacgcgagctggggagggggtggtcctggcggaaggcctggcttcggtcgtggttccggtggttatggggcaccgactagttcaaacattccttcttaa

SEQ ID NO: 81000 - DNA, 450 bp, Glycine max
  Peptide Sequence Number=SeqID_172685
atgaacaacagtttgccggcgttgacatcggatacgtcgccgtcagtggtgaacttgttcagaatcaacaaagttgcggaccgtttgtcttggattgctcaacctggcaaccgaggcgagccttacgaattttacaacctctgcctctccctctctcgaggcattgattatgcacttgccaatggcgaaactccacccaaggctcatgaactgccactacttgtgaaacagatatgtcaactaaaaaatgatgaatgttcgcaagcggctatgatggtattgatgatatctataaagaatgcttgtgaaattggatggttccaaacaaaagaatctgaagaacttgttactattgctgatgagatcagaaaggtctacagcagtttggggactattaatgttggacctagatcttgcagtactgcaatatcaacaataatgcagaagtag

SEQ ID NO: 81001 - DNA, 2025 bp, Glycine max
  Peptide Sequence Number=SeqID_172686
atgtttttattggtggcacaaacagataacattgagacatcagcatgcctcataaatcctcagcaagtgaattttctcctcaatggaaaaggagtactcaataggactaatgttcaaatggatcctggaccacaggtgccaactaatgtgactggtatgcttaaatttgggacaaatcttcttcaagctgtgggccagttcaatggtcgttatgttgtacttgttgcctatatgagttttacaccttttcttgaggatccagttcttcaagattatcttcagcctgctgttacatctgttgattcagattcagatattattgagggggcttcacagatttcacttaattgtccaataagctttacacgtatcaagactcctgttaaagggcattcatgcaaacatttccaggtgactattcctgcattagcatcacttaatgtgcagcaaattgtcactgcaacttatgccgttctctctctggtcctgaaaaatgttggtgagaacattacggaagtgattgttcttgctaatggatcatggaaggcagtcttggaaaaggatcatgatgtggataagatgcagaagaaggcacgcaattgtgaaaaggaacaaactcaaccacaagaatctacttgccctcctggtactgttgacctcaccaaagatgatgatggtttggatacagtgggctcttgtgatattgtagaaagaaaacctaccccggcatctattcatagtcagtttgtcaccccaaattcaacttccttgggtatgaactctactggtgttaatcaaaatgttgccactcaaatagatgacttttggcctggagtttgttttgtccgtagtaggtctgataccccaacagttggtaattctgagctacctgttctgcctgatactgtttctcctacatttagtcaggaatctgctggtcatgacaataaccctgttgttaactctgccatgcataatcaatttttgggaccaaacaacttgcagatgcagatgaatcatatgaattcagttaacgagtatggcagatcatcctcagcaccaagacatattcataggactccggtagctgttcaggccctcccagtccaatctcaggcattgggaccacagcaaaattcaataactaatttgaatagttccttgctacctagcaattcctctgctactcctcatatttctttgtccaaccctacctctgtagatactttgaatgccatactaagtgatacggaaagacaacaacatttttctcgaaccccaatgaatctgcctcaggtctcaggtgtaaattcacctgcatttcagcatcacactgcaacacagaatcggggaccacttataaatacgtcagcaccaactcaaccgcagaaccaatacagagcaaatgcgttttctgaatttagaaatttgcatctgcagcaagctctgaatctccggccacccccaccaagatcatctaatgcccaatggccccgcatccagcaaggtgttccgcaatctgggaattttcaggcggcagccaggggtgcttcagtggctgctggacaaggtagttcccatgctaggaatgttccaacatctggagctactactcatagccatcaagctagaggtatggttgctaaccagcctgccaggccatctgttttggttcaaaatcaaagtaccgtagcaggcacccctttccacgggttaacaacagagcaaagaggaaatacagcacagtcagtttctaggcctgaagaattattcagttcgcaatcagaacagaattgggctcccactggacgaatgcgtggaagtctagatttaagtcagcttaacgatgagtctattgcacagcgaataattacgccaacacaaggtcaaaattcaaggccaccaggtccacaacccattcgacggaccggtatttcctctttgcaacccgccacgacccaacaggatgtgcttattgcaaacaatagaaatgcaaatgctcataatcgttcttccagtagataa

SEQ ID NO: 81002 - DNA, 2001 bp, Glycine max
  Peptide Sequence Number=SeqID_172687
atgaaaagcgaggaaggtgaagcggaaaaggtggaaaaattgggagaaaagttaaggcgaggggtattggtagggaaaagtaggggcccctgtactccaactcacactcacaactaccatagcagcagcgttctttctgtttctgctagaaagctcgccgcggccctctgggaattcaaccactctttcccactctttcaaatgcatcatcatcgttctgctaacaacgcttccgctgctgctgccggcggagctggcgctgatcccagacttcgccgccaccaccattacatccttcataaggacagggctccggacatctccaactttttggctgatgcttctcccagttcccccgatcagcctgctagtgcaagcagtttgaggaggcatgttgcagcatctctaatgcagcatcatcgggcaattgagagaaataatcatgcactacaacctttatctccagcaagttacggtagttccatggagatgacaccctataatcctggagccactcctactagttccttggaatttaagggaaggattggggatccgcactatagtctcaaaacatctacggaactgctaaaagtgctaaatagaatatggagcttggaagaacaacatgcttctaacatttcattgataaaagcattaaaatcagaactagatcatgcacgcgttcggatcaaagagttgcttcgagaccgacaagcagatcgccatgagattgatgacctgatgaagcaaattgcagaggataaattggttcggaagagtaaggagcaggatcgactccatgctgccgttcaatcagttagggatgaacttgaggatgagaggaaattaagaaaacgatcagagagcatacacaggaaactagctcgggatctttctgaggtgaagtcatctctgactagcgctgtaaaagaattgaatcaagagagaacaagaagaaaactattggaggacctatgtgatgaatttgccaggggaataaatgaatacgaacgggaggtgcatactgtcaaacacaagtctgataaggattgggttcaaggggctgatcaggatcgtttgatcctccacatatctgaatcgtggctggatgaacgaatgcaaatgcagctggaagcaggtcagaatggttttacggacaaatccatagtcgataaactaagtcttgaaatagagactttccttaaagctaaacaaaatagtaggggttcagaaaatgttgcagtaaggaatcgccgtaattccttggaatctgtaccattgaatgatcgtgtcagtgcaccacaagaggttggtgatgacgatgattctgtgggcagtgattcaaattgttttgagttgaataagccaagcaacaagggatctaaggtatatgaagaagagcctgtcgacaaaatttttaaggagacatcgaaaaccaaccaaagaaagaaaaaatcaataccacgagaagggttaaaacatcgtagcccatctagcctgcaagtgaagtttgaagaacagatggcttgggccatgtcatctgattcaaataagaagtcccagtcaattgatgcagatcaggggaagatcacagatactaggccagttgaaggaactgtatctgaaaggtctgaacactttgagatttacgaaaatgatgattctgaaagaaaaaataaccccgctgaattgcacaactccagtaaaaatcacattatcgataatctcataagaggtcagcttttggcatccgaaggtggcaatatgcacgctgaaaataattacggtgaggcttcttgcagcaatgctggatggagaaatcaggcaagccctgtgaagcagtggatggcaaaacttgcatcccaagaccttgacatatccgaggcttccaaagtgccttcagggtcaaaggagagtaatactttgaaagcaaagcttcttgaagctaggtccaaggggcagagatcgtgtttaaaagccttgaaaggttccttttag

SEQ ID NO: 81003 - DNA, 897 bp, Glycine max
  Peptide Sequence Number=SeqID_172688
atgactgcgccaccatccaagtacactcaccactccaaactactcattccctccgaagaagaccctcccaaacacccctatcccagactcgtcagaataaccgtcacagacaccgaggccacagactcctccagcgacgaagaacagcatacttccacgcgccaccgacacagaaagttcgtcaacgagatttctatcgagtcgtcgtgcgccagcgagaacgacggcgccgcttcgaggaagagaattcgaagaagaagcaccgctacgcccaaaggcagagcttcagacactcggctcgtgtccaacggcaagaaattccgcggagtgagacagcggccttggggaaaatgggcggcggagatacgagacccgtctcgacgcgttcgtttatggttgggtacctacgacactgctgaggaagctgctttggtgtacgacaacgcggccattaggctgcgtggaccccacgcgctcaccaatttcataacaccgcctgccacgtgtcacaacacagaccctccgccggtggcgaacggttacggttacgcttccggtgaggaaactaatgacaacaacaataacctgttttctcccacttccgtgcttcacagttgttccttgtccgaggaagctgagtccgtaaggggaaaagacgatgagtactcctccgtgtcgatgagtagggtcaaggctgagtcaccatttccggttccgagcgaaatagaatttgactttcgaggtatttcgccggtgcctgagagtgtgttgttctacgatgatgattggtctagtgagtttctcactgcttgtgaggattttggtttcaacagaaatcgtgactttttccaagatatcgacgatttgtttgtttcggatcccctccttgctctctga

SEQ ID NO: 81004 - DNA, 3525 bp, Glycine max
  Peptide Sequence Number=SeqID_172689
atggatgaagactttgttgatgaggcaacccaattagaagttgccgaggaatcacagcgccaaaacaaagattcaccccacccggaatgccgaaaaatcttaaaatccctagaagccttcatccctgttaagcaggactactcccagataccacctcgggaatatgatggcattctacatggtaaaaatgtagttgaaggtattgatcatgcagatacatcacagcatcctcatgtaagcctttttatggatgatgctgatgttatggttgaagagttaacagtaaaaagttacaatggctcaagtttggatattggtacatcaaacaaccgagagcagatatataatcggcagaaccattggcaaaatctttatcagctagcaagtaattcaggaattggaaattcactaagtgatattggaaccagaaacagtgtcccagctacatctagtgctcgggaggatattggatcctcatctttccctgagatgttagctagaaaatctctcagtgatggccagagcaatgtcatggaacacttggcatctgctgaaaataaagagggtgcaggtgatgttcgtcaaggaacacggaaaaaaattatatcccaatcaggatttgctgagtttttcataaaaaatacactgaggggtaagggtattgtatataaaggtccatcttctgatggcttctgtgttcagtccagagagcaaaactggatgaagattggcattgatgcagatcagaataggatgaaaactggcattggtgcggatcagaatcggctgaagactgtcattgatgcggatcagaatcagctaaagactggcattgatgcggatcagaatcggctaaagactggcattgatgcagaccagaatcagatgaaggctagcattggcacagatcagaatcagatgaagaatcacagtggtactgatcagaaacagatgaagactggcattgttactcacttgaactctaatcaatcagtgggctatggttccaaaactgcaaagtttccttcttattgtggtgctatgcctagatctggcaggtctgattgtgttggtgtgactttgagagaatggttgaaacacgggcaccacaaagcaagcaaggtggaaagtttgaatatatttagaaagattgtggatttggtggacatttgtcactctcagggagttgcattgcataacctgtgtccatcttatattaaattgtcgccatcaaaccagatcatgtaccttggtttacctgttcaaaaacagatggtggatagtgttgtaaattctgaagttgttcacttagataattcttttattagaaaaaggctgtcagagcaagtaacatttccctcccttgatatggggtcaaagaaaaaaaaatttaatgagaatgtgagagttactggtggtgacttgtgcctcgaaactgcaagtgataggaaacttcatagtcatacagttggatcacaagattattacaatgaatatgaggaaggtacccaattttctaaatataacattggaagaatgtctagcatccctcgcgtatctaatgcaggtcaaatgccattgacttcatgtgaaaaatttgaaaataaatggtacacaagtcctgagggaggttacacaacatcatcaaatatctattgtcttggtgttctcctttttgagttacttggtcattttgactctgaaagaacacatattgcagccatgtctgatcttcgtcataggattcttcctccaattttcctatcagaaaatcctaaggaagctggcttttgtctttggttgttgcatcctgaaccatcatcacgcccatcaacaagggtcaaggggaataaatgggccaacctcttgatcagtttagtcacaggaaacacatttggaaaatttattccaggaggaagagggacatgtattgagaaggtacagggctgggaaatccttcaatctgaattgattaatggattgcaagagttgtttagtgaggaattgtcatcaagtattgaccaagaagatgcagaatctgaattgttattgcatttcctcgttttgttaaaagagcagaagcagaacaatgccttcaaactggtagaagaaatcaagtgcttggaatcagatatagaagaggtggagaggaggcatgactcaagaaaatccttggtttcctcaggcttgcagaatgattactcttgtcagaaagagattatgcctcttaaaaaggaatctttgagtttggaaatgctgccctcgatatccccaatctctaattcaaataaagtgagattgatgagaagtatatgccatcttgaaggtgcttatttttccacgagatccaaacttcagctttctgaaacagatgcttcaactcaccctgataaagatatactaagaaatcgtgagaaccagaatgtggcccaaaaaagcgaggaacaacctaagaaagatactttaggggtattctttgatggtttgtgcaagtatgcacgttattgcaagtttgaagtgcggggtgtactaagaaatgttgattttaacaatcctgcaaatgtaatttgctctctaagctttgaccgggatgcagattactttgcttctgctgggatatctaggaaaataaaaattttcgagtttagtgcactttgcaatgactctgttgatatccattatcctgcggttgagatgtcaaacagatcaaaactcagctgtgtttgctggaataactatattaagaactatctcgcttctacagattatgacggtatagtgaagttatgggatgctagtacaggtcaagaattttctcaattcactgaacatgagaagagggcttggtctgttgacttctctgcagtatgccctacaaaatttgccagtggaagtgatgattgtactgtcaagctgtggagcatcagtgagagaaactgtttaggcacaatcaggaatgctgctaatgtctgctgtgttcagttctctgctcattcctcccatttgctggcctttggatctgcggattactcaacatattgttatgatcttcgcaatcttagaagtccctggtgtgtactggctggccatcgtaaagctgtgagctatgtcaaattcttggactctgaaacacttgtttctgcttctactgataatacattgaagatctgggatctcaataaaacctctcctgtgggtgcatccattaatgcttgcagcctaactctgtcgggacatactaatgagaagaattttgtgggtctatcggtggctgatggatatattgcatgtggttcagaaacaaatgaggtttacacctactatagatcgcttcccatgccagtcacttcacacaaatttgggtccattgatcccatttctggtaaagacactgatgatgacaatgatggtttaaagaaaaggttccatgtgacggcgactttcttacatttgcgagttcctggagttttgcgcttgtcactcaagcactctggccaatcccatcaacctgctgggagcatataa

SEQ ID NO: 81005 - DNA, 834 bp, Glycine max
  Peptide Sequence Number=SeqID_172690
atggctagtgccgggaatatattgttcagaaaagaggcagatggccacactttgctcattcccattgaccatggctactgtctactagagaaagtaagcagtcctcgttcttttccttgcaatttaatttcccctgcattaccatgtgcttctgcttgtgcctctgacactcggagtatagtggatgtaaaagaaaacttagcgtcaacgcgtcaacattactcccctgatacagttgattatatcaaatctctggatgccgagaaagacatagagcttctgaaatattacaagtgggatgtcccgattgagtgtgcacaaacactctgcatctctacaatgctattgaagaaagaggttgagagaggtctcactccttttgacattggaagcattatgggtttgtgggagggactgagggttaatacagaagttggattagtttggcaatctatgaatttgaatgttgatcctgacttcctcttgaataatgcagttcattggctcaagaagaatttgctaaatacggatggtagtccccttggcaatcttggtccttcgggttttggaggtgtcattcgtaatgggcagtggttttttagttttttttggttctgtgaggtttttgccatttacaatggtttgaaactagcctatgacagaggtattcataacttagtctgtgaatctgattcaaagattgttttgcacttaattaaggagaataagaatcccttccaaccttacaatgctttcattcataagattcaacagtacatagtcgagccttggcatctcagcttcaagagagaaaccattgcgcggtttggttag

SEQ ID NO: 81006 - DNA, 1650 bp, Glycine max
  Peptide Sequence Number=SeqID_172691
atggcacagaagagattcatcatcgaggtcgagaaggcgaaggaggcgagcgaaggaaggccttcgagaggacctgtctatcgtagcctcttcgccaaggatggattccctgctcctatccaaggtctcaatagttgctgggacgtttttcgattgtctgttgagaaatatccatcaaatccaatgcttggtcgccgggaaattgtggatgggaagccgggcaagtacaagtggctaacatacaaagaagtatatgaccaggtgatgaaagttgggaattctatccgcagctgtggttatggagaaggtgtaaaatgtggtatttacggtgctaattctgcagaatggattatgagcatgcagggtcaaaatcagagttttgatcttcctattaagaaaaggagtgacatctgtacaataatgtatactagtggaactactggtgaccccaagggagtgttgatatcaaatgagagtattattactctcttagctggggttaagcgactgttggagagtgtaaatgaacaattgactgagaaggatgtatacatatcataccttccacttgcacatatatttgatagggtcattgaggagacattcatatggcatggtgcttcaataggtttctggcgtggggatgtcaaattgttaattgaagatgttggcgaactaaaaccaactattttctgtgctgttccccgtgtgcttgatagagttaagcttaataacatgaagaaagggcttagacatggagaagcatctccacttcttgataaaattgtgtttgacaaggtaaagcaaggtttagggggtagagtacgtcttattttgtctggagcagcacctttatctgcacatgtggaaggttacttacgggtggtgacttgtgctcatgtcctacagggatatggtctgactgaaacctgtgcgggaacctttgtctcattaccaaatgaaatagaaatgcttggaacagtgggccctcctgtaccaaatgtggatgtttgcctggaatctgttcctgaaatgggatacgatgccctagcaagtacaccaagaggagaaatttgtgtaaagggaaaaaccttgtttgcagggtactacaaacgtgaagacctcactaaagaggttctgattgatgaatggttccatacaggggatattggagagtggcaacctaatggaagcatgaaaattattgatcggaagaagaatatatttaagctttcacaaggagaatatgttgctgtcgaaaacctggagaatatttacggtcaagtttcttctattgaatctatatgggtttatggaaacagttttgaggccttccttgtggctgttgttaaccccagtaagcaagcacttgaacattgggcccaagaaaatggtatatccatggacttcaattctctctgtgaagatgctcgagcaaaaagttacataattgaagagctctcaaagattgcgaaggaaaagaagttgaaaggttttgagtttataaaagcagttcaccttgactcaattccatttgacatggaacgtgaccttatcactccaacatacaagaagaagaggccacagttgcttaaatactatcaggtacaagttgtcaaattctctggattgcatttcacttcatattga

SEQ ID NO: 81007 - DNA, 1389 bp, Glycine max
  Peptide Sequence Number=SeqID_172692
atgggtttcgctttggcattcacagcttcttctacttgctgctcaaatctacaatctcagtctctgttattcgctgctgctgcattgagatcaaaaccgtgtctctctctctgcaacacttatcgacccaaacgcattcggaagcgttctccaattgttggcgctcaatctgaaaacggagctctcgttacttccgagaagcctggcactaattacggaagacaatacttccccctcgctgctgttgtaggccaagatgctataaaaactgctcttttacttggggccattgaccctgggattggaggaattgccatatcaggaaagcgaggaactgccaaaactgtaatggcacgtggactgcatgcaatactgcctcctattgaagtagtagtaggttccatagccaatgcggatccgacctgcccagaagagtgggaagatggtcttacagaatgcctggaatatgattctgctggaaatattaaaactcgtattatcaagtctccctttgttcagattcctcttggaatcacggaggacagactcattggatcggttgatgttgaggagtctgtgaaaacaggcacaactgttttccagccaggcttgcttgcagaagctcatagaggtgttttatatgttgatgaaattaatcttttggatgagggtatcagtaatttgctccttaatgtattgagtgaaggagtaaatactgttgaaagagaggggatcagtttcaagcacccttgcaggccccttctcattgccacctataacccagaagagggtgctgttcgtgaacatctgctggaccgcattgcgattaatttaagtgcagatcttccaatgagttttgaaaaccgtgttgcagctgttggaattgccacagagtttcaggagaacagtagccaagtatttgagatggtcgaagaggaaacagacaatgcaaaaactcagatcatcttggccagagagtatctaaaagatgttactctgaacagagatcaattaaaatacctggttattgaagctttacggggtggttgccagggacatagagctgagctatttgctgcccgtgttgcaaagtgcttagctgctctggagggacgggaaaaggtagaattggtcattctaccccggtcaatcattactgagagcccaccagatcaacaaaatcagcctcccccccctccacctcctccacaaaatcaagaatcaggcgaagaacagaatgaagaggaagaacaagaggctcaacctaaattgaagatggtatcaccacctatcctagatctaatattgggttgccctcaactgtccaaaaaatctacctggtgcggttttcctagtgcaatcctagatccacgacttttagtgcaataa

SEQ ID NO: 81008 - DNA, 3333 bp, Glycine max
  Peptide Sequence Number=SeqID_172693
atggaaaaaagcaagagtctgaatttggcaaatctagtgcaacactgcatcactaacaaagctcatttatccggcaaggttgttcacgctcgactcttccgtctcgcccttttctccgacacctttctctccaaccacttcatcgaactctattccaaatgcgaccacattgcctctgcctgccacgtgttcgacaacattcctcacaaaaacatcttttcctggaacgccattttggccgcttattgcaaagcccgcaatttgcaatacgcgtgccgtctcttcctgcaaatgcctcagaggaacaccgtctcactaaacaccttgatcagcaccatggtacgatgtggttatgaacgccaggcattggatacctacgattcagtgatgctcgatggagttataccctctcatataacattcgctaccgtttttagtgcttgtggttctttgttggatgcagactgtggcaggagaactcatggggttgtgatcaaggttggtcttgaaagtaatatatatgtcgttaatgctcttttgtgcatgtatgctaagtgcgggcttaatgcagatgcgcttcgtgtttttagggacattcctgagcctaatgaggttacttttactaccatgatgggtggattagcacagactaatcaaatcaaggaagctgctgaattgtttcgactcatgttgagaaaagggattcgtgttgattctgtgtcattgtccagcatgttgggtgtctgtgctaaaggggaaagggatgttggtccctgtcatgggatctcaactaatgcacaaggaaaacaaatgcacacactatcagttaaactgggatttgagagagacctccatctctgcaactcgttgcttgatatgtatgcgaaaatcggtgacatggatagtgctgagaaggtttttgttaatttgaatcggcacagtgttgtttcttggaatataatgatagctgggtatgggaacagatgtaacagtgagaaagctgcagagtatcttcagagaatgcagtctgatggatatgaaccagatgatgttacttatattaacatgctgacagcgtgtgtcaagtccggggatgttagaaccgggcgtcaaatatttgactgcatgccatgccctagtttgacttcgtggaatgctatactctctggctataatcagaatgcggatcatagagaggcagtagaactgtttagaaaaatgcagtttcagtgccaacatcctgatcggactactttggccgttattctcagttcatgtgctgagttgggatttcttgaggctggaaaagaggttcatgcagcatctcaaaaatttggattctatgatgatgtctatgttgccagcagccttattaatgtgtactcgaaatgtgggaaaatggagttgtctaagcatgtgttcagtaaactgcctgaactagatgttgtgtgttggaactcaatgttagcagggttctcaatcaattctcttggacaagatgccttgtctttcttcaaaaagatgcgacaacttggcttcttcccttctgagttttcttttgctaccgtagtgagctcttgtgcaaaactttcttccttatttcaaggtcaacagtttcatgctcagatcgtaaaagatggttttctagatgacatatttgtggggagttctcttatagaaatgtattgtaaatgtggggatgtaaacggggcaagatgtttctttgacgtgatgcctggtagaaatactgttacgtggaatgaaatgatacatggttatgcacagaatggagatggccacaatgctctgtgcctttataatgacatgatttcatctggtgagaaacctgatgatattacttatgttgctgttttaactgcttgtagccactcggctttggtagatgaaggacttgaaatattcaatgccatgctgcaaaaatatggagtggtgccaaaggtggctcattatacttgcatcatagattgtctgagccgagcagggagattcaatgaagtggaagtcattctggatgccatgccatgtaaagatgatgcagttgtatgggaagttgtgctaagctcatgccgtattcatgctaacttgagcttagcaaaaagagcagctgaggaactctatcgactggacccacagaattcagcctcttatgtgcttcttgccaacatgtattcttctttgggaaagtgggatgatgcacatgttgtaagagatctcatgagtcataatcaggtccgtaaggatcctggtctcattattatgttaaaccacttctgcagagacctagataatttctgcaaaaggactctagttatggatgctgagcatcaattattcgcgacttgcttctttttcttccgcgaggtggctgttcttcttccgcgagttgcgtcttcgttccctgtgagtggctctctttcttccattcttctgcgagcttccgttgtttcgttcttcattgagactaggaggtatgcatggggagctgctggcctcgtgcatatgtacgatcaccgtaatgatgctagtatcagcaccagccgacaagttgctattgcggagtgtaacgctgatccgaactacgacgagatgtcaccacgtgcgtgtcggtggattgccacgaagaagactgtgaagaagatatctacagcgacgtacaggcagcctggatcgtctcaggatttcagatgtttgctggatgccatatggggagcactgaccggacagctccattgggggcctgttgctatcagatacagaccggagagggttatgcgtcagttcggatacgtccagagtattcttgcacaccctgtcgattcatgggtgtcatttgatgacgtagacgataggtggacgcactactcagaccatcttgcaccagcaggtgacatatgtgttgtgtcaggtcaatgtgtgcccgactacatcgatcggttcttcattatatcacatccattcatgactgcgccacagacatcagatcctcctcgagatgcatttgcgacacaacccagacatatccctcaggtgccagagtcacatgtccctcaggagtcagtagcagcatcgacacatgccgattttgatgccgacaagcccagacatgcagtgataagtgttactatttggttagatgaggtttgtcatgccatcgccgagacgttggagcatcatctcagcctaaatgaagtcacgccaggcacatcgacatatgaggtcatccaaaaatgcctcaggattgtcaggggtgttacagaagaccgcaatgtgtatgtgaggtctcaacacacgtggtgcacggatcaaccatag

SEQ ID NO: 81009 - DNA, 2433 bp, Glycine max
  Peptide Sequence Number=SeqID_172694
atggcatcagaagatatggccaacttgaaaattgaagatagcaaagaccaaagagatggtggatttgtgttcacatccaaacaagacaataataattcttcaggctcatcattccttcagcttggtgatgctcatgctcatgccattgataaattcaaattcggtgcaaggaaggaacaaagtggcaacaataaaagtagaccaaaactcaagttatctacccctccccagggatatcatgattttatttggaagccaaagaatgagtcatttggtttttttagtgtggatgccacatcaattgatcagtgttcgaataagaatgaatgtgaagttgtagacatagagaataaggaggaagcttcagattgtggtggaagcttcaagtctgccaatgatgaagtggacataacaaatgatggttcaagacatatgagtggctttacattttctgcttctcaagtgcaatcatctagctctagcctcaaacgccaccccaataagataaattgggtaaaagttggtcatgctcatcaaaatgatacttacaactccactcctaatccattatcattttctggaacttcctctcttttcacttcagggcaagccaatacaaggggatctgaggtgcaagggataaaggatgaatttgcttccatttctgctacaacccttgcggctgaggaagcctgtgaaaagtggagactcaaaggaaaccaagcctacaaaaatggaaatttgtctgtggctgaggattgctacacacaaggagttagttgtgcttctaaagttgaagcgtctcagagatgccgaagggccttgatgctgtgttatagcaaccgtgctgccacacgcatgtctcttggtaggatgagagatgcagtagaagattgtaggctggctgctgaaattgatccaaatttcctcagggtgcgacttagagctgcaaagcctcctatcctatgtcaaagagggttggctctaatgggtaaattgaaaggcattaacaagaagattatcaattatattcttcctacaggttgtctttcattggaaagttatcattgtttccttgctatgggggaagctgaggatgcgtcaaagtattccaagaggtgcttgcaatcaggaaccgatttttgtgtagataaaaaaattgttgtggaagcctccgatctcttgcaaaagacacagaaagtatcagaattaatcaatcattctgatgaactgttgcaaagaagaacggctgctgatgcagagagagcattggaacttataaatgaggcattggtgataagttcatactctgaaaaattgcttgaaatgaaagcggaggctctttttatgctatgtagatatgaggaagtgatccagctgtgtgatcaaaccgttggctctgccgagaagaattcctatccattggatgctgattgcgaagtgagagatctggatagttcacagctttcaaaaggcttatatttcaggctttggcggtgctcaatgatgcttaaatcctactttcacctaggaaagcttgaagagggtctttctttactggaggaacaagaggaaaaggtatctgccataaacatgagtggaagcaaggttttggaatcactaatgccactagctgtcactgtacgtgagctcttgcatcataagacagcagggaatgaagcgtttcaggcaggaaaacatgaggaagctgttgaacattatacagctgctttatcatgtaatgtggaatctctcttatttgcatctgtctgttttggtaatcgggcagctgcatataaagcattaggtcaaattactgatgccatagcagattgcaatctggctatagctcttgatggaagatacttaaaggcactttctaggcgtgcaacttcatatgagatgatcagagattatgaccaagcagcaagcgatataaggagagttgtctctcttctcattaatagaaatcagcatggcatatctgatagatcaatcagctatgccaatgatttgaaacataaccaaatttggctttccgaaatagaagaggaagccaaaaaggggatacctcttgatatgtacctcattttaggagttgaacattctgtttcgtcatctgaaatcaagaaggcctatcacaaagctgcacttagacatcatccagacaaggctggccaatctttggcaagaagtgacaatggagatgatcagatatggaaggatattgttgaagaaataagcaaagatgccgataggcttttcaaaataattggagaggcatatgcagtcctgtcggacactgccaagcgttcacagtatgattctgaagaagaaatgagaaattcccaaaagaaacgccatggaaacagcatcaatagaaataatgtcattgatcaaactgacaataggagacactggaaagaggtttga

SEQ ID NO: 81010 - DNA, 2952 bp, Glycine max
  Peptide Sequence Number=SeqID_172695
atggatccttttgatgatattctaccagtggctcctaccgcacgtagtaagtgccttgaccccaatgatactggaactcggccgggtgccaagtttattccaaaggccaaatcgaaacagcttcctcgaaaggaaataccggtgtcagaacatgccacctcatctaaggatggaattttggggaatgaatgtcaaaatgcagttgcttcagcggaagagtctaaggggttcattcatcatacacaggtagaaattccaaattcgggggattccacaaattctaaacaagctagtgtgaaaggagatactgcagccttggtggatgattccacaatcacagcatctgaagttgatgctaatcagaattctataaactttttaaaaccagcatgtgaggttactgagggagatccagtagactttgagggggtcaataatggcacaacacaaccagttcaccatgctaatgctgtagaaaatgaattgaataatgtggctgctccatctccaacttgctcaaccatagataggatgaaagaacaacctaaaaatggggaagattcatttcttgatagcaacaaatgtttggaacttattgacaattcaatcctagttggaatggatttgggcttcaaaagttcttcagatgataagattgcaataattcagagcaactttgatttaaagtcaaacttttgtaaaaaacaagagggagtatctgcagaatttgaattggatcctttcagcaacatcctccctaatcctgttgctaggaatgttcataaatttaaacccaagattaagccacgacctagagcaggcaatgtgccagcaattgcttctgattcatctaatgttaggatggaaaaatctgttgagttgcctacatcttgcacaaacaactttcaatcttttctgtcttgtggtgatggcagtggtggagtaaaccaatcaaccagtttacctttgccaacatcagaaattcttaggacaactgaattacccaagaagtttgatgatagtagctcaagtattccattttctgaagacaataagagcttggcagctgcaattccttcccagctggattccccaaatgtaatgctttcagaggatgcagttcataatggaactacagattggtcttctagttttcgtaaatcacccggagaggctgcggacattttttctgggctggaatcccttcatgactttatcacccaagctgccactggtacagcccttcattctttcaatgggaagagtggagaagaaaattttgtcacacctgcttctagttctattaactcttttggggaatgtgatattacccaagctcaaaggtgtcctgagtatcataccccccaagattcattaaccttcaatgaagccgcagtcctcaatgaggataatactcactctagcaataggaggtcggaaacagaggaaattgtggacttgaatcctgcctgcgcgggtgatgatgtgattgattatcaattcatgaaatctggcaaagatccaactggaattccagtgcatgaagagttgacaaatgctgcagatagtcccacattggctgattttttgcatgcagatgttacaagggaaaaagaagattctaataagagaaaaaatgatggttcaacatcatgttctctaaggaagaagagaagatttattgctggtgaggaggataaaggtgctaaaacctcaaggcagctgagaaaacaagcagctcataaacctgcaaacagttcattcaatgaggatgttgaagataataatgaccttgaccctccttataattctaatggagatgaacttcaagaaaatgatgacgactatgaagtcaattatccatccaggaagaaaagagtatcaaaaagttcacagaagaaatctatggctaaaagtggaaaaacatctcaaaagcctaagaaggcttatgaagatttagaaaaaactgaggaacctctcaaaaagttctctcattcaacccgacgaaaaaaaagatgcgtggacaaggctctactggaaattcctgaggatgaacttgatcgtttaagaatacctattaaagatattattttacttgaagaacatagggagcggctggcgtcatggaggttgatagatgtgatagtggtttttcttccaccagtccatgatgatgggaggaggttctggatgttgactaagtttggatatagggaaagttgggttaggttaaggagagggataaggggaattgttaagggcaaggtgggaaaaacagaaaagtctagtggtggagattctcttcatgaggctggtgcttataatgagggggcttataatgagggagcttatgatgatggagcttataatgacggggagttcttaggttcagaagatggtagagacccatatgatgatcaggccaatgaagggattgcgtcaacttctgttttactgaattaccagtctttcagggaaaagacacctagggggaaatggtcaaaacaagaaactgaactgttttatgaggctgttagggagatgggcacagatttttctatgatacaagagattttcttccctaataaatcacggcatcaaattaagttgaagtacaagaatgaagagcggcagcagcctttacagttaactgatgctgtaaataaccgtgcaaaagatcaccctcattctaagttgtttattgaacgactacaactagcttctgccaaggcagaagacccctgtagagatgcctcagatttcgtgatggcggaggaggttgtggacctaacagctggaactaatgaagaggttgcggaggttgcaacaacaaaggaggatgcagatgttaaagaacaggaagattctgtagcagttcctagtccagagcaatctgatgacagtgaggatgactttcaaagatggtctcagtacaaaagtggctatcagtga

SEQ ID NO: 81011 - DNA, 1658 bp, Glycine max
  Peptide Sequence Number=SeqID_172696
atgggaacaagttctttctttctttttctctgcattattattgtgattgatgatgatgatgggtcttgcgcgatcaaatatgaatatgaagcagcgattgttgagactttgttactattgcttgtctcttattccgcaactattgcgtctcctccaaaggcttctcttcaaattaagaaaacctttacattgccagcaattgcggctgatgcggccgcaattgcggtcgtgatgcggttgcccaacatcggaaagcctgttgcattctataaacctgtgggaataccagatgggttccatatccttggacactattgtcagtccagcgacaagccgttacggggttttgtgcttgttgttagggaagtggaaactgcttcatctgagacaagcaaccgtgacaagttaacagccttgaagaatccccttgactacatgttagtatggtgttccaatgcaggaagtaaggaattgccaattggttctgcttatttttgggtgccccagcctcctgaaggttacagtgccctcggctttttggttgctaacatgcctgacaagcccaatttggatgaaatgatttgtgttcgtgctgacctcactgataaatgtgaaccttaccggctgatgcttgatgctgcttctgtaattcctgagtttccatttcaggtgtggagtttgagacctcgtgaccgtggcatgctggggaaaggagtttcagtagggacttttttctgcactagttgttggaacaatggagatgagctatctgttgtgtgcttgaagaacctaaatcctgaagtttacttgccttcttctgttgattggtttttcaataatggagccttgttgtaccgaaagggcgtgtccacgggagaggccattgatgcagctggctcaaatttgccaggtgggggaagaaatgatggggagttttggatagatttgccaagtgatgataaaagggattttgtcaaacatggggacttgaagagtgctaagctttatgttcatgtgaagcctgctcttggtggaacttttactgatattgctatgtgggtgttttgccctttcaatggaccctccaccctgaaaattggaattacaagtagggcttttagtaaggttggagagcatgttggtgactgggagcattttacacttcgtatatgcaacttctccggagaattgtggagtatatatttctcacagcacagtggtggtaaatgggtggatgcctatgaattggagtatattgatggcaataaagctgttgtctactcatcaaaaaatggacatgcaagttacccccaccctggaacatatctccaaggatcttcaaaacttgggattggcattaggaatgatgctactcgtagtaatttgtatgtggattctagcgttcaatacgagcttgttgcagccgagtatctaggagatgttgtcagagagcctcaatggttgcagtttatgagagagtggggtccaaaaattgtttatgattctaaaactgagcttgataagataataaatgctcttcctggcgggcttcgcaattcatttggtagcttgattaaaaagcttccggtagagctgtatggtgaggaaggtcctacagggccaaaagagaaaaataactggataggagatgaaagatg

SEQ ID NO: 81012 - DNA, 285 bp, Glycine max
  Peptide Sequence Number=SeqID_172697
atggatagtgtcgtgcaaaaggagcaaattgcaaacgtgaatagaagagaagaaggacccaatctgaatggtttgtttggaaggcaatctggcacaactcccggatattcctactcttcagctaacaagaacatggctgtgacttgggaagaaaagacactatacgattacttgcttaaccccaaaaagtatattccagggacaaagatggtatttcctggtcttaagaagcctcaggaacgtgctgatcttattgcatatctgaaagaatccactgcacagtga

SEQ ID NO: 81013 - DNA, 1344 bp, Glycine max
  Peptide Sequence Number=SeqID_172698
atgggaggatcaattgctgtgcatgttgctgcaaggagatcattgtccaccttggctgggttgcttgttgtggatgttgtagagggaacagcaatgacttcactaattcatatgcagaaaatcctatcaagcaggatgcaacatttttcaagcattgaaaaagctgtgcatggttgtccatggtgtaggagccatgtgcctggaggcaagaaccaagcacaccaaaagtgttcatttgtggaagttgaaaatgcttccgtgcagattgaatggagtgtcaggggtggctctttaagaaatattgattctgctcgtgtatcaatccctgccacgttaaagtatgatgattcaaagaaatggttagtaccactcttagcctttcagaatatcgctatctttaccgaactgagctggaaaagactgaacaatattggaaaggctggcctctcagataaatttttgtcatgtcccgttccaaagctgttgttattagcaggaacaagaatgcccagttggataaaatcggtaaagttgattggacatgtacataggccgttggaagcacagggggagagagtcgaagaaggacattggaggaacgaggaagtcgttaagagagatctaatggtgaataatacctctaaagatttggaaacggtgttgtgtgatcaaacggagccgaagcctccctcgctgacagggagggctcaactgaaggcgtgtgtggcggatttcaggtcggaaaaggagaagagatggagatcattggcacaacgctgcgccaagaagtggtggaagtccaccgtgtcggagaactccgttgactcggagtcgaagtgggagcgactgttgctgcgcgtgtccattaggctcagcgaacaagcccatgacacgcgtgaggtagagccgccgtgcgaactcgctgccgctcctcccccaacgaaatcctcatcttctccgggggctgaccggctcaccgtcgtggcttccgcggctgatttcaaatggttgctactactgcggagaatgacgaaccaaagagagggaagtgttcaagagtcaggtcacacaattggtcaaatgcaagggaagtttcaaatggcagttgtaaggcatacagggcatgctattcaggaagatgtacctgatgaatttgcaactctgattgtcaacttcatttctcgtaaccaaataggccctcatgaaattgaggtgaagcgacaatatttcagactattatcaaatgtaatgagcagagagaaagatgggattggacatagatttgcgctcatagctagccaagttagtgcctccatcaatgttatccttggttgtaaagtttag

SEQ ID NO: 81014 - DNA, 1881 bp, Glycine max
  Peptide Sequence Number=SeqID_172699
atggagcaacctgaaagaagaagcaaatggagagtggttgatggggttggcgagaagcaatcagttaccaccttagcagcaactaccacaagttttgatgataacgacgttgttgactcaaattcggctgtggtgaggaatttctatggaggaatcaatgcgcatgacgtggattctgtagagtaccttatggctgagaattgtgtgtatgaagatcttgtctttccccgaccctttgttggtcgtaaggaaattctagagttcttcaaaaaattcactaattctaccagcaaaggtctgcagtttgttattgatgatttgtctactgaggactcctcatctgtcgggaatggaagggaaaaccttttccctttagcaaaggggattgaagtgaaacctggcaaaccgtgtccttatcacgctgacaatgtgcgagggaagcttcatgttactcaggctactctaggcattggctcatcatcggagaaaagcattcttcagtgctcttctggacacaaaagtccagttttcttgtgttcattgctaccagataaggttgagtcatgccctttgaatcttgagtttgacgcagatgacttagtggcattctcggttgttggctcacgaagcatccacctttcaggttattttgcggatgatgatggggatgatcttagggatgactatgaatatgattcatggggagaggatattgaaggaactgagtcagaggagtcgtctgaatatgatagtgaagatggatatgctgatgactttattgttgatagtgatactgacatgtacccgtcttcgccaatcccaaatagtggagttgtaattgaggaaataatggatgatgataaacccaaaaatggagatgatccaactaagaaattaaagaaaaagaagcatgtagctcagttgaaagagaaagacaacaaaagttctgagcttccaattgttgctaagggtgatactgaccttgttgtggaaagtgaagatgaagatggctttccaatttccattgcagagaaaggtgtgtctgtctctaagacagaagcagaaatgaaaggagaacaagcacgtaagaaaactgagaaagccaacaagaaggaaaaagatgttggtcattctgctagtgtaaaacgaaaagttgatagtgctgatgaagatgagcctcaggatgggaaaaagaagaagaaaagaaacaagttgaaagatcatattaaagggggaagtgatcatgcatctgacaatagcaatgagaaaaaggttactgaaccagatgaaaaacatgccgaggatgttaaaacttcaaccaaactgagtgatgtttctcatgcaaaggatgaagatggtggaaagctatccaataacgaggtccttgttgagaagaaaatcaagaagaaaaacaagaaaaagaccaaagagtctgaaggggaagctgccgcaaatcaaattactacaactgctgaaaaacagaatttgtccacagagaaaaaggggaagaaacaaactgaaaccaagccatcacaagtgagaacttttccaaatggattgattatagaggaggtgtttatgggtaaacctgatggcaaaaaagctgctcctggaaagaaggttagtgttaaatatattggcaaactgcaaaaagatgggaaaatatttgactcaaatgtgggaagagcaccctttaaatttcgcctgggtgtaggacaagtcatcaaagggtgggaggttgggatcaatgggatgagaattggggacaaacgaaggatcacaattccaccgtctatgggatacgcggacaaacgcgttggcagtataccaccaagttcgtggcttgtatttgatgtggagttggttgatgttggtcgctga

SEQ ID NO: 81015 - DNA, 411 bp, Glycine max
  Peptide Sequence Number=SeqID_172700
atggggaaagaggtttacgacggaacctttcggaagacccgttatgggttcttccggaagttccggaaactttccggaagaagtgatcttccggaaatcaaggccagaacacgaggtttaagtcgtgccataggcagacttgtaggcagagatagacctgatgatcagaatgctgctgatgttcccgagaggcgtaggcctactgcctcagtccgtaggctacgcgttcatcagatgactgcggagggacgtgatatggctgagaacgtcgctgacatgactgacgatgtccctgagcaggctgcggaggcacctgagatgcgtgcggacgcaccggttgctgatagtggtgaggggtcagatggtgatgatgctgctgacgcattccttggtggtccacgtgacccatca

SEQ ID NO: 81016 - DNA, 2505 bp, Glycine max
  Peptide Sequence Number=SeqID_172701
atgggttgtgtgcacgtgttcgaagcacatttggaagttcatgcaggatcaatagatgaggaggaggacgagcaaggaattgcacatatgattgaacatgttgctttcctaggaagtaaaaaacgtgagaagcttttggggacgggagcccgttcaaatgcttatactgatttccaccatacggtgtttcacatccatgctcctacgagcaccaaggattctgatggtgatttacttccatttgttctagatgccttgaatgagatagctttccacccaaagtttcttgcttctagaattgaaaaagaacggcgtgctatactctcagagcttcaaatgatgaatacaatagagtatcgagttgattgccagttgttacagcatctgcattctgaaaataagctcagcaaaaggtttcccattggcttagaagaacagataaagaagtgggatgcagataaaataaggaagtttcatgagcgttggtatttccctgcaaatgctaccttgtacattgtgggggatattgataacatatcaaagactgtttaccatattgaagcagtttttggacaaactggtgcagacaatgagaaaggttctgtagccactccaagtgcatttggtgcaatggctagttttctcgttcctaagctttctgttggttcgagtggaaattctattgaaagatcagccaatgctatggatcaatcaaaagtattcaataaggaaagacaagctgttcgtcctcctgtgaagcataattggtcacttcctgggagcggtgctgatttgatgccgccgcaaatatttcaacatgagttacttcaaaatttttcaattaatatgttctgcaagattccagtgaataaggttcaaacatacagagacttgcgccaggtcttgatgaaaagaatatttttgtctgctcttcattttcgaattaatacaagatataagagttcaaatccaccgttcacttcagtcgaattggatcacagtgactctggaagggaaggatgcactgtgaccactcttaccataactgcagaaccaaagaattggcaaaatgcaattagagttgctgttcaagaggttcggagacttaaagagtttggggttacccagggtgaattaactcgttatttagatgcccttctgaaagatagtgaacacctagcagccatgattgataatgtatcttctgttgataacttggattttatcatggaaagtgatgctcttggacataaagttatggaccagagacaagggcatgaaagtttacttgctgttgctgggacagttacccttgaggaggtcaattctgttggtgccaaggtgttagaatttatagctgattttgcaaagcctactgcaccacttcctgcagcaattgttgcttgtgttccaaaaaaagttcacaatgagggagctggtgaaacagaattcaagatatcatcaactgaaattacggatgctatcaaagctggattggatgaacctattcagccagagcctgagcttgaggtgccaaaagagctaatacaatcaacaaagctagaagagttgaaaaagctgcgcaagccggcctttattcctgtaaatcctgaaacagatgctacaaagcttcatgatgaggaaactgggatcacccggcgccgtctcgctaatggaattcctgttaattataagatatcaaaaactgaaacacaaagcggtgtgatgcggctgattgttggtggtggacgagcagctgagagtcctgagtcaagaggatctgtgattgtgggtgttaggacacttagtgagggaggtcgtgttggcaatttctcaagggagcaggtggaacttttctgtgtaaatcacctgataaattgctccttggaatctacggaggaattcatatctatggagttccgttttactttaagagacaatgggatgcgtgcagcctttcaattgcttcacatggtacttgagcatagtgtctgggttgatgatgcttttgatagagcaaggcaattgtatctgtcatattaccggtccatccctaagagcttggaacgctcaactgctcacaaactcatggtagcaatgttggatggagatgagcggtttattgagcctacaccaaaatcactggaaaatttaaccctgcaatctgttaaggatgcagtgatgaatcaattttttggtgataacatggaggtatgcattgtaggtgacttcactgaggaggacattgaatcttgcattcttgattaccttggcacagctcaggccacaagaaatcatgaaagagagcaaaaattcaacccacccttatttcgaccatctccatctgatttgcagtttcaagaagtatttttgaaggacaccgatgagagggcatgtgcttatatagcaggaccagcgccaaaccgttggggttttactgttgatggagtagacttgttagagtcaattaataatgcatcaataatcaatggtgaactttgttga

SEQ ID NO: 81017 - DNA, 537 bp, Glycine max
  Peptide Sequence Number=SeqID_172702
atggctcacattaactcagtgcaggaagttaatgaagttgtcgcactccatgatccagatcacatgactttagaatttctttcttatgcggatgggaaggaggcagtggccaaagcagctaacttgatttttgtggagcacttgaaacgacataaattgggtggagaactagatctaatcttgttagaacctcaattgaatgaagcattgcaaattgttggtagcaaaggtcctgagcctgaccttttactggtttatggacctgtgaggagccatcttggttttcctgcatggagacttcgttacacagagatcattttaaatctcaagtggttggtgaatatatttggatccgatttaccttctccctatttgctctatattcctcctgttatattttctttctccagcagtaaatctgtgacacatgggatcattgaacttcttgagatatggttccttaatgaaagccatttacaacttcacgaaagtgcaccaaaattatggtacgtagaaaaggaatttggaggtagttaa

SEQ ID NO: 81018 - DNA, 384 bp, Glycine max
  Peptide Sequence Number=SeqID_172703
atggacttggtgaagggttatatgatgttggggttttataactccgacgacggtcaaggaaatcctcctgcaatttggccagtgctgtggtctgtgggtcgggccgtccatgtaaaaggaaactaccgtgatgcgctcttcttcaggagtaccttggtattcgaagaattgggagatcttaaagatccatcccaatgggtcatgaccgtcacatctcgaaacctcgagtttgacgtgagtgaggactcgagaaaggtgttgactttaaaagctaagttagagtgtttggaagcaagggatttagctgggataaggcatcttcaagcctatcggtggttgttttgcgcattctgtggtcagatgagggataagggacctctttaa

SEQ ID NO: 81019 - DNA, 414 bp, Glycine max
  Peptide Sequence Number=SeqID_172704
atggttaacaagtacaagatcacggttttaacaaaacatgtttggctatccttaagttttttggtatggattcccttgattttgccaatgtttgttgagaatctggtggtattgttggtaatgccactatttttggttccgtcaaccgaagccctcaattgtgcccttctccaattgatgtggtacctcctggtgataagaataaaagtgcaacataagtttcaaattttggatgttgcggagtttgacatccttgaggatgcacatgagtgtgtcataatgtctattaatgacatcccagaaaagacccccattcaagccaaccacccattccacctaccaatacccattaccaatgtgacattcgacgaagaagaagaaaggcagctcgatgatgataaagtgaacaactag

SEQ ID NO: 81020 - DNA, 222 bp, Glycine max
  Peptide Sequence Number=SeqID_172705
atggataatacaaccacacctccaacacctatggttctaattcaatggcaaggaatctcacccaaagaagcttcatgggaaccatgggagatagtctatgacaagtttcaccttgaggacaaggtcccttgtcctctaattcaaggttcctcactccccgttcattcctctgctcctatcaacaacacacaagaagaaactggatatgtggttcttccgtaa

SEQ ID NO: 81021 - DNA, 489 bp, Glycine max
  Peptide Sequence Number=SeqID_172706
atgtgtggtgagaaagatgtgcaaaagaaggcacagaccatccagaaacaaaacattgcccctcacgtgttgtctcgtgggggttatgaatatttagaaaataagttgatggatgagaagagaaagggaaaactggaggaagctgctcaatccgaaagcactgacaccatgattgatcctctatctcccatcagacgacacgtgaagtggaagatggcccgcatgaagaaaactgaccaaataacgtctaaggcagcaaaggaaattactgagaagattgattcattggaggagcaggcctcacaagcaatactttggaccgactccaaggacctctcgcacgtcttcctccgtgactcccaaagacctgtagcagctgacgcaacaaatcagggactagctggaagagtcgatcacagaaaaagtgattcgacagctaatgttatccttcagccagaagcagtcccaatttcaggtgggatcctctag

SEQ ID NO: 81022 - DNA, 212 bp, Glycine max
  Peptide Sequence Number=SeqID_172707
atggaatcaatggacgagttgcacaaagaaggaagaaaggaaaagttgggaggaggagtagattggggaaggggaatggaagggtttgttggggttagggagaagggaaggttgaggatggggttaggtggcgtaaggagaaagaggaaggagaaagagaaggaggttagaagaaggagaaaagggatagtgggtgccaagaagggttgcgg

SEQ ID NO: 81023 - DNA, 132 bp, Glycine max
  Peptide Sequence Number=SeqID_172708
atggtggaagttgtgaaaggagaggatgctaagcccactgtcaagatgaaggcataccataaggcatttcaacagggtccatatgaacttcttgcaacaactttacgatcactttttccagggttattctaa

SEQ ID NO: 81024 - DNA, 168 bp, Glycine max
  Peptide Sequence Number=SeqID_172709
atggagaaggaggaaagcccactaatccaagatcaagtccaagattctccaccaagtgtgcttaggtgtcatgaggcatataagtgggctcatacttatcccatggggcaaaaatctaccctaaggcttatgagaaccctagggccttcttcagcagttctggcctaa

SEQ ID NO: 81025 - DNA, 288 bp, Glycine max
  Peptide Sequence Number=SeqID_172710
atggcgagttggttgaggtggataaatcgccatccccagcagcgatttcagttgcttgaggatcaatggcatcttcatcgccatgctcatcaaatatacatactaggtcttgtccaattgatggtgacgttttggggatgcaacctaagcatgtttcagaacatgtttggaatgggaaaccagacagaaaattacacatcagacgagcagtcccgacgtatcaaggtgaagaacaaataccagaggaaattgttcctcggcttcagcaatctgggttttattggataa

SEQ ID NO: 81026 - DNA, 186 bp, Glycine max
  Peptide Sequence Number=SeqID_172711
atgacgatctcggacccattcagcgatggatcgtcggagaaaaataaatcgcatgatgacagtacaagtggaggcttcaatcccttctctttctctttgacgtttgggaactctatcggagcaattagaggaaaaaaattggagaaatctcagggaaccgatagagatgctgctatcgctggctga

SEQ ID NO: 81027 - DNA, 264 bp, Glycine max
  Peptide Sequence Number=SeqID_172712
atgaaaaaggaagaagagatgctatcccaacttatgacaaggaaagcttatgggtctcttcgatgcaacacgagtattagtataagtgagactcacggatccattttcacggcgaatgggatgggcaatggtggttctagcaaagagccaccaaacagtggtggcggtggtaaacgtcgtgtttccttcaaggacttgatgataggcaacaaggcacctgtagcccttcgacaaaaagttgatttgattcaacaaaattggtga

SEQ ID NO: 81028 - DNA, 204 bp, Glycine max
  Peptide Sequence Number=SeqID_172713
atggctagaggaatcgtagtttttccgagacagctctgggtttctgcgggaaagctcagacataacatcccaattcaaaacggtgagaatgcttggaattgggttgcgaacatggtgctcaaatttcacgacgatccaacggtgaatgactccgagattgtcatttttctgagacaggttaggtgtcctgcgggaaaaagatag

SEQ ID NO: 81029 - DNA, 387 bp, Glycine max
  Peptide Sequence Number=SeqID_172714
atgatgggagaaaaggaagaattccctaagggagagttctcaagctttgatggacttgggcctgcgtactcgtgcttagtatgggtgcctatatttgcgcttagcacgcctcttcctcgcttagcgccaatgcttgttttcgcgctaagcgcgtcttggctcatatttagtagttatcaacaaccaatagttgaagttccacaagtcgctgaagatgatcatgtagatcaagttgttaacaaggaacaacaagtcaatgttgaaaatccggttgaacaacaagttcctcaacaagataatgagccaacattaagaagacctactagagtcaaaatgtcaacaattcctagtgattatcaagtgtatttgcaaagaatcggactataa

SEQ ID NO: 81030 - DNA, 183 bp, Glycine max
  Peptide Sequence Number=SeqID_172715
atgatggaagaagactatagaccagtcatacatccccggagaaggctcaatccatctgtcacaacctaccctttggcaggaaggcgaggcgaaaagaaaaggcaaagggtcactttggggcagtttcaactcacccaggcaagttggtttcttcaccatgatgctatttggtggcccaagtga

SEQ ID NO: 81031 - DNA, 129 bp, Glycine max
  Peptide Sequence Number=SeqID_172716
atggacgaagaacagtggatgtatgatagtatcatgtctgaagaagttgatataaatgttgaaaatgaggaagatgttggcatgaaaatagaacacgtcgattgctctaatgcctttaatacttctcag

SEQ ID NO: 81032 - DNA, 741 bp, Glycine max
  Peptide Sequence Number=SeqID_172717
atggcttcatcctttgaagccttggaggttaaaaagatggagttggagattgaatcacaatttatgaatgaagctagtttagaattgaataataccattgagcattcaatccagaatggcaaaaaagaaaaagagatcctttgtaaaagaaaggatgtgttaatggatgaattggaacaacttcttgctaaaaagatgcagtcaagcattgatgtcaagtatgacaaattgcaatttgtccttgctcaaaagaagaaatgggagcaagactttgggaatttgcttggatttctacagcaagctgaaggataccgtgaaattgttaaactaagaagaagtttgatgtcatctacattgacgtccagggaggacaaattgacacttgcaaagaacaatgaaaagctttctggagatgtgaaattgtttcaacaggaggtttctgccacaagagcttccttgcaggaactatcttcaagaaagtcaagcatccagcaaggtatagtatccttcaagcggaggattattttcatagataaaagagtcctagaactagaagcagaaaagaaagttgttactgctgcaagaaatttcaaggagattccacgaatagctactgaagcaaagtcattgtgtgttgaaaaagaaagtattcagatcgacagggatacgactacattaaatcttgagctactgagagagaaacttggacttgtcaaccacagatacaaggaggaatgttga

SEQ ID NO: 81033 - DNA, 237 bp, Glycine max
  Peptide Sequence Number=SeqID_172718
atggacttgctaaaggatgaagatgcatctaaagccatggtggttttgacattcctattggttaagaacagtatggacgacgctataagggatcttccttttcctcataacaaaaacttagcaatcaactatggaagtgatggtgaagatgacttgtttgttccagcattgaatcaacccttgtcttcaaaccgttactatgtgataaaagggagggggaagcataaagggttatag

SEQ ID NO: 81034 - DNA, 852 bp, Glycine max
  Peptide Sequence Number=SeqID_172719
atgaaacaacttcaccatccatcagcattagacatgtttgacaaaattattgacgcgtcaaagggaaaacaatttgtcatgtttctggactatgatggcacgctgtctcctatagtcgacgaccctgaccgtgctttcatgtgtgattcgatgagaaaaacaatgaggaaacttgctaggtgtttccctactgctatagtgaccggcagatgcaaaggcaagatgcatgacttattttggaacttggaagcaacaggtatgattgggatagttgattataccaattatgatgatatgaaatatgctatcaggaaacttgatgactcagaattccgcaatgccttttctcgtgctttcatacgggttattctagaagtcctagtcgtgattcaaggaggagctattctagaagcctcagccgtagtccatatatctcacgaagccgcagccatagccgcaacagaagtcatagctatagtgacaggagcagaaggttcactttggttgccttgttggtctccgaaaccaaaacactctcgacattcaatatctctttcaaggctgtcccaagatggcaggataagggatgcaaacaaagtcttgaatgagatgactgaaactttgaaatttaagaacaagctgttagaagctggtctaaaacgtgatccatttacatataaagcattaattcatgggttctacaagacgaatgaactagaaagggcaaatgagttaatgttcagcatggttgatgctggatttacacccagttattgcacattctcatggattggagatagctacaataagaaagacaatatggatgcagttttagcacttccagatgagtaa

SEQ ID NO: 81035 - DNA, 1566 bp, Glycine max
  Peptide Sequence Number=SeqID_172720
atgatgaagaaagagttaaaaaaatcattgaaagtagagctatctcatattgcatcacatcagtcagcccctattaaggcgccagaaatacaagctctacttgggcgtgttagcacaaagggtagctgcgctggacctgaaggaagcggattacttaaagagcttttgagtggtggtgacgatctgatgggcttgttcgtagttgttggggaaaatactgtgtttgcgggcttgggaaaagtgtttgagaattcatccaccatacataatgttcattatgaaaatgatgttgttaaggttcaggttgtcagaacatacatgcctcatgctgaggtccctattcctacatcagaggttcattatcttgagcagaccgttggcacattcgtcgcatggccgacccatcttgttagggaagtaactaatgaggtggtcgtaggacccgataagcctccatcaaagtctgttggacagctgaacaggttaacatctgtggccacagatgacccattgggagaattggttaagaagtcatatgtggtttacacaaagccaatggagttggcatgggacgaggcgaaatttgggttacctaatgcctcaaatggttttttcattacacatgcagatgtgactgaaataattttaggtgacaaatgtttaaacatatctgtactgcagctgtggatgatgtttatgaatgattggagtacaagcattggtttttttccagtgtacggtttccttgagccccagtctatacgctgcacaaaggacacgcgtaaagaatgtcaaaagtacatagaaacgtgggtcaaggagtcacatcgagaaatctacttaggaccttacttcaatcaggcacattggcaacttcttgtgttgtgtccacgagagaacattatagtatggttctgttctgtacgaagaaagcctgatgttcacattaagtttgcagtgaacaatgcaatgaagaaaatatgcagtaatctccaaggcaaggacaatgcacctccacctccacctcaatggattgaggctaagagccatgtacaacaaggagcatatgagtgtggatattatgtgatgcattggatgtggtgcatcgttagtgccggtttgaaaaatgaactccacaactatttttcagatggaacaacattagacactgacaccatgacgacaatacgcaagaaatgggcagcctattttctagaagttggaaaatggatgtcagcgtttgacatgttcctgcttgggtcgttcagtccgccgcaaccttctcatacattggtccaagaaatcatcggaaaagctcctcaggatgcattgggtaaccaagcagagcatgcattagcctctctggcatcgatgatgttggaatctccttccttcatagtccaatttacacatggtttgaatttgagtctaagctctaaggaatatactcatggagttgtgattcgatttcgatccgttgaggcatttgagatatttataaacagcaaagagtacaaaaatatttctgcacttgggctgttatatgccatccagatattggtctaa

SEQ ID NO: 81036 - DNA, 714 bp, Glycine max
  Peptide Sequence Number=SeqID_172721
atggagagtggcaaattatcaaggggacagttacatgggcaaaccagtgaggataaattgtcaaaaggcgattctgatgatgaaatgctcagctctgttctcaagaaaaaaataaatagtaaagtatcaattgaacaattacttgaacccattaatgtggattcatcgtcaagagatgattctgatgatgaaatgctcagctctgctctcaaaagaactagacgaccatctcttaaatcaaagcaagttgagcttgaaaatatccaaattcatgagagaataatgggcgacgattctttcaatggaggcataatagaggtttcggaaggaaagatgctaaagaaaatgaaaaagcaacccctcttgtttgtggaactccttttctggaagactcggagggaatgccattacatcaatgctgaatatttgttgagcgagcttggtcatttgaagaaagaaagtgccaattggaataacactcagggagatgaagaaattggttcatccccagcaaaggtgtggacacaggatatcaaaaacaagcttgatgttattaaaggctttgcacctacctctggcagtaacagtgacaaagatgatcataatggggagcaattgatggaagacgaatctcaaattgctctaaggagaaggaagaaacttgttcttgatggtgatttggaaagacaaatcaaagatctccatgagaagtag

SEQ ID NO: 81037 - DNA, 441 bp, Glycine max
  Peptide Sequence Number=SeqID_172722
atgacttctaggaaacgcaagagtattggttcaagacctacacaacaatatgatacaaggagattttcctccttatatgcttggaaccggtacacagataatgtcctggggagaaacatcttgcctgagaggaaggtggagctctatcacactgagctagatgattttaagactgaattggagaggtgtaatttccataaacgcctcaccaatttgcctgatgggagcatagacttggctttggtgaaagagttctatgcaaacttatacagctctgagggcccttcaccaaagcaatccagagtcagaggccacctagtgaagattgatactgacagccttaacacattcttagagacacctatggtgttggcagagggtgagactttgcccacatactccagatattgcaggctgcccatagatacggggatcctctag

SEQ ID NO: 81038 - DNA, 234 bp, Glycine max
  Peptide Sequence Number=SeqID_172723
atgctacaatgcgaagggttttcctctaagctcatatatgattgtgaaattaccaacggtgataatgttcggaattgggttgcgaacatgatactcaaatttcacaatgatccaacggtgaaagggttcgagatcgtcgtttttctgagactggtttggtggactgcgggaaaaagaaagggttttgagaggagaaggggaaaaacgaaaatgaggccaaaaggaggcagctga

SEQ ID NO: 81039 - DNA, 1623 bp, Glycine max
  Peptide Sequence Number=SeqID_172724
atggttagaacacgaggtttaggtcgtgcgttaggagctggtagaggtagaggcattagtgaggatacgcatgaggctgatgttcctctgcgtcgcagacctactgcttcagcacgtaggcaacgggttcgtttgcgtgaggacatgacagagagacctgaggatgtgcctcaattgcatgaggatgttccttatgtgtctaatgccaccccagagataacaggcgccgccgatgctgttcagacagagggagtggctattgatgggagcttagggtcacctactgcaaatgagggtttccccggtggaccacgcgacccatcgattttgaccgattttgttgagcatgtcgcacacagcatctggagtggacgggaacgacccgatctgaagttggtctcccacggtagaaaagtaaataaaattgggagaccagcgcctgagatcgaagggttgattgttggcaccggattgagtccactgatcaggtgttttgttatcaccactgatcctggactgatatccgccttcgtcgagaggtggcatcgcgagactagcacgttccacctgccagtaggcgagttgacgatcacgttggatgacgtggcgtcactcctacaccttcccatcactggcgcgctacatacgttcgagccgcttgttacttcagatgccattcgtctactgacggagcttcttgaggtcagtcatgaggaggctacatttgagacccgacaggctggtgggcctcatgctttcaaggacctggcccaggcagggggattcgcctggggggcggctgcattagtccacatgtacgaccatctgaatgacgcgtcgcaggcctctacacggcagctgggcggttatattacacttctccagtgctggatatacgagcacttttctacaatgcatacatccgtcgttgatgatgcttatgatgaggggagcccacgagcctgcaggtggcttacgggtaaggctcatattacggggatcaagggagccccgtatcagagacgtttggatgccctaagtgtgactaacgtgtgctggatgccctatggtgagcactggcgagtcagggcctttgacttgatatcgtcgtacaccggccagctcagatggggtcagattgtgacggtccctccgccgccggtttgtgattctttgacgggtgatgatatagatgaccggtggctgaattttccagaccatttggttccttcaggggagctctgtgtagttcctggacaggtggtggcagactacatggagtggtttttttggatatcgcacccattcgtcacgcggaccgaggagactgctgcgccgagacatccgcctccccctcatcataaggagttcgtcgagccacccatccccgaggtttcagtcgcgaccgatctccctacgcattcagtggttcactgcgaaggatgtcaggggatggctcagaatttaggagcgattgctgaggatttggagcgggtcatcaacctcaggatggtcactaagggcactgacttacatgacatcatgactcgttgtctgaggagagctagaggcgacaccgcagatggaagtcttaggccgcgccagagaagccgcatagattag

SEQ ID NO: 81040 - DNA, 165 bp, Glycine max
  Peptide Sequence Number=SeqID_172725
atgggtggttctacacagaaaatcattggtgttcatcttaaagatgatgattcaacccttgatacttgtcacactcctttctccaaaaacatgcctaatgtcaatagagaaaaagaagttgacgacgttttgatgatgccaaagaaaagcgcttctcacgtttga

SEQ ID NO: 81041 - DNA, 234 bp, Glycine max
  Peptide Sequence Number=SeqID_172726
atggagtcccacggaagaattctttcgccactgtcaactgcagaagaattgcggaagaaccttcttccgtgggactccacggaagaacttcttccgcaagactcaaccgaagaagaaatgacaaacaaggccaaaggaaaaggcaaggaggtcactggaaaaggttctgccagcaagcgcaagggcgccttcgacgacgacaagaccggtggcggccgaaagagaaacaagtga

SEQ ID NO: 81042 - DNA, 234 bp, Glycine max
  Peptide Sequence Number=SeqID_172727
atggcgagggatattggcacttacatcaccaaaatgagttggggaagccataaggttgaagaaaccctagaaaggaaggagcacgattatggttcattaaccttttcgacttctgaggaaggagtttgtatagttgaggatgatgagaggaatgaatgtgttgtgaaggaagagtgtcgcgctggaaaccctaagcgcgagagagtagaggaagagtgttgcgcgcatcattaa

SEQ ID NO: 81043 - DNA, 297 bp, Glycine max
  Peptide Sequence Number=SeqID_172728
atgcagagaatgataagcacaacacataataataacaatctaggttcacataaaatagggagggcagagctgacatctaaactacagacttgggttgaatttcaagaagcatcatcgtcaaaaagaactcttctcttgttgagggttagcataaggagtttagctaagatgcaagtgaagaggggctcttgggaatcgaggagggattgttcctctgcgatgaggttcattatgcgtttagtgaggcgacaacgattgtcatggatttggaagcagcaagggtacttggagagctag

SEQ ID NO: 81044 - DNA, 225 bp, Glycine max
  Peptide Sequence Number=SeqID_172729
atgatgatcaccacctttacctttgtctccatgattgttgttgctgccaccactatcatcatgatgacgatggcggtcatggaggtggttgacaatggtggtgttataacaaccgaggtggtggcaattgacgacgttggtggtagcaacaacgattatgatagtggctgcaacaatgatcatgatggtgaagtgacaatcatgttggtgatgatgatgagttga

SEQ ID NO: 81045 - DNA, 288 bp, Glycine max
  Peptide Sequence Number=SeqID_172730
atggctatgccgcacatggtgggatgccctaatatccccaccaccacttctccttgctcctatagaaacagaagggggagaatcatagtgatcgagatgggctccccagccggggaagcaacagaaggctacgaccttttacggaggttagaagtgcctccaccagtacgacgcaaaaccctcaacctctatgaggaagaggattcactgttagaggccccacgacgagtctcctgtgaggaggaaccactgatggacatgacttctcagtccaccaagggttgttga

SEQ ID NO: 81046 - DNA, 213 bp, Glycine max
  Peptide Sequence Number=SeqID_172731
atgtccgacaagctggacaaaagcgcgacaagcgagaaggaagcttcaagaccaaatcacactagttggacaagaggcacaagccagaaaaatgccagcctctcccaaaaaggcccaagagaaaaatttgaagatgcaaaagttgttgtctcgctaagcttggatcgtgtgcttagcaagactcaaccgctaagcgagacatcaaccgcttag

SEQ ID NO: 81047 - DNA, 282 bp, Glycine max
  Peptide Sequence Number=SeqID_172732
atggaagaaaaaaactcagcaaaagcaaagcaccaagagcaagcaccaacagcaagcaccaacagcaagcacgcagaacactcaagaaattcaagaatggagaaaagaaagggctggcggcacgccatgaagccctatcccgcccatcgtaatggcgagtcccacagattgggtgtcgccagtgagaatggcgattctcactcctacgtggcctatgtcgccactaccaggggcgatacacccctctctcctgctttgccgccactggcaatggcgggttga

SEQ ID NO: 81048 - DNA, 1380 bp, Glycine max
  Peptide Sequence Number=SeqID_172733
atgcctccaatcttcaacacattagactactctctagaccaacatcatttgtatgcaccaaatcaacaccaacaacacctgatgaagttccaaggttccggtgatgaaaacaacaatggatcaatggtggattacatgcctcaaacaacacccccacatggcttttatggtgctactagtgccgccacaacatcctatgacaaactgagttttgcagatgtgatgcagtttgcagattttggaccaaagttagctttgaaccaagcaaaaaactgtgaagagtctgcaatagacccggtttattttctcaagtttcccgtgttaaacaacaagatggaggaggatcagcagaatatgatgatgaataatgatgaccctgatggtgatgaagcagaaaatcatcatcatgatgagaggttcaacaacttggtgagtgtggaagacaaagagggaatgatggtgagagaggatgaagagactacacgggtttccgacgacaacaactcggtgcagattcggtttcttgggcatgaagagcctcagcagaagaataattgtgcagtgcaggagaacaagaacggcaagaggaagaggccaagaactgttaagacaagtgaggaggttgagagccagcgcatgactcacatagcggttgaaaggaaccgtaggaagcaaatgaatgagcatcttcgtgtccttagatccctcatgcctggttcatacgtccaaaggggtgatcaagcttccataattgggggggctatagagtttgtgagggaattggagcaacttcttcagtgtttggagtcacaaaagaggaggaggctacttggagaagctcaagcaagacaagttggggatccatctcttgcaacacaacaacagcctccattctttccacctttgcctattccaaatgagcagatgaagcttgtggagatggagaccggactccacgaagaaaccgcggagagcaagtcttgtttggctgatgttgaagtgaagcttctaggatttgatgccatgatcaaaatcctatcaaggaggaggccaggacagctgatcaagaccattgctgctcttgaagatcttcagcttatcatccttcacaccaacatcaccaccattgaacaaacagttctatattcattcaatgtcaaggtggctagtgattcaaggttcaccgcagaagatatagccagctccgtccagcagatattcaattttattcatgcaaacactagcatgtgctgtagtcgtacaagaatcacttgtgatttctatagttgtctttatgagataaaaatattgattttacaccgccgcttgcatcctaagtcgtttggatttactattgtcattgttgtaaggggtgactga

SEQ ID NO: 81049 - DNA, 240 bp, Glycine max
  Peptide Sequence Number=SeqID_172734
atgcatgagaagtttggagacattggagatgttggtgatgaagaagccctggtggagggtggcgttggagacgagggaagagaggaggagcttcaacttggtttggcatgtgcgctgtatataggagctgctgcttcacttgcaatggtcaccaaggtgaagagaaagaggagtagcaagtgggatgaagaggatttcaagtttaacatctttgtccctcccaaagacttttggcattaa

SEQ ID NO: 81050 - DNA, 642 bp, Glycine max
  Peptide Sequence Number=SeqID_172735
atggtgcgaggtaccaaggtgagatatgatgttgttactattaacaaattcctaaagactgattttcaagatcttgaggcgcagagttgtacctactttgagttgaaggacaaggatgattttgacccagacaagctagctaaggtgctttgtattcctggaaaatcttatgtcaaagcgaaggagagcaacaaggcatacaaattcaagaaggatgcattgaggaccattactcagatttcgatgtcctttgcattctccaacgttgctccaaccttgcacacttccaacctcaacagacaacgtgcttctctcatctattgcatcttggctaatatccctattaacatagggaaagtaatttctgacaaaattcatagccttgcctcgtccaaaaatttcggggaagaggattcagctgacaaacctttggtatttccagctttgatcattgctctatgtgcctatcaaaaggccaaaatacctgtttcaatggagattatggttgtacctgacgagggaaatcaatttcatcataatgaggaatgggttgaagtgtcaaatgcaagagagaagggtgttgaaggtggtaatgatgctggaacaagaaaggaaggatcgggctatgttgatgttttttag

SEQ ID NO: 81051 - DNA, 729 bp, Glycine max
  Peptide Sequence Number=SeqID_172736
atgactaggggaaatccaggtgatttagaaccctttgatcctgaaatagatagaacctttcatagattagttaggcatagtgtgcatccttattattttgagcattctgtgcattctgttgctagtgattctgaacattctgattttgagcatttggctgctaattttcatactgagaacatggctcaacctccacctcgtccattaccagctgggatgaccttaagagggtgttcttggagaaattcttccctgcatctaggaccattgtcatcagaaaagatatttcaggcatcaggcaagtggagagagcttggacttagcaacatggagaagagtatgattgatgctgccagtggtggagctcttggtgatatgactcttgttgaggctaggaatctggttgagaagatggcttccaactcccaacaattcagtgcaagaaatgatgctattgtccttagaggagtccatgatgtggccacagattcatcttcatctgctgaaaataagaagcttgagggaaaacttgatgccttagtcaacctagtaactcaactttccataaatcagaaatctgcatctgcacctgttactgttgcaagagtctggggtctatgttcttctgttgatcaccatactgatctctgtccttctttgcagcaatctggagtcaatgagcaacctgaagcctatgctgcaaacatttataatagaccccctcaatag

SEQ ID NO: 81052 - DNA, 389 bp, Glycine max
  Peptide Sequence Number=SeqID_172737
atggtgaggggtaaaggaaaaggtgcctttggatgtcgtgggcaagctattggttgtagctttgcaagtgtcatcacaacttgttcaacgtttgtcaatatcatcatctcttccaacggcttcacttttgcgagttgttggatgattgtcacacaagccatcagtgagatccttggaaacaagcttgttattggatgttggggatttgatggtggagataaggcgtatgggtatggtaaaggatgggtttgttgctcgttttcggtcatgtgcggcgatgctgacaatggttgtggttggaagatgatgctcatggacaaacagagatgggatagagttggtgttgatggctattgcggtggcggttgtggtggcgaaggtggccactt

SEQ ID NO: 81053 - DNA, 530 bp, Glycine max
  Peptide Sequence Number=SeqID_172738
ggaacgatccagacacgagtgactcagagatatacgggttgtacgtcgaagaaaattctccccgcctggttgtcataagaaaactttatgaggggccaacaaccgtttacaacatccctttgcaccatgatcaagtcaaggttggtgttgaggaagttagagatgcagatgctcccattcctgtacccactgaagaggttcagttagaggggcagacacttaacacctttgttgcttgtccaacacatcttgtcaagcatttatcagaacatgttatgtgggatgctaccatgtttgggggttttaatgacaacttccccttgtacataaagtatgaagatctatctaaaatagcacataatggtcaatgtctcagcatatttgttatacaattgtggattctgcatatgactgagactagtatgcgagcggggaatgccgatgtgtatgaattcctcgagccacaatccatacaaagatctgggcaatcacaatttgaatcagaaagttatattaagaactggatgtag

SEQ ID NO: 81054 - DNA, 696 bp, Glycine max
  Peptide Sequence Number=SeqID_172739
aacactgatcttgaagagactaacgctcttgttttttctcttaataacgagaagagtgcacccgatcctcatggcttcaatggatggctgcttcctagcttgaactccaatcttgctattctcattccaaaagaagaaggtgctgatagagttgagaaatttatacctcttgcttgcccttgcgaattttcacttcaaggacgatacaacattgcagaggaggctcgtaaatgtcgctatccaggatctgaaaacgccataagatctggaacgcgtgctcctccttcagactcacctggaacgcaaactgcacgttcacagactgcgccagttcggcaagtctcagcccgatctcgcggagattgttgcagttttccaccgagggaggcccacgtcgttgatgacgtggacataatcgtggccgttgaaggcctccaagatcacttggttcgcggtgaagtgcgcgaacttcaattaaggacacgcctccaagctcagtttttgtgtgatgctaattctcttactaatgtgcttgggcagcctaaatatatcttgtattctgcgaagaagaagctgagagagggaggagatgattttgattggaatactgatgatgagcttgaaattgagaactataactcttcatcttcatgtttaacccttcctaatggggatgctggagaggtaagcttttag

SEQ ID NO: 81055 - DNA, 954 bp, Glycine max
  Peptide Sequence Number=SeqID_172740
atggcacgcaacccaaggcaggattttagcgtttctaagccttcttcttcttttctcccatccaccattgttgcccaacaaagcttcaacctttggtgctcatttctgctccaaatcgcgaaaggagggcattttcggggtcgtgaagtgcgtggctacaagtgggacttcgaaaatccaggggaagtgtggttttcgaaatctgcattttgtgcagatttttgctgtgaaattgtgcagcaggattttgcacaagtgcagaaaaatactaggcttttgctggttgtggaaagagcagtgcagaatgagttctggatgtttgctagtagatcccaacgagttttctgcctttgctctgttttgcttggttgtgatagcttgtgctgtgtgaatgttgttttgcttggatgttgtggaagcttgagaggattgatggggacccggggatggtgggtttatgcgcgcattgtggatgtggaaaacttgttgtgcaccatcgcccgaccgccacctagtaccacatgtgatggggtgaaacttcctgcttttattgttgaccacagagtggtacctggagatatgtcgcgggggtcaggagaccttggggacgtcaggcgagctcctggcagtcaacagataaaaggaaaacaagaccacaaagcaaggaggcttgtggtggctggccagctgcttgaaaacgaagtcaggaaacttagggagcctctggtaatcgattaccagcctatcgtgatggcggcacagctaattcgtgatcgagtagagatggagtgcctagagggagcttgggagaccctcgaaggcaacacgaggtgccgatttcggggcaccattcgattcacggctacttctttggtgcatccagatgaacctgcacggacgcttcagcgcacggtggcgtggacagctccttggattagttttgtatacttttga

SEQ ID NO: 81056 - DNA, 517 bp, Glycine max
  Peptide Sequence Number=SeqID_172741
atggtggccttggttttaaaattgcacaagcttcctaaagaacacttttggaaaaatagtgatgaagacaactgggaagttatgatggatgatgatgatgtgataagagacaatatttctcaacttatagatgagaacaccactatgagttgtctctttaaagaggaaaaggtcttagaagtaaggaagtaccacgattccatcaacaagtacaagatgggcactcgcaatacagaagccttatgctttaggtgggtgatgaaggtgtcggttgagatgcgcatagaagactctagaagaaggatgagctatacaaaagcgttgagcgagtgtcaactcgctaagcgcactgcttgcatcctccaggattgcctatttaagctgaaatctcgaatttggagagaggatgagactgagagatatctgagcttgatgaggaagccatcttgcggagctttggatgaaattttgagtgattgtgaggtttctagaggtggaggagacacctccactactt

SEQ ID NO: 81057 - DNA, 273 bp, Glycine max
  Peptide Sequence Number=SeqID_172742
atgtttgcacattcgattaaaggctgccgtcccttgggacggacgtgtggggtgctaataccttccccgtgcgtaaatacaactcccgaacctttcaacttaaaagttcgtagatcgcgtcttttccggtttttccgacgttttcctcgaataaacgttggtggcgactccgcgcgtattcctttcgtggaacacgcatcccgcgagtcacgcgtcgccctcccgccgaagggtaggttgcgacagcatccatgctggccaagcaatgattga

SEQ ID NO: 81058 - DNA, 363 bp, Glycine max
  Peptide Sequence Number=SeqID_172743
atgagaaaaagaatagaagaacaacctttaatggttaaggaggagtgtaagaaggtaaatgtctcctccaagagattagctaagaaggaaagtcattttgcaataaagacaaatattaaagaaacttcccttctaagacaacctccacatcttctcctttgtaaaagaacactttttagcactgtcatacctcttgagcttattgctattcctcaagtaaaggagttgttggatgagggtttggttcgtaagagcttacatccttgtgctttggtggtgcccaaaataggggttcccacagatcctaagagaataaaggtcattcctgagtggcctactccaccaagtataagggaaatttag

SEQ ID NO: 81059 - DNA, 357 bp, Glycine max
  Peptide Sequence Number=SeqID_172744
atggaactattccttttaagagatggacttagggaggaggaaacaacaagcatagctaggttccttagtgggcttaatatggaagtgagggacaaggttgaactccattcatatagggacctagatgagttaatccaactttgtataagagtggagcaacaacttaaaagaaagtcttcttcaaaatcttgtggccttcacttttatccaaggaaggaccaacccaaggaattttgggggctgcaccttcaaaacccaaggaagttaagggagactacttcttccccttcctctagtggaagtgaagatgaagtaaggggtgaagagtctattgaggaagtctacccccatgaataa

SEQ ID NO: 81060 - DNA, 363 bp, Glycine max
  Peptide Sequence Number=SeqID_172745
atggaggagatatatggagaagatgatgaagaacaagaaattaaaaacttcttaatcaatggtgtcctttgcttcttgatgatcaatgacagaagaatggagaaggaggaaaggttattagagacatcacttcaaggagaagatgagtcacgaacatgcttaccaccattggaagccatggataagaccttgaaggaagaaggtgatgtagctccatgtggagcttgtaggccttggatcttcttcattaatggagtccttttcttctttaatatcaatgtaagtggaatggagaataaagaaaggcgattggagacgccacttcaaggagaagatgagtcaagaacaagcttaccaccatag

SEQ ID NO: 81061 - DNA, 147 bp, Glycine max
  Peptide Sequence Number=SeqID_172746
atggataagagcttgaaggttggagaagatgagtggagggagaaagagagaaggagaaaagagctatggttcaacccactaatccaagatcaagtccaagattctctactaagtgtgcttaggggtcataaggcatgtaaagcatga

SEQ ID NO: 81062 - DNA, 561 bp, Glycine max
  Peptide Sequence Number=SeqID_172747
atgactagaggcaatccatctgacttacaaccctttgatcctgaaatagataggacatttcatagattagttaggcatagtgtgcatcttgattaccctgaacattttgtaccttttgagcatcctgagcattctgttattggtgagtctgaccattttgtggttggttattttgaacatcctgattttgagtattctgattttgaacattctgagaacataacacaacctccaccccgtgagaggactctaagggaaatggctgcacctgatttcacctacgaaagcttgtgcatccaataccctgatgaggatgtcccatatgttcttaaaactggactgatccatttgcttccaaagtttcatgcccttgcaggtgaagatccgcacaaacatctgaaagaattccatgttgtctgctccaccatgaaacccccagatgtccaggagaaggatcacatatttccgaaggcttttcctcattctttagagggagtgacaaaggactggctatattacctcgctccaaggtccatcacgagctgggatgacctcaagaga

SEQ ID NO: 81063 - DNA, 558 bp, Glycine max
  Peptide Sequence Number=SeqID_172748
atggctagtcaacaactaatcaatggaattaataaggaaagtgagaagaacaagggaaggaatgttggaccaaaagaccacacaaagggtgatcaaattgttaagaacatgtctggttctagtcgtgtagaatcaacacttgctaagggtggtgatattcaaataggaggaaagtccaactttaaaaataacaactcaactacaatcaaatacaagaagaaagctagtgaagagctagttatgttggttgctagcaaggagactcgtgatattagcaaaggaggggcggaggatatcaaaggggaagggcaaaagggtcattttagggattttttggtccctggctcacccaggctagcctctggctcgcctgggccaccaaataacttcatggtgaagtctagaggtgaaggattggggaaaagaagagaaaagaagaaggaagaagagaaaaagaagctaaatcgccgccgaaccacgactacaatcgatttctacatcgttcttcggttgtacttcattcattcttcatccgttcttcgttcttcatccagttag

SEQ ID NO: 81064 - DNA, 792 bp, Glycine max
  Peptide Sequence Number=SeqID_172749
atgagtacgacaaaatttgaaatactctcaagacaaccaaaggttacgcctctcctcaaccgtcgtttcatgaaggggagaagtgatatgagggtccaaccaaatgcatcttttgactttgagaggcttttaaaagcctatataaaggggataatatttcccctatttcttcatcttctttatgtttttcttctccctagcgcaagcttttcttctttggttgtctttgttttatttggtcagcctttcccttttgacattcttcctttctattctctagtcatttccatcaatctaggtacatcatctgcctatctcttctatgtctcattttgggagggagaggccaagtcacctctgcccattccatttcagggtgttgtcgacattgattcgaagaccatagtcgtgcaggtatcaagaagaaatatgattactagtctatcaagagggctcaaaccgagaaggccaagacaaagttgcaagaggccaaaaatgcccaagtggttttttatttggattctcctcctctacccgttaactctggtcgaccacgatatgctaagggaggatggtcctaaggcctccaaggatgccattgctcattttcaagcaaggacttgggggattgtcgagttttggtcggacgagtatgagaaggcctttcacgagtcccagaaagctcaagaagatcttacaaaggctgagatggagttagttgaacccaacaacactactgaaacccttatgcaatcaactgaggaatctcataagtctcttgaagatacatag

SEQ ID NO: 81065 - DNA, 4977 bp, Glycine max
  Peptide Sequence Number=SeqID_172750
atgtccttcaatcaatcaaagtccgataagagcgacgctgtgtaccgaaaatccgggcgatccggcagcttcaatcagcagcgcggtcccttcggcggtgcgtacggtaagggcggcggcggcggtgccggaccttctccgtcgctctcctctagccggagttttaacaagaagtctaataataatgcacaaggtgggcaatctagggtaaaccctactccggtgaattcgaccgagtctaatagtacttatgcagcccggactgtaccaaacggttcctatgtacagccgcagattcatggaggatcggatgcaccaattacaaatgcaactgccaagtcatctgaactgttggctgcacagaggagctccagagctgttccaaaagctcctacttctcaacctccctccatgagtcctgatccagcagctcctacaacccctgctaaggcagatgcatctaaggcattccctttccagtttggatctattagtcctggctttatgaatgggatggcaattcctgctcgcacaagctctgctcctcctaatatagatgaacagaggcgtgatcaagctcgacatgattctcttagacctgtaccctcaatgccaacacctcctgttccaaagcagcatctggtgaagaaggatacaggtgttgctgaccaatctaatgctggggagattcatactgggattagggcaaaaaaggatactcaaatgtcaccattacccccagcaagccagatgcagaagccttctgtcatttctttatctggaatgtcaatgcctatgccatatcaccaccagtcacaggcatctgtacactttggtggtcctaatccacagattcagtcatcggcacctcttcagatgccattaccaatgcctttaccgattggaagtggagcacaagtgcaacaacaggtttttgttccaagccttcaacctcatcctatccatcctcagggaatcatgcatcagggccaaagcatgggtttcactcctcaaattggccctcagttgacccatcagttaggcaacatggctattggaattagcccacaatatccaccacagcaaggaggaaaatttgctgctcgtaaaactactcctgtcaagataactcaccctgagacacatgaagagctaagacttgataaaaggacagatgcatattcagatggtgggtcatctggttcaaggcatcattctggcatgccttctcaatctcagcctgcccagcaatttgctgcttcccatcctattaattactatccatccagttcttacagtaccaattctctcttttatccaactaccagttctcttccattaacaagtagccagataactcctaactctcagccatccagatttaattatgcagtgaaccatggtccacaaaatgcaagttttataaattcatcatctcatagttctctgcctgtcaataaagctggcacttctattcctggcaatgctgaatctcctaatccagaaattttccaggatgtacataatacaatcttgtctgctccttcaggagtaacttctgtgtctattaagccaactggtggatctggtgttgttgtggactcatcattttccaattccagtactcaaaagagtggatcttctagttcttcattaacatctagtgatgctttcgaaacaactgaaatcacttcacaacagtctaaggtgtccagtgattcatcagttttgagttcattaccaagtttatctgctgcatctaccatgaagcctacatcagcttccttgttacttcctgcatctgctgtgagtgaagattccatttcagttctgcctaataatgaaggcggaaagaaggaatctcttagtaggtcaaattctttgaaggataaccagaagaaaatacagaagaaaggccaatcacagcatcaggttgctgtgcaatctccttctgtggttaatgtgcctttccaagctgttgacggtgatatccctgatgaagtttctgaaactgtaggaactaaaacaaaccattctgcggcaattaccagtgaagatctctccgctgctgcttcagacacgttatcagctaccattgagagcctaacttgtgctgttgaaatgaaaactaatgattctacacaagtttctgcttgtgcttcagctgaaggacctgttacacaagtgatggataatttgaacaatcataagattgctgagctagatgaattgtcacaccaggataaacccttacagccaaatattttggaaatgggtggtaaaacagaaaatttgtctcttcaaggaagtaaacaaagtgttagtgatggtggaacagaattaaaacaacctaagaaaggtactgtgaagttaagcactgagtttgtaaccttgaaaaccaaagaatctaccagttgtagtgcagaatgtgacacaacggctgataataacggcatgtctgtctctaccaaattggattccaaagatgtttgtttaaatagaaatgatagtgtagttagtaatgaagcggtttcttcaaattctggcacatcagatcagcagtctgctgatctcctagaagcaacttcaaaacagtgcaaggatgatagtgcagagaatgctggcagtgtttcagtgtctcttccagcatcaggtaccaaggacagaccaatttcagagtctagtaaggtgaaacctacatcaaaggggaaaaagaaacgaaaagagattcttcagaaggccgatgctgctgggtcaacatctgatctttataatgcatataagggacctgaggaaaagaaagaaactattataagttcagagaaaacagaaagtggttctacttctggaaatttagagcggttgccaactgatactgctcagccagatgctgtagcaaatgagcaatctaagcagagtaaagctgaacttgatgattgggaggatgctgctgacatgtctacacctaaactagaagtttcagatgaaactgaacaggttagtgatggaagtgcaattactgccaaaaagtactctcgagatttccttttgaaatttgcagagcagtgcactgatcttcctgaagggtttgaaatcacagcagacatagatgaggccttgatgagtgttaatgttagttcccatgtaattgaacgtgattctcattctactggaagaattattgataggtcaggtgggatgtctcgtcgtgggagtggtgttattgaggaagacaaatggagtaaagtttctaatgcatttcattctggtatgcgtttggatggtgtaggaggtaatgccggatttcgacctggtcaaggaggcaattttggtgttttaaggaatccacgcacacagacacctctgcagtatgctggagggattctttctggtccaatgcaatccatggtaaatcagggaggaatgcaaagaaatagccctgatggagaaaggtggcagcgtgctactagcttccagcagaggggtttaattccatctccttctactcctcaaactcctttacagatgatgcacaaagctgagaagaagtatgaggtgggtaaagtgacagatgaggaacaggcaaagcagaggcaattgaagggtatattaaacaagttaactcctcagaattttgagaaactttttgatcaggttagagcagttaatattgacaatgttgtcactctcaatggtgtcatctcacaaatctttgagaaggccttgatggagcctaccttctgtgaaatgtatgccaatttctgttttcatctagcagctgcgttacctgatctcagtcaagacaatgaaaagataacttttaagagattattgttaaacaagtgccaggaagaatttgagaggggtgaaagagagcaagaagaagctaataaggttgatgagggtgaggtcaagctgtctaatggggaaagagaagagaaacgtaccaaggcaagaagacgtatgttgggtaatatcagattgattggagaactatataagaagaaaatgttgacagaaaggataatgcatgaatgcatcaagaagttattgggtcagtatcaggatccggatgaagaagatattgaagctttgtgcaagctgatgagtactattggggagatgattgaccatcccaaagccaaggaacatatggatgcgtattttgaaatgatgagatcattatcaaacaacatgaatttatcttctagggtgaggttcatgttgaaggatgtcattgatttgagaaagaataaatggcaacaaagaagaaaagttgaaggtccaaagaagattgaggaggtgcacagagatgcttctcaagagaggctggcccaagctagtaggctgggtcgtggtccaggcaacaatccacctagaagaatccctatggattttggtccaagagggtcatctatgttatctcccaatgctcagatgggtggactgcgtggattgcctactcaagttcgcgggtatggttctcaggatgctcgcatggaagacaggcaaacttatgaggctaggacattgtcagttcccttgcctcagagacctttaggtgatgaatccataaccttgggaccacagggtggccttgccagaggaatgtccattagaggtccacctgcagtttcaagttcaactggtcttaatggttataataatttgtcggagcgcacttcatacagctctagggaggaccctgcatcaagatatactccagatagatttgctggttcgactgcttatgatcaatctagtgttcaagatcgtaatatgaattatggcaacagggacttaagaaatgcaaataggattcttgataaacctgttgtaacttcacctgccagagcacaagggacagcagcctcccagaatatttctgcagagcgactgcaggacatgtccatggcagcaatcagagaatactatagggtaggtttggttgagtggaagagaatggaaaggaaatga

SEQ ID NO: 81066 - DNA, 513 bp, Glycine max
  Peptide Sequence Number=SeqID_172751
atggttgcttctggaggaagcaacctagctcgcctgggcaagctaggtggcaagctcctcccctattttgctataaatagtgggaggagtgaagaaggaaagggttcagccttcttgacacttcatattcacttaaaattactgaggaaaattgtttacgtgaagaaaatccaagccgaggcacttccgaacgtttccgtgggtgatttcgcgaagattttcagccgttcttcgtcattcatcgtttgttcttcattgttcttcgatcttcaaccgacaaacgtgagaggtgctaataccttcctcaaacgtaaatacaactcccgaatctggaatattcttcatgaccggtttccttcggtttttccgacgttttccacaaataaacgttggtggcgactctgcgcattttcctcctttggaagacgcacccgtgagcatcgcctcactcgcccgcaaaagggtaggttgcgacagttggcgactccactggggactgtttttgtgagttag

SEQ ID NO: 81067 - DNA, 156 bp, Glycine max
  Peptide Sequence Number=SeqID_172752
atgacaaagacaacaatagatacctcagagccctacactggggcaatgagaggcaccatgcatgagcctcaagcgaacctaggggcagatcaaaatttttcacccagaaccatcgctaaaccagcgggaggagcaataccaacaacacatgcatga

SEQ ID NO: 81068 - DNA, 1509 bp, Glycine max
  Peptide Sequence Number=SeqID_172753
atggggagccttaaagccctaagtccggatgctaaggtggaaaaagttaataaaacattcattactttgattccaaagaaagatgaggacattggtttacccgataacattgtgcaactcattggtggttgtgtttctatggctttaatgagggttctttggaatgtgtctctttcaactcatttcgattgtagtggaccaaggagtttgacgagttctgggcaaaagattaaccttgataagtcaaggatgttcttttcaaagaatattggtaggaatctcaaacagcaaatcagttctgaggtggggacgcaatggacagatgatcttggaaaatacttgggattgctagcatttgctaggagagtcactcttgcaaagtctgtcttacaagctttggttacatacatcatgcaaactacccttttccccaagaagaggtatgtaaatcaggcctttatgttgagagctaattggcagttttgtcaaatggaagctcctatttgggcttctattttacgaaacaagtacagatgtggtgcagattcgttccctacagttgatagtaaaagggccgtgaatttttggcgtgattgctggatccctagaagctttcctctgattgatagctatgctgaggctattcctgaatcaaagatggagaagaaggtctccgattatgtggggattaatggaaactgtgatggtaactttgctttgcgagctgcgtatgaggagattattcacaaagcttgcaattgggttcgtgcttatcaagaagctgctgccatttataagtctatcagtgcctttaacctggtgcctggggaaattgctcttaattgtgatggtgctgttacggatggtgggaataaatctgcttgtggaggggctatttatttggggttgaagttggccggtcaagaggctttcgcaagatcagagtggattcatgctcgaacggaggaagtcgttgatgaggttgatagcaagggacccagatcaaaacgcggctaccatcgaggaggtgttggtgatgtggatgaggatgaagtgggagttttagctccgattgagatggctgcaagagatggggaactgagggtcttccttgttgcaagtgaagtttctggagactccaccgcttcctgcctcatggcttcgcttaagattctctcccctttcgctattcactttgctgcgaaaaccggtggagactacgcgtctccgctgtcatcgaagttgttctgcacatcctcctcaaacgaaagtcagtcatacaatgggttgttgaatgatgcagaaatcacgaacattgtgcccagaacgaggagcctctcggtgacgatctacccctgctgtctggaaagggacaccgcgaaggtgttcgggatcactgctagagaaccatggtggaggaaggtggcagacatggagaggatatcaaagcagccatggaaagtgacgatggcgacagtggcactaatgggagtgaaagaaggttggtga

SEQ ID NO: 81069 - DNA, 207 bp, Glycine max
  Peptide Sequence Number=SeqID_172754
atgaagtacaggagtagctacaggagaagtgtggaagggtctgctgcttgttatggagaagtggtatctgccacgggtgtcggagatgctggagtggcttcaagagacttttctgaggtggctgcagcttcctgggttacagctaccctcctcttcctgatcaagggctcaggagtggaagactctgatgactcatcctctggctga

SEQ ID NO: 81070 - DNA, 198 bp, Glycine max
  Peptide Sequence Number=SeqID_172755
atgtcagtgaaaaacctcgtcgggcacctaggaggagaccagtcaaggtcacattgttttgggagaatgctccaaccatgtgggatcggcacaggcttaaaggagcactcaaactgggtgacccccaaggcctatactccgaagagtccgtcagggcctctccctcctgattcaggtccaacccataaaacattttag

SEQ ID NO: 81071 - DNA, 261 bp, Glycine max
  Peptide Sequence Number=SeqID_172756
atggaagcaatttcatatgcatctattgttgggagtattatgtatgctcaaatctatactcaattacacataagttttgtagctagaatgttaggaagatatcaaagtaatccaggaaaaggaacattggaaagctgcaaagaaggtgctcagattgattctctgaaaggttgtctcagactgactgtcaagagtaaagagctcagaagatcccttaaagcccatttgaatgatgaagaatacttccctctaagtacttga

SEQ ID NO: 81072 - DNA, 603 bp, Glycine max
  Peptide Sequence Number=SeqID_172757
atggttgctgataaggtttgccctcatttaccagtatgggatgctgccaagaagcaaggattcgagctgtattacaaggcacaaatgccctataggcatatgaagatagtgtggatggattctaaaaaatcctcaacccctacctatgatggaagtgatgttgttgtgccacacaataatgtgcaattgttacgacctcttccctccattccatatagaggaaactacaacttgaagaagatgacggaagctcaaatgatagcccatgtgactccaatccatgaggctcaaaagaagaggagagctgaagctactgctgctaagattgatgagcaagaagctgtcactactgttcaagttgaagcatctgctaaagttatggatgacaccattattggtgaaacgtccaatgcagttatggatgatgaagttgaaccacttatttcggatcctgcgtctaagcagtcaacaacttccaatgatgccacatttcgagacaagggtgaccatgatgttgtaattgtatacttcacaagttctgttcctaccctctcaattatgcacaacccgtcactttcactcgtgatcaggttcaagatatga

SEQ ID NO: 81073 - DNA, 924 bp, Glycine max
  Peptide Sequence Number=SeqID_172758
atggtgattagcaaggtcggaagaatcaacatagtaggtaatagtaacatatccaggtttgatcaaccttgttggaagactagaagaggaggctggatggccctttgtggaattttgttgtgcataacaggatcagaagccatgtttgctggtcttgggcacttttcccagctatcaatcaaggtatggcttgtagactcaaagggtttaattgttagttcacgaaagaattcacttcaacacttcaagaagccttgggctcatgaacaggagcctattaacagtctcctggaggcaatcaaggtggaaaaaggtttgtccaaagatgataaggcgcagaaattacctctaaggcactggcttgaacctggcgtatgctggttattgttgccacctgtacaattaattgttgggattagtcatgtatcttgggtttctttgccttttttcattggtagcagtataggacttgtggattggtcatggacaagcagttatttgggtatctttcggtggtggagatatcttctattttatgttggcttcaatatcattttggtgtacatatgtcaacttcctattgaattccccgagacctttaagtggactttttaccactttgggttgttcaaactttctacaaagttagaatggtcagaagttttttctggtctttcacttctacttttctacattatggtatctctcttggccacacctttgactgcagaggtagctaagaggttgggtttcgtgaaccatatcgttgaagaggctcaattgttgaagaaaagtagggaagttgcagatgccattgtgaaaaataaccaagacttggttttgaggtacaaggcggtcatcaatgatgtcctcaagctagatcttggccgcacactttctcttgaaaaggtgagggttgtgtaa

SEQ ID NO: 81074 - DNA, 141 bp, Glycine max
  Peptide Sequence Number=SeqID_172759
atggcagcggaatggagaaggaggaaaagtgattggagacaccacttcaaggagaagctatggttcagcccactaatccaagatcaagtccaagattttccactaagtgtgcttaggtgtcatgaggaatgtaaagcatga

SEQ ID NO: 81075 - DNA, 336 bp, Glycine max
  Peptide Sequence Number=SeqID_172760
atggtgatgcccatattggggtctagagactttgtcagcgatagggacatgttttgcatgtacaaggtggtgatgggtgaaaaggaaaagcctagccaacccaaacctaaactcctcaataaaagaaaagacccacctccaccacattttaaccctaagtccccagaccacaaaccaaataaactcaagaaccaaccaccctcagatcctaaaccttcagaccctagaaattcccaaaagattaaggttctagactctaagtttgaacttgaatttgaaccaacacctaaggggccaaccatcaaaatcaaacatcctcaatctacaccatcttaa

SEQ ID NO: 81076 - DNA, 390 bp, Glycine max
  Peptide Sequence Number=SeqID_172761
atggaagaaacatatatgtttaggaacaaagtcagacaagctggacaaaagcgcgataggcgagaaagaatcaccaagactgactcacgcaagtcggacaagaggcacaagccggacaagtgccagcctttcccaaaaaggtccaagtacgagcgtcacacacccctgacagccaattgcactacaatcctcgaggaggctttcaacatggaagtacccatcaagctacctccgatgaaacctccctggacgagagacttcaagtgtatcaaccccatcaaccaagacgaccccatggttgtctccatcataatcgccaacttcatgttgtccaaggacctcatcaaccagggcagctccaccgacatcttatattggaagacattttag

SEQ ID NO: 81077 - DNA, 1563 bp, Glycine max
  Peptide Sequence Number=SeqID_172762
atgtcttcattcctatctgattccgccatcagcatgagtggcaatgattccgggggttcgattcagcaacccctgatggaccgggaggcctatgagattttgtgcccttttttcaacatctggcctagtgtgccggtcttcatgtttttcttcctgacgaagttgactaacaagattggttgggtcctggctgccaatgtcggggttgatggtttgccacttatgtttaacagggacggggatccccgcttcccgttctattggcagtttgaccccaccaggccctttctaaagcaagatgaacttgttggtgggactgtgccaccgtccatggtcccccctactattggagaagggggccaaccttctggtgaggttggccctgttgttggtattgtcgaggtcacccccaatgctccttcttctgttttggctaagaggaatcaagatgacgatgttggggtgtcaggccacaagaaggttgacgcctggttcgggtcacccttcaagtttacaagatgtgccttcaactctgcgcaaggtggtgtccttggaggtggagagtgccctaaggtagctaacaccaccatcgccttcgctgaagctgtgaggtcaaaccaccaactatcttccaaggttggtagtgtcttggccaagttgcttcgccaaggcattgcgacagagatggaaaagcttgccaaggtggttgcagagttagaggctgggctgaaagagttggagtccaagatgggtgagtctgagttgtgggtgtctaaggagagggaggccagtaaggagcttgaaggggagctgatagacatcaggcaggctgggttctttgccaatgacattgacttgggtctttttgaccctttcaaggacgtgaaggacgatgttctgctcgatgaggaagatattgctgtcgaggaagaagctgttaaggaggaggctagcgaggaggcacaagatgttggggccaatgaagcagaccttggtgatttaggaagcaaggccttggtggtcttgtgtgaagtaaaaagtgtaatttgcacccggttgaaggtcttgccaaacagtctggtggtagttcgttttgtggaacttggacttttgaatgtggttttcatggttcttaaggaaacgtactttgggttttatgaacctgtgaaactcaccaaggacgtgtccgtcctggattttggcgagactcgccaagggcagaccttggatttgatgagcttggtgtgtgtagtgtatgtgtcatgctcatgcatacatgtcactcatggagcggtatgtcctggagatgtggtgttgtgctcttgcatatgtgtcactactgaagtgtcatgtactggagacatgatgtcgtgctcttgcatacgtgtcactcatggagtgacacgtacaagaggactcaccaagggtgaaccttgggttttgcaagccctttggagaaacgaccagcgacgcgttcatcatggattttggcaagactcaccaagggaaaaccttgggtttgacgagcctgtggagctgggaccatggatgtacctgtcttga

SEQ ID NO: 81078 - DNA, 294 bp, Glycine max
  Peptide Sequence Number=SeqID_172763
atggagcttacatcatcacgtctccagtacgtgcccactccacgagtgacacaagcagcccggacaacacttgtccaggctgggaggcttaacaagcttgacaaacttgcaactctctcttgtcgaggccaccaccctcaacaccagatgacacttgcccatgctcgggggctcaaccgactagtcaacctcctacttatcaaggccactaccctcgacatcagacaatctccctcgccacaggacaatctccttcgatactggacaacctttttcacccgcaaggcggcttag

SEQ ID NO: 81079 - DNA, 690 bp, Glycine max
  Peptide Sequence Number=SeqID_172764
atgggcctgggccgcggcccgatctccttcacctcccagctcagtaacacaaacacaaaacacaccttctcttactgtctcctcgactacaccctctcccctccccccactagctacctcaccatcggccccaccccaaatgacgccgtttcgcagaactcattcacttacacaccgttactcactaaccctttttctccttccttttactacatttctattcagagtgtttccgttgacggcgttaggttaccgataagtgaatctgtttttcggattgacgcccacggtaacggcggcaccgtcgtggattctggcaccacgctcagttttctcgcggagccggcttacggaaagatcctcgcggcgttccggctgcgcgtcaggcttccggcggtggagagcgcagccacgctcgggttcgacctttgtgtgaatgtctccggcgtggcgaggccgaggctgccgcgtctgagattccggctcgccggaaaagcggttctgtctccgccggcgggaaattattttattgaaccggcggagggagtgaagtgtctcgcggttcaaccggttcgaccgggttctgggttttcggtgattgggaatctgatgcagcaggggtacttgtttgagtttgatttggaccggtctcggatcgggttcacgcgtcacggatgcgcggttcgctaa

SEQ ID NO: 81080 - DNA, 306 bp, Glycine max
  Peptide Sequence Number=SeqID_172765
atgaatgagaagttgtgggatggaactcagaagccgtcaaatatttcagttaatttggcactccagcacctcttgcatcaggcactctcgtgggaattttattgctgccagaacacaatgctatcagggagatctttcacctcaggaagcagaggaaatagcattgcttacagtggtgagttgtgcccactccaccgacgagacccctttgcctccttttctctttatgccactgcacatagggttggaaacacgtcaggtcaagccaagctaagcctaactaggtgtggtcttagcctgaattaa

SEQ ID NO: 81081 - DNA, 1554 bp, Glycine max
  Peptide Sequence Number=SeqID_172766
atggggactgttatgcagaaaatatcagcaatcttctcaagtctggctggactcataaaaagtttgtgtttgctcttgtatacacaactaccttatgatttgacaactgatgaagtagggacaaaatctaaacaaagaataaccacagactgtggggaaataattgagttagttgataagctgacaacatctgaagcaggtttagagtcaacccccttttctagtgatattggtcagcaaaatcccaatttactagatcttggtgatgcctataagctagctgtcagtaacagcagaggaagacctggcatgcttgtagaacattggcttggaaaggattctacaagaattagtgaagatttgaagatattgctgtcacaattttcagctactcgagggactgatctgtctgttaatgatatcagtcctagattgtctataaacagtgatgaagtgaagacttctgatgtttctaactctgctggaatccagatacttcaaaaaatgatttcacttgagcgaaatgaatatggtttgtctctagatggaagccttgttagtgaaattgaaggtgaaagcgcagtcgacaggctaaaaagacaagttgaccatgacaggaaacttaatgctttgtataaagagctggaggaagaaagaaatgcttctgcagttgctgcaaatcaagcattagccatgatcacagggctgcaggaagaaaaggcaacattacatatggaagccttgcaatacttaagaatgatggatgaggagtctgagtatgaaacagaagctttgcaaaaagctaattgccttcttgttgagaaggagaaagagatagaagagttggaagctaagcttgagttatataggaagaagttccctgatgaatcagtgctggaaagcatggtggatacaaactctgaaatgaaggatgaaagtatccttggaaagtcagtttctgaaaatactaatatatctgacaaatctgaagttctacccacatctctggaaaaacagaatgttcaatctgtaaaaaattcaccattggagtttcaagatgaaaggttatatatttcccaacgtttgaagaagttggagaagcaagtttactttttcctgaatattcatcaatctcgggataattggctaaattctgaaaacgatgaaaaggaatctctggaaaattgtgagaagttggataataatattctaatgcaagaaactgtttgttctcctaaattaaattcagatgacatgggtgatgattcctcatccaaggaacctccagtttgcaagcaaaatggtgaacttggatacaatggacatagctcccctgcgctctgtaggaataatgatttatcttctactggtagtttggtttcagattttattggaaggttgcaagttcttgaggcagatttgagtttccttaagcatagtatcaacttatcgagcaatggagaagaaggacttaaattattgcaggaaatagctgatcagctacaacaattacgccagattgggataagagaattagatcaaccttttgcttga

SEQ ID NO: 81082 - DNA, 429 bp, Glycine max
  Peptide Sequence Number=SeqID_172767
atgtccttttctggggagggttctatttgctctggtgacagccgaatgttgttgttggaggtccgccttataagagagagtttcaacgatgatcccgcccaccttcattgtggttctaactttgctagcgaccaatcctccgacattcgtgtaggtggcgccatcgttggtggtgtcgtggtccctctcagcgctggtgtcgtcgcccctacgggtggcattgccactggaataaggcctcatccctattttggtgtgcgttcgactcttatggaggatgaggctgaatccactcggccaaattggagaaaaaggaatcgcatgaagacagtacaagtggaggattcaatctcttctccgtctctgatgtttgggaattctatcggagcagtcggaggaataactgaaggaatctcagggaaccgttag

SEQ ID NO: 81083 - DNA, 446 bp, Glycine max
  Peptide Sequence Number=SeqID_172768
caaggaatcacgtattccagcagatttaaagtacttttccagttttgccttgtcatggatcttttcatggcaatacagatacggaaagactgaaaacagcaagcaatatccaccgttacagagacacgcctttgtaaaatggtggtcacaattcgatacttcaaaggctgctccagaccaagtcaagaactggttccagagcaatcctgagttccttaaacctgctgatccggagacatctttgtttctaaatcagaagtcgcaactggcagcattcttagcaagctcaaaatctaaagagagtcttgctcagaatctcaaagaagttctccaactacttcaacaggaagtggaagaagaaccttccaagaaggaagctgaatcatctgagactaatgatgaccaagaagatgatccattctaccagaatgaagaatactgttttg

SEQ ID NO: 81084 - DNA, 306 bp, Glycine max
  Peptide Sequence Number=SeqID_172769
atgaacccaaggaacgttggtcccttgtgttcaatgttcaaccaagaagaccttctcttgaagacagtcaccaagagtaggtctcttgaaaagctttttgctgatgcaatgatcgcctccggacaagtttacacacttatagcaaccaaattcatcaccgaagaagaaactaagtccaacactcactttgttcaacagtttgaccgccaaagatttcaatttcaagttgaggaaagagtgaatacgagaaaggtgtcgaatgacgaaattcactgtcaagctgaatcaaagaacatgcgattgtga

SEQ ID NO: 81085 - DNA, 404 bp, Glycine max
  Peptide Sequence Number=SeqID_172770
aatgtgataactcactccccgtgtgctatttgtgtttggatcctgtgatgatctcaaactttgtgttcgtgggagcagatggcccttttctttcgcttcatcatgtatcgggtggtggtgccaccaacaccgccagtggtagcgtcgggctccgggttttcgtcattgtcgacgacgatgagggtgatggggatcggggaggcttagggtttcaaggaattagggattggtctgtggtggtggcggttcttgttgtgggtaatactgaggtgacagagaacgaaggcatgggtttggtatttggaagagagaagggaatggagtggataatcacttttgtactctttgaacctcctttggaagctggcggcgaccatggcctttacaaggaagaagatggatag

SEQ ID NO: 81086 - DNA, 345 bp, Glycine max
  Peptide Sequence Number=SeqID_172771
atggccacagtggtcgcgttagcagtcgatccgagcctcgtccctgaaaagaaacatcaattcgaaatcgaaattggcacgcctcctcctcctcctcctcctcaaaaccctagattcgaaaaccctagatcaggcgcggcgtcgcagatctcctcctccaatccgccatcggggaagactttgatcagagtagatttctttgatggtcgcaacttagattgggcaaaatcagaagataaggcttatggtggccgaaatcaacctccgtggcagcggagcagagagactgagggagcgaggtcgagcaaaggccccagagtaagagtgcggagggacctcaattag

SEQ ID NO: 81087 - DNA, 120 bp, Glycine max
  Peptide Sequence Number=SeqID_172772
atggagaaagaaacacatacaaagaccacttctcagggagatgaatctcagaatgtatcgagtccctactacctccatcctggagaaagtttaggaattgtagatgcaattgcttttgat

SEQ ID NO: 81088 - DNA, 498 bp, Glycine max
  Peptide Sequence Number=SeqID_172773
atggcatctagggtcatcgagcacaagcttcgtactgttggtaaaatttctcaatcccccacttcattcgttcttttgtttttcctcattcacgggtgtctatggcttagtggtattttgggttcaatcgcttacaattggtctcgacccaacatgaaaactggtgttaagatcattcacgcaagctctccacctgacaatatctttttgcagtttttgtggtttttatttggatcagggtgtctgtggctcagtggtatgtcgggctcaattgcttacaattggtctcgacccaacatgaaaactggtgttaagatcattcacgcaagttcctgttacgggaaagttcctattactcgcaaagtggagggtacatccacttggtttttcaaagagaacaagggagggtacatcccttgtggatctttggcttgtaaaggattttacaaggttgaaagaaatatcaagaaccgcaggttgcttggggactggatgtag

SEQ ID NO: 81089 - DNA, 312 bp, Glycine max
  Peptide Sequence Number=SeqID_172774
atgtctcctccacctctagaacctcacaatcactcacaaactcatctcgagctcttaggacgacttcctcttcaagcttcgttctctgcaggtggcattgttggtgcttgcgcgcttagcgcaactctggctcgcttagcgcgcattagtgaatttcagcttagcgcttatctttttgctcaacggatggactcaagtggtgcgcttagtgggattagccctcgctcatcgaacatgcacaactcatccttcttccagattcttcctcgcgctcaaccaaaggagtgttgcgctcagcggatggctctctaa

SEQ ID NO: 81090 - DNA, 531 bp, Glycine max
  Peptide Sequence Number=SeqID_172775
atgcattttgagtaccctggacagtacataatcccctcaagctctgagccagcttgtgggcaaaagaggttgtccagtgtcaaaggaaattgtctgatgtccggggtagtagccttaacattaacaagtctatcatgcttgtcaagccctaggcctggacaagtgttgtttgggctgcttctgtcaagttgtccgaggtggacatgcttttggttttgcaggcgaggtctgacgtgtcaggaggacactcaccacggtgcttctgacagtgaatcctcttcctcagagaggttgagggtttcgtgtcgtgttggtggaggagcttcttgcctctatgggagggtgcaaccttctgttgcttccccgaccggggagtctgttccgattactatgattctcccccttctacttcaaggggaccaaggaacaatggtggcggggatgttaggatgtccccccgtgtgtggcatagccatagtgcttggtcgacatcgtttgagacaccctttaccccatacatatatgtactaa

SEQ ID NO: 81091 - DNA, 750 bp, Glycine max
  Peptide Sequence Number=SeqID_172776
atggttctattccatctacaagaaggtgagattatgttgagaaagtggatgatggaaagagatacactaggatatagtgggaagagagttgggagcttggggattggtgtacgttgtatccatatgtggcgatcactcccgattgtcatccacataaacataaatgtaaaagatcatcaagacctaggaggctttgcggcaaaggagcagaggactcatccctacaaccaacaactttcaggtattgatgatgttgaggatgtcgatgcccttacgagcttagtatgtttgcctgtacttggactggaggaacctcgtcatgacttggagttcaagttgacttcggtggggtatgatagacaaggcaacgctttcagctaccatgtggagccagtgagcataattgaagtaaccgaggatagaggagaccattcggataagacgttcgaggagattaaggagaacaaagaacttttgcggcaactagagcctttgtctgaggagcagtgtgacgatcctcctaggacatctcttagatatttaccatgtcattccatacttcacaagccacatgatcgacatatgaggtcaatagtaatgtgtcctcaggggcaccaggaaacagaacgggtggttgtggctcctggtgctccgcatgctacgcatgaccaacattctctacaggctccacttgcgcaacaggatccaaaggctctatcacttgagcttctacatgtcacctttgattag

SEQ ID NO: 81092 - DNA, 246 bp, Glycine max
  Peptide Sequence Number=SeqID_172777
atggagggtacgaaaacactcaacgagcttggagccatcgtctccatagaacatctaaagatgaagttctccaccttgatgggagagatcatgactgtcaaggcagatcaaaagcacgcacaacagtgctacgcggaaagcttgaaagtggcactctatcctcccaccagggagcctgccaagctttaccccacagcagatggtaccactcaaatcatgagtgtggacgaagggtctccagtctga

SEQ ID NO: 81093 - DNA, 897 bp, Glycine max
  Peptide Sequence Number=SeqID_172778
atgatcctcgttgaagttagggaaccgttgataaagaggttgtttttccaagaacaacagaatgaagaaaaaagggaaccaaaggcttgtcaaaccaagggtcgtaaaacccaaggtacacccttggagagtctctccaaaacccaggacggacgcgtcattgatcagtccaaaggctcgcaaaacccaaggacgaacaattccttggttggttctccaaaggctcacaaaacccaaggtccgcccttggtgagtctcgtttctccaaaggctcatcaaacccaagatccgcccttggtgagtctcgcttctccaaaggcttgtcaagcccaaggtcagtccttggtgagtctcaattctccaaaggctcgcaaaacccaaggtccacccttggctcgtaaaacccaaggtgcgccctttgtgagtcttgcttctccaaaggctcgtcaaacccaaggtctacccttggtgagtctctattctccaaaggctcgcaaaacccaaggcttgcctttggttagtcttgccaaaatccaggacgaacgcatcgctgatcgtttctctaaaggctcatcaaactcaaggtctgcccttggtgaatctcttttctctaaaggcttgtcaaacccaaggaacatcaaaatcccaaggtccgcccttggtacaaaaacccaaggttcaccattggtacacactcttacaaaacacaaggcacccctttggtcagctcactccttaaggaccacgacgaccacagtcaaaggtctaggttccacaaggaaaactaccattagactagtcggcaagtccttcaaccaggtggaagtcatactaactccttacaaccatcaggggaaaagctccgcaaaggacaaggaaacaccactagatgagtga

SEQ ID NO: 81094 - DNA, 1089 bp, Glycine max
  Peptide Sequence Number=SeqID_172779
atgaaaagagaaaaacatgtctcctatagtagtcataactcttgcaagagcctaagtgaagaacttcgtgactattatgaagtaaggcataggtcacatcttagaccttactcccataggagagaaaatgaaagaaagtctcaagaggctaacattaacctctcatacttccatgggaaggacaatgtagaggcttacttagattgggaaataagggtagagcaaaaactaaaaagaaatactactttaaaatcttatggctctcattcttatccaaagaaagaccaaggtctaggcatcttaggggtagcaccttctaagaccaaagataataaggggaagacaatagaaaagcaaccccctaaggctagtatgcaagaaaagattagctctataaagtgctttaaatgtcttggaaggggacacattacttctcaatgccccaccaagaaaaccatgattatgaggagtcaagacatttatagtagccaagatgaggctactacttcaccttcctctagtgaaagtgaagaagcaaaatgggaagaatctagtgaagaaatctacccccaaaaagaaggacaacctttaatggttaaggaggagtgtaaggaggtaagtgtctcctccaagagattagctaagaaggaaaggcattttgaaataaagacaaatattaaagaaatttcccctcttagacaatctcaacattttctcctttgtaaaaagacacttgttagcattgccacatctcttgggcttaagtttattcctcaagtaaaggagttgttggatgagggtttggttcgcaagagcttaaatccttgtgctttgttggtgcccaaaataggtattattaggcaccaaatccctaaaataggtggtatgatgaatgttttgagtggtgcaaccctcttttgtaaaatcactcgtgcacccaacatcttcatgatttgtgtacatagggactcattaggtagtgatcaaggggttctcatgaaccctaagagaataaagatcattcctgagtggcctactccaccaagtgttaaggaaaaaagccagagtttcaagaatctcgggatttga

SEQ ID NO: 81095 - DNA, 297 bp, Glycine max
  Peptide Sequence Number=SeqID_172780
atgaggtgtctccgcatgtcatcggacttgctgtctccggatgacgaaggtgagactaaagtagtctcggtgttctttcaccaagccatcaacaccaatgggcgaggtgtgcataaccattctcgcaaggaatccaagcaaaggaagaagaaaagaaagaagaagagaaaaaaccagaggaataaaaaagatgacaaggaatccaaggaggaatctgcgccgccagaaatcgtgcaaggcataacctttgcaatgcatggacactttaagcacgatttctggcatcttttaagttag

SEQ ID NO: 81096 - DNA, 216 bp, Glycine max
  Peptide Sequence Number=SeqID_172781
atggctaggagactccagaaagattgggccaggaatgcaagagaaggccctagggttctcatgagccttaggtggtgtctgcaatcaccattcctccttcgccattccactgccattgatcttcaagaagcaaatgactccattgatgaagatgatccaaggcctacatgctctacatggagctacattatgtggtatcagagcatcatcatctag

SEQ ID NO: 81097 - DNA, 135 bp, Glycine max
  Peptide Sequence Number=SeqID_172782
atgttggaaaaaccaaaagatgatggtctgcgtattttgaaaatgacgggttcgggagttgtttttacgcacagggaaggtttttttatgcattatgcggcagagagtgttaagcacctcaaagtggtcaattaa

SEQ ID NO: 81098 - DNA, 183 bp, Glycine max
  Peptide Sequence Number=SeqID_172783
atgtatagacaacaaaaaagtctgtatcaccctatctacttctctctctcgacaacggagtggaacgcgggggaaaggaacagacgtgaggggatgacatggagagaagggaaggaaggggtttgggttgagcggaaggcaaaggagaagaggagaggggaggcaccatccactagggaataa

SEQ ID NO: 81099 - DNA, 435 bp, Glycine max
  Peptide Sequence Number=SeqID_172784
atggaggacggcgtaggaagaggtttggaatgcccgaagactatggatgggaaggcgagtaataggaatgggttagagaaggatattccttcttgttgtctgaaggctagggctccaatccatgagtctgaggtgaagtgccattccactgttgtttctgggtggttctcagcttctcaaacttgccctgagaaatttaggaaatctgtttacttcaacaacctaatgtggccaggggtacttcctgatggacaagaaatagaaataaagagactttctagtagatcggggcaagggttggtggagtttaagaatgaggctgaacttgtagcaaaattgcagcatactaatcttgaggttgcccttgaggagatgaagaaagaacttaaagcaaggccgaagagtgggaagtggctacaagtggagaagagatga

SEQ ID NO: 81100 - DNA, 210 bp, Glycine max
  Peptide Sequence Number=SeqID_172785
atggaagaaagtgaggcatcacaaggtgtaatggggccagattgcaatgcaaggtgggatgttgctattgatgctcctcaaccatgtctacatcctgttgatccttttgtggttgttattgttgtggttactattgctcaccatgtggttgttgttgccgtagtgggttgtgctcattatacacataaccagtcgcctgatatcgaatag

SEQ ID NO: 81101 - DNA, 558 bp, Glycine max
  Peptide Sequence Number=SeqID_172786
atggttgaagtgttaataaagtatttccaggctctcttcccaaggtctaatcttattggtgtacaaaaggtggcggggggtgtaggaagaagacttaccgaggaaatgcttgaagttttaaatgggagcttcactgaggatgaggtcatcgaggaaggtggggtgtggagaatagggaacgagcataactttgatgcatcaaagcaagatgggttcctttctcccgcatgccagcctatgattgtacatggtcttgaggaggaatttatgatgcacaccctggtgtcctacataaaggtgcaaaccttttggttttcttctcctttggggttgtgtattgatgttgaaagatttactgattttcaagagtggttggcaagttgtattagaagcgctaaggaggaggagaaggaggaagcgtcccgtgggagtatcgatgtatttgagactccagttatttggaaggccccccgtgcaggcatgtacaaagccaattttgatgcttctgttagaaagggtgttggtgttggaatgagattgatattaagggatgactga

SEQ ID NO: 81102 - DNA, 204 bp, Glycine max
  Peptide Sequence Number=SeqID_172787
atgaagaaacaacaatggaagataagcggaagacaaaggagaagaggtgagaagaggtgccatccactaggaaataagccatggaagaaggagcttcgccaccaagaatgtgccttagataagaagcttggagaggatgcttcaatggaggaaaagaaagaaagagagaaagagagaggggggagcacgaaattgaaggagtaa

SEQ ID NO: 81103 - DNA, 678 bp, Glycine max
  Peptide Sequence Number=SeqID_172788
atgattgatcagtggaacaatcgccatgcttttagggtcgacgcttatccccgacaagaaggcctattgagctttaactcggactacatggtctggtataggcgaaagacaaagatgtttgttgacccacaaaatgcaaacacgactgcattggctgaagttgcggagacattacaatacatggtgtctcctcaagggaggaatacatggacagttgatgatctcgtgccttatgtggagaaaattacaattttatccgaagagcaagagagaatcactgagccagtgtcacatggtcctgcatcagagcgtcaatttctcgcacagcattatcacattcttcaatcaagtgttgaaactcagggcatagccagtcgaaggaaggctgttgaagcggaagaatattcccaaaaaatggcggagcatgaccatggaatgtattacacgccacaaacatttgctcagtatccgacacagatgtatcagtatccttttcagggtcatcacactgatacttctgcaagccagcattcgttcggtggtgttgcggaaacacaatctcatttttcatggcctaaagaaatcctgatcgccaagcacgaagatgggatcgaccatgtggcacattctcacggcatcacggacaccaaaatgaatgatttgcatgtctccgtttaa

SEQ ID NO: 81104 - DNA, 664 bp, Glycine max
  Peptide Sequence Number=SeqID_172789
atgacggacaccactgacgatatagcggaggaaatctccttccagggcttcgaagatgactgcaaattgctagggaaccttctcaacgacactctccagcgagaggctggctccaccttcgttgacaagctcgaaaaaattcgagtcctttcacagagtgcttgtaatatgagacaagcgggaatggaggacatggctgagatgctagagaagcaattggcttcagagttatccaagatgacattggaagaagctttgccccttgctcgtgcatttagccaccatcttactttgatgggtatagctgaaacccatcatagggttcgtaaaggaggaaatatggttcttactgcaaaatcttgtgatgacatctttaaccacctgttgcaagatggggtttctccagatgagctttataacacagtgtgcaagcaggaggttgaaattgttctcactgctcatcccactcaaattaaccgtcgtaccttgcaatacaaacaccttaaaattgctcatcttttggattataatgatcgacctgatcttagccctgaagatcgagatatgttgattgaagatctgggtggtagattatcttcaaatgtgaaatggacggatgagcttacgcgttcaaaacccacaccagttgatgaagctagggcgg

SEQ ID NO: 81105 - DNA, 168 bp, Glycine max
  Peptide Sequence Number=SeqID_172790
atgaagtctgagagtgctaaggagatggactcaggagagttgattggaatgggggaaaaaccagggggaacactaggtgcaagagaggagtgggaagaagaatgttgggatgatggaggagtaggactagtagatggtggggacagattgggactaagactgaaatag

SEQ ID NO: 81106 - DNA, 192 bp, Glycine max
  Peptide Sequence Number=SeqID_172791
atggttgattccccacggacgaataagatgactaaacaacaaagaccaacgaagtgtgatccgtcttattgggagtatgtggatgcattacattcggtgaaaaatagctcatccacacttaaatgttctacatcatcatttgaacaaacaaaaccgaagaggaagatgccaatgttggtgcaaaatgcttag

SEQ ID NO: 81107 - DNA, 666 bp, Glycine max
  Peptide Sequence Number=SeqID_172792
atgcaatgtggtaccttttcagtgaaaaaccttgttgggcgcccaagagtacatgacaagacaaaccacacactgcccaccactgctcattttccactgttgtactctacgaatgatcataaagttaagaaaacatacattgcccttggcatcagtcctcctcccaactgggaacaagtcaccattagagtcagtcacgaaggtccaaatttggcatctggcaagtctatgttgtatctgatgttggactcatgctattgggtggttttgttgttctatccatggagacttccttcgaggtgttgccaatcaacagataaagggagcttcaaggaggtggtgttgtgtcgtagtgatgatgttgggtggggcatagtgttgggtagggcgcaatggtgttggatgactagggttgtgcaaggtgaaggaagcataaaagaggacgtaggaagaagagccttaggtagacaggttagtggtgatgagaaagaagcccctcagcatcgaaggccgacaacatcgacacatagacaatgggcagttacagttgttgcagaggatgttgagaatatggataatgttgctaacgtgtctcatgaggagccttacgattcagttatagagaatgtaggtggtgattcacaggattttccaagtgggccctag

SEQ ID NO: 81108 - DNA, 138 bp, Glycine max
  Peptide Sequence Number=SeqID_172793
atgccgagtacacgattacttgttatgaagggtgttctgatcaatgagtatcaaggaactccaaatgtttgggtattcagacatgttgaatacttgaacactgatgaggaatggtttagggaactagcattgttatga

SEQ ID NO: 81109 - DNA, 150 bp, Glycine max
  Peptide Sequence Number=SeqID_172794
atgggggtagcagcggtgaaggtgaagtttccggcgtcaagctttgcggtggttggtggtcagtggcgacaaacgaggtgtttgagtgccgagaggatgttttgcggtgggctcgatccgtggctcatgaaaacggatttgtggcgatga

SEQ ID NO: 81110 - DNA, 252 bp, Glycine max
  Peptide Sequence Number=SeqID_172795
atgttcctcgtattcaacagtgcttttaaaggacttgatgatactccacaacctaaatccaaggctggtgcttggtggattgttgttaagtgtaatagacaaaaaggaagcactgagtgcggctattacgccatgcactggatgtccacgataatcttaggaactttcaggaataattgggaaacgtattttaacgatgttagaccattggaagcaaagagattgaagtcacttcgcatccactggacatag

SEQ ID NO: 81111 - DNA, 147 bp, Glycine max
  Peptide Sequence Number=SeqID_172796
atgccctgcaccactacgactttcaaaacggacgatttctgtgaacgcatacgggagattcaagttgtaggagacaatttgggttgggggtgccttgtaaggagttacatgcagatgactagtaagcaacaaaagcgagaggtatag

SEQ ID NO: 81112 - DNA, 396 bp, Glycine max
  Peptide Sequence Number=SeqID_172797
atggacgtagctgaggagtcgcgtggtataacacaagtgaaactgtcgcaacctacccttttgcgggcgagcgaggcgaggctcacgggtgtatcttccaaaggaggaaaatgcgcggagtcaccaccaacgtttatttgtggaaaacgtcagaaaaaccgaaggaaactggtcatgaagaatattccagattcaggagttgtatttacgtttgaggaaggtcgacaaaagcggggcttttgctcctatgtaccctctatcgaagaggaaatcagacctacgtatttctttctaaagggaaaatcaagcgattctttttacttggaaggaggtctttttaaggcgttggaccttaaaatgacccatttttacttggtgaaaaaactgaggtattga

SEQ ID NO: 81113 - DNA, 414 bp, Glycine max
  Peptide Sequence Number=SeqID_172798
atggttacaaggctacaagatgagaaacttaataaagtgatactgaagttagcagatgcaaaagttgtgttgtggtccattcaagaagtgtgctcaaacaaggaagataagaaaaacacagaaaatttgtcttctgtaggtaggaagagaggaagggtgaaactaaagaagttgcccttaagcatttgcacctccaaagatagggcacagccaatggaaggtgtgagagctagaagtgctccattgactgagatgaacactggtggcaatcatcatcctgttggtaacatccctttgtttccaatggaaccatcgactgaaagagtgattccaattgaggctacaacaacatgcaaatgccaggagttcaaagcaccggcttgtatcaaacagaataaagctgtgcaatcataa

SEQ ID NO: 81114 - DNA, 219 bp, Glycine max
  Peptide Sequence Number=SeqID_172799
atggatctggggtggactcgcatgcagttcccggtgagacagaagtgctgtggttcgaaaactgttgtaacaatagtttatggcaaaccgaaaaaattattggctgagtcacggacaatgtcgctttctttaagacgtttcgtggcactgccaaaaattgtgcaagcagactatcaaccacgacgtccccaggataaaatagcccagatcactgtataa

SEQ ID NO: 81115 - DNA, 267 bp, Glycine max
  Peptide Sequence Number=SeqID_172800
atggacatagactatgctataaggaaagacgaaccaactgcaatcactgatgaaagtagcccagctgatgttgcgctatatgagcggtgggagcgatccaactggcttagcgtgatgttcattaagaacaaaatctcggctgagatacgtggttctgttgatcaggatgaaaaggaagaagaaaggcttgtaatggagatgggtgagagtgcattgctgaaaactgcttatgggaagaataaaataactaagtctcaagctaattag

SEQ ID NO: 81116 - DNA, 1593 bp, Glycine max
  Peptide Sequence Number=SeqID_172801
atggcagtgatggctgaaaaatggagaaagatatggaaactgcaagaatacaccacaaattgggtgagaagaggtagggctggtcgtgtgcagccaggagaatgttaccacctttaccccaaatgtgtttatgatgccttttctgaatatcaacttcctgaactactgagaacacctttgaattctctatgcttgcaaataaaaagtttgcaggttgagagcataggagggttcttatcagcagctttacaggcaccagagccacgggctgttcaaaatgctattgattttctcaagatgattggagcattagatgaacaagaaaatcttacgaatcttgggaagtttctctctatgcttcctgttgatcccaagcttggaaaaatgttaataatgggagctatatttcgatgctttgatcctgttcttacaatagttgctggccttagtgtcagggatccttttcttttgccccaagacaagagggatttagcagggacagcgaagtctaggttttctgctaaagattacagtgatcatatggctcttgttcgagcatatgaaggatggaaagatgcagaaagagaagggtcggcttacgagtactgctggaggaattttctatcagcccaaactcttcaggctattcattcacttcggaaacagtttagctttatcttgaaagaagctggcttggtagatgcagaagctaacgtcattaacaaattgagtcacaatcaatctcttgtgcgtgcagtcatatgttctgggctctttcctggcatagcatcagtggtgcacagggagacatccatgtcatttaaaacaatggatgatggccaggttttattgtatgctaattcagtgaatgcacgttaccagaccattccttacccttggttggtttttggtgagaaagtcaaggtcaatgctgtttttatccgtgattccactggtgtatctgattcaatacttatcctttttggtggtgctctaagtaatgggatacaggctgggcatctgaaaatgttagatgggtatgttgacttcttcatggatcctaatttagctgacagctttttgaagcttaaggaagagctcaataagcttatccaaaagaagctggaagatcctagcattgacattcacaaggaagggaaatacttgatgcttgctgttcaggagctggtttcaggggatcaatgcgaaggaagatttgtatttggccgtgaaagccggaagcctaaggcctccaatgatgaaaacaaattcacaaaagatggaacaaatcccaagagcttgctgcagactctgttgatgcgagcagggcactccccacccaaatacaaaacgaaacatcttaagacaaatgagtttagggcattggtggagtttaagggaatgcaatttgttggcaaaccaaagagaaacaagcaacttgcagaaagggatgctgctatagaggcattggcttggttgactcacacctctgacaataaccagcatgaagatgataagtctcctcctgatgtaactgacaacatgctaaaactcctagggaagcgtagaaaatcaaagcgaggccatggttga

SEQ ID NO: 81117 - DNA, 918 bp, Glycine max
  Peptide Sequence Number=SeqID_172802
atgcgcaattcaaagttgtgtgcagcgtctcttcttatagcacgggccaagtccctccaacttcaccaccgccacgtgcgtcactgcttccctccattttcttcttcttctgcaacctcaatctcactcttcaggtttcatcacccttggctctcttccttgtgcaacgcgaaatcactcatcaccacgcgcctcttctccagctactactccctcgaacagttctccgatgacgaatacgactgcgacttcgagaatcaacaggcatcgtctacagtggctaatgtggatgagtggaaatggaaactcagcatgttgttacgcagtgaaaaggatcaggagattgtatctagagacagaaaagataggagggactatgaacagatagctaaccttgccaaaagaatggggctttacagtgagttgtttggaaaagtggttgttgcaagcaaggtgcctcttcctaactaccgtccagatttggatgacaaacgtccacaaagagaggtggtgattccactaagcttgcaaaggagggttgagggtttgttgcaggaataccttgataggcttcagttgaattctgcaaagacaactgacagcctagatgatgtgaattccaccaatcaagttaaagatataaacatggatgaaaatgctgattcttttgtggatgaatctgttatggaaaaggttctccagaagaggagtttgaggatgcgtaatatgcaaagagcttggcagagcctaagtgtggagaacacacttgaggatttccattcaatcatctctagttacattcaagttggcatcaaagggggaacgatcctgctctgcttgattatcaccgacgccaccgccgctgtcagtccactgtttgcttccgccagccaccggctacagctctggcgaaactag

SEQ ID NO: 81118 - DNA, 204 bp, Glycine max
  Peptide Sequence Number=SeqID_172803
atggcgtcaattcatcatgccccttatgccctgggcgacacatgtgctacaatgacagaacaaaggatcgcgatcccacgaggccttgtacacaccgctcgtcacactatgggagttgcccatgccagaattcgttaccttaaccacaaggagggggatctgaaaggcagggctagtgactggagtgaagtcgtaacaaggtag

SEQ ID NO: 81119 - DNA, 1181 bp, Glycine max
  Peptide Sequence Number=SeqID_172804
atggttacaatgaatgttggacaacatgagcataccttgcacgattacctcacccttagtttgagaatcactgcaattaaggcatggactggtcaacatgatcaaaaggatgcaattcaatggccgatcatcagaagatcatgtggtccatctgaagaagttcttgagactcacagacacagtaaagagttcaccaatgctcatgactacatcaaattgacaaccttcccgttctcattaacgggagaggcaaaagattggctcagtgacttgccaaagaaattgggaacttttcctagtttgagaaggaatcattgtttgaagcttttgagtgattcaagaagctatgaaggagttgcccacacaccatggttattcattatagagggaaaccttatgcccaaactgaccgatgcaacaataggaattattgaggttatagcttccaatgctaatagtggtataggcagcaaaaggattcccaggaggccaactagagttcatcgggtagtggttaattcatccagttcatctcttgcacaaaaaatggatgtgttgaccaagcaaatggaaactccgatgaaggctaaggtacagatgatgacacccacacctctacctcctgtttctgatgagtttggggagacaagacatagaccacccaaatttgtcttggaaggagcaaaaagatcaaaggcaaggcctaggaaagaggagaaaagacacaccatgcaggacatgatgatggagcacatgactaagagtgatgagaggagtgagaagccacatgcagagtacaagaagaaggagaaagcaacttctgcagagaaggacaaggaggtgctcactgaagaaggtccaataaaggacaaaaaggcttttactgacagcatagaggatgtgttggttaaggtgaacaagttcatctttctagacgattttgtggtgtttgatatcgaggtagatgaagatgtccccatcatactggggcatccattcctaaacacttatgacatagtgatagaggttaagcaagccttattcccaagtgtgaggatggaggaccccttggaaagagttcttgttattgatgacttgaattgggatttgagcagtgttgaagaggaaatactgatgttcctcgaagctcagagtgctgccaaaccgatgagaaatcagag

SEQ ID NO: 81120 - DNA, 270 bp, Glycine max
  Peptide Sequence Number=SeqID_172805
atggcgaatggtcatcttagactcaaggaacccattgtaagtcatttttctttggcgaagagagatcttgctaaagcaaaagttactcatagaggtgaggcactctctatttgtaagctcgctctggcaaagatggatctcacaaagagagagctttggaacgacaacaataaaaaaaataaatacaagctgaagaagaaaagatttggaaatgctgctgaagggctcgctcagcgagccagattggctaagcaaggccaatctgcttag

SEQ ID NO: 81121 - DNA, 426 bp, Glycine max
  Peptide Sequence Number=SeqID_172806
atggaaataggaaaggaaggggagaagctttttgcagtgcaagaaatgaagggaaataaaaaaaatagttcaaatttttcttccagcagcggcttccaaatttctatatggttccaaaaaatatattacgcttcatcggggactaggaaaacgcacccaacggcagcaacggcttccagatttgtatgtggttccaaaaaatatgttacgcttcagcggggcctaggaaaatgcacccaatggcaggtgcccatccacgatggtgtgccatctattgctgacccatggttccagtaccttcatgaaaaaaaattgatggccggagatgaggttgtcttctacttccggtttgatgaccatgctggggagcttttgatcaggaaagatattgaatgggacaaggaggacatccaccttgatgattga

SEQ ID NO: 81122 - DNA, 2772 bp, Glycine max
  Peptide Sequence Number=SeqID_172807
atgtctggtgctccagtacttcctcgggaactcatagtggaaattctgtcatggcttccagtgaaggctctcatgcgattcaggtacgtttccgagacttggaattccctcattttcgatcctacgttcgttaaattgcacctagaaagatcccccaaaaacacccatgtcctattagagtttcaagcaatctatgacagagatgttggccaacaagttggcgtcgcaccctgctctatacgccgtttagttgagaacccatcattcactattgatgattgtttgaccctattcaaacacactaacagtatctttggttcttgcaatgggttggtttgcatgactaagtgttttgatgttcgagaatttgaagaagagtgccagtaccgattatggaacccagccacagggatcatgtctgagtattcaccacccttatgtattcaattcaaagataataataatacctactatccttggaaatgtggctttggattcgatgattcgagtgacacttacaaggtggtggcactcctttgcgatattaaatcgcagacaaaggagatcaaagttcattgcttgggtgacacttgttggagaaagacttcgaatttccctgcttttcccgtgctgggagaaggacattttgcgtgtggcactgttaactggctagcactacgcgtgtcaagttttcattatctatgggaaaatgttactatcgatcatatcgatcagttagtaattttttcctatgatcttatgtacgagacatacacatatttgtcgatgcctgaaggtcttcttgaagtccctcgcatggagccttattttggggttttgaaaggttgtctgtgtctttctcttgatcacatgaaaacccattgtgttgtttggttaatgagggagtttggagttgaaaattcttggactaagttgttgaacgtaaattacgagcaacttctaaatcatgaccgtcctttgtgcatgtctcaagatgaggatgtcgtgttgctgacaagttatgcagttcttgcactgttggctgttgcctctgttttcccttgcttgctttacttcagtctctctctgtctcactttacgttcgagcttcttgctacgatgaacgcacccatcattgaccccttacagggagattttccagaagtgatagaggagtatttggaacatgggtgtatgaaatgtattgcctttaatcgtcgtggtacacttcttgctgctgggtgcaacaacggaagttgcgttatctgggattttgaaacccggggcattgctaaagagctacgagataatgaatgttcatctccaataaccagtgtctgttggtcaaagtgtggtcatcgaattcttgtatctgctgctgacaagtcattgttgctgtgggatgttatgagtggtaagaggataacaagaatagttttacaacaaacccctctacaagctcgtcttcatccgggttcctctaaaccatctctttgcttggcatgccctctctcatgtcctccaatgattgttgacttgaacacaggaaacacaacttcgcttaaagtttctatcttggagatatccaataatggaccaacccctacctcacgtaacaagtgtgccgatggaattacctccttctcaccaactgctgcatgttttagtaagtacggaaacctggtttatgtgggaaactctaaaggggaaattcttgtaattaactatgtagatggtgaggtgcgtgccatggttcctatacctggtggttctgtggtgaagaacattgtgtttagcaggaacggacaatatcttctaacaaactcaaatgatcgaataatcaggatctacgaaaatcttctacccctaaaagaagaagttagaacacttgatgagctaaatgggaacctcaatgatctaaatgatgttgagaagttgaaagctgtaggctcaaaatgcctaactttgttccgggagtttcaagattcaataacgaaggtgcactggaaagcaccctgcttcagtggtgacggtgagtgggttgtgggtggttctgctaataaaggggagcacaagatttacgtatgggatagagttgggcatcttgtgaagatccttgaaggacctaaggaagcccttattgatttagcatggcatcctgtacgtcctattgttgtatctgtttctttgaatggcatagtttatatctgggctaaggattacaccgagaactggagtgcatttgctcctgatttcaaagagctcgaggaaaatgaggagtatgtggagcgagaagatgaatttgatttgattcccgagactgagaaggtaaaaggatctgatgttaatgaagatgacgaaattgacattgtaacggtggagaaagatcctgctttcagtgactctgatatgtctgaagaagagttatgtttcctgccagcaactcccagttgtgatgctcctgaacagccagacaagttcgtaaatagttcttcaaagttggtggacagcaataactctggatccccactttcagaagaggctggaccaaatgaaaataccatgaatcataactcaagtccagtggaagatgatgctggggggacacgtatcaaaagaaagtggaaaccttcagagaaggtgttggagttgcaggcagaaaaaatgaagaaacccacaaaatctggcaaatcatcaaaatccaaaagtaaatatttggttgatgaggatgatggtattggtttttatggtgatgatctttctgatggataa

SEQ ID NO: 81123 - DNA, 345 bp, Glycine max
  Peptide Sequence Number=SeqID_172808
atgataccaattgatgtagcaaaactaagaactcagctaagggattcgaagttcttggacaaacaagggaactcaatgagacgaatgaattctgatgagcataattctatgtggcacaatgtggaggcatctgctgcgaaggaaaagacaatggtgcacaatgttgaggtcgagccagtgagggaggtggaagaagtcatcatcaaagtcccatattcagagggagtgtgtggggatgccgaatcacttgtcatcgtggttgtcatggaggtgagaagaggagggacacaagcaggaaaggttcgacagagtaaaacgaaggaggcaaagggaggagggagataa

SEQ ID NO: 81124 - DNA, 428 bp, Glycine max
  Peptide Sequence Number=SeqID_172809
ccaagccaactttggactggccaacaaggaaaaaaatagctttaggagctggaagaggcttgctatatttgcacgaacagtgtgatccaaagattattcatagggatgtgaaggcaaaaaatatcttgcttgatgattattgtgaggctgtggtgggagattttggagctcttgactttgggaaagcagcaagtgaagagattcaggttcttcaagagcaaatgaaagaagcacatgcttctgagatggattcaatcaagcaactttcatttgagacagaaaccgcaagaagggaagagaaggaaatgagatccaaaacacaagagctgaagcaagaagctgaaaaatccaaagcagtggcaaaagaactagagaagaaactagagctttacctacaacaagctgagggtgcaaaagcatcagaataa

SEQ ID NO: 81125 - DNA, 558 bp, Glycine max
  Peptide Sequence Number=SeqID_172810
atggacatgaatgtggggtacctcatctcccaccagatctccctcattgctcagcatgacacatccagacatggattcccggccttgattacaactttatgtaaggctaggggagttcagtctaactcgagatccttggagagcatgagtcctgccattaatttggcatacattaagaagaaatgttggaatcttaatgatccaacagtaactttcagaggactaaggaaggccagaggaaagaaatctgaggccccttccacttcagcaccagaggcagaaggtccttcttcttctacacttcctccctcttcctccacagagatcccaatgattcctccaacaccttcacagatgccatttctagctccagtatctacaggagaccagtcttcttcttacggagggggtggggcctccacagcccaggagcctgtgactaaggagcctccagcagcagcagtagaggaggaagctactccagagcagattccaaagccatctctagcccctgcgcatgcacctgatgatgccacaccagtggtggagcctgagtag

SEQ ID NO: 81126 - DNA, 504 bp, Glycine max
  misc_feature (14)..(14): n is a, c, g, or t
  Peptide Sequence Number=SeqID_172811
atgacggaagggtntggtgaagggttttgccttgcaaaccttcccggtgatgcttttagtctatgggggaacttctttgaggcaaagaaacaaatgatggctgatgccaagtttgcggggctgcttggggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattgtgcgaatcaacggttcctctcgtactag

SEQ ID NO: 81127 - DNA, 550 bp, Glycine max
  Peptide Sequence Number=SeqID_172812
atggcctttcattggaacttttaccttttttacaaacccccaacaagaaagaaccacaacttagcaactaacatgagtcatcattcatctagtgttaatggtgagggaaggaataggtcacatcttagacctcaccaccataggagagaaaaggaaagaaagcctcaagaggctaacattaacctcccatacttccatgggaaggacaatgtagaggcttatttagattgggaaataagggtagagcaacaacataaaaggaagtctacttctaaatcttatggctctctctattatccaaagaaagaccaaggtcaaggcatcttaggggtgacaccttctaagcccaaaaatgataagggggagacaatagaaaagcaaccccttaaggctagtatgcaagagaagactagctccatgaagtgctttaaatgtcttggaagaggacacattacttctcaatgccccaccaagaaaaccatgattatgaggggccaagacatttatagtagccaagatgaggctactacttcaccttcctctagtgaaa

SEQ ID NO: 81128 - DNA, 417 bp, Glycine max
  Peptide Sequence Number=SeqID_172813
atgctcgataaactcgacgccgcgttacgttttcagcaggaagcgctcaatttacgcgcccagcggcaggagattttagccgccaacatcgctaacgccgatacgcccgggtatcaggcgcgcgatattgatttttccagtgaactcaaaaaggtgatggagcgtggacgtgccgaaggaacgggtgttgcacttgccatgacatcctctcgccatattcctgctcaggcgatgaccgcgccagcgaccgatttactttatcgcatccccgaccagccatcactcgacggtaacaccgtggatatggaccgggagcgtacgcagttcgccgataacagcctgaaataccagacgggcctgaccctactcggcggacaaatcaaaggcatgatgaacgtcctgcaggggggcaactga

SEQ ID NO: 81129 - DNA, 267 bp, Glycine max
  Peptide Sequence Number=SeqID_172814
atggaacgagatgagaaaagattggagtaccgtttctgctgttcgtcggaagaaaacactggggaagaggacaatgagggtggaattggtgctgtggatgcgctaattttaatcggtgaaatcaaaagaaaaatgaaaaagaagaagattgcaatttacgggagtcgatttgatgaagaaatgagtgagataggaaggtttggaggtttgggaatggaggtacggcgcaaggaggaaggggctgcgcaagagattctgaaaacgtga

SEQ ID NO: 81130 - DNA, 372 bp, Glycine max
  Peptide Sequence Number=SeqID_172815
atgctgacatccaaaatctcatttatggttatgggggggtttcatcagcagactctccttccccgtgaagaaaacaccgagactttttcaagtcacacaagttatccagaactacgtaggtctgagttcctcattggaggatacgtaggagcaagagcctcgcttttgtcgaccacacctttttttgttaccatgacccaaaagctggtagcccgcggagacgtcttacggttatccgcgcctcttcattcgatgaccccaagtgtgattgatgagcagaggccaatgtggccatctgcgcccttttcggagatgtcagcatcttccggtggagactttttcaagtctcacaagttatctagaactacgtag

SEQ ID NO: 81131 - DNA, 993 bp, Glycine max
  Peptide Sequence Number=SeqID_172816
ctaagcgagcttcgctcgctaagctcccaacacttagtggaatttttgaagagttggtgccgctaagcacagcctttaaggagcttagcgcatatccttgcggcagatgccagctaagcggaccatgtctcgctaagcggccaatgtcttccagaaaaagaaagagcattggtgcaaggcccacagctcaatatgacacaagaaggttccactccttcgaggcttggaccagatattcggataatgaactaggaagacatatactagctgagaggaaggtagaaatataccatacggagttagatgagttcaaggctgaattggagaggcgtaacttccataagcgcctcaccaatttagctgatagtagcatcgacctagccttggtaaaggagttttatgccaacctctacagtcccgaggggccttcaccaaaacaagtcagaatccgaggccgagtgataagaattgatgcagacagcctcaacaccttcttggagacacctgtggtactcgctgagggagaatccttacccgcttacttcagatactgcaggatgcccactgatataagagagattgaggctgctttgtgtatacccaaccgagggtctgttttaaatgctgaaggccatcctgggaagatcctcaggaaagatctaacaactctagctcaggtttggagtgttctctcatactccagcctggctccgacttcccacacctcagatttgattgtagatagagctaggttaatctttggccttgtttctcagtgggacatgaacgtaggagctttcatccatggccagatcacaggggttgcttctgacagcccgatcttcgaacgcttgagcccgatcattaacttggcctatattaggaagaactgttggaaccatgctgatctgacagttactattagaggggctaggagagcgagggcaaggccagctgaggctccttccacatcagcagctcctcctccagcac

SEQ ID NO: 81132 - DNA, 597 bp, Glycine max
  Peptide Sequence Number=SeqID_172817
atgtcctacccagtgatcataactctaaccttcctctgcccaagtgtcagttggtgtatgccacccaccaggcaccctctagacccagataagtctaacagggacctggggtttccagcgttgattacgggcctctgccagtcattcggggttcccatcacacctagtaaggtgatccagtcgccgatcacccaagccttcattgagaagtattgcacacctaggcaagcacagggtgatgcgccacaggccgtagacgcactgccgccacctcatcaggctgatcccgctgggtcattaggcatggagcggtatctacaacacttggttcgccaacaggcggccaaccaccgggggcaggtgcagatacatgagtgcctctaccagctcagcctcagtcagcagggccagggttttgctcctttagcatgccctactccatatcagtttaaggttgaggtcgcatggcccgaagattggcccgaggaccagacggaggaggcacctgcaggagctcccgacgatgcagaggacgcccgcatggatgaggaaatgacagacttgctcggcttcttgggaggaagcggagccatgtga

SEQ ID NO: 81133 - DNA, 528 bp, Glycine max
  Peptide Sequence Number=SeqID_172818
atggatcaagccactgcagacctctcacggtacccatcagtacgcgcaacatcacccaagcttctcagcttgcaccggggactcttcaaattcagcacccgtacaaccaagagcgcctgcgcccatccagagggaggccctccaagctccggctccaaccccgactcgcccggccgacaacgcccactttggcgccatttccaacgcgataaggaactttcccccgaggccaactccataattcaccccgatcccaatgacgtacgaagacctcttgccgtccctcattgccaaccaaatggctgtgatatctcccgggaagatctaccaatccccaattcgagcgagaatattccagtgaaaggtcttccggagaaaaaggatggttgtggcaagaaagaagtatcgctagaggaggaaggaaccccggccaaagtctctcttttggaactgctcatgagctctgagcctcatcgggcttttctagtaaaggtcttgaacgaagctcatgtagcccaagatatttcc

SEQ ID NO: 81134 - DNA, 209 bp, Glycine max
  Peptide Sequence Number=SeqID_172819
gacctttcgtggtgaaaagagctttttctgggggtgctctgatactcacccacatggatggcgaggagttgccttcgcccgtaaactccgatgggcagggccttcttgggtcacggttagaagtcaagacaagttgactgcggaaatcaaccaagcgccaccccttcccggcgctaaacaagcagagaacgtcgctgcagggcagccca

SEQ ID NO: 81135 - DNA, 234 bp, Glycine max
  Peptide Sequence Number=SeqID_172820
atgcatggcagtgtgaaaaatggcacgcagcgtgtctgctccgtgcccctattcaaaggacctatgtgggagggagctaaaaggacttttttagtgatatttcccaaggtggtcatatctctcttgatggtctctagaggtatcatcctcttcaaagaacatactgcagcagtagggactactagcaacaatatgttatcaaagagaaaaactctagatgagggttcactgtaa

SEQ ID NO: 81136 - DNA, 219 bp, Glycine max
  Peptide Sequence Number=SeqID_172821
atgacagtcaagggtctccgagaaaagtggagaatggagaattggcgaacagcgctacgcaataacttcgcggggctccagactcgaagggtctccgaaaaaagtggagaatggagaattggcggacaacgctatgcaataacttcgcgcggctctagactcgaaggtggaggacacatgaacagcgctaggcaattacattcatgggtctccgaataa

SEQ ID NO: 81137 - DNA, 276 bp, Glycine max
  Peptide Sequence Number=SeqID_172822
atggtgggttacacaccttccagctttgcggatatgttcttcgccggcaaaaggatcgaagtgggtctgaaaagaggcaaatttggtcatcttgctttgatgaaaactggggcaagtgaagagggtgagaatgagggagaaacccgtgttgtgactgtcattcctgtacagtcaagtttcccaccaacccaacaatgtcattacccagccaataacaacccttctccttacgcaccacccagttatccacaaaggccatccctaaatcaaccatag

SEQ ID NO: 81138 - DNA, 648 bp, Glycine max
  Peptide Sequence Number=SeqID_172823
atgccagagcacaacacctgccaagccaccatcgagagattagaggaggccgtaaaccgcttaacccataaccactcagccttaaacacaaaaatggattccatccactcctccctcaatgccaagatcgattcccttttggagcgattcatggcaatcaccaccaaccccaacccatccactcctttgcctacccctccttctccttccctgcctcggcctcacatgaagcttgacgtccctcgcaatatggcacagttaatgaataccttaccgagttcgagcggctggcaaactgcattgtgggactcgcccgctcgtgtgtactcagttgctttgtttcggggcttttgtcagaactacgccgcgaagtttaggcacttcgacctttgtcccttccttaggtggccgaactcgccagacttcaggaggataaaatcctcaatcatcgtcgtagctccagattgggccctgtcgccccactctctcctcttccgaagctcacaggtgcttcgccgtccacgcgtcttctcttcaagcacctcacaatcgaggagatggtcgtttgtcgagatcaggggttgtgctaccactgcaatgataagtggagccctggccatcgctgcaaaccgcgtctgcatctcttaa

SEQ ID NO: 81139 - DNA, 447 bp, Glycine max
  Peptide Sequence Number=SeqID_172824
atgggtgtggtaaagaagttttatgctaacttatacagcacagaagaccagagccctaagcaagtgaggggccatccttggaagcttctaaggaaagatcttaccactcttgcacaaacatggagtgtcctctcctacaacaacctgactcccacttcccacacctctgatcttaatatggacagagccaggttggtttacggcttagtcacaggcatggacatgaatatcggagccctaatctcaggtcaaatttctaccattgctcagagtaagtcctataggctcagattcctagccttgatcactgctctatgtagagctagaggagttacctctgacagtctaacctatgagagcctgagcccgaccattaacttggcttacattaagaaaaactgttggaatgtggatgatctgacagttaacttcagaggggctaggaag

SEQ ID NO: 81140 - DNA, 168 bp, Glycine max
  Peptide Sequence Number=SeqID_172825
atggagggaggcataggtctgatactagacctcactcccaaagaagagaaaaggatagaaggtctcacgagggatcctccagtagagtattggaatgattttaagagtgcccttaggaagaggcacattccctcctactatgaaagggagcttgtggacaagctctaa

SEQ ID NO: 81141 - DNA, 921 bp, Glycine max
  Peptide Sequence Number=SeqID_172826
atgggactgcagctgattttcttgctaattgagctgcatttagatttttgcactcagcaggtccatgaatatgcaggtccttcagtcttcaaatcacaacctcctttctcctcaccaaatattaaggatattcatgcccctgcaactgcaccatcaccagcaactctgccagtaccctctccttcacctagaatttctcctctaggttcatcgttgaagaagaaaaagactccaccaccagcatatacattgattctgccacctccacctcctaataaggattgcttgtcgatgacttgcttggagcccttgacatatacagctcctgggtcaccttgtggttgtgtttcagagctagccaaggaaattgcaacaagtgttctgctgaaccatacccaggttcgcattgtgggagcagatgcagctaatcagcaactggagaagatcactgttctcctagacttagtacccaaaggagtaaaatttgatgataccagtgcaattttaatatataagaaattctggtacagggagattctgatagatgcttcggtctttggtgcttatgaagtactctatgttcattcaccaggtcttcctccatctccaccgtcaactccctcagatgcttctggtatagatgatgggccaaatccaggacatgacaacaatggaacgataatgaaacctttaggagtagatgtcccaaagaagaaaaaagaagggaataatggaagactgattgttatatttgtgctgtcatcatctgctatacttctgaagccagatacgagcagaggtggaggtatggatcctggtggctatgtaaaggttaaatgcatagcttgtggacatcgaaatgaaaggtttgtgctgctgacagccatgctgctagacctttttcctgttttgtatggatag

SEQ ID NO: 81142 - DNA, 363 bp, Glycine max
  Peptide Sequence Number=SeqID_172827
atgttgaagttagtccttaagagtctaagaaagcattcactaattgatgatgaaaaggtttggccaaaggatgctttcattgtaaaagggattttacaagatagtggaactctcaagcgggttgcttggggactggacataggcacaagggtccctctcactaatgaaccatttgtccaaattaagcattcctttgcaatagaagccgatgtagctacttctttcagttataagaaagatcttgatggacaatgggttcgcaaacaagatcaccaggctaatgttccttatgaacgctctccatctccaccacctagggatccctcctctgctttactgaatgatgttctcaacgagttttga

SEQ ID NO: 81143 - DNA, 822 bp, Glycine max
  Peptide Sequence Number=SeqID_172828
atggagggtactcatcatcttcgtcatctgcatcaacaacaacaacaaaaacaaagggttcttcctcagagtatgagtagtgtcaacgtggatgtgactgataggtttccccaatggagcatccaagaaacaaaagagtttcttgtgatccgtgcagagctggatcagactttcatggagactaagaggaacaaacagttgtgggaagtgatatccaaccgaatgaaggaaaagggttaccatagaagtgcagagcagtgcaagtgcaagtggaaaaaccttgttactcgctataagggatttgaaacaatggagcaagaagcgacgagacagcaattcccattttacaatgaattcaatgcaattttcacggcaaggatgcagagaatgttgtgggctgaagctgggggtggatcgaagaagaacaaggcgatgacgatgcagctctcatcggacgaagaagatggcaaagaagagagtactgaagccggtagcgacagaaagaagaaaaaggcaaagatagttagtgggggtggtggtagtttgaacaatttgaaggagattttggaggatttcatgaggcaacagatgcaaatagaagcacaatggatggtggcgttcgaggcgagggagaatgagaggaggttgaaggagatggagtggaggcaagccatggaggtgttggagaatgagaggataatgatggaagaaagatggagagaaagggaggaacaaaggaggattagggaagaagctagggctgagaagagggatgcactaatcacagctttgctaaacaagctagagagacaaggaatgtag

SEQ ID NO: 81144 - DNA, 192 bp, Glycine max
  Peptide Sequence Number=SeqID_172829
atggaggcttggaataggttgcgtgatatattccaagataacaatcactttcgtgccgttacacttgagtatgatttcacccacacaaccatggaggccttttcaagtgtctcttcttattgtcaacatctcaagtcattgtcgaatcaactcaagaacatcagctttccgatcgataacagtaggttgaat

SEQ ID NO: 81145 - DNA, 645 bp, Glycine max
  Peptide Sequence Number=SeqID_172830
atggtagtactgctcaaacccgaggctcgccagagaactggttgcaatgatccacaacacgttcttcctcattcccctttttcttctcaaaccctcacttctgcaatctcttcccttcatcgtccaaaatgcgaaccctacttcttcttcattatcctcctgcgcagggggagtttgagaagggcttgcaacactagcttgaagcctttctctgacgaagagttggcgaagaagattgaagatctcacactcaagtttcagctctctatagaaaataccaatgcaaatgatttggattcagaagattttcaggagatttctttgtcatcggtgaattttgcagaggagttcgagctaccagaggagattattctggcaaacattgaacgaaaagcgaacaatgtagagcttccgttttcgttgaggataatgaagaacaagctataccggaaggaagagttcaaagaggcaggggaattcgtgtattgctttgccaagaaagcgttctcttccatggtttttatctttagggagcttcacagtttcactatgccgatgagggaagttttgttctacgatgttagtgaggatccacttactgtaaaagtcgatcatctcaaggttttacttggtgctgcaggataa

SEQ ID NO: 81146 - DNA, 492 bp, Glycine max
  Peptide Sequence Number=SeqID_172831
atgggagttgctacgtgcacccagcaatattgctggggcacccaacaaacagtgaatggacaattttgcccttctacgaaggctgtttcaggaagagccttattccggaaaaatttccgaaagacgtcactccgaaaaacttccggaagaaccttcttccggaaaaagaaggtgggattccggaagaactccggaatacgttccgaaaggacgtgttccagaattttcccggaagaagggtctttcgaaagaccaccttcttcttctggaagaagttttttagaaaagatgaacagtaaaaagctattcccgaaagaacttttaactacaggaggaagtagttccggaatgagaatgttgaatttcttgaagtacttcttccgaaagttactatgcttaattccagaagaagtggttccggaagtgtcttccggaaccacttcttccggaattggacatagtaacttccggaagaagttgttccagaattga

SEQ ID NO: 81147 - DNA, 277 bp, Glycine max
  Peptide Sequence Number=SeqID_172832
ggcatggagtcaagagttgagagcaatccctaggcgaaattgtggagcagggggatctaggtggcttggaggggaaggggaaaagaagagaatgaggaatgaagtttcaacatcaaaagggatgagcaacccaaggggtggtcaagttggtatccaaaaggccctggcagcaaggcctgtcagggattatgatgattctcagttggaactgttgaggtttgggaaactcgagagcagttccaaccatgcgggatttagtccaaaagcacaaacttga

SEQ ID NO: 81148 - DNA, 423 bp, Glycine max
  Peptide Sequence Number=SeqID_172833
atgcaaggatggcgatgtgatttaaatgcctctcctcaagcactagataggctattgggttgtttccttgcattcaaagtgaaggtgcaaccaaggttcaggaattctattgttcttaaatattcagatgaatcagacttggtcaatgctgtcctggatatgcttcccgatagtgagccatgttgcaagatcgagaattcaatacttgagtcgaccgatcctacagagcttgaatctcaatttgtgtttgttaccactgatcatgatcgttcaatgcttgactcaagtgagcctatagagcttgaatctattccattgacaccaactaagcgcgtatcttctgatgagttcgatgatgagccaaaaaactttcagatttcacctgccgaagtttcctccaacaaattagccaagcattcttag

SEQ ID NO: 81149 - DNA, 247 bp, Glycine max
  Peptide Sequence Number=SeqID_172834
atggcatcgtgtgatccatgtaaccttgcacggtgggataaggcttttgatgttgtcggtggtggaagtgcagaagtcaatgctcacggtgttgccaattccaataaggccaataccactttgtttctgtacaaaattgaaaaggaaaaaaacggggttgttgaaggtgcggttgagggtgcggtttggggtggatgggagggagatgatgatgggttggtttgggagagggttgaggagagaagag

SEQ ID NO: 81150 - DNA, 375 bp, Glycine max
  Peptide Sequence Number=SeqID_172835
gtcgactctagaggatccccaattttgcttccccggtcttcaaatttggctcaagcctctgaggaggacttgattttgatatgggctttccttaccggtcgtcagatcgactgggctcacttggttcggtaccgaatgcataaggcattacgggtcaatgcacctcttccatatcctcaattggtcaccctctttctccatcattttcaaattcctcttgatgatgaaccttttgttcaagtcaagcgttcctttgctataggtgctggtgcaatcacttcatttggttaccgtaaggatcgtaatggtcaatggctgaagaaagatgcactccctccacaagacgagcgtactccttctcctgctcctcagtga

SEQ ID NO: 81151 - DNA, 477 bp, Glycine max
  Peptide Sequence Number=SeqID_172836
atggcttgggcgtccaagtatattggtgggggtaggaagaaaatttggtactgtgatgaatgcttcgttcttaaaaccgcaaactccatgaagatcgagccagggttgaaagacgaagtcggtccgtctaacgtgcaaccacaacgctctgttccaccatcgtcactgtttggcagcttcaaccaaccactagccacacgtcaagccaccacgcctgaattgatgaacgaagaccacagaaaatgctatgaaatgaccatcatgttgcagatcacaagaacatcagaggagattttaaacattgttcatgccaaggagcagacttacggtgaagttagtaggtcatttgccataaggtggatggacatgcttgaacggtggacagcgttgagggatttcgttgatcgtagatcatcaagtgatgttaatccattatggtcaaagtctattcttgatgaccatattcaaaaccagtag

SEQ ID NO: 81152 - DNA, 267 bp, Glycine max
  Peptide Sequence Number=SeqID_172837
atgatgttgtttgctaagacagcaattgtcgtgcttggagatttagctgatactttgggcaataacactggccccttgattcagcagaaggcggaaacaattttgacacaaacagattatgttcataaggagttcatgtcattgcaagaagaggcagacctcacccaggaggagatcatgagtaagtggtttactgaggatgtctttgctgaagctgcagaggaaggagacttaagaaggattagagtaaagatgaaatggatatag

SEQ ID NO: 81153 - DNA, 57 bp, Glycine max
  Peptide Sequence Number=SeqID_172838
atcttgaggcttgctagggatcttggagattttctacttgttggaatacacagtcag

SEQ ID NO: 81154 - DNA, 454 bp, Glycine max
  Peptide Sequence Number=SeqID_172839
atgggagatttcatcagcagactctccttccctgaaaacaccgagactttttcaagtctcagaagttatccagaactacgtaggtctgagttcctcattggaggatacgtaggagcaagagcctcacttttgtcgaccacaccgccttttgttgccatgactcaagagctggccaatgtggtcatctgcgccctttccggagatgtcagcattttccgatggagacttttcaagtctcacaagttatcaagaactacaggcggcgggcccgatgatacgcggagataccttacggttatccgcacccttttgtcatccagaggcggcgggcccgatgacaagcagagaccaagcggcgggcccgatgaacaagcagagaccaagtatggtcattctgcacccttgtatcatccaaaggcgtgcgggcccgatgattacgcggagataccttatg

SEQ ID NO: 81155 - DNA, 82 bp, Glycine max
  Peptide Sequence Number=SeqID_172840
atggctgggacgtcacaactccgtgcgtattcctttcttggaagatgcacccgcgagccacgcgtcgccctcccgctgaagg

SEQ ID NO: 81156 - DNA, 183 bp, Glycine max
  Peptide Sequence Number=SeqID_172841
atggcagatcagagttcagagacagaatgttattctcctagattgatgccttgccaagatattccaattgcagggacaaaaactggagctttgaaatgggataaatgggcctttttcattaaatactactctcctacaccgaagaagatggacaagaataagcacaagagaaaaatcccttaa

SEQ ID NO: 81157 - DNA, 258 bp, Glycine max
  Peptide Sequence Number=SeqID_172842
atgtcgctgcatgttctttatctttatgcgttttctggatttcccctagggatttcccgtctgctgtatctctcgttacaatctttcaaagaaatgaacgggcaggatcatcttgagctaccttctggggtggggacaaaacatgaaaagcagaaaccaatcaaggaacggatgcaagtggggatggagtcacgaccgactgatcgttgccccttctctgcgctgaacaagcagagaacatcgttgcaagacagcccc

SEQ ID NO: 81158 - DNA, 159 bp, Glycine max
  Peptide Sequence Number=SeqID_172843
atggcaactcgcctaggtgagctgatgcttactcctgaagtaactggctcgcccaggcgagctggttacttcaccctgaagtcttttgggggcgcaggcgagccaaaggctagcctgggcgagctaggtaattggtgtcgaacaacgcaatccagctag

SEQ ID NO: 81159 - DNA, 264 bp, Glycine max
  Peptide Sequence Number=SeqID_172844
atggcagcgggttgttttacattgggccggtctcgtgaaacgtcagccatctggcttctatcaaactttggacttgcgttgaaagccatgcactgttcggttgagtggccggggtctcccatggtatgcgcaggtgcgttagggttataccactttgggaaaagaggctgctggatccttcagggagatatcacagccatctggttggcgaagagggatggcaagaggtcttcgtacatcattgggatcagggtgaattcttga

SEQ ID NO: 81160 - DNA, 240 bp, Glycine max
  Peptide Sequence Number=SeqID_172845
atgagttgtacaagttcgctaagtgcaccgcttcatcttactaagcgcaccacttcagttcatctgctaagcgagaaaagcgggctaagccaaaaatcactaacgtgcgctaagcggtccataagtgcgctaagcacacgagcacaaacaaggccacctattttcattccactctgcctctaccttgatcaagtagatgcatgctttgttagggtcattcaacagtggaaactggtctga

SEQ ID NO: 81161 - DNA, 432 bp, Glycine max
  Peptide Sequence Number=SeqID_172846
atggcctcaagagagagagcaagagctgaagacatcccttcatcatccaacccacctcctccaacagcaaccatagaactagatggcctacaagcacaacctatagttcctatgttgccaatagtatccatggagcaatttttagataaagtggcctggcctgaagctcagctgccgttaggaagatctcccgaggttgtgccccccagtcctataccaacaagggtagagcctgaaccagctgagtcgcaaccaccagtagtagacccatcggcttccccggaggttgagattccaccacctccaccagcgccaccggcaccacctttgatactcattcccgatgactcagataatgaagttgtagctcctcctgactcaccagcctactacctagaggatggttcagacttttctgactggatggactag

SEQ ID NO: 81162 - DNA, 408 bp, Glycine max
  Peptide Sequence Number=SeqID_172847
atgactgaagttctttcagagttacggggtcttcgcacttatgttggtgaacgatttgattctttggatggtcgcttagtaggaatggatatccgtctcacgcagcttgaagaggatgaattaaattgtcattatcaaaaagggggagattgtagaagcaaagactttgcctttgatgttttgatgatgccatatgatcgtgatgatttgatgtcttatggaaatgcgcttctcaagttgaattcaagagaacaatccgagaatacaagatacaacatcaagaagatgtctagtattttaggaagggaattccaaattgaaatagcaaaaggtttggccaagaaatttaagttaaaaagttttttttcaagagattactctctggtaatcgattaccagaggatgtaa

SEQ ID NO: 81163 - DNA, 375 bp, Glycine max
  Peptide Sequence Number=SeqID_172848
atggttaagtccaatactcttcaagaagtttttcctattccctatcttggtccatcaccttctttgcaagaatcagagtcaactataggttctaccatagatattcctgacaatcctccacttgagaagactcaaagatcacccatcgtatatcgacatcatcctcgaattcttgacgtagaacttgaaggtaatgaaagaccatctgaatcatgtcttactccagtagataatccgaccatggacctactcgaagagaatcttgactcgcccattgctcttaggaaaggaactggttcctcttcccccaggcaagaaacctgttggctatcgatgggtatatgctataaaagttggggccaatggacatattga

SEQ ID NO: 81164 - DNA, 147 bp, Glycine max
  Peptide Sequence Number=SeqID_172849
atggggagaatggaaatttatagttgtcatcatcaaaaagggggagaatttagaagcaagcttcatgatgaatcaagattgattcaaagagttttgatgataacaaagataatgacaaaaagctcaaaagtcaagaacacttcatga

SEQ ID NO: 81165 - DNA, 519 bp, Glycine max
  Peptide Sequence Number=SeqID_172850
atggctccgaagaagcattccgcaaagagatctaggagggacgtcgcggttgaagggaccagtgccgctcccgagtttgatagccaccgtttcaggagcgccgagcaccagcagcgcttcgaggccatcaaaggatggtcgttccacatagagagacgcgtccagcccagggacgatgagtacacagattttcaggaggagatagctcgccgacattggacgtcgctagtcactcccatggctaagtttgaccctgatatagtcttggagttttatgctaatgcttggcccacagaagagggggtgcgagacatgcggtcatgggtgaggggtcaatggattccctttgacgcagatgccctcagtcagttcctgggtgacccgctagtggtagaggaaggccacgagtgcgagtttagtcagaggaggaacagggccgatgggttcgacgaagaggccattgcccagctattatgcacaccggggcaggatttcgctcggaccgctgcacggaggcgg

SEQ ID NO: 81166 - DNA, 1230 bp, Glycine max
  Peptide Sequence Number=SeqID_172851
atgctgccgcgtactgcgcgtgttattggtgatatcaaagctgtgccaactgccatccagccaggcttcaacccaggcatgagtagcaacgtgttcaacgttgtcagtatacagatagccactgacgtagcgcgccggaatccccaggctgcgacagcaggcgagaaacacgtggctgtgatcctggcaaacgccgctgccggcagcaaacactttcgccgcgctgtcgctcacctgcgtgctgccgggctggtacggcattttcagcagcagctcgtccatcagtttttccaggctggcgagcggtttctccgcctgccagtaacgccgggcgaagtcgcggattgccccgtccggctgggtcagcggcgtggcgcgcagaaacaccagcggcgacagcgtcgactgcggatccggcgccagctcgctggcatccagaatctcgaccacgccgcgcgcggcaatctccagcagctgatgcggcctgtccagcgtcagcacatgcagcacgttgccgtaagcatccagcgtgcgcgtcgcctcacacggcagatcgagctgccacgacagcacttgctggtgcaccgaattctgcggcgtcaggcgcagatactgggtgctgagttttacctgctgctcataggcgtaccaggtgtgattgatgctctccgccagcgcgttgatgcggctgagaaaatggtccagccacggctgcaggccgtcgcgcgtcaggctctcccaggtgctgaagcgcatctccgccagcaggaccgtactgagatagcgcgggcgatcctcgccgctgctgccaatctgctccagctggctggcgatctcttcaatgcaggagtgcagcgagcgcggactttcgctgcgcaggatcagcatttcgttgaccagcggcggcatcagttgctgcttaaagatggcgttgtaggcctcgcgcgccgacaccgcgcgcagcaggctgtcgaggcagtaatattcccgtaccgtgtcgggatgctgctccagcagctgctggttaacgctcagcagccgcgcggtgccgtcgctgcgctccatcagcgtgccaagccggataaaacgcagcgcatcgccgcgcagcagcgtgccggacatcgcgccgcgaaacagatgcgaacgctctttcacccagtcgaagaagctgtcggcaccggccggcgagataccgcggcggcgcgtgttgcgcatctcaatccacgtcga

SEQ ID NO: 81167 - DNA, 477 bp, Glycine max
  Peptide Sequence Number=SeqID_172852
atggagaaaaatgtggccgccgctgccgctgttagttcggctgccaaagcagacccaactctcctagctaccacgcaccatcctcccccaaatacgataggacgaggaaggagcacactagggcacaacaacaacacccatttgggatacaaccgggtggcttacccttatggattgccgcctaattacacgccgccagtcatgcaagatgatgcaggtcatcccgacgaggtccacgaagatcatcaagagtatgcccaaggggatgtcgagttctaccccctgatccccgttgaggggccgacacccaacactttgcctcagcccaacctcacagcacaaccaatattcttttccacagaaggaccactcccggtgaccgaggaaagaaggaaactcgatctcctcgaggagagattgagagttgttgaaggcttcggtgactatccgtttacggacatgacggatctttgcttg

SEQ ID NO: 81168 - DNA, 261 bp, Glycine max
  Peptide Sequence Number=SeqID_172853
atggaagttaattcttttcaaaagcatgctggcatttcagtcgatcatgagcaactaggtgtgtcctactatgacttgagaaacaaaggtgatcaaataacaagcagagatttaaaagttactagaggtggtggcggtgcgcctgttgcccactactatgatgcctcgccctgcgtctgcctgggggtgcaatacttctcgatgaaagtccagttagtaggaagcctgatgaccttgctgggggtgacaggcactccgtag

SEQ ID NO: 81169 - DNA, 219 bp, Glycine max
  Peptide Sequence Number=SeqID_172854
atggcttcgaagaagctttcctcgatgagatctaggaaggacgctgcggccgcagggactagtgccactcccgagttcgatagccatcgtttcaggagtactaagcaccagcaacgtttcaaagccatcaagggatggtccttccaccgagagagatgcgtccagctcagggacgacgagtacacagatttccaggaggagatagctcgccggcgttga

SEQ ID NO: 81170 - DNA, 921 bp, Glycine max
  Peptide Sequence Number=SeqID_172855
atggattcctccaccacattcctcaacgaccttcctcccctcaagagactaagactcttgcaacaacaacagcaacaaaaagaagaacatcagtattatgactcttcttcacctttacccgctaaaaaacgcaaggagtctcgaaccctatctccaccctctcccaccaccaccaaaaccgtttataactattccctccccgccaagaaaagagtgtgggccctacaaccccagagcccaccctcaaatgacgtcgtccccgccttcgacctcaatgtggaatacacacccagccccaacaaccacggagacttagaagaagaccactccgaggacgaggacggggttctatgctgtgtgtgccagagcacggacggcgaccctgcggatccaatagtcttctgcgacgggtgcgacctcatggtgcacgcctcctgctacggcactcccctgtccaagtccatcccggatggagactggttctgcgaacgctgctgtttccgtttcgagaagaatgatgttggcaacatcaattgcaatgcttgcgtgctgtgcccttccaccgagggggcgatgaagcggaccaccgccgaggaggaaggtggcgcgacgtgggcacacgtggtgtgcgccctgttcgtgccggaagtgttctttcttgaccccgaagggagggaggggatcgacttctccaaggttccaaagaagaggtgggaggagaggtgctatctttgcggatcctgcgaagggtgtgctttggtgtgttctgagcccaagtgcgggttggggtttcatgtcacttgtgcgctgaaggaggaactttggattgagtacagggaagggaagaagggtggtaccatagttgccggcttctgcaaaaagcacacccaagtttgggaaaagggaattgaatcttcctaa

SEQ ID NO: 81171 - DNA, 360 bp, Glycine max
  Peptide Sequence Number=SeqID_172856
atggccaaaacgttgaggtttggaccaaaaggcctacggatgacaagacatgatgtatgtcggtatatttgtctagcaaacggttcaagaataagggaaatgccccaaatcatttctgtcgcaacctacccttcggtgggagggcgacgcgtgactcgcgggatgcgtgttccacgaaaggaatacgcgcggagtcgccaccaacgtttatttgaggaaaacgttggaaaaaccggaaaagacgcgatctacgaacttttaagtgaaaggttcgggagttgtatttacgcacggggaagggtgtttccctttgctcctacgtattcctcaatttgcgatgaggaaatcagacctacgtag

SEQ ID NO: 81172 - DNA, 1149 bp, Glycine max
  Peptide Sequence Number=SeqID_172857
atgcgctatgcgagcacgagctcgccgcataacatgttcgaggaattgcttcacggagacccgttccacgtggaggcctatcacaacctcttaatgttgacttcgaagacgaacaagccaaccgaggaactattgaagagaatcgaagaggtgggtaaggattgtggattgatatttgatataaaagaggtaggaagaggcgctgacaaagggtacaacggcaactccagcaacattccgacgagccgtttggagcggttgttgagggacagagagctgaggaagagtgggagggcgagcgagaacaatggagaagcgatggaggaggaggtggtgcggttgagagaagaagagagcgcggcggaggcggcgacgaagggggccggtggtggggaggagaggcaagaaacgaagccgtttcggcagaggctgctggtggtggctaacaggctgccggtgtcggcggtgcggaaaggagaggacgcgtggtcgttggagatgagtgccggtggcctcgtcagcgcgttgttaggtgtgaaggagtttgaggcaaagtggataggttgggccggtgtgaacgtgccagatgagattggacagaaggcacttactaaagccttggctgaaaagaggtgtattcctgtatttcttgatgaagagatcgttcatcaatattacaatggctattgcaacaacatattgtggccacttttccactaccttggacttccacaagaagaccgccttgccaccacacgcagttttcagtctcagtttgaggcgtatgagaaagcaaatcagatgtttgctgatgttgtgaaccggcactatgaagagggtgatgttgtttggtgtcatgattaccatcttatgttccttcccaaatgcttaaagacacataacaagaaaatgaaagttggatggtttctccacaccccttttccatcttctgaaattcacaggacactgccgtctcgttcggagctcctgcattccgttcttgccgccgatttagttggttttcacacctatgattatgcaagacattttgttagtgcttgtactcgcatccttggacttgaaggtacaccttacggggttgagtatcaagggaagctaactcgagttgctgcagtacgtgccacgtaa

SEQ ID NO: 81173 - DNA, 450 bp, Glycine max
  Peptide Sequence Number=SeqID_172858
atggactttaagcctcatcgtacttatgcactcgaagttggaggactgtgtactactctggtcgtgcaccgactgtctcaggacttcaagcctcgttgtgctcgcacactcaaggctagaggactatgtactgctttggttgcccatcgaccgtctatgacttctcccatatgcccattgtcaattggtcagctaaaacctaggtgtgatctagttacaagaacattttggcacccattaaggggctacggtaaaacttttcccattgcccttgttttgcattgtttctttgacaaaatgagtggaataatgaacaaccattccacattggggattcccgttgtaccattgatgttggaaactttgatggcggagatgaggagaaaaggcaaggattttaggagaatagcaaatgaggcattaagagcccgggacttcctatgccactag

SEQ ID NO: 81174 - DNA, 261 bp, Glycine max
  Peptide Sequence Number=SeqID_172859
atggctgcagtatctggctcaattcctgcaaatctaccagttctcacaggaaagaactatgaaaattggaagattcagatcagggtggtgatgcgattccaaggggtttgggagttcgtagaagaaggttatatacctgtgggagagagagcaacagaggaacaaaaggctgctgatagagaaaaagaaaagaaagattgcaaggcacttttcattttgcagtgggatcctctagagtcgacctgcaggcatgcaagctga

SEQ ID NO: 81175 - DNA, 444 bp, Glycine max
  Peptide Sequence Number=SeqID_172860
atggcccaggccctccgtgccatcgaacacctccgccgtgtgataggcagtgatagttgctcccctgactgttatgagaaagtaaagaacataaacaataacttagacaaaagtaaagcggaaatagaaagtgcacaacagaaagataaagagtgtagggaagaagaagacaaacacaagatttatactgggaagaggaagaatcaaaagaattctcaggcggttagtcctttgaatcttttggcaagagagagaaagaagaatcaaaagaattctcaggcggttagtcctttgaatcttttggcaagaaagagaaggaagaatcaaaagaattctcaggcagttagtcctttgaatcttttggcaagaggaagaaggaagaatcaaaagaattctcaagtggttagtcctttgaattcttctggcaagagagagaaggaatga

SEQ ID NO: 81176 - DNA, 261 bp, Glycine max
  Peptide Sequence Number=SeqID_172861
atgaggcttcattgtcatcaagcgagtcggagacctagcatgaccacagatcgacctctactccttatggctcacagacctgggtccatgtgtggagcttgtaggccttggatcttcttcatcaatggagtgctttgcttcttgaaaatgaatggtagtggaatggagaaggaagagaaagatgatcggagacgccacttcaaggagaagatgagtcaagaagaagctcaccatcataggaagccatggataagagcttga

SEQ ID NO: 81177 - DNA, 207 bp, Glycine max
  Peptide Sequence Number=SeqID_172862
atgcatctacatgatcaaggtacttacagggaagatccaacagaggatttagctttccataccaggaagccttctttagaacaaagagaagaacaagatgaaagattgcaaaaatacaagtgcgcacttatggaccgcttagcggacattagtgaatttcggcttagcgcgtgcctttctcacttagcggatgaactgaagcggtga

SEQ ID NO: 81178 - DNA, 391 bp, Glycine max
  Peptide Sequence Number=SeqID_172863
tggttgccacccagctcgcccaggcgagttagattgcttccaccagaaggcaccgccttctgttggaagatcctggaaggcccaagtggaactttacggattgcctaacgatgggtgtcaagtacctcaaagtggtcaagcgagggtcgcatcccaacaaacagatggcccccagacgaaattagggtatgacacgggggaaccacatgggacaacgagtcaggtggtgggcggagataccttatggtcatccacgcctttcgtcgaccgagcgaaacgaattcggcagtatcaggatgatgttggtcgttcgaggcgattgggtgcaatggcaaagggaagttccgttggcggggatattgaccgaccgaatgatgttccgctcgaatga

SEQ ID NO: 81179 - DNA, 408 bp, Glycine max
  Peptide Sequence Number=SeqID_172864
atggataagagtttgaaggtaggagaagatgagtggagggagagggagagaaggagcacaaaattttgtgtctcaaatgagaaagccattgctcctacggtgaaaccccaacccttgcctcctatgcaaattgatgagttggaacgaagggtagagcctctagctgtaaaggctgctagaaaccaccctgcaggcacaactgaagtgctcatccaatggaaagacttacctgactttgaagccacatgggaatcgattgatgttatgaagcaacaattatctgcatttcatcttgaggacaaggtggctctcttgggggggaatattgttaggctactggttaagcaagtgtatgaaggaaggacacatggcaagtataagaggaagtcagagcaacaaccaaagtag

SEQ ID NO: 81180 - DNA, 387 bp, Glycine max
  Peptide Sequence Number=SeqID_172865
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccggtccgaccgctgcgccttatccggaaactatcgtcttgagtccaacccggaaagacatgcaaaagcaccactgggcagcagccactggtaattga

SEQ ID NO: 81181 - DNA, 1632 bp, Glycine max
  Peptide Sequence Number=SeqID_172866
atgactggccgtatgctcggccaggccagccgggagatcacgctctaccgcccgaaagctgattttgttgagcaatcctctgatgagatctggcagtccgtgtgtaacgcgattaaagacgtggtcagtcaggcggatatcaacccgattcaggtgaaaggcatcggttttgacgccacctgttcgctggtggtgctggataaagaaggcaaaccgctgaccgtcagcccgaccgggcgcagcgagcagaacattattgtctggatggatcaccgcgctatcacgcaggcagaacgcatcaatgccaccggccatcgcgtgctggagtttgtcggcgggattatctcgccggaaatgcagacccccaaactgctgtggctgaaacagcacatgccgaccacctggagcaacgtcggacatctgttcgacctgccggattttctcacctggcgcgccacccaggatactacgcgatcgctgtgctcaaccgtctgcaaatggacctatatcggccatgaagaccgctgggatccgagctatttccgccagattggcctggaggatttactggaaaacaacgcggcaaagatcggcagcgaagtgaaaaccatgggtgagccgctggggcatggcctgacgcagcgcgctgccgcagagatggggttaatggcgggcacggcggtcagcgtttcgattattgatgcgcacgccggcagcctcggtattctcggtgccagcggcgcatccggcgaatcagcggattttgacaaccgcattgcgctgattggcggcacgtccacggcccatatggcgatgtcgcgcagcgcgcgctatatcggcggcatctgggggccgtactattcggcgattttgccggattactggctgaacgaaggcggacaatccaccaccggcgcgctgattgaccatgtgattcagtcgcatccgtgttatcaggatctgcttaagcagggtaaagacagcggcaaaaccatctatgaagtgctgaacggcattctgcgcaaaatggcgggtgaacccgagaatattgccttcctgaccaaagacattcatatgctgccatatttccatggcaaccgctcaccgcgtgccaatccgaccctgaccggcacgctgactggcctgaaactgtcacgcacgccggaagacatggcgctgcattatctcgccaccattcaggcgctggcgcttggcactcgccacattattgagaccatgaaccagagcggttactgcattgataccattatggccagcgggggcggcaccaaaaatcccatctttgtgcaggagcactccaacgcgacgggtgcgcgatgctgttgccggaagagagtgaagccatgttgctcggcagcgccgatgatgggcaccgtggcggcgggcgcagtacgactctttgcccgaagcgatggccgccatgagccgcatcgcactcttttcgccacaatccgcatttctaccagggcattctccggaatgaactctgacacgccgatggcagaccatgccgggatgggtacttatcggtttgtctttccgcgctgccgtcacaccggaaagatacagggtgccatcggcttcgataacgggagagaagtgccagtcatg

SEQ ID NO: 81182 - DNA, 111 bp, Glycine max
  Peptide Sequence Number=SeqID_172867
atgaggagatacatggagaaaaatgaagaaacaaaaatggaagagaagcttgcttgtgaagctacaatggaggctggatctttgagcttcaatgagatccttcaatggtga

SEQ ID NO: 81183 - DNA, 306 bp, Glycine max
  Peptide Sequence Number=SeqID_172868
atgagacttacctgccaagcacttaagcatttgatcaatgaatggcaggggaaaatgatcttttctggtttcctggttcagcctcttataatcaatgcagactcgccagctgttctacactcttgtggggataagctcatccctctcattcttgatcgctgtgaggcctgtcttctaaggaaccacttggactggactcacccactggctgtcagaaatggggtagatgattccagcttgcaagagcttggctgtggctgcctcactggcttagctccatcctctaaaagtatcctatgcatgtag

SEQ ID NO: 81184 - DNA, 566 bp, Glycine max
  Peptide Sequence Number=SeqID_172869
atgggattaagtcaaatgcctctgctcaagaaaaggttttaccaagtcaagatcaagggtctagaggtcaccagtttacaagaattaagggagttgatggggcagctccagtggcaagcctttcgcaaagcctatggtaagatttggaacttggctatgatagaagcctttgcaaaggcgatcgcttccctcacccagcactatgaccaacccctgagatggaggaagccttatctcttttctggattctacccctccatgtctagaatcgccagagtagttagaatttcagcacaagaattagaccgagtaaagcaaaatagaaatggagtggccggtataccaagaaaatgtctagaagaaagagcaagggccttggcaagtcaaaacgagtggcctcctttcattgatatcctagcgctgttaatcttcgaagtcgtcctctttccaaacgtggatgatttggtggacctagcagcaattgacgctttcctcgcctttcaccacaacaaggaaagtccagtcgtcgccatcttggccaacatatacgacacatttgaccggag

SEQ ID NO: 81185 - DNA, 249 bp, Glycine max
  Peptide Sequence Number=SeqID_172870
atgacgaagaacgaacgaagaatggtgaagaacgatgaagaatttccacagaatctcttacggaagcgttacggaagtacttcgactcgatttttcttcacgaaaacgtgctttttgccaaaaatagccgaaatgcatagccaaggggtttatggaaattttacggaagcattacggaagccacggaagccccggaaaccatttttcaaaaacgtggaggagcatgccgcccagttgcttcctccttaa

SEQ ID NO: 81186 - DNA, 323 bp, Glycine max
  Peptide Sequence Number=SeqID_172871
atggcttgcctcccaaactatacaccacccaatgtggcgtacattccgaatgaggatgtcaataactccactcccatactcattaagtgccaacaacctcaatctgatcatgcacatgtctctcgacccatggaggagacgcatgaaattccccaccacgatctagccaacttcgagccttgcctcggatatgccgctgaagggcaagcagttggtggtatacccatgccaaacactttggagggccctcagtttcgcccacaaccacaacccttgcattttgcggtgggaagagcccctcctgctatggctgaaaagggaaa

SEQ ID NO: 81187 - DNA, 414 bp, Glycine max
  Peptide Sequence Number=SeqID_172872
atgttgatagtttcgatgccttcaatatttttcagactatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 81188 - DNA, 150 bp, Glycine max
  Peptide Sequence Number=SeqID_172873
atgacaatagataccttagagccctacattggggcaatgagagacaccatgcatgagcctcaagcgaacctagggccagatccgaagttcttacccgataggaaaaaacaatcaagagcgtgttatcaggggattggtcctgaaatctaa

SEQ ID NO: 81189 - DNA, 572 bp, Glycine max
  Peptide Sequence Number=SeqID_172874
gtacattgagcaactgactgaaatgcctcaaaatgttctttacgatgccattgggatatatcaacggtgttggaacctcttacgtgccgatcaacgtctcattttcgccaaaaagttggcccagggcttcccggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgattcaaatgtaaatgggttgacaacaacaccgacccttgtgatgaaaagtggtcagtggttctacacgggaaaacaattggtgttaatgttgaagatgataattcatacattgatacttatgttagtcctttgtccacacaaatgtcgcctaacatcgttggagaagaagaagttgatgacgttcatgctaatc

SEQ ID NO: 81190 - DNA, 141 bp, Glycine max
  Peptide Sequence Number=SeqID_172875
atgggggtgagcttagctattataggggcttctttaggaatcttcttaaggaagcttctcaaggagcttctcaaggaagtcttctcaaagaagcttctcaaggaagttttctcaagaaagcttctcaaggaagctacctag

SEQ ID NO: 81191 - DNA, 303 bp, Glycine max
  Peptide Sequence Number=SeqID_172876
atggttcaactaagcgcacatcattgcgctaagtccaacaacttcactgtaagttgcaccttaagcagtgggcttagcgtggatggtctgctaagtgcgccatcctgcgctaagccccagattcattcttcattggaagtgcgcttagcgcaggtagtggcactaagcctgaatcactcactgctaagcgcatgttgcagaaagatttttggtgttgtagaaagcgctaagcgccactgctatgctaagccccaaatgcttactggaagttacaacttcaagtttggcttagtgcgaggctag

SEQ ID NO: 81192 - DNA, 354 bp, Glycine max
  Peptide Sequence Number=SeqID_172877
atggcacctccagactctattcccatagcagagcagtttaatgagatggtagcctggcccgggacccaaccttctcttcataaggaagacgaaggtcccacagcccaggtacctcagcatataaaggatgagtcatctgaggccaccatcccagagccatttgatataggagaagaggaagaggaaacacagcctgcagcagacccctccactcctcttctacagatgctagaggacccaactacagtagtcctagctatggacacttctcctcacactactccagtgcttcagctgacagatgaggaggatggtcagacacaggacacacaggaccagtcacaagaattttga

SEQ ID NO: 81193 - DNA, 282 bp, Glycine max
  Peptide Sequence Number=SeqID_172878
atgaggtccttcaatggtgattttccaccatggagatgcagcggaaggcaaaggagaagaggagaggagaggcaccatctactagagaataagccatggaagaaggagcttcaccaccaagaatgtgccttggataagaagcttgaagaggataagaaggagcttcaccaccaagaatgctttgaagtgtgtctcaaaagactttcattaatcaaagttacaacaagtgttacacaagcttctatttatagactaggtagcttccttgggaagctttcttga

SEQ ID NO: 81194 - DNA, 525 bp, Glycine max
  Peptide Sequence Number=SeqID_172879
atgtgtagaaactgccggaaatcgtcgtggtattcactccagagcgatgaaaacgtttcagttgctcatggaaaacggtgtaacaagggtgaacactatcccatatcaccagctcaccgtctttcattgccatacgaaattccggatgagcattcatcaggcgggcaagaatctgaacggtctggttataggtacattgagcaactgactgaaatgcctcaaaatgttctttacgatgccattgggatatatcaacggtgttggaacctcttacgtgccgatcaacgtctcattttcgccaaaagttggcccagggcttcccggtatcaacagggacaccaggatttatttattctgcgaagtgatcttccgtcacaggtgctccagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 81195 - DNA, 522 bp, Glycine max
  Peptide Sequence Number=SeqID_172880
atgttgattgagaatacaccctttgatctcgaggaccctccatctcccattgaaaggcatgtcaagtggaaaatggcttgcaccaagcgatatgggcagatgacatcagaggcggcacaagaaatatccgatagaattggtagttttgttccccatggtcgggacgacatactcaatacagccattgggcgatcggagcatccaagtcgtgttcatgtagcggggtctggtatgaccattagtcaatattatagtagggcatcacgtggctccagcaattcctctacaacaataacccaacaacagttggctgacattatcaaaaacctgaaggaacaagagacccatgttagtccaaagaaactgcctgaaccagttcaaagggcaacaaatgtttttgaagatgatccattgcgtcagctgattaagagcctgtcataccctaatttcgtccggggacctttgcttgatgacatgcgacctttctttggtccttgtgaggtgcttggcacccatcattag

SEQ ID NO: 81196 - DNA, 209 bp, Glycine max
  Peptide Sequence Number=SeqID_172881
atgagtctcagcctgcagagtcagggctttacttctttccgtgccctactccggaccagttcagggtagaggtcgcatggcctgaggcccaggcaggagaggcaccagcaggggcaccagcagaggctcccgatgaggcagaggaggcccgcgaggacgaagagatgaccgatttacttgatttcttaggagggagcggagccgcatga

SEQ ID NO: 81197 - DNA, 348 bp, Glycine max
  Peptide Sequence Number=SeqID_172882
gaaatcactgccaaacaagtccagcattggccaaagaaagggaagctttctacagggaagctaagtgtgaagtatgcaatcctgcataggattgacactgccaactgggtacccaccaatcatacttccactgttgccacagggaaagctgctgcttcaggtgctgtgtccaaggatgctttgattgctgaactcaaggacacatgcaagacagtggcattgatgatggatgaagcagctgaggaagaagaagaagcagctgaggaagaagaagaagccgctgaggaagaagaagatgcagcagatgatacagaatccgatgatgatgattctgatgccaccccatga

SEQ ID NO: 81198 - DNA, 414 bp, Glycine max
  Peptide Sequence Number=SeqID_172883
atgatgatgataaaagatgatgacaaaggtgatgacaaaaagctcaaagatcaatcaaagaacaattcaagagaatcaaaggccaatcaaagaacaactcaagtaaatcaaagagcaatcaagaagactcaagaagaaagtctagagacaagaatcaagattcaaggttcaagatctcaagaatcaagatcaagattcaagactcaagattcaaggatgaagagaagactcaatcaagataacttctccttccaaggcttaatccctagtggatggcgcctcctctcacctcttcttctttatcttccgttgcatctcgatggtggaaaatcaccattgaaggatctcattgaagctcaaagatccagctgccatagaagcttctcaagcaagcttccatcactacctaattaa

SEQ ID NO: 81199 - DNA, 456 bp, Glycine max
  Peptide Sequence Number=SeqID_172884
atgtatatgagatctttcttgatcggtgctgctgtggttgcatcctttggttactgcaaagagcgtgatggctcttgggtaaaaaagggtactcaaccaaatgatgatgaaggacaattaccggttgaaggagactcttctctccttcaaagtattttggacaggtttgatggactccaaacctatgttggtgaaaggtttgatgctttggaacaacaagtggacatgcgatttgatgcaatggactcaaggatcacaaaggattgtcatcatcaaaaagggggagattgtggaagcaatgtcttccaaggttattttgatgatgccaaagaatcaagagtcaagcaaaatccaaagattcaagaatcaagtttcaagaatcatgattcaagaataatcaagatcaagattcaagactcaagattcaagaatcaagagaagactcaatcaagataa

SEQ ID NO: 81200 - DNA, 291 bp, Glycine max
  Peptide Sequence Number=SeqID_172885
atgagaacgaaaattctcgaagaaagtaatgcagtcgttgatgatggggttgatgttgaaaatgtgaatgatgaggccttcagagaagccatgcccctgggcaccaagatgctctcttggcttcttcatgcccttgctataagtgtctgcactacgttggtgtctgtggaaccaaagcttacagttgaaaccagaagccatgtaatgaaggctatgttggggttcttcactataccaaatgatcccattgatgttgtcaatccccttatagacaacttgattactctttaa

SEQ ID NO: 81201 - DNA, 746 bp, Glycine max
  Peptide Sequence Number=SeqID_172886
gaaggaccaagcccaaggaattttgggggctgcacctttaaaacccaaggaagataagggtaagaccatagagaaatccacccctaagactatttcccaagcaaggactagcaacattaaatgcttcaaaagtcttgggataggtcacattgcctctcaatgccccataaagaaaaccatgattatgaaggctcaagacatttatagtagtcaaaaggagactacttccctttcctctagtggaagtgaagatgaagtaaggggtgaagagtctagtgaggaagtctacccccatgaagaaggtgacctcctaatggttagaaggcttcttggaggacatattctcttaggaaggccatggcaatttgattggaagatcatttacaatggcctaactaatgagattaccctcacccatcttggcactaaatttgtgttgcattctcaaacaccttcacatgtagctaaggatcaagtacaaataaaactcaaatgggatgaggaaaagaatagaaaaagaaaagaagaacaacatttaatggttaaggaggagtgcaaggagataagtgtctcctctaagacgttatctaagaaggaaagtcatttttcaataaagacaaacattaaagaaacttcacttcttagacaacctccacatcttttcctttgtaaaaggacacttgttagaaatgtcatacctcttgagttttatgttattcctcaagtaaaggagttgttggatgagg

SEQ ID NO: 81202 - DNA, 282 bp, Glycine max
  Peptide Sequence Number=SeqID_172887
atgtataagattgttgaagtaaggcaatcaaaaagatataataaagcatacgacctattcatatttgcacaacaagaagaacaagtttattacacaacatatcctgagggacatcaaggatggtcagccgtaatgaagacaaaaactcgcagcagaatcactgacaatataatagatgcagatttacttaaagaagtagacttggttgaaccagacgaggatgaatgcatattaagtgagaatgacattgagagtgattttgatgatacaaatacttcttag

SEQ ID NO: 81203 - DNA, 1191 bp, Glycine max
  Peptide Sequence Number=SeqID_172888
atggcatcaaagaagagaaaggcacctggcacaccttcccaggaagaactagagagaagaaaatgggatgaggaattgactagttttgatgaaggcaacattgatgttgcaattgtaaaagagttttatgctaacctctatgatcccaaggataaatcacctaagcaggtgagggtgataggccatttggtgaagtttgatgtagacactctgaacactttcttgaagacccctgtgataattgaggagggggaagagcttcctgcctactctagatttgcaatcttgaggcttgatcctcaagagttggctgctaagctctgcatcccagggaggggatttgagttgaatgctgatggtcagcctctgaagatccttaggaagaacatgaccacactcgctcagacttggagtgttatttcttactccaacttggtccctacctcccacacttctgacatcacactggatcgggccaagttgatttatggcattatcatgaagatggacatgaatctgggctacctcatctcccaccagatttttatcattgcccagcatgactcctctaggcttggattttcagtcttaatcatagctttgtgtaaagctagaggagtcacatcagattccagatctttggagagtcttagccctgccattaacttggcatatataaagaagaactgttggagtctagatgatccaatagtgacattcagagggctaaggaaggccaggggtaagagatctgaggctccccctacttcagcagcaccagatgcttctactccttcttcatctactttaccagatccttcagcaccagccacttcgtctccacatcttccacagttaccagcttcagctcccactcccttaccatctctaccatctccttctagagggggtgaggcctccacagcccaagagtatgtgctagtagaggagcctgtgccagaagcagaggatgagcttgttcctcttgagccatcttttcatgagactgattcaatcgctcaggaggaagcagtagctcaagagcttcctgcacctatttctgaggataccctgccatctgcaccagcattggagcaagagcagcctagttcacaggatccaccagctgctctagtgctggatctgaacgagcatgcagaagatcaacaacaggatgatcaggagttttaa

SEQ ID NO: 81204 - DNA, 465 bp, Glycine max
  Peptide Sequence Number=SeqID_172889
atgaggcgagtatctaaagtcacacatttggaaggcccgactgggtttgagataaaagtcagtgagaaatgcatctggaacataaactggcagatggccaacccaaaatctaaagagcatttactgcaacaaaatggaagagcaaaacaatatgtgagagctggggacagtgagagggaactgaatagaaacaacagagcaaggccagaaatgacaggaaggtgctggaaaacgtcagaaattaccagagatggtgccagagaaaagcagaaccacagaacagagactacggtgcaaagaagtgatgagaaaaggagagaaatgaacaaaaacagggtctttgatgttgaggaaaagaaatgtcttggacatgtgaaagtaatagcactgataatggatgcaattttggccatgaaaagcaccgcttcagctgcaacgggctggtgcaacacgacaacaggatag

SEQ ID NO: 81205 - DNA, 243 bp, Glycine max
  Peptide Sequence Number=SeqID_172890
atgccatctttaattgcttacaatgatcctcagtatgctatgaaggtcaatacagagttccatggaaagtgcttggcacccatcattaggcaatttgtgaaattccaggacatgccggaaaaccaaaaaaatattgatgcacaatccctgggttgcttctggaggaagcaacccagctcgcctgggcgagctaagttcgcctgggcgagctgggcggcaacctcctccccctttttcctataa

SEQ ID NO: 81206 - DNA, 321 bp, Glycine max
  Peptide Sequence Number=SeqID_172891
atgaagctcacaaatgtagcccttgagaggctcgacgtagtcctcaaagccgagagtggtcatcgcctagagcaggttgttgtcgttgatcgtcttgcgcttctcgcattggcacttgtcagaggccttgtcgatgatgaagctgatgaactccgacacgcactcttacaccgtctcctttgcgtccttcgagatcttcgcattcgtcgtcaaagccttcttcatgatgtggctcacaaagctgtcagagttgttgtcaaagtccgccatcgacaaacagataatcaaagaagcaatgagaaagatgaaacgaatcactaa

SEQ ID NO: 81207 - DNA, 201 bp, Glycine max
  Peptide Sequence Number=SeqID_172892
atggctgaagttattgttggagctaatctcaattgtagtagctttcacttcaaagatgaacttctcccaagtgatgatgatctgacaatgggttatcgagtggaggcaatgatgaaaggttatagagatgatgatatggttgaggtgacttgcaaattaagcaatggcagtgaagatgataaaagtgatgaggtgtggtga

SEQ ID NO: 81208 - DNA, 487 bp, Glycine max
  Peptide Sequence Number=SeqID_172893
atgacttcttctgtggagttgtggtttcttggccaagggtaccatgaccacttggaaaagggagttggtgatgtcccaaacgacaagaaatctgagtgggaaaaacttgattttcaactttgtgctgcccaagagatttttgccaatgatattcaaagcctgtttgatgcaaccatgaaagttacagctctcaagcaaaccagccatgacatgattgcacacataggtaaagctcgagccgcagtggaagagctgaaaaggtttcttgtggttgattcgttggaggaattcttgctggagaccaagttccgtcaatggactctcatcactagacttcttcgtgtgcctcatgtattgaaagatgaaaatctagctgatgttgtggaaacatcaaccatgattgcacctcgtgggagaggaggaggccggaacaatagaggaggccgcagtggaagaggtggatgtcctcaatgcacctattgcaaga

SEQ ID NO: 81209 - DNA, 300 bp, Glycine max
  Peptide Sequence Number=SeqID_172894
atggtagagcattgcatggaatcgacgagcaaggacgaaaaggaatcttcaagtgacgcgatgaggaacccgtggggtagtcacgatagggtctttggcactagcttttggccacgttcatacgttggatgttgtgtatgttcgtggggggcactgtgcactgaccttccagggtctttggcactagcttttggccgtgatcatacatcgtatggagtggaacacctttgggctctcaggctgatcacctatgggaggggggctgttacgtgcacaaccgggtggtctcgacaaacttag

SEQ ID NO: 81210 - DNA, 165 bp, Glycine max
  Peptide Sequence Number=SeqID_172895
gcgataaagggaagcgccttggcagattattggcccaacaacccctccaagattatcggccgatgcaccctgagttcccggatgaagacatcatggccctattcgaagagaagcgaacacacgaggatatggacaaatggattgtttgcttcgatggggcattga

SEQ ID NO: 81211 - DNA, 519 bp, Glycine max
  Peptide Sequence Number=SeqID_172896
atggctccgaaaaagctttccgcaaagagatctaggagggatgccgcggctgaagggactagtgccgctctcgagtttgatagccaccgtttcaggagcgccgagcaccagcagcgtttcgaggccatcaaaggatggtcgttccacagagagagacgcgtccagctcagggatgatgagtacatagattttcaggaggagatagctcgtcgacattggacatcgctggtcactcccatggctaagtttgacccagatatagtcctggagttttatgctaatgcttggcccacagaagagggagtgcgggacatgcggtcatgggtgaggggtcagtggatttcctttgacacagatgccctcagccagttcctgggtgacccactagtgttagaggaaggccaggagtgcgagtttagtcagaggaggaacagggccaatgggtttgacgaggagaccattgctcagctattatgcacaccgggtcaggattttgcccggaccgctgcaaggaggcgg

SEQ ID NO: 81212 - DNA, 1386 bp, Glycine max
  Peptide Sequence Number=SeqID_172897
atggaagtaactggccttgaattgcaggctgtcatccgccagcagcagatggttgaagcgcagccagaaaccggcttcggtggtgctggtggtttccggccgcagattaggattgggcacccaatagttgccggggaagtggcgcgaatcgttgtacatctcgcccatggtcggggcacggaaggcctgggaataggagccgaacagcatcagccagtcggtcggcgagtagctcagggctccgcgggacgaccatttgtcggccttgacgtcttcgtggccctggctgttgcctttgtaatcgtcgtagcgcgtgcctgccagcacggtgaccggaatgtcgcgcagcgtaatttcatcctgcagccagccggaggcgaagtttatcttggcctgcgggaagctggtggtggcgccgcccggctgctgtttctgttcatagatctcggagccgcgcgtgcggttttccagcttgccgccgttggtggtctgcttgcggaattcgtcggtcgcgccggcgttgtgtgcattgattttgacttccgaggtgtacaacttggcggtggcgtccagcaaatcctggccgaccggcttgagcttatagctcaatgccgcatcgcgctggatggtcgagcggttggtcatcgggttgccgctcgagctgcccggcgtctgcggatttttcggctcttgagcgctgttgttgtagtagcgcagatcgccgctcagcgactgattgtcgtcgatcttccaggtgcctttggccagcacgttgctgatggtttcgtcgttaggcgcatcgaagccgttgccctggcgcagatcgccgacgtcgcgggtgccgaaagacagcaaaccgtcgaggttatcggtcttgccgtaggcgctggcgcccatgcccaggctgtgatcgccgctgccggcggtgccgtagacgcggaacccgctatcgtggcccggcagcagcagatcggcggcatcaacggtctcgtaggcgataacgccgcccagcgcgccgctgccgtacagcaacgcggagggcccgcgcacgatttcaatgcgcttgaccagcgccggatcgaggaaggtgccgccgatgtggccggtatcggtcccctggcggatgccgtcgaccagcgtcagcacgccgtttttgccgtagccgcgcatcgtcacgtcctggccgttgctgcgcccggtgccgttgacggtgatgcccggcacgcggcgcagcatatcggcggccgaggtggcggtctggctttccggcgagttgccttcaatgaccgtgaccatcatcggcgcttcaaagctgctgcgctggttgccggtggcgaccacggtcatggtctcgtcggcggctttggcttttttggccggcgccgc

SEQ ID NO: 81213 - DNA, 1218 bp, Glycine max
  Peptide Sequence Number=SeqID_172898
atgattgaacaaccgggagcaatttacttacgatatttagttgacattcataaaaagtatctaatgatttatgaattcaatacatcctgtttagcagaaagacgtatattccttgctaattatcagacaattacttattcacaaaccttgcggggggctaatagttttcatttcccatctcatggaaaacccttttcgctccgcttagccctacctccccctagtaggggtattttagtgataggttctataggaactggacgatcctatttggtcaaatacctagcgacaaactcctatgttcctttcattacagtatttctgaacaagttcctggataacaagcctaagggttttcttattgatgatagtgacgatattgatgatagttacgatagtgacgatatcgaccgtgaccttgatatggagctggagcttctaactatgatgaatacgctaactatggatatgatgccagaaatagaccgattttatatcacctttcaattcgaattagcaaaagcaatgtctccttgcataatatggattccaaacatccatgatctggatgtgaatgagtcgaattacttatccctcggtcttttagtgaactatctctccagggattgtgaaagatgttctactagaaatattcttgttattgcttcgactcatattccccaaaaagtagatccggctctaatagctccgaataaattaaatacatgcattaagatacgaaggcttcttatttcacaacaacgaaaacactttttcactctttcatatactaggggatttcacttggaaaagaaaatgtcccatactaatggattcgggtccacaacgatgggttcaaatgtaagatcggttcaggatcatgggatccttttctatcagataggaagggctgtttcacaaaatgtacttctaagtaattgctccatagatcctatatctatctatatgaagaagaaatcatgtgacgggggggattcttatttgtacaaatggtacttcgaacttggaacgagtatgaagaaattaacgatacttctttaccttttgagttgttctgccggatcggtcgctcaagacctttggtctctacccggacctgatgaaaaaaatgggatcacatcttatggactcgttgagaataattctgatctagttcatggcctattagaagtagaaggcgctctggtggatcctcac

SEQ ID NO: 81214 - DNA, 270 bp, Glycine max
  Peptide Sequence Number=SeqID_172899
atgttgtggaagcttgggaggattgatggggacccggtgttgagagaaacgaggataagggctacgtgggagtacgtgagctcagttgaaggtgggcaacaggggatggtgggtttatatatgatttgtggatgtggagaattgttttgcaccatcgcccgaccaccacctagtaccacatgtgatggagtggtacctagagatatgtcgcgggggtcaggagaccttggggacatcaggtggggtgctattgcccaaaaccaagcttga

SEQ ID NO: 81215 - DNA, 246 bp, Glycine max
  Peptide Sequence Number=SeqID_172900
atggagaagaattttggagcttcaatggaggcacaatggagaagaagaagaagagaaaaaggcaacaagccaagtggtggctccactcattcaaggaaatacttcccagagtcgaagactgcggaagggaaagctacaatctcttcatttcatcagtttcctgatgaatctctaagtgaagcattggagaggttcagaggcttgttgagaagaactcccactcatgggtttttcgagccaatctaa

SEQ ID NO: 81216 - DNA, 102 bp, Glycine max
  Peptide Sequence Number=SeqID_172901
atgaacaaagaagaagtcatgtccccagtggagtcgccaaccgtcgcaacctacccttcggcaggagggcgtcgcgaggctcaccagtgcgtcttccaataa

SEQ ID NO: 81217 - DNA, 543 bp, Glycine max
  Peptide Sequence Number=SeqID_172902
gtgagggcgtgcagccctctgatggctaggacgtgcggccctctgatcgcgaggtcatgtggtcttctaaaggcgaggatgtctagtcctctaaaggtgagagcgtgcagccctctgatggcaaggacgtgtagtcctctgaaggtgagggcgtgcaaccctttgattgtgaagacgtgtagtcctttaaaggtgagggcgtgcaggcctctgatggcaaggacgtgtagtcctataaaggcgaggatgtctagtcctctgaagaaggtgactgcgtgcagccctatgatggcaaggacgtgtagtcctctgaaggtgggggtgtgcagccatctgatggcgaggaagtctagtcctccgaaggtgagggcgtgcagccctctgattacgaggacgtgtagtcctcagaaggtgaacgcgtgcagccctatgatggcgaggacgtgtagtcctctaatggtgggggcgtgcagctatctgatggcgaggaagtctagtcctctaaaggtgatggcgtgcagccctctgatggcgaggacgtga

SEQ ID NO: 81218 - DNA, 540 bp, Glycine max
  Peptide Sequence Number=SeqID_172903
atggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaactgaaacgttttcatcgctctggagtgaataccacgacgatttccggcagtttctacacatatattcgcaagatgtggcgtgttacggtgaaaacctggcctatttccctaaaggccaatccctgggtgagtttcaccagtttggatttaaacgtggccaatatggacaacttcttcgcccccgtattcaccatgggcaaatattacacgcaacgcgacaaggtgctgatgccgctggcgactcag

SEQ ID NO: 81219 - DNA, 171 bp, Glycine max
  Peptide Sequence Number=SeqID_172904
atggagaattggcgaacagcgctaggcaatgacattcgcggggctctcagactcgaagcgctaggctatgacattcatagggctccaaaaaagtggagaatggagaattggcgaacagcgctaggcaatgacattcgtagggctccagactcgaaggtggaggacacatga

SEQ ID NO: 81220 - DNA, 812 bp, Glycine max
  Peptide Sequence Number=SeqID_172905
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttgaagcacacgtgatgttagatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 81221 - DNA, 537 bp, Glycine max
  Peptide Sequence Number=SeqID_172906
atggggggttacacaccttcaagctttgctgatttagttttcgccgatgaaaggatcgaagtgggtctgaaaataggcaaatttaatcatcctgcttggacgaatgagaaaactggggcaaatgaagaggctgatatcatcccttctcattacacaccacccagtcatccacaaaggtcatccctaaatcaaccacaaaacccacctaccacacaaccaatgctaaacaccacctttagcacaaaccaaaacaccaacgaaggaaggaattttgcagcgaaaaagcctatagaattcaccctaattctggtgtcctatgatgacttgctcccatatccactcaataattcaatggtagccataaccctaaccaaggttcctcaacctccatttctccgaggataccactcgaatgcaacatgtgcatatcatggaggagttccgggacattccattgggcattgtatgacttcaaagcgtaaggtgcaaagtctaattgatgcagggtggctggaatttgaggagaatcgcttgtga

SEQ ID NO: 81222 - DNA, 459 bp, Glycine max
  Peptide Sequence Number=SeqID_172907
atgtccatcacttggaaggacattgagggaggagtcgttgtcaataagaactttggccgctatgtggtccaaacattttatggatacgtgcaaggctttgttgtgcccctagccctcgatgggtatttcttcatcggggaatgtgaggatattcctgtttttctcaagtcatcttcttccttggcaaaccttccggccgggacctcgtcctccggaactaggcccaccttgtcgctctcttctacacctgcctttgctttcccctttgggtccttggaccacaccggtggctcgggtgccgtgaagatccgcccactacaagtcattccgctcgtgccagagatgttagtgaccttagcaaaggatagatcacctttaacgtgtacgacggacgcgtccttcctttcatcgggcctttgtgtggcgtacctccatggcactgctttgtcactcttgtag

SEQ ID NO: 81223 - DNA, 190 bp, Glycine max
  Peptide Sequence Number=SeqID_172908
atgactatgacacaagatcacgagaagcttgattcagatttaattgccactagtgtagtagacatgatcagagaagattcatcaataaaagtttctttgattcaagaaaggataaacaatgaatttgcctacaaggtgtcgtacaaaaaggcttggatggcgaaacaaaaagtcattgcaattgaatatg

SEQ ID NO: 81224 - DNA, 396 bp, Glycine max
  Peptide Sequence Number=SeqID_172909
atgcctacaagacactcagtgggccctaagaagtccaacagggtcttggggtttccagctctgattacgagcctccgtcagttctacgaagtgcccgtcgcctccagcagggtcatcaggcccttattaacagggctttcatcgagaagtactgcgcctccaagaaggtgcagggcgaggcatcacagtagcgggcaacagacgcactgccaccacctccagtgttcacctcagctcatccacaaaaaggctggagcgttgcctacgacacatggccgaccaacatgcgaccaagtccaaagccaaagacaaagacaggggcagctaagggatgatgaatttttgcacttccttggaggaggcggagccatacaatcgggatcgccaaacttgtga

SEQ ID NO: 81225 - DNA, 120 bp, Glycine max
  Peptide Sequence Number=SeqID_172910
atggctagaacacgaggtttaggtcgtgccataggtagagttataggcagagatagacaggatgaccatgatgatgttcccgagaggcgtaggcctactgcatcagcccgtaggcaacgg

SEQ ID NO: 81226 - DNA, 339 bp, Glycine max
  Peptide Sequence Number=SeqID_172911
atgtataatagtataataacctatattggtctccactgcagtgcacattggcaaatggtcatcattttgcctaaggaaaatgttgtcatctggttttgttcattgcatactaggccagacaactacctcaaaggaataattaacagtgctttgaaggacttgacgatactccacaaagtaaatccaaggctggtgctaggtggattgttgttaaatgtaatagacaaaaaggaagcaccgagttatttcaatgatgtcagaccattggaacctgagagattgaaggcgcttcgcatccagtgggcaaagtattatttgaaagttagaaatgaaacttag

SEQ ID NO: 81227 - DNA, 261 bp, Glycine max
  Peptide Sequence Number=SeqID_172912
atgggggtgcaaatagcaaccaggcccacttgggccctccagaaggttgttgcttctggaggaagcaaccctgctcgcctgggcgagctgggcggcaaccatctcccctattttgctataaataggggaggaagtgaagaagaaaaggccgaggcgcttctgaaacgtttccgtaacgtttttcgtgaggaatttcgcaaaggtttcgaccgttcttcgacgttcttcattcgttcttcatcgttcttcgatcttcaacgg

SEQ ID NO: 81228 - DNA, 157 bp, Glycine max
  Peptide Sequence Number=SeqID_172913
cagtagcgacaacggtagagatatcagtggcgatggcggtggtggaggtggaattggtggtggtagcaatgacgacgtggtggtggtagcggtgttggtggtgacaacaactgttaagtctggttgtgtccaactcacattggattgtaccaaatag

SEQ ID NO: 81229 - DNA, 225 bp, Glycine max
  Peptide Sequence Number=SeqID_172914
atggtggttcaacagcaagtaacaacagctcgtgacggccaccggtggtcgtgggtggtggaggaggattttatagggtggtttggtggagttttgagagggaggtgtgaaaatcgtctttgcaagcttgtcttgctaagtgggaattcacttttggcgctaagtgcgaattcctctcgggttggtattgcgcttagcgaacttctcgcactaagtgagatgtaa

SEQ ID NO: 81230 - DNA, 225 bp, Glycine max
  Peptide Sequence Number=SeqID_172915
atgagtcaagctcaagccttacgtattcaactcgggtcgagctcaagcctagtacccataattttttccacttgtggacttgttgacaccgttcaagaagggtatactggattccacatgggagcattcaacgtagaaatcagtgattacttgaatgtgactattttgttggttattgtgagtgctggatatcatctcagcttggctaggtgttttgggacataa

SEQ ID NO: 81231 - DNA, 288 bp, Glycine max
  Peptide Sequence Number=SeqID_172916
atgtggtaccatatttcaatgaaaaacctcgtcaggcgcctaggagtacatgacaggacatgcctcacaatgggtaggtcaggcttaaaggagcactcaaaccggatgacccccaaggcctacactccgaagagttcgtcagagcctctccctcctgattcaggtccaacccagaaaaaacatttgaacacacagactctacctatgaattatgcaatgcacacaactactcaattgttttcaaaatctcaattatatatatattttaactcatcgcgcctcaagtga

SEQ ID NO: 81232 - DNA, 246 bp, Glycine max
  Peptide Sequence Number=SeqID_172917
atggagcaagaaaatgaagtgaaaatcaagcttagagttgaaaatggaggtcgcttacctaagcttgatggaagaagggctcaagaacacttggtaaaacatggaagaagaagaaaaatatggtatcctctttctccaaaatcttcagcaaaatcttggacagcccttgaggttctctccacgagctcagcaatgccttatatggcttcttgcacttttccagaattatataaaaggataaagtag

SEQ ID NO: 81233 - DNA, 261 bp, Glycine max
  Peptide Sequence Number=SeqID_172918
atgccagaaacttcaatgttgcagaatgggttgaagcctagaacaacggtgctgaaaccctcaaagcagcaaactaaaaaaggccaaacctcgatgccgaaaccacggagccatcaagatgcaacgagaaagagcaaagggaaaatatcagagtttagttttgtctcaaaatttcagagggcagggtgggaaagtgaactcaaaaggctgcctgctaggggtcttagcgtagcgggtgctagagatctaaattcaaattga

SEQ ID NO: 81234 - DNA, 456 bp, Glycine max
  Peptide Sequence Number=SeqID_172919
atggagctacatcactttctaaagtttgtggatccttctaatgcttctaaaactacagaaaatttatataagattttgagggatgttgtgttacgtgttggccttgaaaatgttgtccatgtagtcacagacaatgctgcaaattatgttgttgttgcatgtgttgagaaattgaaacttactgaaccacttgtgcttgtgttacgcctcgttgatagtgaagataaactgactatgggatttctttaccatgctatgcataaggctagggaggagatgggggaaaacgccattgccactggcggcaaggctcaacccgccattgccagtggcggcaaagcaggagagaggggtgtatcgcccctgggtgctggcgagacagccatgcttcacgtgaaccttgcagggcttcaacttttcaggcttgcaggcttggttctgctctccattgattag

SEQ ID NO: 81235 - DNA, 928 bp, Glycine max
  Peptide Sequence Number=SeqID_172920
ctccagcgcagaggagcaggatccgacccggcgccacctggatcccccacccgggttaactgctgaagagttcgaggacctcaaaccctccgtgctggagcaccacacctactccgtcacacccacccgccaaagctcctccctcctcgcgcagcgcatccacgcgccaccacacgcggtgtggtccgtcgtgcgctgcttcgacaacccacaggcctacaagcacttcatcaagagctgccacgtcaaggagggcttccagctcgccgtggggtccacccgcgatgtccacgtcatctcagggctaccggctgccaccagcaccgagcgcctcgacctgctcgacgacgacagacacgtcatcggcttcaccatcgtcgggggcgaccacaggctcaggaactaccggtcagtcacctcggtgcacgggttcgagtgcgacggaaagatctggaccgttgttctggaatcgtacgtcgtggacgtgcccgaagggaacaccgaggaggacacgcgtctgtttgctgatactgttgtgaagctgaatctgcagaagctggcgtctgtcagcgaaggaatgtgcggtgacggtgacggtgacggtgacgggggtcggtttttagggggaaaacgccattgccactggcggcaaggctcaacccgccattgccactggcggcaaagcaggagagaggggtgtatcgcccctggtagtggcgacataggccacgtaggagtgagaatcgccattctcactggtgacacccaatctgtgggactcgcccatcgtaatggcgagatagggcttcatggcgtgccgccagcccttctggcgggattggcagtgtctgaaataggattcaaagctagctgtagatgttcacaggttgcgcatgctttccttgttcatgatgagactaaacataag

SEQ ID NO: 81236 - DNA, 285 bp, Glycine max
  Peptide Sequence Number=SeqID_172921
atgagtacaagtgatgtagctccatatagagcttgtaggccttggatcttcttcatcaatggagtcctttgcttcttgaagatcaatggcaggggaatgaagaagcctagtaatccaagatcaagtctgatgcaagctccattggagcttgtaggcctaggatcttcttcatcaatggattcctttgcttcttggaagatgaatggcagcggaatggagaaggaagagggagaggagacgccacttcaaggagaagatgagtctagaagaagctcaccaccatag

SEQ ID NO: 81237 - DNA, 429 bp, Glycine max
  Peptide Sequence Number=SeqID_172922
atgaaaaacttgtggctaaacgactgctgtctcgctaagcccaggctaagcgagccatgctcgctaagccaatcagtgtccagtactcgagttgcactaagcgagcactactcgctaagcgcatcttggaacagatacacggataacattctcggtcggaatatccttccagagagaaatgtccagatatatcatactgagtttgatgagtttaaagtagaattggagaggttggtttacggcttgtttatctcagaggggcaaggaaggcaagggcaagaccaactgatgcttcttcttcttcttgatgcaatcctccctaggaagcaaccagtcactagagccatgagcaagaggctcgaagaggattgggctaaagctgttgaagaaggccctagggttctcatgaaccttagggtagatttttga

SEQ ID NO: 81238 - DNA, 771 bp, Glycine max
  Peptide Sequence Number=SeqID_172923
atgacaccggtaaaccgaaaggcaggaacaggagagcgcacgagggagcgccagggggaaacgcctggtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttcccttttttctcctgccacatgaagcacttcactgacaccctcatcagtgccaacatagaaacagctatgaccatgattacgccaagctcgaaattaaccctcactaaagggaacaaaagctggtaccgggccccccctcgaggtcgacgaagaggtgtccagggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 81239 - DNA, 102 bp, Glycine max
  Peptide Sequence Number=SeqID_172924
atgtatctacgtgatcaaggtacctacagggaagatccaacaaaggatttagctctccatagtccgaaaacctccttcacaacaaagagaaaaacaagatga

SEQ ID NO: 81240 - DNA, 303 bp, Glycine max
  Peptide Sequence Number=SeqID_172925
atgcagccatgttgcaagatcgagaattcaatacttgagtcgaccgatcctacagagcttgaatctcaatctgtctctgctaccgttaatcatgaccgttcaatgcttgactcaactgagcctacagagcttgaatctcaatctgtgtctattaccggagatcatgaccctcttctcaggatttcattaacaccaactaagcatgtatcttccgatgagttggatgatgagccaaaaaactttcagatttcacctgcccaagtttcctcaaataaattagccaagcattctcaggctgaatga

SEQ ID NO: 81241 - DNA, 729 bp, Glycine max
  Peptide Sequence Number=SeqID_172926
atgtcctcgtctttagagggctgcacgcccttgacttcagatggctacacgtcctcactttcagagggctccacatccgcacctttagagaactcaaggagggccaactgtgcgagcacaaccagaggaggaggcaggtctccagcttcgacgaggaggctatcgcatagctactatgcaaaccagggcaagatttcgcccacaccgctgcagggagacgagtgcagatcatgcgtaccaccacaatgtcgatctccccctgtggaagtatcagttggtctatgccgtcacgacatagggatcgtgccctctacgaggagccccctggacccgaagaagtccaacagggccctagggttcctggctctgatcatcaggccccctattaaccaggctttcatcgagaagtactgcacccccaagcaggcacagggcgaggcaccacaacagcttggggacgaccagcagcgggcaacaggcgcactgtcaccacctctagagtccacctcaactcatctacaaaggctggagcgttacctacgactcgtggccaaccagcaggcgaccaagtccaaagccaaagaagaagcaccattgaagagggttccagtgtggccccacaagccgacacaggctttggcaaacactgatttcagagcatggaacatcagtagcatttcgaggccatcaagggatggtcattcctcagacagagacatgggcagctaa

SEQ ID NO: 81242 - DNA, 821 bp, Glycine max
  Peptide Sequence Number=SeqID_172927
atggtgaaagtaggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatagccattcgtgtcattttgataagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 81243 - DNA, 279 bp, Glycine max
  Peptide Sequence Number=SeqID_172928
atggcgtacctgttgaaggaggagtttcctgttgaaagagcaacaacaagaacaaaatgcggcgatgctcaaacaagacgatggtcaattaagaaatctgaaagtggttacaacaggatggaacaatttcttgcttcaagattgagggaaattatgaaggcaaactcctgcgacttttttatgcccaagggttttggaggggaagaggggagaatgggggtggaggaggaatgcggagttgagggtggtggtggcaccgggaagaagatgaagagatga

SEQ ID NO: 81244 - DNA, 273 bp, Glycine max
  Peptide Sequence Number=SeqID_172929
atgggattgaaccaagcaccctcttttaataaaaggttttatcatgtcaaaatcaaaagcctagaggtagctagtttacaagagctagggcagcggatggagcaactccaacgtcaagccttcctcaagacatatggaaaaatttgggatttggctgtgatagaattagtaccaactatagaagagtttgaaaggatcttgggatgcccactaggaggaaggaagtcgtatttgttttctgggttataccccttcatggcaagagtagcgaag

SEQ ID NO: 81245 - DNA, 192 bp, Glycine max
  Peptide Sequence Number=SeqID_172930
atgattctcgaaattgccaatcatccgaggatccatcaggcatctcttgcaggtgaatttgagattaaagaccttggatccctaaaatattttttgggaatggaggttgcaagatcaaaaaaggggattgtggtgtctcaacagaaagtatattctggacctactcaaagaaactgggatgatgggttgtag

SEQ ID NO: 81246 - DNA, 170 bp, Glycine max
  Peptide Sequence Number=SeqID_172931
ctctagcttctcatctcaaggaggtgagcttagctattagagagcttctcaaggaagttttctcaaagaagcttctcaaggaagttttctcaagaaatcttctcaaggaagcttctcaaggaagttttctcaagaaatcttctcaaggaagctacctagtctataaatag

SEQ ID NO: 81247 - DNA, 579 bp, Glycine max
  Peptide Sequence Number=SeqID_172932
atgctcgctcagacatggagcgttctttccttttctaacctggtccctacctctcacaccttggatatcacattagatagggccaggcttgggtttctagccttaatcattgctctgtgcaaggccaagggagtcatttctgattcatttacattggaaagcctcgggtcacacaaggccaaggggaagaggtctgaggctcccccatcttctgagattcccccttccttagctgcagcaccaattccatctaccccatctgcatctacatttgttcttccagctcctttatatgcaggaccctcaaatttttcatttacacctcagatgcttcattccatgctccagagcctacacagggggcagtccatcatcatgcagagccttgagggcttaggcttgccatccattatgagcatggatgagtttgatctgcagatacctaagccatctcctgcacctgttcccgaggagacccagccagctacaccagtcacggagccagagcagcctatccaggattcatcagcagtgccaacactggatcttaatgaagatcagccacaggatgagcaggat

SEQ ID NO: 81248 - DNA, 444 bp, Glycine max
  Peptide Sequence Number=SeqID_172933
atggtagccataaaccctgctagggttcctcaacctccatttttccaaggatacgactcgaacgcaacatgtgcatatcatggaggagttccggaacattccattgagcactgtatgatctcgaagcgactacacgtccacaccttcagagggctacacgtcctcgctatcagagggctacacgccctcacctttagaggactacacgtccttgccttgaggactacacggatgcacgcccttgccttcagaggactacagatcctcgccttcagagggttgtatgccctcgccttcagaggactacacgtcctcaccttcagagggttgcacgccctcgcattcaaaggatgccacgccctcgccttcaaaggactacacgtcctcgccttcaaagggctacacgccctcgccttcaaagggctacacgtcctcgccttctga

SEQ ID NO: 81249 - DNA, 243 bp, Glycine max
  Peptide Sequence Number=SeqID_172934
atgatgttgccacttagcaacattctgcccagcgaccacaatgccgatctccccctgtggaagtatcagttgggatcgtgcccacaagacacccagtggacccggaaaagtccaacagggccctggagtttccagctctggttgcaggcctctatcagtcctatagggtgccccgtccccccagcaagggatcgcgcccgcaagacacccagtggacccgaagaagtccaacagggtcttgag

SEQ ID NO: 81250 - DNA, 548 bp, Glycine max
  Peptide Sequence Number=SeqID_172935
tggagaaccggttgaggagcaaagacgccttttataatcggcggccattacctcaccactgtctgggccacagccttgtcgatgaggaggctaaacccgccgaaccgttcggagagaggagaaggaagatgcatatccacccttacattctcgaaaatcatggtgtctatcccaagagatttctggaggatggtcaattcttcggcgtgcggaaaaccactcacgataatctcgaccaacggctggtcgccgaagtcgaccgggaatccgacctgactgcctattccggatatgtcgccatggaactgtgggctgatgatgacgacattccgacgggagcgaggattgagatattgttcagcgaccggaaaggcatcgccgccctcctctatgaccatcccaacatatccgatgctttcattgagtgggtattctgcgcctcacccgtcgatgccttgactgaatggaagaggaaggccggcgagggcattcatgagaaccagtggtgcaagcatgccggctgcaagcgccgcaataacctcaattga

SEQ ID NO: 81251 - DNA, 435 bp, Glycine max
  Peptide Sequence Number=SeqID_172936
atggcttgcgatgtggcacccagctacagccgtggcaagagggcgacgcaaagtctaaatgtcaggactgtgatagggcgtcatcagccactttgctactgcatcgaagccgggaaacgctggcactttaacgagacgtttcgacagcgatggactacggccaatctcagcttcgttcagtcccctaaacgacgtgagacgggtcgcgccccgcaaggtcttccggttcgagatccgcaggatcgcgtttcgttgcccgcagaacccgttgaaaaagagaaatccaggggcatcgcgctgtaccaaacgctgatgcaatcgccgcaacgtgcagttttcgcactggcgatacccatgtccgtcgccgcgacaataccgcgtggggtcgacaataggcacatgccaaaaaaattcttttgcttcctacgtgcttga

SEQ ID NO: 81252 - DNA, 303 bp, Glycine max
  Peptide Sequence Number=SeqID_172937
atgggtagaaagaagctggagatgggttttaaagatcagaaaattgatttggatttgtttgttgaagacaagcctgctgcagaacaaaatgtttgcttacaagtgatggaagtgggtcaacaagttccagagcgcaagcctcgtgctaagcgcatatttgttcacgtgctaagccgcgagtctcaagcgcttagcgatcaacccttgcatctgaggctgatttggtccactaagttagccaaggctgagttaagccaatttcagttcgatctgaattcggctaagcgacggcctaaccgctaa

SEQ ID NO: 81253 - DNA, 294 bp, Glycine max
  Peptide Sequence Number=SeqID_172938
atggtgaaaaaacccggtggaccattcggtcccaccctcaaatcttatctggagccccatgaattgattgtcgttcatgcatcctctaccatcgagtctggagcctcacgaattgattgcctagcgctgttcatctatcctccaccctcaaatcttattcggagtcccatgaattggttgcctagcgctgttcatacatcctccaccatcgagtctggagccccacgaattgattgcctagcgctgttcgtctatcctccaccctcaaatcttattcagagtcccatgaattga

SEQ ID NO: 81254 - DNA, 249 bp, Glycine max
  Peptide Sequence Number=SeqID_172939
atgtgtgttctagaagaagaaaggttaattatggaagagggcgaaagggtgaacttaactgttcatggaaaaaagaaagggcatcaacccaaaaacaagggcaagattcctgctcagccagtcataaagaaagagtccaagtgtttcttttgcaagaagaaaggtcacatgaagaaagactgcttaaagtttaagagctggatggacaagaaagggtatggaaaacctaaggatgcttgtgggaagtga

SEQ ID NO: 81255 - DNA, 1656 bp, Glycine max
  Peptide Sequence Number=SeqID_172940
atggctgatttgctgctgggcgtcaatatcgatcacatcgccacgttacgtaacgcgcgcggaacccaatacccggatccggttcaggcggcattcattgccgaacaggcgggagccgacggcattaccgtgcatctgcgcgaagaccgccgccacatcaccgaccgcgacgtgcgcctgctgcgccagaccatccagacgcgcatgaatctggagatggcggtgaccgacgagatgctggacatcgccattgagctgaagccgcatttctgctgcctggtgccggagaagcgcgaagaagtgaccaccgaaggcggcctggacgtcgccggccagctggacaaaatgagcgtggcggttgagcgcctggcgcaggcgggcattttggtctcgctgttcatcgatcccgatcatcgccagatcgacgcggcggtggcggtgggcgcaccctatatcgaaatccacaccggcgcctacgccgaagcgcagggcgagctggcggtacaggccgagctgcgccgcatcgcggtagccgccgcctacgcggccgagaaagggctgaaggtcaacgccggccacggcggtgatgagcgggctgccggccgcggttgccgacatgaaagtgctgatgcgggaagcgcgccggtaatggcggtgctcgggctgggaaccgacatcgttgagatggcgcgtatcgaagcggtggtggagcgcagcggcgatcgcctggcgcgccgcgtgctgagcgacgccgagtgggcgctgtatcagcagcaccagcagccgattcgctttctggccaaacgtttcgcggtgaaagaggccgccgccaaggcgttcggcaccggcattcgcaacggcctggcgttcaatcagttcgaagtgttcaacgatgcgctgggcaagccgaatattcgtttgcacggccgcgccgccgagctggccggggagatgggggtcaccgcgatccacgtttcgctggccgacgaacggcgctacgcctgcgcgacgcaccacgaacttgtcccacagctgttcgttggtctcgcgatgctgcggatcggtgatgatggtgttgtcgatcgggcaaacctgctggcaggtcggcgtatcataatggccgatgcactcggtgcagcgatcggtatcgatctgataaatctcatcgcccatcgaaatcgcctggttcgggcattccggctcgcacatgtcgcagttgatgcatttcttggtaatcagcagtgccattgtcagttatctttccatcggtgggtcgtcagccaactgatcgaaatcaacccttctctgcccgtcaaacacccagcgcttatcggtatccgccatacgcatcgtaggcatcacctccggatgggtaacccgtattcccgcctcttgagcaaacaacccgataaaatcgaacgcgctcaagggatcatcaatgatctggtgctgttggtcgcgatcgctcagcaccagcaacggcacctggtaattctgccgggtatcgccgctgtgacgcagagaacgtatgccgccgatatccttatgggaaagaccgtgatcggagaaatagaacagtttaaacggcgcgccggtctggttcagactttgataaacctgctcgataaaacgatcagtcttgcgataggtagagag

SEQ ID NO: 81256 - DNA, 2310 bp, Glycine max
  Peptide Sequence Number=SeqID_172941
atgaaatttaaacgtaagattcagccctatcgcgccgctgcgggcggctggggctcgctggaagccaccacccgttttgtccttgacagtaaagctgccctgaaaaacatgcgtaacctgatgcgcatgaacaaagcgcgcggctttgactgcccgggctgtgcctggggcgatgataataagagcaccttcagcttctgtgaaaacggcgcgaaagccgtgacctgggaagcgacacgccgcgtcgttgagccagaattttttgcccagcacagcgtcagcaccctgtatcagcagagcgactatttccttgagtatcagggccgtctgacccacccgatgcgctacaacagcgcgaccgatcactatgaaccgattagctgggatgacgcctttgcgctgatcgcgcagcatctgcaggcgatggatcatccggatcagctggagctgtacacctccggtcgcgccagcaatgaagcctcgtggctgtaccagctgtttggtcgcgtgctgggcactaacaatttccctgactgttccaacatgtgccacgaagccagcggcaccggactgaaacgcagcattggcgtcggtaaaggcaccattcgcctggacgatttcgaccacgctgatgcgatttttgtctttggtcagaaccccggcaccaaccatccacgcatgctgcacagcctgcgtcacgccgccgatcacggcgccagaatcgtgaccttcaataccctgcgcgagcgcggcctggaacgttttgccgatccgcagaagccgctggaagtggtgacgtcgatggccggcaacatcagttctgcctattatcagcccaacctcggcggtgatatggcggcggtgcgcggcatggtcaaagcgctgctggaggagcagcgtaaacggctggctgccggtgaaaaaggcattttcgatcaggcctttattgacgccaatactcagggcgttgagcagtatctggccgccgtggacgacacccgctgggagcagattgtgcagcagtcgggcctgagcgaagcgcagattcgcgaagccgccgccatttaccagagcgccgaacgggtgatcattacctgggcgatgggcattactcagcacaaacactcggtcgatacggtacgggaaatcgttaacctgcagctgctgtttggccagctcggcaaacaaggcgcgggcctgtgtccggtgcgcggccacagtaacgtgcagggtaaccgcaccatgggcatcgacgagaaaccgtcgaaagcgttccttgatgcgctgggcgcgcattttgcttttgaaccgccgcgcgagcacggccataacacggttgaagcgcttaacgccatgctgcgtgatgaagtcaaagtgctgattgcgctgggcggtaacctcgccgcagcggcgccggactcaccggttaccgaagaagcgctgcagcactgtggtctgacggtgcacatcagtaccaagctgaaccgcagccatctggtaccgggccacgaaggcctgattctgccgacgctgggccgtaccgagcgcgatcgccaggccagcggtaaccagttcatcaccgtggaagattcgttcagcatggtgcacgcctcagaaggtgtcggcattccgctggcggagacgcagcgttcggaaacagccattgtggccggtatcgcgcatgcgacgctgggcagtgaccacatcgactggctcggcatggccgctgactataacgtcattcgcgatcacattgcggcgaccatccccggcttcgctgattttaaccgtcagtgtgatattcccggcggcttttacctcggtaacgctgccgcggaactgcgtttcaatacgccatcgcgtcaggcagaattcagcgcggcagcactgccgacctcgctgttcccgcagctgggcaatgacgttgaagtgccgttcacgttgcagacgctgcgctcacatgaccagtacaacaccaccatttacggcctggatgaccgctatcgcggcgtatacggtcagcgtgaagtggtgtttatccatccggacgacatggcgtcgctcggtttcagcgaagggcagcttgttgatattgaaaccctgtggaatgacggtctgacgcgtcgcgtcagcggctttaagctggtgccgtataatattccgcgtggtaacctcgccgcctactatccggagaccaatccgctggtaccgctctccagctacggtgacggcagcggcacgcccacctccaaatcggtaccggtgaagctggcgctgaccgccgccgcgcccacccagcgtatcgcctga

SEQ ID NO: 81257 - DNA, 264 bp, Glycine max
  Peptide Sequence Number=SeqID_172942
atgggtcagcgaggtgctgaccgcatcgggcagcagggtatggctcaggccgagcagaaaacggtcatcaatatgagcggcttcgggaaccaggggagcagtagcggacgtatgcgggcgagtctggctttcataaaaccagtggtcatggccgggagaacggcggtgttccatggtcattcctttcgcaaaaaacggactgagtgcacaacgggcaaatctgaaaagcgcatcgccactcaagggctagcttatcgtcgctga

SEQ ID NO: 81258 - DNA, 1523 bp, Glycine max
  Peptide Sequence Number=SeqID_172943
atgaaaattctgagcctgcgcctgaaaaatctcaactccctcaagggcgagtggaaaattgactttaccgctgagccctttgccagcaacggactgtttgccattaccggtgcgaccggggcaggcaaaaccaccctgctcgacgccatctgcctggcgctttatcacgaaaccccacgtctgagtaaggtttctcaggcgcaaaatgacctgatgacgcgcgacaccgccgagtgtctggccgaggttgagtttgaggtaaaagggacggcctatcgcgcgttctggagccagaaccgggcgcgcaatcagcctgacggcaacctgcaggcgccgcgtgtggagctggcgcgctgcgaagatggcaaaatcctggccgacaaagtgacggataagctggagcaaactgccgccctcaccgggctggattatggccgttttacccgctcaatgctgctctctcagggacaatttgccgccttcctcaatgccaaaccgggcgatcgggctgaactgctggaagagctgaccggcaccgagatctacggccagatctccgccatggtctttgagaaacataaatccgcccgcagtaggcttgaaaagtgtgaggcgcaggcggcgggcgtcgtgctgctgagcgaagagcaacagcagcagttacagcaaagtttgcaggcacttactgacgaagagaaaaccctgctggtacagcagcaaagccagcagaaagattttcagtggcttacgcgccatgatgaactggtgcgcgagcagcagcgtgtcaccgcgatgcagcagcaggcgcaacaggcgctgacggacgctgcgcctgaactggccaaactccagcttgctcaaccagccgcccagctccgcccgctttgggaacatctgcaggagcaaaccgcgcgtctgacgcaaacccggcagcgaattatcgaagtaaatactcgcttacaatccagaaccgcgctgcgtgcgcggatccgcaataccgccctgcgcaaccacgcgcagcttcagaccgaactgaccgcactggcgcagtggctggcggagcacgaacgctatcgcctgttgggccaggaaattgccggctggcgcgcgcaattcagccagctgacccgcgataaaacgcacatcgccacccttgccgcacgaatggctgagctacgccagaagctggcagagatgccggaaaacacgctgacgctgaccgccgatgaggtgagcgccgccatggagcaacagtcccggacgcgcccgctgcgccagcggctaacgtcgcttcatgctcgctatcagcctctgcaaaaacgtctgcttcagaatgcgcaaatcctgcaaaaagcccaggcggaacaggcgaagctcactgaaacgctgacgctgcgccgccagcagtacaaagagaaaaaccagcactatctcgatttgaaagccctgtgcgaaaccgaagcgacaattaagaagctggagcattaccgttctcaacttgaggcaggcaaaccctgtccgct

SEQ ID NO: 81259 - DNA, 459 bp, Glycine max
  Peptide Sequence Number=SeqID_172944
atggcgtttgaggctgaggggaaggggttcggcaccctgggtattcaaaattcacttaaattagtgaggagaagaagaaagaaggagaaaatccaagccgaggcacttccgcaatgtttccgtgatcaattccatgaacgttcttcgccgctcttcattcgttcttcatcgtttgtcaatcttcaaccgtgccaaaggggaatctggaaaggcatctgctacgcaagcacgcgcttagcgtgttatcagctcgctaagcgagtcgaagccctttttaagcctgatttgcacaaaattagggaagagaacggttcactactaagaggcctgaagagtgtgaatttcagaaagcatagagcagagcaagggatcaagttttcatcttttagggagattagtgagtttttgagtgattgtgagattcctagaggtggaggagacatccctactcctttgtaa

SEQ ID NO: 81260 - DNA, 96 bp, Glycine max
  Peptide Sequence Number=SeqID_172945
atggaggagatacatggagaagacgatgaagaacaaggaattaaactccatgtggagcttgtcggccttggattcaaaattcaaatgataggctaa

SEQ ID NO: 81261 - DNA, 159 bp, Glycine max
  Peptide Sequence Number=SeqID_172946
atggctatttatagggaaaaagccattttggggtggttgaagctcacccaggcgagttggagctcgcccaagcatgaagctatttcatggcccaaattgaagacattgaagagttgtaaatgtaaaagactgaagatgttgaagtatttggaaatgtaa

SEQ ID NO: 81262 - DNA, 591 bp, Glycine max
  Peptide Sequence Number=SeqID_172947
atgaagattgttatctctattccattaataaattgtggttttgctggaggagaacagtaccaggaaaattgttatttctattctataaataaatccgactggagacaggagtcgactatgtacaattatcatgagaaaggaagagctcctgatcttgaaagtgtattggtagacttcatgacatatcaagctagatctaaaggtgattactattcaatgcaacatcagggaactcagtttgagaaggactattcttttgcagattatcaatgggagtcagaatggaaaccgtattatcataaagaacctgaaggattgtctaatctggatgacctgttagtacaattcaaagatatagtagattcaatgcacaaagaatttaaaagagctgagactcacatcggtaagttggtggacgacatgactaaagttgtggtcagaagagaagaagaatatgaagagattgaaacacatcaagaaagaattcttcaagttaacataatccatcatcaattgatcaccaaagaagaaaaggatgaagtctccattattccaaaatatccctgcatggcaactactggatatgtgtag

SEQ ID NO: 81263 - DNA, 717 bp, Glycine max
  Peptide Sequence Number=SeqID_172948
atgactacactagctcaggtgtggagtgtcctctcatactccaacttggcccctacatcacatacttctgaattgacagtggatagagctaggctgatctttggcctagtctcttgcttggatatgaacataggagcactgatctctagccagatgacctctatagcccagtctaacacttctagacttgggttccctgctctaatcatcgcattatgtagagccacaggggttgtctctgataacctcacttttgagcgcttgagcctggtggtggcacctccaggatctattccttcagttgagcagttcagggagatggtagtctggcccgggacccaaccttctcttcacagggaagatgaaggtcccacagcccaggtacctcagcatgtggaggatgagtcgtctgaggccaccatcccagagccatttgttataggagaagaggctaaggagacacatatgagacaggtagctgctgccacacttgagcgatcccttgaggctactttagagccttctgcacaaggggaggacataccctcacctcagcctgcagcagacccctccactcctattctagagatgccagaggacttgactacaccggtcctggctatggacacttctcctccagctactctagtattgcatctgatagatgaggaggatgttcagacacaggacacccaggaccagtcacaggaattttga

SEQ ID NO: 81264 - DNA, 573 bp, Glycine max
  Peptide Sequence Number=SeqID_172949
atggcgcctcctctcacctcttctcctttgtcttccgctacatctccatgttgtgtctctacaaacacaggggggcaagcccaacctcagattcaccaacccagacctgaaccacccaccaagagaaaagaccatccaccttcatttgaacctcacccttctatctcaaccaaaaagcacaaagcacaacaaccctcagaccctaagcctttagaccctagaaccactctaaagaggaaggatccaaactcgaacaaaaaagaagttgcatcctttgcaaaggctaataagaaatccttgtcaaagcacactagaaggccaaagttagatgagacgcttaagaagaatgaagcttttgagctagaagatggagtgtatgtgtttgttaaagcactatccgaggaaaagcacgagagaaagttggaagaaaatgccaagcatagtgctaacaaggctaccgtgatggagatagatggtgagccgatgttgaaagcatttattgttgaatctatacaagcacaatctaaacaagacataaagaaatctcaggtggaagaattggagcaagtttaa

SEQ ID NO: 81265 - DNA, 357 bp, Glycine max
  Peptide Sequence Number=SeqID_172950
atggatgaacatcaacaaaactggaaggaaatggataacataatgatcaagattaacaaagaattagatgaaatgttcaacattgttcatctttacggtgaagtgagtaggtcatttgctataagattggatgaactagagcctacctggcatctgctacactctagtggaaacatgcactctgtcacatataaccaagatttggtgagcccagctctacttgctggatggatggaacttagagagttctatgggctcactggaaatcgtcatgtcaccttgacccactatggacagagtattttcctcctcaccatcttcaaaagtagctctgaaccaaaagttttccctaaatga

SEQ ID NO: 81266 - DNA, 513 bp, Glycine max
  Peptide Sequence Number=SeqID_172951
atggaaagtgacaactcatcaaatacaggggataacatagcaagtcaagaggaagatgctacagtagcaacaataggggtacaccaaccaaacaaagaggtgcaattagcaaagtttgatatcgcagaagctacgaaggttaagacgaaggttatgtcaacagtagcaacgagatggcggcaatttaagtccacattgactagcaaatttgtgtttgctaagagtgaaggtcaacaaatgcaggatgttgtgacaaaatatggactagatcctgaagcgtggaaacaatttgaagaaactcggctcacacataactgggagggtattaggaaacgagcacaatcaattcaaaaacacaacgactgccctcacgtactttcacgtgggggatatgatttgcttcagaagaaattgttagacgagaaacgaaaaaggatacaagaggaagcattgttgagtgataatccagcaagtcttgatgaccccccatctccaataaaaagacatgtttag

SEQ ID NO: 81267 - DNA, 708 bp, Glycine max
  Peptide Sequence Number=SeqID_172952
atggctagcaacccttccagagctcagaagaaagccaagtcctccaagaggaaacaaggagagtgctctcgatccactctcaataggcttgatacatggtttatagatgagagtaagaagaacaacttcaagatgatatacagtgcagtagttggactggacatgggtggagtccacaagtttgaagaatctactgatggttacagcaagatgcaaacttacaaaggtatgctccttgacccagcaaggaatatgaggaattgcctaggtgtaggtgatttgactattgaagatagaatgcttgtgtacctcataacctacattctcacaccgaggtcttgtaattacacacaggtgactgatgatgatttacatattgtgtttggtctaaaatcaggtattaagatgatctggatacttttgattgaagatatcatgttgaagagccctcggttagtcgattatgagttttcgtatgttgtgctggccttaagattcattgattattttaatatcgatgactctaatgagatagtagacttcaccaaagcatttagtgagataaccaaaaggcatctcaaaatgcttgggatgaggtttgttgaacatgaatggatcatggctagagagccaccagcaatagcaaacatggaccaaatggaagaagaagcagaagctgaagctcagcaagagcctgcgcaacaatga

SEQ ID NO: 81268 - DNA, 255 bp, Glycine max
  Peptide Sequence Number=SeqID_172953
atgtcggtctcttcacgtcaacgggctcgtttgccccctggcattgagtcttacagatatcaaaagtgtgcggatgatcgtaagttgtctccgcgtgccatcggacataattgtctctggatagcgaaaaaggtgcagatgaccataatttgtctctgcgtgccatcagactctattgtctttggatggcgaaaaggtgtgcggatgaccataatttgtctccgcgtgctatcagacgttgagtcttacagatag

SEQ ID NO: 81269 - DNA, 712 bp, Glycine max
  Peptide Sequence Number=SeqID_172954
atggcttttagaggctcaaaaatagaggagaaaacgaacttcattttctgcgtttttctggaaaacgcgatgaattcgctaagcgtgcctactgcgctaagcgagcttagcgggcagtcgctcgctaagccaattatgcagaagcggaattttcttcaatattcgctaagcggcccccatgtcgctaagcacctcacatttgagcgcctgagcccgaccattaacttggatgacatcaggaagaactgttggaacgttgatgatctaacagtttcattccggggggttaggagggcgagggcgaggctagctgatattccatctacttctacagcttcaacagctactccagcatctacttctatagctccttcagtcccagctcatgttgactctcagtgcttcaaagtacaggatgcttcatctgagaccaccattccagagccattcactcttcatcatgaggaaggtgaagaacaggtgagaccagagactgctgctactcctgagagatcacttgagggcacatcagagcctcctactccagtggcagacctctcctcaccacagcctgcagctgaaccttccactcccaaacttgagatactagaggacccaaccacattagtcctggcactgaacacctctcctccagctactccagtacttcacttgacaggagaggaggatgctcaggggatacccaggatct

SEQ ID NO: 81270 - DNA, 270 bp, Glycine max
  Peptide Sequence Number=SeqID_172955
atgtcacctgacttcaagcatttcgtttctaaatggccatttagaggaaacactgggttcaacaaaaatagaagaaaatcactcaaagtgtatcaacctcacacagggcaaggattgacattctcaccgtgggtcaaggtttatggtaagttgggattttggctcaaggcttgtagaacggctggacatgatatatgtcagggtttggccagcggttcggggataaaggggatgtcccacattatttccatgatacacatgcaacaatga

SEQ ID NO: 81271 - DNA, 879 bp, Glycine max
  Peptide Sequence Number=SeqID_172956
atggcttcttcttctccctctgttattaaggatgccaaggtgcttatggttggcactggcagaattagctatgagcttcttatgaccctcactctctccagtttccttgacattcacatcgttagtactcttctctacaagtctttccaagtttttttctctctcaagggttttctggttttttttgttaaactgaaagatgatcctatagctcttgtagaatttctttccaaatactgccaatgggttgttttaacattgggcgctaatgggtgcattgctaaacatggaacaaagagtgtggatgcagaatcaaatcctctaaaagtgaggacgtgtagtcctataaaggcgagggcaagcaaccctctgaaggcgagggtgtgcgaccctctaaaggcgagggcgtgcagctctctgaaggcgaggacgtgcagccctctgaaggagagggcgtgtagccctctaaaggtgagggcatgtagccctctgaaggcgaggacgtgtagtcctttgaaggcgagggcaagcaaccctctgaaggcgagggcgtccagccctctgaaggcgagggcgtgtagtcctctgaaggcgaggacgtgtagccctcagaaggtgagggcatgtagccctctgaaggtgagggcatgtagccctcttaatgcgaggacatgtagtcctttgaaggcaaggacgtgtagtcctttgaaggcaaggacacgtagtcctttgaagccgagggcatgcggtcctttgaaggtgagggcatgtagccctatgaaggcgaggatgtgcgaccctctaaaggtgagggcgtgcaaccctctgaaggcgagggtgtgtagccgtctgatggtgaggacatgtagttctcttaag

SEQ ID NO: 81272 - DNA, 258 bp, Glycine max
  Peptide Sequence Number=SeqID_172957
atgcaggacttcttcacgaggccgtcagggaagcgaacacgcaatgatttgacttctcaatataatgctggtggatatatacctcaacaagatggagctgggcaagatggagctggggatgctgcacatggagtttttgaaattgaggtggtgataacaaagaaaaccattttccttttaggaagcattaatggtcatgcggttacattgttggtgaaatgggttgtaagttatgtgtttagtgagatgcctaaatga

SEQ ID NO: 81273 - DNA, 387 bp, Glycine max
  Peptide Sequence Number=SeqID_172958
atgctccaaccatatgggatcaacataggcttaaaggagcactcaaacccggtgacccccaaggcctacactccgaagagtccgtcagggcctctccctcctgattcagaccgttctgggtttctgcgggaaaggaaaaggctacaatgcgaaaggtacttctctcagctcaaacatgatatcaaaattcccaacggtgagaattctcaaaaatgggcttcgaacatagtgttcaaatttcacgacgatccaacagtgaacaagtccaagatcgtcatttttctaagacaggttaggtggcctgcggaaaaaagagagggttttgggagaagaaagaaaaacgaaattgtgaggcagaggagactgaggagtcagtctgaaaactga

SEQ ID NO: 81274 - DNA, 1377 bp, Glycine max
  Peptide Sequence Number=SeqID_172959
atgagccagtgtgttcccagttgggatgtcgaagacaacccaccaccctcaagagtctcacttcgctccaactctaattcaactgcccctgatgttcccatgttggactacgaggttgctgagctgacatgggaaaatgggcaactttctatgcatggcttagggctaccgcgtgtgccggtaaaacccccaacagccgtcacgaataagtacacatgggagaagcctcgcgcaagtggcaccttggagtccatagtgaaccaagtcacgagctttcctcaccgaggaaagccgacaccattaaacggcggtgggggcggcggcgtttacgggaacttcagggtgccgtggttcgaccctcatgccactgccaccaccacgaacaccgtgacgatggacgcattggtgccctgctcgaaccgggagcagagcaagcagggcatggagtcggtccccggcggcacgtgcatggtggggtgctccacgcgtgtggggtcatgctgcggggggaagggggcgaaggggcatgaggcgactgggagggatcagagcgtgagtgggagtgccacgtttgggagggatagcaagcacgtgaccctagacacgtgcgacagggagtttggcgtgggtttcacttccacctccatcaactcgctcgaaaacaccagctccgctaagcactgcaccaagaccaccaccgtagacgaccacgattctgtttcccacagtaaaccagtgggagaagaccaggatgaagggaagaaaaagagagcaaacggaaaatcatcggtgtccactaaaaggagcagagctgcggctatacacaaccaatctgaaaggaaaaggagggataagataaaccaaagaatgaagacattgcaaaagttggtcccaaattccagcaagagtgataaagcttcaatgttggatgaggtgatagaatatttgaagcagttgcaagcacagttgcagatgataaatagaatcaacatgtcatcgatgatgctgccattgaccatgcagcaacagcttcaaatgtcgatgatgtctccaatgggcatgggattagggatgggtatggggatgggtatgggaatggggatggatatgaactccatgaaccgtgctcacatccctggcatccctccagtcctccacccttctgccttcatgcccatggcagcctcgtgggatgccgcggccgcagctggtggcggcgaccgacttcaagggactccggccaacgtgatgcctgaccccttgtcgacattttttggatgccaatcacagcccatgaccatcgatgcctacagtagacttgctgccatgtatcaacaactgcaccaacctcctcctgcttctggttccaagaactga

SEQ ID NO: 81275 - DNA, 726 bp, Glycine max
  Peptide Sequence Number=SeqID_172960
atgaaagataagagggatgaggaggaaaaactagaaaaacaaaagaaaaagaaagatagtaaggccttgtcttcaaaggccaaggggaaggaaaaagaggaaaatgatttctccaagaagattgttatgaaggaaaatcattttgtaacaaaaggtgatatcaaaagagcactacttcttaaacaatctttctaccttctcttgtcaaggggaatatcccttagcactgccatacctcttgagcttgaggttattcctcaagtaaaggagttgttggatgagggtttggttcgtaagagcttaactccttatgctttgttggtgcccaaaataggtattatgaggcaccaaatccctatgataggtggtatgatgaatgtgttgagtggtgcaaccctcttttgtaaaatcatccatgcatccaacatcttcatgattaacatatatagggacttattagatcaaggggttgtcacagaacctaagagaacaaaagtcattcctgagtggcccactccaccaagtataaggaaaatttgggacttccatcacttaacaaacttttacaaaaggtttgtcccaaatttttctatacttgtagcaccactcattgagttggtgttgaggaaaaaaagcccagagtttcaagaacctcgggatttgaggccaaatccttttcaagggggagggaatgatgcaatcctaccccccaagggcattggatag

SEQ ID NO: 81276 - DNA, 530 bp, Glycine max
  Peptide Sequence Number=SeqID_172961
actcgaaggtggaggatgcatgtacagcgctagggaatgacactaatgggtctccggataaaagtggagaatggagaattggcggacagcactacgcaataacttcgcgcggctctagactcgaagcgctaggaaattacattcatgggtctccgaaaaaagtggagaatggagaattggcgaacagcgctacacaacaacttcgcggggctccagactcgaagcgctacacaataacttcgcgcggctatagactcgaaggtggaggactcatgaatagcgctaggaaattacattcatgggtctccgaaaaaagtagagaatggagaattggcgaacagcgctacgcaacaacttcgcggggctccatactcgaagcgctaggaaattacattcatgggtctccgaaaaaaagtggaggatggagaattggcggacagcgctacgcaataacttcgcgcggctctagactcgaaggtggaggacacatgaacagcgctaggcaattacattcatgggtctccgaataa

SEQ ID NO: 81277 - DNA, 1374 bp, Glycine max
  Peptide Sequence Number=SeqID_172962
cggcacgtcgccgatcagcggcaggtgcaggtcgaggtggccgctggtcaggaacggcacgccgaacagcatcgaagcgctgccgctgaggatggcgatcagcaggcccatgccgatgcagcggatgtagtcgaagccgaagcgcgattccaccgatgcagtgccctggatcacgtactggatcagcagcggcaccgccagcaccaggccggcgatgaagccaccgcccggcgcgttgtggccgcgcaggaacaggaagatcgacacggtcagggtcagcgggaacatgatctgcgccaggtcggccggcaccggcagcttgatcggcgggccgggcatgatctgctcaggtgccatccgcgtgcgccgcagcagagcatgcaccaccagcgcggcgatgccgaacacggtgatctcgccgaaggtatcgaagccgcggaagtcgaccaggatcacgttgactacgttctggccgtaggcctcgggcagcgcccggcccagcagttcgccggccatcgtgttcggcggaagggtcatcgcggagtaagccagcgcgccaaggccggcaccggcgatgatcgcgatcaccgcgtcacggcgcttgcgccagcgcggccgctccggcccggactgcgcaggcaggtagttcatgcccagcagcatcagcaccagggtcaccatctcgaccagcagctgggtcagggccaggtcgggtgcggacagaacacgaaggtcagcgccaccatcaggctgacgccacgacccagcaccgccagcaggcgtgcgtatcgacaccggcgcatcgcgcccgggccgccaccggcagtcagtgcctcggcgaacagcattcacaggaagccgttgagcagcgggatgccggccatcgccagcgaggcgatgatcgccagcgcgctggtgaacggcatcagcttacgcaggcctcacgagcttgcgcatgtcacgggtgccggtttcgtggtcgatgatgccggcggccatgaacagcgaggccaaggtggcgtggttgaggatgtggaacacgccggccaccaccgccagttgatcagcgtgcgacaggccgaacagcagggtacgccgatcgcgctcatcgccagggcaggttggaaatggtcgagtacgccagcacccttcaggcatgctggagcatcgcattccgaggatcgaggccgatcagcggcagtgcgccgagccgcgccacggtcagctgccggggccggatgcaggcgcgccagcagaacaccagcagttccaccggcaccttctaccatgcgcgagtgcaggtatgcggcaccggggtcggcggatgcgggcagccgaagaaagtgtcggcacgggaagcgcggctcttggtga

SEQ ID NO: 81278 - DNA, 231 bp, Glycine max
  Peptide Sequence Number=SeqID_172963
atggcagcggaatggagaaggaagagacagagaagacgcaacttcaaggagaagatgagtctagaagaagctcaccaccataggaggccatggataagagcttggaggaagacagcgacgaatgaagggagaggaagagaagagcgcgaaattttatgctctaaaagagctctgaaatctgaacccactaatccaagatcaagtccaagattctccactaagtgtgcttag

SEQ ID NO: 81279 - DNA, 584 bp, Glycine max
  Peptide Sequence Number=SeqID_172964
ttggtttgtaccaacaatgcggatatgaccggacgtcttcttgtcgggtcattggcttttgaaagccgcatccttcactatttaattgtgcgtattctgcttccacggtcttccaaccttgcccaggtttctgaggaagatctaattatcatgtgggcctttcataccgaccgtcaacttgactgggcacatcttgtaagatatcgcatgcatcaggcattgcgattaaatgcacctttgccgtatccacaacttgtcactctctttttctgccattttcaaattcctcttgattctgaaccttatgttccaatcaagagatcttttttaattggtgctgctgcgattgcttcttttggttaccgcaaagagcgtgatggctcttgggtcaaaaagggcactcaacccgctgatgaagaaggcaacctcccagatgaagataattccactcttcttcgaaggcttatggacaagtttgatggacttcagacttttgttggtgataagtttgatgccatggaattgcaagttgacatgcttgcgcgattcgtgaaattccgtaatgtggcgaaagtcgaaaagag

SEQ ID NO: 81280 - DNA, 210 bp, Glycine max
  Peptide Sequence Number=SeqID_172965
atggaactcggccttagattggaggcgttaaatgacaatttctccaacgtgctcttgggcatcacgtttaggattgagccgttgtcgatgagtactttggccataacgtgtgtcgcaaaactacccttcggcgggaggacgacgcgagactcgcgggaagtgtcttccaagaaaggaacacgcgcggagtcgccaccaacgtttatttga

SEQ ID NO: 81281 - DNA, 262 bp, Glycine max
  Peptide Sequence Number=SeqID_172966
atgttggtgcgcatgatccacactcgtctttttgcagcgacatgggtgaaatcttgccccggtatgcatagtagatgcgtgatagcctccctctctggatgtgctcgcacacttggtcaccctctaatatcagggggtgtgatatggagcacactgaaaatgagtaggcgcagccctctaaaggcgagggcgtgcagccctctgcaggcgaggatgtgcagtcctctgatggcgaggacatatagtcctctaaaggtgatag

SEQ ID NO: 81282 - DNA, 129 bp, Glycine max
  Peptide Sequence Number=SeqID_172967
atgggggggggggggaaactgccaggaaccacattacaagcgaacctcaagagagttgggcttcgtcctcaaaaggaaaaaacaccagaaaaactagccttccatagattcaacagaaagcgcaaatga

SEQ ID NO: 81283 - DNA, 1149 bp, Glycine max
  Peptide Sequence Number=SeqID_172968
accagcagaatttgcccgatgccgatggccggcggcagcagccagcacgggatcgccagcgccagcagcaggtgcgccgccttgcccgccagaaactcgcaccagccgcgcacgccctgctgtgccatgcgcgccgccacccgggtgcgtcccgcccgatccagccagtcgaacagccagatgtagtacgggaacgtcagcgccgccaccagcggccaatagtaacgctgggcgcgcataaagggccgccagcgctggaacggcgtttgccgcagcacgccgttggcgtcgatgtcggggtcgtaatgttcgatattgttatgggcatggtggaacagcacgtgccgcacgcgccaacagtcgggatccagccccaacgggacgctcaccagggcgttcagccagcggttggcccagggccgacggaaaaacgcgttatgcgaggcatcgtgcaccacgttcaccgtcaggaacatgccgataaagataaaaccgaagtagcaagcgaaaaacgcccagccgttttgctgctgcaggctcagcccgtaacacaggccgcacagcgccagcagcagcgccacctttgccagcatgccgccgtcggcgaagcggtgatcgccgttggccgccagataatgctgggctggctaacgcgacgcagcgctttcatggcgattggccccataaggcgcaagaagcgctgttgctgcgccagcagttcgacgatagccgatgcagcgatatgccatgccgtgccgctgcgcacttccgccagcgggcataaccgacgccagcgccggatagtggcgcccgccggtcaggtgctccagccagcgcggctcgggctgccagtcgcaggcggtggcgaaattgtgccggaacaccaccagcagcgaggcaaacatctggctgagcgcgtaagccaacagcacccagccccaaccgatgccgataagcaggtggcacaggatcagcggcaccaccagcaccagcgccacatgaagcaatttgcacagcacgaacagcgtccaaccgccgcgccccgccagcacgcgtttttcccggcagcggcgttttatgtccgagccgatcggaccaatcgaaaatccacgcgatgtagggcagcgagagcgcggcgatcagcggcca

SEQ ID NO: 81284 - DNA, 327 bp, Glycine max
  Peptide Sequence Number=SeqID_172969
atgctcaaatacctgttgggcaccgaaaatggcattcaggggaaagatctcggccagcagggcggcgtgatgccgcaggaagtggaatggcgcgagcagggcggcgaaggcaagctggatttggtggtgacgctcgatttccgcatgtcgagcacctgcctatactccgacgtggtgttgccgaccgccacctggtacgaaaaagacgacatgaacacctccgacatgcacccgttcatccatccgctgtcggcggcggtcgatccggcctgggattcgaagagcgactgggagatctacaagggcatcgccaaggctttctccgag

SEQ ID NO: 81285 - DNA, 348 bp, Glycine max
  Peptide Sequence Number=SeqID_172970
aattctaacgttggccaaggaacctacgggccgaggggacagttctcaggtagacagtttctatggggcgtaggcctcccaaaaggtaacggaggcgtgcaaaaggtttcctcgggccagacggagattggccctcgagtgcaaaaggcagaagggagcttgactgcaagacccacccgtcgagcagggacgaaagtcggccttagtgatccgacggtgccgagtggaagggccgtcgctcaacggataaaaggttgggctgttcgcccattaaagcggtacgtgagctgggttcagaacgtcgtgagacagttcggtccatatccggtgtgggcgttagagcattga

SEQ ID NO: 81286 - DNA, 147 bp, Glycine max
  Peptide Sequence Number=SeqID_172971
atgggtgccaagtgccttgaagtgctcaaacaagggtcgcatcccaacaacggatggtccccggacgaaattagggcattctctgaagaaatcgctaagcgcgcttaccgcgctaagctaagcgcgctaagcgagttcatcctttga

SEQ ID NO: 81287 - DNA, 300 bp, Glycine max
  Peptide Sequence Number=SeqID_172972
atgttagtgaaaaatctcaataggagcctaagagtacatgacaagatagtccacacactagaagaccagtcagggtctgctccaaccatatgggatcaacacaggcttcaaggaacatttaaaccgagtgtatttactcccaaggcctacactccgaaaagtctgtcaggggctctccttcctgattcaggtccaacccaaaaaacattttaccacgtaaactctatctatgaactttacaaaacacacgactccttaattgttctcaaaataattttatctcgtcgcgcttgtgattaa

SEQ ID NO: 81288 - DNA, 207 bp, Glycine max
  Peptide Sequence Number=SeqID_172973
atgacaaaagactttcattgtagcgaggacacttcttgctacaacgaggcttcatctttagcaaatgatacttcacttgaatcttcttgctctctgaccaactttcgctatggtgagagttgtactcgttgtggcgagtggttgctcaatatcttagtctttaacattcatattcattgtggcaagtcttcacattcattcacttga

SEQ ID NO: 81289 - DNA, 219 bp, Glycine max
  Peptide Sequence Number=SeqID_172974
atgttgatgcatgctttgttaaggtcattcaacagtggaaactggtctgattctaaagtccttgatattgtatatgtgtgtcttaatgcggttctggttgagtttagtgcaacaagaggaatctgcggacgatgcttgatcaggattaggctaacctatcatgaggaatcggggtttagtatctcaggagacaccataggaacacatgagcattgttag

SEQ ID NO: 81290 - DNA, 243 bp, Glycine max
  Peptide Sequence Number=SeqID_172975
atggagaattggcgaagagcgctacgcaataacttcgcggggctccagactcgttggtggaggatgcatgaacagcgccaagcaatgacattcatggggctccgtaaaaaagtggagaatggagaattgcgccagacaatgacattcatggggctccgtaaaaaagtggagggagattgggaacagcgctactcaataaccttcgcggggctccagagcgtaggcggaggtatgaacagatga

SEQ ID NO: 81291 - DNA, 81 bp, Glycine max
  Peptide Sequence Number=SeqID_172976
atgggtaggtcttgtgcactttcgttcacacgcctttttcgagtctctgtcgaaagataccttgaatatgcatgtatgtag

SEQ ID NO: 81292 - DNA, 213 bp, Glycine max
  Peptide Sequence Number=SeqID_172977
atgacccttcaaatccccccacatttagctttttgcattctggggaaatttaaaaggcttataagaacaaaaatgcctaaatcatctcccaacatgcatgtgaaccaagaagtatcaacacgagtcaagccaaggctattgagcaagcaatcaatggggcaaaacacatcgaataaaatagatgatgatggctcaaaatctcaccaagggtaa

SEQ ID NO: 81293 - DNA, 339 bp, Glycine max
  Peptide Sequence Number=SeqID_172978
atggtgtaccgtttgaaggtttctgaggaagattcgataattatgtgggttttcttaaccggtcatcaaatcgactgggcccatcttgttagatatcgcatgcataaggcattgcgatcaaatgctccacttccatatccccatctgatcaccttgtttctgcatcattttaatgtccctcttgactctaagccctttgttaaagtcaagagatctttctctatcgatacgaatgtggtctcctcgtttggataccgcaaagagagggatggttcttgggtaaagaaggacgctcttgcacaggccgcagcagaccgctctccatcaccacctccttag

SEQ ID NO: 81294 - DNA, 375 bp, Glycine max
  Peptide Sequence Number=SeqID_172979
atggctatcttcagaggaggatttgatgattatatcatcaatgtaaacttgcataaatgtgtctataaaatcatgaaacatggaattcatggccctttgataagtggtgtcgcaacctacccttcggcgggagggcgacgcgtgactcgcgggttgcgtgttccacgaaaggaatacgcgcggagtcgccaccaacgtttatttgaggaaaacatcggaaaaaccggaaaagacgcgatctacgaacttttaagtgaaaggttcgggagttgtatttacgcacggggaagggtgtttccctttgctcctacgtattcctcatttgggatgagaaatcagacctacgtagtcctttcggacaaagtgtttggttaa

SEQ ID NO: 81295 - DNA, 254 bp, Glycine max
  Peptide Sequence Number=SeqID_172980
atggctcaaactccacctcgtgagagaactcttagggagatggctacacttgatttcacttatgaaagcttgtgcattcaatatcctgatgagggtgttccatatgttctcaagactggactaatacatttgctgcccaagtttcatggtcttgcaggtgaagatccttataagcatcttaaggaggagtggccaaagattggttgtactaccttgctcccagatccatctccagctaggatgatcttcacagg

SEQ ID NO: 81296 - DNA, 290 bp, Glycine max
  Peptide Sequence Number=SeqID_172981
atgggaggtgcaaatagcaattttcaaattttgatttgggcattccagactatttttcgaagctggattgcttctgaaggaagcaacccagctcgcctgggcaagctaggcggcaacctcctccccctttgtcctataaaaaggcaaaaggggactgttctaagggtccctgattcccctgactatgcatttcaactccgaggtgcttctgtaacgcttccgagacgtttccgtaagcaaatccgtgaaggttttcctccgttcttcatccgttcttcgttcttcaacag

SEQ ID NO: 81297 - DNA, 429 bp, Glycine max
  Peptide Sequence Number=SeqID_172982
atggaggccatgaaagagcaaatgaccacaatgatggaagccatgatgagtatgagaaaaataatggaggtcaatacggctacagtcattgccgcaagtatcgccactaaggtggaccagactcacccatctggcctcaatcaagtccagagcaagcattccttcccaccatatggcttgcctccaaactatacaccacccactgttgcacatgctcccgatgagaacgtcgataacttggctcccatacccattaagaaccaacaaccccaatctggtcatgcacagagtccttcctgctatggtggagattatgcctttgttgacatggcagaactgtgcctagtgcctgatgtcgttatccctccgaagctcaaggtgccaaatttcaataagtacaaggggactacttgccccaagatcacctaa

SEQ ID NO: 81298 - DNA, 294 bp, Glycine max
  Peptide Sequence Number=SeqID_172983
atggagcggtatctacagcacttggttcaccaacaagcgaccaaccaccgagggcaggtgcagatacatgagtgtctctaccaactcagcctcagtcagcaaggccagggtttcgctccttttgcatgccctactccagatcagtttagggctgaggttgcatggcccagagattggcctgaggaccagacggaggaggcacctgcaggagctcccggcgatgcagaggacgcccgcatggatgaggagatgacagacttgctcggcttcttggaaagaagcggagccacatga

SEQ ID NO: 81299 - DNA, 215 bp, Glycine max
  Peptide Sequence Number=SeqID_172984
cccaagagcctaacattgaggaaccaccagcaccagcaccagcagcagaggaggagacaactccagatcagactcctcagccatctccagcccctgcacatatacctgaggatgttgcaccagttgttgagtctgagcaacctatacaggattcattagcagcttcagcactggatcttaatgaaaaccagccacaggaggagcaagacgtttaa

SEQ ID NO: 81300 - DNA, 902 bp, Glycine max
  Peptide Sequence Number=SeqID_172985
atgacgactgagcccgcaaaggaaatcactgagaagattgatattttggccgctgctattggacgtccagagcaccctggacgtgttcgtgttgctggagccggtgtcaccatcaagcaatactttggatcggctccacggacggaccagctagaggagtccatcatagagaaagtgacgaggcaggtcatggcatccttcagccagcttcagtcacagatgcaatctcagggacttgtagtgccttctgagcctctggttggtcctggtcccttcggtcctcgagtgagcacaaaggggagttgtgttgatccctcaggaaacgatcctgagacgggtgactctgacaggtgcggctggtacatagaagcagatcctgcccgcctggttgccgtggggagagtttatgagggatccactgttcatagcactcctttgttgcctggccaagtaaaggtgagtgtggacgaggttaaagatgcagatgctccagttcctgtacccactgatgaggtttccttagtggggcaggcacttcacaccttccttgcttggccgacacatctggtcaagtctttatcacagcaggtagctgtgtctccgccaaaaccacctccgaagcccgatccggaggtcgatgatccgctttatctgatgacattgaccatcccagagcttttcttgaggccttatcaggttagatgggatgccaccgtgttcggggtcgttaatccagatttccccctgtacataaagcacgaagacctctccgaaattgcacacggtggtcaatgtctcagcatatcagtgttacagttgtggattctgcatctcactgaaacatgtatgcgagcggggaattcggatatctatggattcctcgagccacagtccattcagag

SEQ ID NO: 81301 - DNA, 774 bp, Glycine max
  Peptide Sequence Number=SeqID_172986
atggcccgcaccaagaaaactgggcagataacatctgaggcggcaaaggaaatcactaagaagattgattctttggaggagcaggcgtcacagggttcgtttgtcctccatggatgtcaggatctcctgactactgtcattggacgaccagaacaccctggtcatgtgcgtgctgctagagccagtgtcctcatcaagcaatacttcggatccactccacgaagctcccacatttcctcctccatgcctcctgaagaactcgagcagctgactcaacaaatcagggaccagctggaggagtcaatcacaaaaaaagtgacttggcagctgatgttatccttcaaccagatgttgtcccagttgcaatcacagatccaatcacaaggacttgcactgcctccgaagcctgaggttggtccctcagctactcgtgtcaacacgaaggggagttgtgttgatctctcactgaccaatccagagacggttgactcagacaaatgcgggttgtacatcgaagacaatctttcccgcctggttgccctaggaagagtttatgagggatccacaatggttcacaacatccctttgttgcatgaccaagtcaaggtaggtgttgaggaggttgaagatgcaaaggctcccattcctatacccactaacgaggttattttagtggggcaggcacttaacaccttccttgcttgtccgacacatctcgtgaagcgtgtatcagaccaagtattttactttcattatatgctttttttcaattga

SEQ ID NO: 81302 - DNA, 909 bp, Glycine max
  Peptide Sequence Number=SeqID_172987
atggcggaaccatcgaagaagcggaaaggcacttcgagtcaaagtcaacgacattccgggtcacaggaaaccccaattcctccctccattccctctggatcattgttctcatcagaggaacagtgtatacggaaccctaatgtttatgggactaagattgtcattgaccagtccctattctatgatttaacccaattgccaagcgaaggtgtaccatttgaaggtgcactgattgatgattggaaattcgatttctctgtacatgatgcccgccgattggtttgtactaatcaagcggatatgatcggaaggcttcttgccggttcattagcttttgaaagccgcatcctccattaccttattgttcgcgtcttgcttcctagatcttcaaaccttgcccaggtttctgaagaagatctcattgtcatgtgggcctttcataaaggtttacaaatggatggggcacaccttgttagatatcgcatgcataaggcattgcgattgaatgcccctttgccttatcctcatcttgttacccttttccttcaacacttcaacatccctcttgattctgaaccttatgttccaatcaagagatcattccttataggcgcttcagtcatatcatcctttggttatataaaggagcatgatggctcttgggtgaagaagggtgctagaaatgttggtgaagaaggacatgaaggagaagattcatctcttcttacgaatattatggacaggtttgatggtcttcaaacctttgttggtgagaggtttgacactttggaattgcaagtggatatgcgcttcaatgaaatggagtcaagaatcacaaaggttgaagaagatgtgtcttacattcgttcaagcttttatcttccaccggcgccaccaccatcatcttag

SEQ ID NO: 81303 - DNA, 1272 bp, Glycine max
  Peptide Sequence Number=SeqID_172988
atgcctaatatttacaacgctctgatagttaagggtcgagatactgttggtcaacaaattaatgtgacttgtgaagtacagcaattattaggaaataatcgaattagagctgtagctatgagtgcgacagaaggtctaatgagaggaatggaagtgattgacacaggagctgccctaagtgttccagtaggtggagcaactctaggacgaattttcaacgtgcttggagagcccattgataatttaggtcctgtagatactcgcacaacatctcccattcatagatctgcgcctgcctttatacaattagatacaaaattagccatttttgaaacaggaataaaagtagtagatcttttagctccttatcgtcgtggaggaaaaataggacttttcggtggagctggagtgggtaaaacggtactgattatggaattgatcaataacattgccaaagctcatggaggtgtatctgtatttggcggagtaggtgaacgtactcgtgagggaaatgatctttatatggaaatgaaagaatctggagtaattaatgaacaaaatattgcagaatcaaaagtagctctagtatatggtcaaatgaatgaaccgcccggagctcgatctgaagtatctgccttattgggtcgaatgccttctgctgtgggttatcaacccactcttagtactgaaatgggttctttacaagaaagaatcacttctaccaaagaggggtccataacttctattcaagcagtttatgtacccgcagacgatttaaccgatcctgcgcctgctacgacatttgcacatttagatgctactactgtactatcaagaggattagcggccaaaggtatctatccagcagtagatcctttagattcaacctcaactatgctccaacctcgaatcgttggtgaagaacattatgagactgcgcaaagagttaaacaaactttacaacgttacaaagaacttcaagacattatagctatccttggcttggacgaattatccgaagaagatcgcttaaccgtagcaagagcacgaaaaattgagcgtttcttatcacaaccttttttcgtagcagaagtttttaccggttcgccggggaaatatgttagtctagcagaaacaattagagggtttaaattgattctttctggagaattagatggtcttcctgaacaagccttttatttggtaggtaatatcgatgaagctactgcgaaagctacgaacttagaaatggagagcaatttgaagaaatga

SEQ ID NO: 81304 - DNA, 246 bp, Glycine max
  Peptide Sequence Number=SeqID_172989
atgtgggagaggaatgaggaccactcgggccaggaggaggaggagaatgaggaagcttgggattgggaggctttgagtttgagtgggagaggagagggagaagaagagaggtggagggaatgggtggataagaggaagaggttgcggtggtggtggtggtggtggtggcggcggagaagagggaagggagtggcgaggaggaagaggaaccttggggccacgccacccattttcgtcgtctgctaa

SEQ ID NO: 81305 - DNA, 420 bp, Glycine max
  Peptide Sequence Number=SeqID_172990
atggcaactcaacttttatttttcacatttgcagctgaggtgacaaaagctatggcctcaaagctgcttttgaagagaaggctctttaggtttttgcaactgtcacaaccttctttttcttccattcatgcagccccaatcctttctgtaaaagcttcagaattcatgttcccctacaaggagaatgcccttcttcctcctctctcttcttcttctagaaacttctgctctcgcagttttaatcttgatgaatctcaaggccccctgactattgattacagttctctactgcaggagggtgaattccacagactggctgattccacaatacatagcctccaagagaaattagaggactatggagactcagttgaagttgatggatttgacatagactacggcgtgagtatgattttgtga

SEQ ID NO: 81306 - DNA, 249 bp, Glycine max
  Peptide Sequence Number=SeqID_172991
gtgtttgacagtcgagacgatgttttgcagtgggctcgatccattactcatgaaaacggatttgtggcggtcattataaggtctgacacaaacactagtagtagaggaaggacttcgtttgtgttaattggttgtgaaaggagtgacgagtataggtgtaggaaaaaagaatttgttagaagagatactgagactaggaaatgtgtgtatcccttcaagcttcaaggaaaaccagtggttggatggtga

SEQ ID NO: 81307 - DNA, 375 bp, Glycine max
  Peptide Sequence Number=SeqID_172992
atgatgctaattaatgtcattgagactgtagaatcgacgatgaactgtaataaaggactttcaattgttttttattttaataataagaaaaaaagagcaccttccattgaattagattatccttcttcaagcacaagtggcatgtttcccacggtgttaaaggtatgtccattgtatgaagaagatgatgtctatgaaaataagtttgaagatgctctttctgacgatgatctagacaacattaacgaggaagtttgtcttgatgatattgatgctttgctagcaggaaaaaaaaatcaagaacacaacataatacaaacaatcgaaggtgatgaagaatgggaaatattctacatcatgagacaaccattttag

SEQ ID NO: 81308 - DNA, 1491 bp, Glycine max
  Peptide Sequence Number=SeqID_172993
atggaggggcatctaaagcagaagctgttgagaaacaaagagagaagaacatcatcagagcaagaagaagaggagctatcattagtgaagagggtgtggaatgagagccaggtgatgtggatagtggcggcaccagccatattcactaggttctccaccttcggaatcagtgtcataagccaagcctttgttggccatattggctctaaggaattggctgcatatgctctcgttttcaccgttctcgttaggttcgccaatggtgttctcttaggaatggcgagtgcgttgtcaacactttgtggacaagcatatggtgcaaaagaatatggcatgatgggagtgtatcttcaaagatcatggatagttttgttcctaactgcagtctgtcttcttccggtgttcatcttcacaagcccaattttgatgctcttgggccaagatgagagcatagcacaagtggcaggaaacattgctctttggtcaattcctgtcatgtttgcctccattgtctcgttcacttgtcagacattccttcaatctcaaagcaagaatgtcatcattgcgttcttggcagcattttcgatagtcattcacgtgtttctatcgtggcttttgacaatgaagttccagtttgggattcctggtgcaatgatttcagcaggcttggcatactggattcccaacattggtcaactcatatttgtcacctgtggttggtgttctgatacatgggaaggtttctcatttttggcattcaaagacctctggcctgttgtcaagatgtccctttcagctggtgctatgttatgtcttgagctctggtacaacacaatattggttcttttgactggtaacatgaaaaacgcagaggttgaaattgatgctctatccatatgtctcaacatcaatggatgggaaatgatgatatcacttggtttcatggctgcagcaagtgttcgagtagcaaatgagcttggaagaggaagtgccaaagctgcaaagttctctattattgtgtcagtgctcacatcattggccattggattccttctgttcttattcttcttattttttagagaaagacttgcatatatatttacctcaaataaagatgtggcctttgctgttggggatttgtcacctttgttatcagtctctatattactaaacagtgttcaacctgtactctcaggagtggctataggagcagggtggcaaagcattgtagcatatgtgaatatggggtgttattacgccattggtattcctgtaggtattgtacttggcaacgttctcgatttgcaagtcaagggaatatggattggaatgttgtttggaacgttgattcaaactatagtgctaattgtaatcacctataaaactaattgggatgagcaggttaccattgctcagaagcgtattagcaggtggtcgaaggtggacaatgctgatcaagaaaatgaagcacaaagaaaatatgttagctaa

SEQ ID NO: 81309 - DNA, 147 bp, Glycine max
  Peptide Sequence Number=SeqID_172994
atgttgtacgcagccttacccttgcatatgcaaagaggctgtttccggattcgaacccatgaccaacaagtcaccaaggcacaactttaccgctgcaccaaggcaacaaagcagaagaaccagcaattgtctgcacttgactcatga

SEQ ID NO: 81310 - DNA, 1308 bp, Glycine max
  Peptide Sequence Number=SeqID_172995
atgaagttaagtgtttgtaagagatatgttaacctcaaatggataaaattcatgtccataattaaaaacatgagaggaaaacagcttgaagactccagagcaaagggaagggaagaggccattcctaaaccctacctctcaaaacatcatcaaattggtcgcagtcccaacaatgaagggctccatgagcagccttgtcaaaaagtagaacagaacccccaatgcgatcgaaatcggaagggctggcagagccttccggcacatggacaacaaaatgagcgtgcagccaagccccgaaataatggcgaggtagcacgcatacacagtcatcaaatcatacatagccgctctacccacaagaacactgtagaaaacaaagtccccaagtccaaacttaatccctctttcaccaatcttcctcctcaccccttccccttcctcctcattttcccccacaccactcatctcaacaagtggcgacattccctcatcaacaacaacctcaccaaatctcattccaccaaccaacggcgacctttcccattcatcgttaatcccattctccccattatcattgttactactcaaattgttattattattactattaaccctagacactacctgaagctcaattctggaagtttcggaatccgaaaccccggcgacgataaacccaaccgccgcggcgtggtttcgcgtattcaccgtcggccgtgcctcgtagaccagcgccgggagctcctcgttgcggctcgactccaattcgacgaggagcttgagcgggccgccgggagcgaggacggctaccaggtcgtagagcgcgagcgcgacgaggaccgtccacgtggtccactcgggaagcttggtgaaccacgcggcaacgatgatgccgaggcagaccgtgtagcactggcggagcaggatcgggaggccgccgccggcaaagacggagaggactccgacgacggcgaagttgaagaggaggagaaaggaggtgacggcgtcgagggggacggagaagcgttccaggagggagaggaggatggatccgcccatggcggcgaggacgaagaaggtggagaagcgcgtgtagtggaggaggaaggcggtgcagttgtagtagtagaggaggacgaggaggaaggttgcgagcgcgatgaagacgatgaagacgacggcgttgaggaccgcgccctcgagcttctgcgcggcggtgtcggaggggttctcagcgtagacgaggttggcggcggtggcgatggtggtggcggtggtggacggcgaggagagggagtacaccagtag

SEQ ID NO: 81311 - DNA, 492 bp, Glycine max
  Peptide Sequence Number=SeqID_172996
atgaagatgatacaagctgctgcactgaccaggaagcctggttcagataaagtttgttacgaaggaaagataagtagtattatctttagtcctggtagcttcagcaaacattcatatgatgacagatttgcaaatgagggatctggtccaagaatctctgacttttctatgtctaatggtggtgagcaaatcaaaactgatgttcagcattctggtacctgttcaagtgaagatgtatggtctcatgcaataaatatgtttctggaaacaaactccaagagagatgcagatggaattcatcgtctacagcttttggcagcttgtcctcaagggatgttaggatcccattgcaaggctttgggctcacctacaacaactagtttttgtagtgtggttctctcgggttcttatcattttagatgtctaaaaatctttgtattggaaaatattggttctgatgataaatctaggaattgggttactgcacactga

SEQ ID NO: 81312 - DNA, 957 bp, Glycine max
  Peptide Sequence Number=SeqID_172997
atgctgaaaggctttagttttgttaagtattggttttgtgagatgttagataatcatgttcccgatcccgaatttgagatatatgatgtgttgacatctgttaatgttcaaaatgtcagaataggctatagtatgctatctgatgctgaagagattggagcaatttctcctgggaagaccattttggttgaaccaacaactggaaatacaggacttggcattgcttttgttgcagcaacaaaggggtacaaacttatagtcacaatgcctgcttctattaatgttgagagaagaatccttttacgtgcatttggtgcagaggttgttctgactgatgctgagaaagggctaaaaggggcagttgacaaagctgaagaaattgttcgcaacacacccaatgcgtacatgtttcggcagtttgataacatgactaatacaaagatccacttcgaaactacagggccagagatatgggaggataccatgggtaatgttgatgtattggtagctgggattggaactggtggcaccgttactggcactggacgttatctgaaaatgatgaacaaaaatataaaggtggttggggtggaacctgcagacagaagtgttgtttcgggtgacagtcctggtttcatgccaagcattttggatatcaaactgcttgatgaagttatcaaggttacaaatgttgaagctgtcgaaatggcaaggagattagcattgaaagaaggtttgctggttgggatttcttcaggagctgcagcagctgctgccataaatttagcaagacggcctgagcattctgggaaacttattgtgcttgagttgttgaatgtagcactcaatagtttattttgctttctgcttcttctatggtcccagatgcatcattcggacaaggcacaattcttgaagctgaggtctttcaggaagctaaagtggggactgacatga

SEQ ID NO: 81313 - DNA, 786 bp, Glycine max
  Peptide Sequence Number=SeqID_172998
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggactataaagataccaggcgtttccccctggaagctccctcgtgcgctctcctgttccgaccctgccgcttaccggatacctgtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttga

SEQ ID NO: 81314 - DNA, 847 bp, Glycine max
  Peptide Sequence Number=SeqID_172999
agggctacacgccctcgtctttagaggactacacgtcctcgctttcagaggactacacgtcctcaccttaagaggactacacatcctctcctttagagggctacacgtcctcgccttcagagggctacgtgccctcacctttagaggtatagacgtcctcgccttcagaggacttcacgtcctcgccttgagagcactgcacgtcctcaccttcagaggactacacgtcctcgccttcagagaactgcacgtcttcaccttaagaggactacacgtcctcacgttcagaggactacacgtccttgccttcagaggattgcacgtccttgccttcagagggctacacgccctcaccttcagacgacaacacgtcctcgcctttagaggactacatgtcctcgccttcagagagatgcacgccctcgcctgtcttcaccttcagaggactacaggtcctcgccatttgaggactgcacgtcctcgccttcagatgactactcgtcttcgccttcagaggactacaagggactacagttcctcgccttcagaggacttccacgtcctcgccttcagagcactgcacgtcctcagcttcagaggactacacgtcctcgccttcagaggactgcacgtcctccccttcagaggactgcacgtcctcactttcagaggactaaatgttctggccttcagaggattgcacgcactcatgcatcctcaccttcagaggactacaggtcctcgccttcagaggaccgcacgtcctcaccttcagaggacaacacgtcctcggcttcagaggactgcacgtccttgccttcagaggactgcacgtcctcacctttag

SEQ ID NO: 81315 - DNA, 485 bp, Glycine max
  Peptide Sequence Number=SeqID_173000
gggtaccgtatggttatccgcacctttcgtcatctagagacggcaagtccgatgacatgcaggggtaccgtatggttatcgacacctttggtcatctagagacggcaagtccgatgacatgcggggacggcaagtccgatgacatgcagaggtatcgtatggttatccgcacctttggtcatctagagacggcaagtccgatgacatgcggggacggcaagtccgatgacatgtgggggtaccgtatggttatccacacctttggtcatctagagacggcaagtccgatgacatgcggggacagaaagtccgatgacatgcagggatatcgtatggttatccgcaccttttgtcaccccgagacagcgagtccgatgacatgcggggggactaacgttgtcctctgcacctttcgtcaacccaagggaaacgagcccgttgacgcgcagagactaacatcgtcttctacaccttttgtcatctag

SEQ ID NO: 81316 - DNA, 324 bp, Glycine max
  Peptide Sequence Number=SeqID_173001
atgaccgcccctctcgatgagtcaatctcttgctttctcataagggtggacccttgggtactagtacctattgcctttagagggctacacgccctcgccttcagaggagtgcatgtcctcgattttagaggactgcacatcctcgccttaagagggctgcacgccctcgcctttagaggactacatagggctacatgtcctcgacttcagaggaaaacacatcctcgacttaagagggctacacatccttgccttaacagggttgcacgtcctcaccttcagagggctgcacaccctcaccttcaaaggagtgggatcctctag

SEQ ID NO: 81317 - DNA, 462 bp, Glycine max
  Peptide Sequence Number=SeqID_173002
gagaagacgtgagaggagacgccatccagtagagaataagccatggaaggagaagcttcaccaccaagagagtgccttggataagaagcttagagaggaaccttcaatggaggaagagaatgagagagagtccatctctagaatatttccattggatttaatgatgaaatctatccaatttcaggtgaaaaagaggctaagtcatgaagtgctaaaagtgatagttgagcttagctcatctattgggctaagcgtgtatccaccgctaagcgcagcttcagtgctcatagcacgacagaagaatctagcagagcatcaatgtcaagccaggctcaacgcacgactggtgctaagctcaaatccacttactcgcgctaagcgtgagggtggcgctaaagcacaccataatgcctatttcgggaaaagagctctagaggcagcaagaggagcagcttttgctag

SEQ ID NO: 81318 - DNA, 262 bp, Glycine max
  Peptide Sequence Number=SeqID_173003
atggcccttgcaaaagaacttattggtttttcctcatttgtttctacttcctacaaagtgtttctgcaccacaagcatggcaccttctgcgtcaatactatcttgcttcctttggataacacaagagttgtgaggttgaggaagggagcaaagttgccgatggcagctattaagactatcttgaagcatttggatgccatcaatgataggataggaacaagaaacattgtgctggagcttatgagcaccgagattgatccaa

SEQ ID NO: 81319 - DNA, 1248 bp, Glycine max
  Peptide Sequence Number=SeqID_173004
ggtggacccttgggtactagtaccctcaccctcagaggactgcacatcctcaccttcagaggactgcatgtcctcgccttcagaggactgcacgtccttgccttcagagggctgcatgccctcacctttagagggctgcacgccctcaacttcagaggacttcacgtcctcatttgcagagggctacaccccctcatcttcagaggactacacgtcctcactttcagagggtggcacgcccccaccttcaaagggctgcatgccctcacctttcgaggactacatgtcctcaccttcagagggcttcacgtcctcgccttcatagggctacatgccctcaccttcaaaggactgcacgtcctcaccttcagaggactacacgtcctcaccttcggaggactacacgtcctcgccttgagagggctacacgtcctcaccttcagagggcttcatgtcctcgccttcatagggctacatgccctcacctttagaggactgcacgtcctcaccttcagaggactacacgtcctcaccttcggaggactacacgtcctcgccttgagagcgctacacctccttgtcatcagagggctgcatgccctaaaccttcagagggttacatccactcaccttcagaggaccagacggctacacgccctcacctttagaggactacacgtcctcaccttcagagggtcgcgcaccctcaccttcagaggactatacgtcctcaccttcggaggactacacgtcctcgccttaagagggctacacgtccttgccatcagagggctgcacgccctaaaccttcagaggggctacacgccctcacctttagaggactacacgtcctcaccttcagagggtcgcgcaccctcaccttcagaggactacacgtcatcaccgtcagagaactgcacgtcctcaccgtcagaggactgcacgtcctcaccttcagaggactacacgtcctcaccatcagaggactgcaagtcctcaccttcagaggactactcgtcctcaccgtcagaggattgcacgtcttcacttttcagagggcgacacgccctcacctttagaggactacacgtcctcgccatcagaggactagatgtcctcgccttcagaggactacacatcctccacttcagaagactacacgtcctcgccttcagagggctacgcgctctcactttcagtgggctccacatctgcgccttaagagaatttaaggtcctcttcccttaa

SEQ ID NO: 81320 - DNA, 129 bp, Glycine max
  Peptide Sequence Number=SeqID_173005
atggttcccgcatgtcatcgggcccgccgcctctggatgacaaaaggtgcagaagacgagggtcattatgacagagattgtggggcggctgacaaaagcgaggctcttgctcctacgtatcctcaatga

SEQ ID NO: 81321 - DNA, 584 bp, Glycine max
  Peptide Sequence Number=SeqID_173006
atggagccagaatattgggataagaatccttttaaagcaaccgccaaagtattccccccaggatttcactataggccatcaaccctcaacaaaaccaaaaaattttacgaattcattctaatagatacaaactccgtatctatgaaacatttcaaggaccctaaggacccaaacctaaacactcactcaacaatccaaatcctaaaggtaatgcagccacgacattacggctccaatttaaaccaacccaagaagttttctgcaccttttgaccttgcagaggaagtccaacatggatttcaacagttcaacaaactattcaacaacaaggaatcaagaattccagccgatttgaagtacttttccagcttcgctttgtcatggatcttttcatggcaatacaggtatggaaaatccgaaaacaacaagcagtatccgccgttacaaagacatgcctttgtaaaatggtggtcacaatttgatacctcaaaggctgctccagatcaagtcgagaactggtttcagagcaaccctgagttcctcaaacctgctgatccagagacatccttatttctaaatcagaa

SEQ ID NO: 81322 - DNA, 330 bp, Glycine max
  Peptide Sequence Number=SeqID_173007
atgggtaatctatatcctttcttatgggttgttctaggtatgctagaagtagtgtctaatccaaggaggtttacagtagggaactggttatgtgactcagatctggttagtcctactggaattgaacgggttctaaccgaaaaagaccttctggctgactcatattcagacctagaggcttttatccttgatgagaaagaatttctcctattgaaggttatctctacctttccggagttatcttgtttgattttttcaataattggagcgggtcggggatcagacggtgtggccttctccatgacccatttttcggggagagttacttaa

SEQ ID NO: 81323 - DNA, 699 bp, Glycine max
  Peptide Sequence Number=SeqID_173008
atggttggagcattctcgcaaaacatcgtgaccctgactggtctccctatgatcttacttagtgagagtgacctgacaaacccatggtgtgctaggaatgtgataactcactccctgtatgttgttgtgtttggatcctgtgatgatcttgaacttgtgttcgggaggctatcacgcatctactatgcatcccgaggcaatttcacccgtgccgctgcaaaaagaagagtgcggatcatgcgcaccaacatgaccactcttacatggatatggatgacgtcgctatttagcaacattctgcccagcgaccacaatgccaatctccccctacagatgtatcagttgggatcgcgcccacaagacgcccagtggacccgaagaagtccaacagggccctggggtttccagctctggtggcaggcctctgaatcgcacccacaaagacactcagtggacccggagaagtccaacagggccatggggtttccaactctggttacgggcctctgtagtcctacagggtgcccgtttcccccggcaaggtcacgtcatcatgacatagggatcgcgcatgcaagacacctagtggacccgaagaagtccaatagggtcttgaagtttccaagctctaattacgagcctctgtcagctctacggagtgcctgtcgcccccagcaaggtcatcagaccccctactaa

SEQ ID NO: 81324 - DNA, 132 bp, Glycine max
  Peptide Sequence Number=SeqID_173009
atgcatgatgcaatcctccctaggaagggaccaatcacaagaaccatgagcaagaggctccaagaagattgggctagagctgctgaagaaggccctagggttctcatgaaccttaggggctccatattgtag

SEQ ID NO: 81325 - DNA, 228 bp, Glycine max
  Peptide Sequence Number=SeqID_173010
atgggaagggtctttactcttaacaatgccaaagcttcgaaatccaaaaatctaatccaagtgagtaaggataggatgtttatctctgcaaaccaagttattacatcttcaaaagaagatgctcaagtgtacatgatcttgtctaacctagaagtagagacaaaggtttccatgggtgacctccctattgtcagagagtttcctaaagtgttccctgaggatatatga

SEQ ID NO: 81326 - DNA, 261 bp, Glycine max
  Peptide Sequence Number=SeqID_173011
atggttgcaggaaatacaaccatagaaaaacctagggaagaatggagtgaagagcaaaagaaattagttcaatacaacttaaaagccaaaaatataattacatctgctttagggatggatgagtactttagggtatccaattgtaaaagtgcaaaagatatgtgggataccctacaggtaacacatgaaggaaaaatatttccaaatgaagatcttatcaatgaagttttgagatgcttaagcagggaatggcaacccaag

SEQ ID NO: 81327 - DNA, 693 bp, Glycine max
  Peptide Sequence Number=SeqID_173012
gagcactgatctctggccagatgacctctatagcccaatcgaacacttctagtcttgggttccctgctctgatcaccgcattatgtagagccagaggggttgtctctaatagcctcacttttgagcagctgagcccgatcattaacttggcctacatcaggaagaactgttggaaccccgagtatctaatagtttctatccgaggggttaggagagtgagggctaagctagctgagctcccttccacttctgcggctcctactccagcgtccatgtcagcatctccttctgttccaacccagatagattcccaacgccttgaagccatgcttcagagatctattccctcagttgagaagttcagagagttggtagcctggcttgggactcagtcatctcttcatagggaagatgaaggtcccacaactcaggtaccacaacatatggaggatgagtcctatgaggccactatctcagagccatttactatagaggaggaggcagacgatacacagacgacacaggtagctgctgccactcctgagagatctcttgaggccatttcagaacctccaacaccagcagtggatccatcttcaccacgcaacagacccttccactcctcttctagagatgctagaggacccgactacaccagtcctaactatggagacttctcctccagctactcca

SEQ ID NO: 81328 - DNA, 408 bp, Glycine max
  Peptide Sequence Number=SeqID_173013
atggataatgaagagggcgtgcaagagcagatgaaggccgacctattggccttaaaagatcaaatggcttctatcacggaggccatgctaaaactccagaaaactctagaggataatgccacggcgaccgcctccaatgcagttagggaagcggaaccggtgctacagcccacaataaacttgggccgagatagaaacccaatggtgttcggtcggaggtacagtccgcaagcttacccttatggcttgcctccagacttcactccccgtgccgctccggaagatgtgagccaagcccctaccttcgaggggcaacttcctccttatgccgattatgccctaaaagaagacaacgaaggagatgcccatctaggccctctgcttcccctcaaggatccagccccatga

SEQ ID NO: 81329 - DNA, 1479 bp, Glycine max
  Peptide Sequence Number=SeqID_173014
atgtccactcatccgtgtttcccaagtaatattgatatgctggttctctcccattttgatgaggatcacgttaatggagttgaggaccttctcagacactgccacggaacttcaccatccacagcacttttgcaacttaatcccctgcaatggttagcaactagagaatttgatgttcaagttgatgaggttgtactaatccaaggaggttccgatagaccgcctaatgctcttggtgaagaaaaacccaatccaaagcccgatgactttcaacgtgatgatgactccagtattctcggcgatggctactttactttcaatcagcccacagcacttggcaccatcaagctaagaactattaaacatgaccgccccattaatctcattatgcgtccaaattcactttctccgacttcgcgtctggcgaccctctgcaccggggatatacatcttactcctgaggtaatttctgatctgcggaaccatcttggaccacaacgctgggacaagattggtttaattcaggtacctcaccacggttctaagaattcatggaaagtgggaaatgctgcattactgtcaccagctcaatttttgcattgtgcttcaggtactaagcaccatccacattcaacggctgcggaagaagcgttccatcgggctgttatcccagcagtttccccgccgactgacgctttgctttattctgtaacgccagagaagttgctgatatttcaggcctgtatactggcttccctgatcgctatggaacatgacatcacgcggttggctacgcgtctcatatgccatccgcagagcactccagccgataactctgcgggcaaaaagatccattacgaccgccagatagcaccagcgatttcctgcccagatataagtaatatctccgcaccatacccggtctggctccggtacagcgaactggcgctcgagcagatttggcaggcatgtatgctcctgacgggcatttttgtactgatattttccgagctgacaactgctcaggttcagggatttcatcagacgcccggcacggtaacggctcatcggaatgccgttttgggtcagcatttcagccagagtgcgcgcgccagcagagccacggctctggttccatgcccggcgtatctcgctgtacaacctgactcgcgccggattaacagtatcgcatcgtttctgccagtaccggtacctgctacggtgtactcccagagcggaacaaagtctgactaccgtgtggctgtcgctcagcctggcaattatcgtgaaccgttcagtgagtcggacatcaagagcgcgacggcgaacctgcttttccagctcgcggatacgctgctgctctggggtaatgggggtggcagaaggcgtaataccctggcgctctcgtctgagctggcgtacccaagattcaagcgtggtagaaccaacattaaccgcttcactggcttgtcgatatga

SEQ ID NO: 81330 - DNA, 147 bp, Glycine max
  Peptide Sequence Number=SeqID_173015
ttgaacgacaacaacatcaacgaactgaccgattatcagggctacaaggcggagttcctgcgcctgttcggctttggtctgcagggcgttgactacgacgccgatctgagcggcgaagccaacttcgacgtgatcgagctggtctaa

SEQ ID NO: 81331 - DNA, 291 bp, Glycine max
  Peptide Sequence Number=SeqID_173016
atggtgcaggaaggtgatgaaggattttggtttgagaaggctttttatggatcaagaggaccaacttttggcaccaaggttgccaactaccctccatgccccaacctagtgctggtgaagaagggtcttcgtccccacactaatgctggtggaattatccttctcttccaggatgacaaggttatcaccaatggtaagtacaagagtgtggagcaccatgtgatagcacaaacagatgggaccaaatgtctattgcctcattctctatgtgtgatagcacaaacagattga

SEQ ID NO: 81332 - DNA, 969 bp, Glycine max
  Peptide Sequence Number=SeqID_173017
atggctgacaaaagtgcacgagacatgatttctcctagcagtggtgtacatattatactccctgattattattctccagagggaatgggcttaattgttcccaaaactaaggatggacgtgttgttttcatgctaccatggttgggacgaacggttgctggaactacagattccaacactagcattacctttcttccagaaccacatgaagatgaaatacaatttatattggatgccatctctgattaccttaatgttaaagtccgccgcactgatgttctttctgcctggagtggcattcgcccattagcgatggacccaacagctaaaaataccgagagtatctccagggatcatgttgtctttgaggatcaccctggtttggtcaccattactggtggcaagtggactacctatcgaagcatggcagaagatgctgtcaattcagctataaagtctgggaagttgacccccgccaatggatgtatcaccaacaatatcaggattgttggtggtgaagggtgggatcctgtttcctttaccattctttctcaacagtatatgcgcatgaaagtcacatataggggtaaagttgttcctggtgtgatggacactgcttcagcaaagcacttgtctcatgcatatggaacattggctgaacgtgttgctgccattgctcaggctgaggtggcctactgtgcccgtcatgaatattgtgaatctgcgattgacttcattgctaggagatctcgtcttgctttcctggacacggatgcagcaggacgggcattacctcgtgtgattcaaatattggcagctgagcacaaatgggacaagtcaaggcagaaggaagagatgtttaaagctaaagaatttttggagacttttaaatcctccagaaatgctcaattctatgatgggaagcacaattacgatgtgagtcacattcgtgggttgtggctgttgttg

SEQ ID NO: 81333 - DNA, 399 bp, Glycine max
  Peptide Sequence Number=SeqID_173018
atgcgaatatacccaaggggaggggcaaaaaggtcattttcaggcatttttctgaactctggctcacccaggctagcctctggcttgcctgggccaccaaataacttcatggggaagaaaccaactcgcctgggcaagctcattgcttcagcactaagtaacagctcgcctgggcgagctaccatgaccctaagtgccctttttcctataaataggcatgctagggaggctaaggggagggggaaaggtccagaagtgaaggaattgaaagaaagaagagagaagaagaagaaagaagagaaaatgaagttgaagcattgccgaatcacgatcgtgatcaacttctacatcgttcttcgttcattcttcgttcgtcatccggttttaaccgatcattag

SEQ ID NO: 81334 - DNA, 180 bp, Glycine max
  Peptide Sequence Number=SeqID_173019
atggccttgctagtgcttgcacgcttagcgcaactctgcatatggactcaagtggtgcgcttagcgggattagccctcgctcagcgaacattcatagctcgtccttcttccagattcttcctcgcgctcagcaaaaggagtgttgcactcagccagccgattggcttagcgagcggatga

SEQ ID NO: 81335 - DNA, 1190 bp, Glycine max
  Peptide Sequence Number=SeqID_173020
cccaacatttcattggagacccatccttgtggaaagataggtctgcagaattattatcaaatcttaagtgtagaaccttagaagattttaggtggtacagagatactttcctaactagggtttacagaaaagaagatagtcaacaacctttttggaaagaaaaatttctagccggtcttcccagatcattaggagacaaggttagagataaaatccatagtcaatctgccagtggagatattccatatgaaagtttaagctatggccaattaatttcttacgttcaaaaggtagccttaaaaatttgtcaggatgacaaaattcagaggcaattagccaaagaaaaggctcaaacaaagaaagatttagaaacctcagaggaagaaacaaaaacttcatcctccgagccttccgatgaaaacctaaatctaatccaacaggatgaccaactatcatcaatagatgatgatgatgggcaaatcaatactctaacgagagaacaagatctcttgtttaaggcaatcaattccatacctgacccccaggaaaagaaggttttcctggaaaaacttaagaaaacattagaggtaaaacctaggcaaaaggattttatcacaaacaacaaattcgatgtaagtaacatactcaagagattagaaaattcttcaaccaagccaacgacaatccaagatctgcaaacagagataaacaatctaaaaagagaagtaaaagaacttcgtcaacaacaagaaattcatcagatcattctttctcagcttgaggaagatagtgatcctgaaagtgccaacaacagtgaggaaaaccaaccagaaaatttagaagatgatatgtttatgggattaatcaacaagattaaaatccaaaatttttacataaacataaaaataattattaacgatttcgttttagaaacaatggccctatttgacacaggggctgattcaaactgcattttagaaggattaattcctacaaaattctttgagaaaacctcaaaaaaattaagtacggcaaacgactcaaaattaaaaattaatttcaagctatcaaatgcaatcattgaaaaccaaggtcttaagattaacaaaaactttcttctggaggcctccacactcaagaaccgaccaagtaggctacttagattcaaagaatatgacagatttaaataa

SEQ ID NO: 81336 - DNA, 676 bp, Glycine max
  Peptide Sequence Number=SeqID_173021
atgtgtatgtattgtaagcagggtcctcattctaattttgctggacaaacttcaggaagcactgcctgcgtcacaattattagaaacaactatacttttgtagctaatgccggttattcacgttgtgtgatatgtgggaagggtcaggcgtatgatttgtctatagatcataaacctgatcttgagattgagaaggaaagaatcgtaaaagttggtggttttattcatgcaagaagagttaatgggagtttaagccttgcaagagcaataggtccatttgctaagagaaggcattcgttggtggactcaatagtagtttcggaaataagaagaagccttgaagaggaggttgaattccaagtggatttaagtgaggaagaaccttgttggagatgtgtgatagggagtggcatgcatggtgctagaaatcccgagggcatagctccttctagacatgattatgttgttgttagtcttctaggaagcaaccctgctcgcctgggcgagctgggcggcaagcatctcccttattttgctataaataggggaggaagtgagaaggaaaaggcgcttccgaaacgtttccgtaacgttttccgtgaggaatttcgcgaaggttttcgaccgttcttcgacgttcttcattcgttcttcatcgttcttcgatcttcaacgg

SEQ ID NO: 81337 - DNA, 180 bp, Glycine max
  Peptide Sequence Number=SeqID_173022
atggatacagcacttccgttgtcacagaaaagcacgggagtagtgaatggattaccaagatattatgatgcaatcttacccgcattggatagaagactccaagaagattggaccagagatgtacgagaaggccctaggattctcatgagccttagggtagatttcgggctcatggactaa

SEQ ID NO: 81338 - DNA, 291 bp, Glycine max
  Peptide Sequence Number=SeqID_173023
atgttatccacgcaccaagcccaagaagtgttgggtgtgagggagtgtattgggaaaaacccaagtcccacatcggctaaagataaagccaagttagagtatataagtgaagggcaaccctcaccccttgagctaacttttagaattgagttagacctaaacttacattctaaagattctaaaatgtcgttcccaaacaccgttgccgagaagctcgatgattcaaactaccttcactggcgacaacatgtagaaccagtgatcaaggcacataaattgcagatcgtgtga

SEQ ID NO: 81339 - DNA, 987 bp, Glycine max
  Peptide Sequence Number=SeqID_173024
atgttaccccttagtgatttccaaatcagggttttgaattttcttagaattttcccttcccaactccatccaaatgcctggggctttattcttgcatttgagaggttatgtgttcaacactacttcttcttgtctgtcaatgtatttcattatttctttgttcccttgtatattaaacatccctctggttattcgtgcctctctttaaagggtcatagagatacaacgattcttaaagcttatgaagaatcatatacaagctttaaggaaatgtacttttgggtgagacattttaaggattgttgggatgacctatttgttgttgataagaatgaagcattcattgggaaatcaaaggataagcctttattggttgccactccttatgctgccactgaaaatgataagaagactttgaataagtcagaattgtccgacaaaggaaatagttttaccatggagacccactttaagtctaatcatgacatgcctccccttcctctaaaaaggcaaagggtcatcaattttgatgatgatgtggaattgattggctctatcttggtctatgttaagaaatttgttgctccttttatgtggatgtcttcaggagtatctaactcatgttactctagggttcaaaagcttttggaattgaagcaatccttgggtaatgtcaacccactaaacctgattaaggagaaagattttgccttaaagaaaactcagggtcaagttgaggaaaagcttgttgatgtagaaacagctagggatcaatggttgttgatgagtaattttctgtttggattgatggaaactactaatgtggatacccctgatgacacgatgactaatggatttattaataccctgaaggctaacattgatgatagagatacaaaagcttctaaactaatgcaaatctcgaagaatcttgaaggttggtatgttggtcttgcatgtattggaacgagtttggctgcttgttga

SEQ ID NO: 81340 - DNA, 342 bp, Glycine max
  Peptide Sequence Number=SeqID_173025
atggggattatatgggtggaggtctgcttgatatctgcacatggactccagctttcaacctcactttggaagcgtcaatggtttgctgttgggtggattgatcataacaacaaatattgcaccaaagttgttaattctgggaatgcaaatcctgtatggagaaccaagtttgtcattcctgttgatgactcggtgtcaaacatccaagatttggccctgaacgtggaagtttacagtatagaccccgttttcttcacggaaaagcttctaggctcagcaacagtttttctaagagagtttcttgtcaagcggtaccagaggtactctaaagtacagatatag

SEQ ID NO: 81341 - DNA, 555 bp, Glycine max
  Peptide Sequence Number=SeqID_173026
atggcaggtgaagaaaagggaaagggcgtgatttgcgacgttggcaagaaggtcgtgggcattgctagtgaccccaatgttagtggcgagtggatagtgcggagggtgtcgtcaacaagtggatcgttgtcctcttctttctccaatgaatccaacacccagaagcccttctttcctcttcctctttgctacatcttcgacacctatcacccaccagtgttagcgctagcgagaggcgcccgtcgcggccaccgatggcattgcggcctaagccgatgctgtagttggctaggcgcttgtggcgggtgtaccaccgcttgtcgcactgccatcagtcgtcgattgggttcccgatcccgcatgagaagaagttcaggttccttcgagctgtgtccaaggttgttgaggattcaagttagcttctttcgtggtccaagattcagttttgaagaaaaacaagggataggtcccacacaagcacgtacaggatctgctggccttagtttcatggctggtctctttccttttctaatccgtcatatcatcttgatatga

SEQ ID NO: 81342 - DNA, 963 bp, Glycine max
  Peptide Sequence Number=SeqID_173027
atggcaaaagaattgggggtcacttgcgggtcagtgcaggggaaatttgttgagaaaataaaggaaatggaggaaagagataagaaagagcagagtgattgggaaataggagaaaatgtcaagaacgagcacatagacatgatctgtatccaagagccaaagaaggagttagttgggaagcgcatcctgcgtgggattctatgtatatggagtgaaaaaacattcaaactagaaaggaaagtcattggcaatggtttcataatgctggtagggcagtggcttaaggaggcacaacaaggggtatgggaaagtaacatcagggagttcaacgaatggattgaagagttggaggtagaggaagtgccatgggtggaaagaaaattcacatggttcagaccaaacggagctgctaagagcaatcaaaacaattttggtgaggcatcaatggagaatgtcaaggcaatcaaaacaattttgaggacctttgaacttggtggtggacaagttggtgaccttacaacgaagattcctcatcaaggacaattgtgggctagggtactggagtctaaatatggtggctggaggagcttgaatgaagcattacgagacaacaacgaatccatatggtggagggacttaaagatggcttctcaacatttgcaacagggtgatgcattccaaaatagaacattgtggagggtcgggtgtggtgataggattaagttctgggaggacaactggattggcggagagggaacattattagcaaaataccctagactgtaccttatctcttgtcagcaaaatcaagttatccagcagatgggagtccacaaggacacagggtgggtgtgggatttcatatggaggagaccactgtttgacagtgagatagccatggctgttagattcctaaaagatgttgaaggcaagccaatccagccacatagaagagatgattga

SEQ ID NO: 81343 - DNA, 284 bp, Glycine max
  Peptide Sequence Number=SeqID_173028
atggcagcagaggaggaacaagtaatcttttccaatgacaccttcgatggcaacaaagtgatggatgatgcagctttcttactctggacatggcttagaagtttggagaaggattttgcaactcattttaatcaatggtctagtaatcttacagcagggaaaagcacctttgagttgcagccaagacatggtttcccaccatatgggttgaactttactgcaatggaagaagagatgggctgcgtcctcttgatgggttctgcagagaggacaaagagaatctg

SEQ ID NO: 81344 - DNA, 1596 bp, Glycine max
  Peptide Sequence Number=SeqID_173029
atgtgcttccagaggaaaaaatgttgcctaagagttactatcaggccaagaagatattgtccaatgggtatggagtatcagaagattcatgcttgcctaaatgattgcatactgtatagacatgaatttcaagaaatgcccaaataccctagctgtggggtatcaccacccaactctcctcctcctcctactagtgcagcatcacagtcgccatctaccttgaagcggacaagaaaagccacacggctaagatcattggcatctagactaattagggcagagagaccgcttgtccatgttgatcctgcgacaaggaaagccgactgtccccacagaaagttaagaacatatttagggattgtcgctcgtgaaaagtggagacaatttaagtatgatttgacactgaaaggggcacttgcagccgacaaggaaagtgtcgacgatactgtatgcaaaaagtacgacattagcaaggagaagtgggcccaatttcgtcagactcgcagagacccttcgcgggaggatgtgcgaaaaaaggcacagtccatccagaaacaaaacactgcccatcacgtgttgtctcgtgggggttatgaatatctagaaaacaagttgataaaggagaagaaaaagaaaaaagtggaggaagctgctcaatccggaagcactaacaccgtgattgatcctccatctcctatcagagaacacgtgaagaggaagatggcccgcaccaagaaaactggccaaatgacgtctgagacaacaaaggaaattgctgacaagattgattcgttggaagagcaagcctcacagggttcctttgtcgcccatggacaacaccctggtcgtgtgcgtgctactggagccggtgtcacgatcaagaaatactttggaccggctccaaggacctcctgcacgtcttcctccatgactcccgaagacttggagcagctgacacaaaaaatcaaggaccaattggaggatcaatcacagaaaaaccagatgcagtcccagtttcaatcgcagatgcaatcacagggactcgcactacctcctgagcctgaggttggtcctttagctactcgtgtcagcacaaaggatatttgtgttgatccctcagggaacgatccagacatgggtgactcagaaaaatgtgggtgttacgtcgaagaaaatcctccccacctggttgccctaggaagactttatgaggggtccataaccgttcacaacattcctttgctccatgatcaagtcaatgttggtgttgaggaggttaaagatgcagatgctcccattccagtacccactgaagaggttaagttagtggggcagacacttaagaccttccttgcttggctgacacatcttgtcaagcgtttatcagaacaaaaatcaaagagggatgtgtacctagcaacctacttgaatggtgctttgaaagaacttgacaatactccacaaagaaaatccaaggctgctaggtggattgttgttaaatatttcaatgatgttagaccattggaaccagagagattgaaggcgcttcacatccagtgggcaaagtattatttgaaagttaaaaataaaacctag

SEQ ID NO: 81345 - DNA, 361 bp, Glycine max
  Peptide Sequence Number=SeqID_173030
gtttgtcatcatcaaaaagggggagattgtagaaacaagcttcatgatgatgaatcaatcaattttgatgatgccaaatgcccaagtgattgattcaagacttcaagatcaagcatcaagaatccaatccaagattcaagattcaagagaagaaatcaagaagcaacaagtcaagacttcatataggataaaacaagagagggtacatctcttgtcgatcggttcaagtggagcgtacatccacttggttgttcaaagagaacaagggagggtacatcccttatggatctttgcttgtaaaggattttacaaggttattggaaatctcaagaaccggtggttgcttggggactggatgtag

SEQ ID NO: 81346 - DNA, 240 bp, Glycine max
  Peptide Sequence Number=SeqID_173031
atgtacaaagataagtggacccaaccttggcccatgggctcaaaaatctaccctgaggttcatgagaatcctaggaccttcttcagcaactctagctcaatcctattggagcctcttgctcatggctctagttgttggacaaatggcctcagttatcttaagaatggggataacccatcccttgtgtttaggaatccttacaacttaagagaccctcagtcccttaatcaatctctttga

SEQ ID NO: 81347 - DNA, 1242 bp, Glycine max
  Peptide Sequence Number=SeqID_173032
gttgtcgcccggcggcggcttgaaagaccacgggttaacactggccatgagaggaatgaggggatgaacagcaatcaccttgcatccatcgcgcgcagtgagaaaatctgtttcgactatatggattttctgtccgcatcgtgcaggaagcactggcgctttgttgatgctatttatggtgtgatgccgatcttcggcatggtgttgaaatcgcgcgtgaccacgtcacaaacgcgcaaagagcagttgaaagagctggcgctgcaggtggtgtcaacccaggtcagcgatgaaaccaacattgtgcgcctgattgacctggcgcagcagcagggtctgacggtatttgatattcagctgccctatgagctggaggcgcagcagctggcggccattcagaaagagtgcgcggaaggcatcgcgatcgccctgcgcatcgtcaaacggcttgcccgccaggaacagttccggggtgccgacgaagcggtaaccgtccagcgcctcgcgatcgataaccacgacggccattttcgatccttccctgatattttgcagcgtctggccgccggtattttcgttgtaaatcagcgtacggtcgtcatacaggcgcaaagagcgcttggggccgatatcgggcatgccgcttgggctgctggtcgcctgcacaggcagctgtttggccagcatctttttcatctcatcattcaattcattcattggcagattacccctcaggtcgtggtggcgttgttaatgcacggtggcggaatggttcgccgcgggcgcgcagacgctggtttccggcagccggtgctcgcgcagcgcctgcagcgtttcaattcggaaccgcagcaggtgccgttcggcgatctgctgcatctgttcgcacagcgaggtgtcgtccatcagttgctcgatggcgagccgggcctgatgcacgtggggttctacgccgcgaagcggcttttgccgcaggcgcagatgggtgatgttgttgaacgtgacgatcagcgcggccagggcggattcgaaaagatgcagtgcgtcaaaccgttcggtatattccgcgttttgccagggccgctcggcgacgagcgcctgagcggcctccagcgcctgctggcggtaaacaagggtaatgcgtgcagcattttttcagccatgaaatgccttccattttcagccggtctaaacccgcctcctgacgcctctcggcagggggcgctcgcgtcttgccgttaa

SEQ ID NO: 81348 - DNA, 1101 bp, Glycine max
  Peptide Sequence Number=SeqID_173033
atgtccacccaccaggcgctgatggaaagcattggttcaatgccatcaaacaatgccgccgcagtggataaacttcgaaaagctttgctacctggcgatggaaagcatcccttgatgatggacggacttgatggcatgttaccatcaatgaagcgacaagcgaccgattctgaaatgcttgctcggcatcaggtcattcatatggcttcgtcggccggcaagagtggcaccaccagtacgttgagcggcggcggtggcaacacggccagcatcagtcactacctggaaccaatttccccgccacaacacaacaacaatgacactgctaatgcggcatcatcgtcggcaagttcgtcaacttcggcatcgggcacgaccacaaccacggtgaccgccactcactggccacccgttcagccaccatcttccaccgcatcctcgggcaattggacatcgatgcccactgcattttcactgtttgacaatcctggacttcgggtgaacaatcccgccaacaccacctcttcgtcgtcgtccaatgtgaacacttccacctcaaatagtgttgccggtggtggttcttctagtggtggcggtgcgttgaatgatttttttcaaaaccgtatcgccgaagcgatgagagtaactgccgccgatgaggcgtcctcctcctcttcgaaacgtgccgaaacgcccaaaacgttagacttgcaaggaaaacactctgaactgtccaactcgtcatcgtcgactgttgcgaatcgaaacctcacctatccggacagtccaagctcaccacccgagatggtgattgacgagaaccgagctccctctgtgtcgcccgatatcaaggccaacgagcaacaccatccgttgaggttgtttggttttggcggtgatggtggcaaaaagcctgaaccagccggtggcgattcttcgcggtcgtccactcctggcatggcaggcgtcatcaagaaacatgcaatcaatgataacgacaccaaatcgatgacgttcaattcggatgcgctcaaatcgtcagacaccaactctacgatgactcctcgtcgggcaccaacgttccaccaccatcgaacctaa

SEQ ID NO: 81349 - DNA, 909 bp, Glycine max
  Peptide Sequence Number=SeqID_173034
agggctacacgtcctcgccttcagagggctacacaccctcgccttcagaggactacacgtcctcgccttcagagggctacacgccctcgccttaagaggactactcgtcctcgcctttatagggctacacgccatcgccttaagaggactacatgtcctcgccttcagagggttgcacgccctcgccttcagaggactacacatcctcgccttagagggctgcacaccctcgcctttagaggactacacatcctccccatcagagggctccacgccctcgccttaagaggactaaacgtcctcgcctttagaggactacacgtcctcgccttcagaagactacacgtcctcgccttcagagggctgcatgccctcgcctttagagggctacacgccctggactgcagagggctccacgccctctccttcagaggactacgcgtcctcgccttcagaggactacacgcccttgccatcagaggtttgcacatcctcgccttcagagggctgcacgccgttgcctttagagggctacacgccctcgccttcagaggactccaggtcctcgccgttagagggctaaatgccctcgccttcacaggactacacgccctcgccttcacaggactacgcgccctttccttcaaaggtctgcacgtcctcgccttcagagggctgcacgccctctcctttagagggctacacgcccttgccttcagaggactccaggtcctcgccttcagagggctacacactttcaccttcacaggactacacgccctcgccttccgagggttgcacgccctcgccttcagaggactacacgtcctcacctcaaagggctacacgccctcgccttcagagggttgcacgccctcaccttcagaggactacacgtcctcgccttga

SEQ ID NO: 81350 - DNA, 411 bp, Glycine max
  Peptide Sequence Number=SeqID_173035
atgcaagtgggaggctgtagtatttatggaggagctcatgaatccagttgttgtataccccaagatgattcagccaaagaggtaaactacatggggaatcaaaacagacagggatttcattcaagtggcttttcaggttaccagcaaggagggaacttcaatcaaaatcaagggcaaggatggaggtcacatccagggaaccaatttaacaaagatcaaggaggaccttccaacaaaccccctaatcaagggcctaacttgtatgagaggaccaccaagttggaagaaactttggctcaatttatgcaggtttcaatgtctaatcataagagcactgaatcagccattaagaaaagaaaatatttgatacgcgaagacataattgaatgcatttttcaattatttctataa

SEQ ID NO: 81351 - DNA, 372 bp, Glycine max
  Peptide Sequence Number=SeqID_173036
atgaaggaagagttgaaaatgatcgaaaaaaatgacatgtggaagctagtggacagacctcaacacaaacaacctataggggaggagatttatgtagagcaacatgaggggtttcaaatcaaaggagaggagcaagaagtttacaagttgaaaaagatgatgacaaaagtgatgaacaaaaagctcaagagaatcaaagaacatccatctcaagaaaatctagaacaagtcaaagagttcaagaatcaagaagaattcaagactcaagatgaaagcctacaaacaagaatcaagattcaatacttaagagattcaagatctcaagaatcaagatcaagattcaagaatgaagaaaagactcaatcaagataa

SEQ ID NO: 81352 - DNA, 339 bp, Glycine max
  Peptide Sequence Number=SeqID_173037
atgggatttgtaggtagaggggatatggaggttgaggttgatgtatggagattgaagagtttgcgaggtggaggagtcggggatggggatgatatgatagttggtaatgatgggtttggaggtgatgttatgaatggggctgatgctgtggttggtgaggggtggagtacgattttgatggttagagggtggagcactataggaataggatggaaggaaggagaacttaagatagtagctcctggatgtcctaaacggttgtgccataattccgtggataacgcggcaaaggtggatggtggcaaggttgtattaggtggtcttgtggcaatgggatag

SEQ ID NO: 81353 - DNA, 315 bp, Glycine max
  Peptide Sequence Number=SeqID_173038
atgctctgggtcaaacacccacgtcactacataagagcgctgagagcatttcgggttttacaaagggatatcatttggaaattccgaccacgccaatgtgaccggggttcaatactagggtttcattctctaccgaaaccgcgagccaagttggaagattccgcttcggttgaagggttcctctcggtgtgggtctcaacggagaataatggcagtttgtggtggctaatggtggctgcgggtgatggagaaagttcttgggatgttagaaatgactttggaagaaagaaaggagaagaaatggcgtttttctaa

SEQ ID NO: 81354 - DNA, 147 bp, Glycine max
  Peptide Sequence Number=SeqID_173039
atggccaacaccaagaaaactgggcaaatgacttttgaggcagcaaaggaaattgttgacaagattgattccttggaggagcaggcctcacaaggttcctttgttgcccatggacgtcaggatgtattgactgctggcattgggtga

SEQ ID NO: 81355 - DNA, 186 bp, Glycine max
  Peptide Sequence Number=SeqID_173040
atggtaacgcattgggtgccagcccctcggcggggaacggggagtaggaatcgatgtctccctgagcatgctctcgacaatcctcgtggacctcgtccggcagttgaggaggctccccttcaaggatggggggaaggacatgacccgcgtcgtgatgcaatactaccctgcaagggcattagatag

SEQ ID NO: 81356 - DNA, 1830 bp, Glycine max
  Peptide Sequence Number=SeqID_173041
atgaaaaaagtactgattgtgtgtggaaacggtttaggcagcagcttcattgtggaaatgaacgtgaagaaaattattaaggagctgggtaaagaggctgaagtgggtcataccgatttaacctcagccaaatccgagcaggccgatattatcatcagcgctaaagatatcgctgaccagctgtcgagccacagcgcacagaaaccggtatccgatgtgatttccggtacgctaaaaaccatcatgggttttgttattcttatcgccggggccaacttaattgcggccaccctgaccatcttcagccagctattcgagcactcgttcaatattcagggcgtagtgccgaataccgatgcgatggccgcgctggcacagaaaaactacggtaccgaaaccgcgatgatcatggtgttcggtatgctggtgaatattgtgctggcgcgcatcacgccgctgaaatacatcttcctgaccgggcaccatacgctgtatatgtcggccatgctggcggtgatcctgtcggtgggcggcgtgcacggcttctggctggtgctgatcggctcgctgatcctcggcaccatgatggtggtatgtccggcgattctgcagccgttcacccgcaaaatcaccaactcggacgatctggcgctgggccactttggctccaccggctacctgttgtcagcgctggttggcaaagcggtgggcaaaggcagcccgtcaattgaagagctgaaagtaccgaaaaccctcaacttcctgcgcgactcgtccgtggcaatttcgctgaccatgatgattctgtttgtcgcgctggtactggtcgccggtaaagagtttaccgaaagccaggtgagcggcggccagaacttcatcgtctttgccattatccagtcaatcacctttgctgcgggtgtttacatcattcttgccggtgtacgcatggtgattgccgagatcgtcccggcgttcaaaggcatcgccgataaactggtgccaaacgctaaaccggcgctggattgcccgacggtcttcccgttcgcgccgaacgccgtgatcatcggcttcctgtgcagcttcgccgccgggctgatcagcatgttcctgtgcccgctgttcggtctgagcgtgattgtgccgggcctggtgccgcacttcttctgcggcgcgaccgctggcgtctacggcaatatcaccggcggacggcgcggtgcgatcatcggttcctttgtccaggggctgctgatctccttcctgcccgccattctgctgccgctgatgggtgaccttggcttcgcgtccaccacctttggtgatgcgacttcggtatcgtcggcattgtgctcggccatattatttcgttcttccattgatgtcacagacagcgcctgcgggcgctgtttgcgtaatgaggaaatcagcatgaacgcccgcttttcaccgtccctgatgtgcatggatttgacccgcttccgcgagcagatcgaagcgatgaacgccagcgcctcgttctatcatgtcgatattatggatggcagctatgttaagaatattacgctgtcgccgttctttattgagaacctgcgtaaaattaccgatgtgccgattgatgtgcatttaatggtgaaccacccggaagatattattccgatgtgcattgacgccggcgcggatattatcagtttccatccggagacggcgaataacaaaatttttcgcctgctgacgcaaattaaagaggcctggccgtcgctgcggcgtggtgctgaatccggcgacgccggccggaaagcattcgtgagtatgcgcatctgctggataaagtga

SEQ ID NO: 81357 - DNA, 210 bp, Glycine max
  Peptide Sequence Number=SeqID_173042
atggggaatttcatgtggcatatccgagccaaggctcgaagtcggctagattgtgatggggaatttcatgtgtctcccccacggagtggagttattgacattcttattgggagtgtacgccacattgggtggcgcatagttgagaggcaaaccatatggcgggaaggcgtgctcgttttgaatttgcacatcatgggggccgcccattaa

SEQ ID NO: 81358 - DNA, 240 bp, Glycine max
  Peptide Sequence Number=SeqID_173043
atggtgccaaaaacttgttcgcttccgacaagtgcaccgaatcgcacaagtagtataaaatggtatgtaaactatctatgcaaaaaggaaaatcaccctaatcctgatcaagcatcatcctcagattcctcttgttggactaaactcaaccaggaccgcattaagacaaacatactacaactaaattatcgcaccccgattgtaatgaaccacctcgtcgctacggtatccacactctaa

SEQ ID NO: 81359 - DNA, 420 bp, Glycine max
  Peptide Sequence Number=SeqID_173044
atgaagtataaagtatcatggcttctccaccctgcctcgcctcctcctcctcctcctacttccgacgcatcagctttgtcgtcttccgtgaagcggacacgcaaagcctcacgtctacgattcttgtctactagaccacctggtgctgagagaccagtggtacacgttgatcctgctttcggcaaggccgacggtccccacaggaagaaattaaggacatatttggggattgtggcacctgataaggtggacatcacgtacgagaactggaacaagatccctactgttcagaaggacttgatttgggaggatattcagactgtcgacgagagatggaggcagtttaaatcagacctcatgaggaaatgggcccttgcagctgatcaggacggtgtggatgacactgtttgtgagaaatag

SEQ ID NO: 81360 - DNA, 62 bp, Glycine max
  Peptide Sequence Number=SeqID_173045
cggagcttcacaaaggcatgctagatccttattgcttgactgttgactatccaagcattctg

SEQ ID NO: 81361 - DNA, 564 bp, Glycine max
  Peptide Sequence Number=SeqID_173046
atggacgtggatgccgtcattgttgccggcgggaaagcttgtaccgccattgacaactgcgggaacaaggatcccgccattggcaactgcggcactcagcctaaaccgccagtacgaacggcgggacaggagagagaggctgtaccgctgatagcaacggcgggacaggagagagagaggctgtaccgctgttcctcctggcgggacatgccaacgtggcagtcccgccactgccacctgcggaacaccttgacgtttcaggcttgcagtaatgagaagctaggaggcagtggcgggactgccacgttggcatgtcccgccaggaggaacagcggtacagcctctctctctcctgtcccgccgttgctattagcggtacagcctctctctctcctgtcccgccgttggtactggcggtttaggctgagtgccgcagttgccaatggcgggatccttgttcccgcagttgtcaatggtggtacaagctttcccgccggcaacaatggcggcatccacgtcataacagaccccgtctgtgataagtttgaaaagaaaccttctttg

SEQ ID NO: 81362 - DNA, 312 bp, Glycine max
  Peptide Sequence Number=SeqID_173047
atggctcgcatgaaaaaatctggtcaaatgatgtctaaggcagcaaatgaaactacaaataggattaattccctggaagagcaagcctcacagctaagctttgtcgcccatggacgtcaagatttactgactactgccattggcctaggagcagttgacacaaaaaatcaaggaccaggactcgcactacctcttgagcctgaggttggttcttctgctactcataatcctccccgcttggttgccctaggaagtgtttatgaagggtcaataatcatcctcaaagtccctttgggcaatgatcaagtgaag

SEQ ID NO: 81363 - DNA, 819 bp, Glycine max
  Peptide Sequence Number=SeqID_173048
atggcattgccttcttcgtcttttcacccttgggttgtagaagcaaagctttatggcgaatcaaaggtgattcaaaggatcaactgtgtgtgtgttttgatgataacaatgatgataacaaaagatgatgacaaaggtgatgacaaaaagctcaaagatcaatcaaagaacaactcaagtgatcaagatagaatcaagaacaattcaagagttcaagatagaatcaagaagaattcaagactcaagaggaaagttaagaggtacatcctttgtggtacaagtagagggtacatctacttgggtttgactgagaacaagagagggatttttacaaggttgaaaaaaatctcaaggaccgctggtcgcttggggactggatgtaggcacgggccacttgatccaacatgggtctccttggatcatttgtatacctctagtgatattgattcactatggggtgaaacttacaagccgaagcagaagacccagcacactacaaattctgtcaaagtctttctcaagagaagtttggtgattcaggaagagaatggacagtggcaccaagaggctttgcacaaggtggtgtccatggaggcagaggccgaaccaactgtcttccaaagttggtggtgtgttggccaagttgctgcgtaccaggagaggaaggccagcaaggagcttgaggaggagcttcttgtttacaagaagaaggatgtgaaggatggtgctcttcttggcaaggagtacattactatagaggaggaggctgttgatgaggagcagggtgctgcggagcaaggcgatgatgcctatgtctag

SEQ ID NO: 81364 - DNA, 153 bp, Glycine max
  Peptide Sequence Number=SeqID_173049
atgaataagagcttggaggtaggagaagaagaatggagggagaagaagagagagatcacgaaatttgtgcctcaaaagagcccactaatccaagatcaagtccaagattctccactaagtgtgcttaggtgtcatgagacatgtaaagcatga

SEQ ID NO: 81365 - DNA, 333 bp, Glycine max
  Peptide Sequence Number=SeqID_173050
atgtttggaatgatctgttatcacattggaatgcacctgagtatcgttccaagtgcgcacaagaaaaaaaaggcatctgaaaaggtgggggtatgcacacaggaagaatttgaggctagactatctcaagctaggtctgatgctgcatcaagtgttggtgaatcacaactcactcctttagaccctgttgaagaacaaagacttaggagtcgatgttgggttgtgactgtgggatcaaagcgtaaaggacgcctttatggtgctggagaccttgttcatacttacaaatgtggaaatgacatcttcatgcagcatacacaaggatcttcctaa

SEQ ID NO: 81366 - DNA, 264 bp, Glycine max
  Peptide Sequence Number=SeqID_173051
atggccgcttcgcctgagcccatcaatttcaagaagtccaagattccgtccatgtctcacttgagactctcaatgaacgaaagtagcagagaagcacttgctggagaccactctcagaacattgaccctaagataaccatggccattgcaagggaggtggcagcagtgactcgccttggcattgaggtgactacaatggattcttttatgttggtgggggtaacatcttccgtggatcctcctgagctggaagtagcggactag

SEQ ID NO: 81367 - DNA, 443 bp, Glycine max
  Peptide Sequence Number=SeqID_173052
atggctccgagaaagcttcctgcaaagagatctaggaaagacaaagcggctgaagggaccagtgccgctcctgaatatgacagccatcgctttcggagtgctgagcaccagcagcgtttcaaggccatcaaaggatggtcattccaccaggagacacgcgtccagctcagggacgatgagtataccgacttccaggaagaggtagttcgccggcggtggacatcgctggttacccccatggccaagttcgacccagacatagtcctggaattttatgccaatgcttggcctacacatgagggtgtgcgggatatgcaatcttgggtgaggggtcagtggatccctttagatgcagatgccctcagccagttcctgggataccctttagtgctggaagagggccaggagtgcgagtatggccagaggaggaatcgggtcgatgg

SEQ ID NO: 81368 - DNA, 99 bp, Glycine max
  Peptide Sequence Number=SeqID_173053
atgaatcagagcacaactgagttccatttgatgcttgcaaaggtgattgctattggtgtctttagtaatatggtgttatccaattggcaaacctcatga

SEQ ID NO: 81369 - DNA, 387 bp, Glycine max
  Peptide Sequence Number=SeqID_173054
atgcataaaggtctttggaccagacaacatctgaacaatacagagttgtcaccaagtaaacaaaaaaagaaaggaaaccacgatctaaagtggtcctctccctttgatcaccaaccaaaatcctgtgcgtcggtgacttgtttgccttgcaccaaactaaacagaaaaggaaaaggccaagaacattcaaagccaaaattcccacacaaaaaaacacgccattcccaagaaaaagtcctactgatccatgatcacgcatatttcatcagcatactccccttccccggtagtgatggaagctttcttgtgaagcttctatggaccatggagatgcagttgaaggcaaaggagaagaagagaggggaggcaccatccactagggaataa

SEQ ID NO: 81370 - DNA, 429 bp, Glycine max
  Peptide Sequence Number=SeqID_173055
atgacaattctgatgcccaatacttcgacaacatttcttagagatgaaagactcgggaattcgtatgctatgcatgaaaaatgcaattatgagaggaaaatgcaaggatcatgcatgagcgaacatgaaaacaaaagagccccacggaacttattccggctgtgctcttccctacgagccctcttggtttctcgtttcaaggctttggtggtagccacatttacatctctcagttcggtattctcctttcggatttttagagccgctgatttgaacctttctttaactgtttgggcttgctcgagttccgccctaagggcctacacctcttcgtcttcctctggtgcctcaacttcctctcttttaacggttctcaaacttggaagccaatccaaaccttgcgcgtgggcttttaaccacttgcgatag

SEQ ID NO: 81371 - DNA, 390 bp, Glycine max
  Peptide Sequence Number=SeqID_173056
atgcaaaaatgccctaggtatggggtatcacggtacaaagtgaaggatgatgacaagtgtagtagtgacgaaaactcaaagaagggccccctagtgacgtttaagcactcaacacaattcgtggccagttttgctagtaatttacaacttgcctccttggttgttgttgcaacctatccttcggcgggaaggcgacgcgtgactcgtgggtgcatcttccaagaaaagaatacgcgcggagtcgccaccaacgtttatttgaggaaaacgtcggaaaaaccggaaaagacgtgcactacgaactttaagtgtgaggttcgggagttgtatttacgcacggggaaggtattagcaccccacacgttcgtcgcaagagacggcagcctttaa

SEQ ID NO: 81372 - DNA, 195 bp, Glycine max
  Peptide Sequence Number=SeqID_173057
atggaggccatgatgagtatgagaaaaatgatggaggtcaacatggatacagtcgttgctgcaagtatcgccactgaggtgaacccgactcacccacctggcctcaatcaagtaaatcgtccagtctcggatatgtatttaggaagtgatcctaggtcgtctcccaacgagcaatggtcaaccaaacgttcataa

SEQ ID NO: 81373 - DNA, 822 bp, Glycine max
  Peptide Sequence Number=SeqID_173058
atggattctgtaggaataagatcggctaacccttatttggcgactcctggagcaacggttcatggccattatggggaaatactttctgaaggagatatattagttacatttatctatgaaaaatcgagatcgggtgatataacacaaggtcttccaaaagtagaacagagagttgatacttggaatgggcgtataacaaaaattcttggcattccttggggattcttgattggtgctgagctaacgatagcgcaaagtcgtatttctttggttaataaaattcaaaaagtttatcgatcccagggagttcacattcataatagacatatagaaattattgtgcgtcaaataacatcaaaagtcttggtttccgaagatggaatgtctaatgtttttttgcccggtgaactaattggattgttgcgagccgaacgagcagggcgttccttagaagaggcgatttgctatcgagttctattattggggataacaaaaacatctctgaatactcaaagtttcatatctgaagcaagttttcaagaaactgctagagttttatcaaaagccgctctccgggggcgcatagattggttgaaaggtctgaaagagaacgttgttttagggggaatgatacctgttggtaccggattcaaaagaataatgaaccgttcaaagcaaaggcaatataacaagatgacctcggaaacaaaaaaaaagaatttatttgagggcgaaatgagagatattttgtttcaccacagagaattctttttttttgtttcaaagaatttatgcgatacatcgcagcaatctagtatttaa

SEQ ID NO: 81374 - DNA, 138 bp, Glycine max
  Peptide Sequence Number=SeqID_173059
atggacacattagagttactggaagttgaagttggaagtggaagttattggaagttgaaagttgaaaatgaaagttggaagttggaagttggaagtggaagttactggaagttgaagttggaagtggaagttgtgtaa

SEQ ID NO: 81375 - DNA, 396 bp, Glycine max
  Peptide Sequence Number=SeqID_173060
atgcttgaagtcactcatgaaggcactgcgaataagaaaaaaaaaagaaaagaaagggaattgcactcaacggaagactgcaaagaaagttctagtgatgacgaagatgcagggaatttaagcttgatggtgaagaagtttggaaaatttctcaaaagatccaaatacaaaaaattatctaaatcttcaaagaagatagaaagcaacaacaacaccttcacatgcttcaaatgtggaaagcaaggtcacatcaaatctgaatgtcctatctaccttagaaaacaacttgctaaaaagaaaggaaagaaggatagaaaacaaaagcaagcctacatagcttgggaagacaatgcatccacatcctctgacttttgtagtgaagaagattttgcaaat

SEQ ID NO: 81376 - DNA, 249 bp, Glycine max
  Peptide Sequence Number=SeqID_173061
atgagtcaatcaaacattttttttactttacttgtcatttatggcaccctcaccaaacatggagaacgagcaatttttgatttaacagacttggagatcaactcaggagcgcagggtcatacaatgctcaatggaatgtcctggaactcccctatgataagcacatgtcacgttggggttgtatcctctgggaaacggaggttgagaaatctttgctgggcttatggataccattgcattattgagtag

SEQ ID NO: 81377 - DNA, 366 bp, Glycine max
  Peptide Sequence Number=SeqID_173062
atggtggatgagccacgctcgagaccaatcacgtgcgagccggtcagttctggacccatcgacgaccctttgcgtgcacgcacgctcccaacgagacctcagcgtcctcagtggcggactggggcccaagtcccctggaagggggcgccagagagggtgagagccccgtcgtgcccggaccctgtcgcaccacgaggcgctgtcggcgagttcgggttgtttggaatgcagcccaatcgggcgggaagcggatgggggccggcgatgtgtcccggtcggatgtggaacggtgagagccggtccgccgatcgactcgggacattgaccgacgcggattgcgatggtggcccaagcccgggctgttga

SEQ ID NO: 81378 - DNA, 450 bp, Glycine max
  Peptide Sequence Number=SeqID_173063
atggggcgggacgtcgcagtcgggagcgaccttgaatggcaatcccaaaggaagaaccactttaaaaatgggttttcctttgccgacggttatttacctcgccgaaaatttatctgcattcgttatttgctctcccttgatgagattctgctgtccctttcttcgggggggaaggatgaggattctcttcacagactgtcgcaacatgcccttttgcggctgagcgaggcgaggctcacgagtgcgctttccaaaggaggaaagatgcgcggagtcaccaccaacgtttatttgtggaaaatgtcggaaaaaaccgaaggaaaccgatcgaaaagaaaattccaagttcgggagttgtatttacgcttgaggaaggttgacaaaagcggggctcttgctcctacgtaccctccatcgaagaggaaatcagacctacgtagttctttttaa

SEQ ID NO: 81379 - DNA, 279 bp, Glycine max
  Peptide Sequence Number=SeqID_173064
atgcatatgacacagatgcaatttatgagtacgggagcccgggaaattgtctcctttgtggaagcaaagcttcatgatgaatcaacaatgattcaaagctcaaaagatcaaagagcaactcaagtaaatcaagaacaagtcaagagttcaagaatcaagaagaattcaagactcaagaagaaagtctacaatcaagattcaagattcaagatctcaagaatcaagatcaagattcaagactcaagattcaagaatgaagaaaagactcaatcaagataa

SEQ ID NO: 81380 - DNA, 405 bp, Glycine max
  Peptide Sequence Number=SeqID_173065
atgccgtacgaatttcagtttttaaaaccaaaggctcaggtggaatctaagaaaaggaaggctccttctacaccttcccaagttagatttgaccaatctaggttcacatctcaagaagcttgggagaggtataccgatattgtggtgcctaggaaactactaacagagaggaatgtggtagtttactacactaagtttgatgagttcaaggaggaactcgagataagacactgggatgaggagttgactgattttgctgatggcagcatagatattgccattgtgaaggaattttacgtgaacctctatgaccctgaggataaatcacctaagcaggtgagggtgagaggtcatttggtgaaatttgatgaagacactctgaatacctttctgaagacccaatga

SEQ ID NO: 81381 - DNA, 285 bp, Glycine max
  Peptide Sequence Number=SeqID_173066
atgattatgaagggtcaagacatttatagtattcaagaggagactacttcttccccttcctttagtggaagtgaagatgaagcaagggatgaagagtctactgaggaagtctatccctatgaagaaagtgacatcctaatgattagaaggctccttggaggccaatcttggacatataaggatgaagttatctatgatatagttcccatggaggtagggcatattctcttaggaatgccatggcaatttgataggaaaataatattcaatggcctaactaattag

SEQ ID NO: 81382 - DNA, 438 bp, Glycine max
  Peptide Sequence Number=SeqID_173067
atgggattgtcaacttcaccaccctttgcatgcaacgggcttagtgaagatgatgattttgtagttgaagttcacaaacaattactactggagagaggtttgattcactcaaagaagagaagtaggcttgagcaccaaaagcttcaagacttggtttatgttaagtataaccaagctcttctagatcgctttgagtgtcatgatgatattgatcctattgctttaaatgatattgataatagcaatgagtggttattgggagaattggaaggagaagaagctggtaatgatttggtttttgatgatgatgatgatttgaattggttagatgttgctgaggcaactgggactggtgaacctttacaaaacacaaggagtcaaacacagataaacaaggcagcagctgcacctgcacctacaaatgaaaaaggaaaataa

SEQ ID NO: 81383 - DNA, 330 bp, Glycine max
  Peptide Sequence Number=SeqID_173068
atgggggagacacatgaagtaccccaagaccacactctagacgactctgagccttgcctcggatatgctactgaggggcaagcatttggtggtgtacccttgccaaacactttggggggccctcagtatcgcccacaaccacaacccttacattttgcggtgggaagagtccctcctgctatggtggaaagggagaaattggatcatatagaggaaaggctaagggtccttgaaggaggcaaaaattatgcctttgctgacatggcagagttgtgcctagtgcctgacgtggtcattcctccgaagttcaaggtgtcgaacatcgattag

SEQ ID NO: 81384 - DNA, 204 bp, Glycine max
  Peptide Sequence Number=SeqID_173069
atgtatggaagcaatgtcttccaaggttattttgatgatgccaaagaatcaagagttaagcaaagtttcaagcaaagattcaagaatcaagtttcaagtttcaagattcaggattcaagaatcaagtttcaagaatcaagaatcaagaagaatcaagatcaagattcaagaatcaagagaagactcaatcaagataagtattaa

SEQ ID NO: 81385 - DNA, 213 bp, Glycine max
  Peptide Sequence Number=SeqID_173070
atgagtgttaagccttccgaagcgatcaacaatggtcctctgatgcaatcctaccccgcaagggcattgggtagaagactccaagtagattgggctagagatccaagggaaggccctagggttctcatgagccttaggcttctcaaggaagttttctcaaagaagcttctcaaggaagttttctcaagaaagcttctcaaggaagctacctag

SEQ ID NO: 81386 - DNA, 165 bp, Glycine max
  Peptide Sequence Number=SeqID_173071
atggagaaggagaaagatgtgaactatgtagctccatgtggagcttgtaggccttggatcttcttcatcaatggattcctttgcttcttgagcccactaatccaagatcaagtcaaagattctccactaagtgtgcttaggtgtcatgaggcatgtaaagcatga

SEQ ID NO: 81387 - DNA, 267 bp, Glycine max
  Peptide Sequence Number=SeqID_173072
atgcagcaacctggagcaattgagcagcctaaagcttatgctgcaaacatttacaatagacctcctcaacctcagcagctaaatcaatcacaacagaaaaattatgacctctccagcaacaaatacaatctcgaatggaggaatcaccctaatctcagatggtctagccctcaacaacaacaacaacaggagcctgctccttccttccaaaatgttgatggtccaagtagaccatacgttcctcctccaatacaacagcagcaatag

SEQ ID NO: 81388 - DNA, 642 bp, Glycine max
  misc_feature (5)..(5): n is a, c, g, or t
  Peptide Sequence Number=SeqID_173073
atgtncgtggtctttaatccagatttccccctctacataaaacatgaagacctatctgaaatcgcacacggtggtcagtgtctcagcatatcagtgttacaattgtggattctgcatctcactgaaacatgtatgcaagtggggaattctgatatctatggattccttgagccacagtccattcagaggtctgaggaatcgcagtttgagtctgaaagttacataaagagttggatgcagagttcacaacgcaatgtctatcttggagcctacctaaatgggtttcattgtagcggacactggcagatggtggtcatcctgcccaaggaacacctagttgtttggttttgtttattgcataacaggccagacaactaccataaggggattattagtagtgctatcaaaggtcttgatgatgctccacaacctaaatcaaatgcttctgctaggtggattgtcgtcaagtgtaatagacaaaaaggaagtactgagtgcgactactatgtgatgcactggatgcccaccatcattttaggaacttttaggaataattgggaagcgtattttaacgatcctagaccattggagctagagagattaaaggcattgcggatccagtgggcacagttttatctctga

SEQ ID NO: 81389 - DNA, 346 bp, Glycine max
  Peptide Sequence Number=SeqID_173074
tcacttctcttcttcatgctcacgactcatcttcactctcgacccttctcttcatcttcacaatcgcgctcttcccttctcttcatcttcacgcaaccgcaccgtaagtcgttgtgccacccaccacaagctcattgctccactagaccaggtctacgacttgccagctgtcgctgcacctgggtcccattttcgccattggatgggtttgaacccggcatacgaagtggaggtgaagcgtgtgtcgcagatattagtggcgttcgttaacgacattgaggaagtgttcgatgcgatggtgatgccggctcaaagcatacaaaacttgattccagaaaagggctag

SEQ ID NO: 81390 - DNA, 216 bp, Glycine max
  Peptide Sequence Number=SeqID_173075
atgggcaaggaagggttgacggaagagaggtatcatcataggctattctctttgactgtggctaaagatgagaaggtggctgatattagagtatggggggaggaagggggaattggagatgttttcggagtcaaagttggcttccgacgaagagaatttggtgaaatgattggtgttaagtattcaagaccagacatgtggaagatgcaacgttga

SEQ ID NO: 81391 - DNA, 636 bp, Glycine max
  Peptide Sequence Number=SeqID_173076
atggagacagagccaaaagggctagaagcttccctagaacatttgattgaccttcaccaccacaaatctcttgtccttgcccaccacacagacaaagccaagaaggacgcaataaggaaagccgagcacgtttctgatttgttggttgaagcggtgaatggtggggtccaagattccttcatcaaccagaagcgaattgagctcgaaattcgaactctggctaccaccatcacgaggttcatgaagcaaactgatcaatggctcgctgccactcatgccctcaacactgctctcaaggttctgggtaatttgtatggattagaagggacatgtaagaaagcaacaaccttggttacgattgttggatggcaaatgggcataactccatacactgatgaacccttaacctggggtggtgtgtttggtggcacatgctgtctaccctgcttgagggtaatagaacagagaattgagaggaaactcatatttgattctggtagaaatgattttcataattcaattctgttacattattgctgtgataataatgccatgactaacactaacaataacaaggctaacacatactctattagagtgcatactgcatacactagggtagggctatctaagtga

SEQ ID NO: 81392 - DNA, 402 bp, Glycine max
  Peptide Sequence Number=SeqID_173077
atgactctcgaggacttcctcgctaaggccaatgtcgtcaatgacgccagccataaccatgaccataaccacgacctcgactatgacaatgattccaagggagtcctcaactttgattttgagggcaacctcaatgccaccccatcctcatccttcaccaccacccatttcgggcccctcgtctcgcacaactcctctgtagtcacctatgtcgtgtctaacagaggccctgtcacccctgccttgtctgtagaggaccccgtgggcagtgacaacgttctcgagcagcgtagcttccggctctgtggagaataccaagaacatgatggaagtggagagtatactcttgaggaagagaaagcaattacggggttattggatggaagtgaagagtatactctt

SEQ ID NO: 81393 - DNA, 1147 bp, Glycine max
  Peptide Sequence Number=SeqID_173078
atgggtaacaacaggttcaagttatcagatatgataccaaatgcttggttttacaagctgaaagacatgagcaaatcaaggaagagaaatggttctcatgctatgaagagtaaagtgtcttcaccaccaacaacaacaacatcacaaaggtcgctgccaagatattcacactatttctccactgagcctattagagctggtaagctatacaacactcccattcacaccaaagacttggacatgccattcactgattcacctagaaggtcttccaagagaagggctaggagaaaaaccatctacaagccttctcccaccgttgtttcgtcctctttcattccctcttccggctatgactccgcgaatcattggatcaagccatgccaggttcagtcaccagattatgatgtgtcttcagctgaaagctcttctgagtctgatcttcatgagtatgcttattcagagtctgaatgtgacagcttttctgttcctgatttgcttaatggaatggacactaattgcagctgcagagttagctcttccactaatgacatcatcattgacatgaacagtgagtccttccttgggaatccggaaaagcaagatgggtttgatgcaatttcacagcttggtcttgctccaatattgacaaggccagtgaagtttgatgataaggtcatcgaagccgctgaggtgagaagttcaactgatttggatgaaatgcaggatgatcagtctttctcaattgagattaacaaagaggaaagcattagaactcaaaggaggaggaaaagcaatcatagaaagccctttgctaattctgcaggcataaggcttagagtcaattctccaaaacttgcaagcagaaaagttcaagcatgtgcaagaaggagtgtgtcatccactgcaagcaaaggttcaaggagtacaggctttccagatggatttgctgttgttaagtcctcatttgatccacaaagtgacttcagggagtcaatggtggagatgattgtggagaacaatatccgcgcatcgaaggatttggaggacttacttgcttgctacctttccctcaattcaagtgaataccatgatctcattgttaaggcatttgagcaaatttggttgacttggctcaactacgact

SEQ ID NO: 81394 - DNA, 1380 bp, Glycine max
  Peptide Sequence Number=SeqID_173079
atggtgccaaccagcactgaactccaaccgagagcaccttgcaaccttgtactgttcctctctgctcctccaactacacttccactttctgcaaggatcactgttggattcgatctgtatgagtttaagtctattggggtgttctcttccgaaatccccaatctccctcacttgcaaagatccatttgcaatgagacccttctgagtgaaaacagcagtgaggagaacagatgctatgaccaaaaagtgcatccccaccccattgaagttcctgccaaagagaatgcttgtgcttgtttggaggtcatgaggaagatgtttgatgctgtttcggtgttgaaattggcataccttcagcttcagcaggctcatatcccttatgaccctcagaagattgttgcagctgatgaccttgttgttgctgagcttgagaagctttgcaagttcaagcgcgaatatgcgcagaaacactgcaagaaagtgaggttcaatgccgcacgttctgctcctttgatggctgaaattgtggccaaagaggcacttttggggaagcttaagtctcagaacagtgccaaagattctgagattcttcggttgtggcgggagctgcaagatttggagatggggaataaaaatctgagcgagaagatcaagcagataagttcagagaaaaggagagcaggtgttttgagtgttactaagtttcaggatgtcttcaatgctgcttcaaagtccattcatgattttgcaaaaccgctgattagcttgatgaaagcttcgggctgggaccttgatagggcagcaagttccattgagaatggtgctgtttattccaaaaggtgtgacaagaagtatgcttttgaggcctacattgcgcgcagaatgtttcatgggattgtgttaacctcttatgatgtgagtgatattatgaagtttggtgacccttttgatgcactgatggaaaatccacattcagattttgccaaattttgtcaagcaaagtaccttcttgttgtgcatccgaaaatggaagagtcattctttggcaatttggatcaccgaacattcataatgagtggcaagcaccctagaaccgagttctatcagttgtttgctaaaatggcaaaatgggtttgggttttacttggatatgctgtgtcaatagatcccgaagcaaccctgttttcggtgagtagaggaagtgcgttctccagcttgttcatggaatctgttgaggaagaaaaggagagtgcaattctttcagatgaagatgaagaaagagcgacacacaaagttcagtttatgatcatgcccgggtttcaaattggaaatatggtggtgaagtctcgagtttatatctcgaaacattcttcaagctaa

SEQ ID NO: 81395 - DNA, 518 bp, Glycine max
  Peptide Sequence Number=SeqID_173080
gcttttcgtcttacagatagcaaaaagaatgtttatacggataaccactcgagtattttcgcccgtcagcgtgactcaaatgtcagtatgacagatcttgtgagcgcggaagatgacacagcaaaaaagaatgtttatacggataaccactcgggtatttccgcccgtcagcgtgactcaaatgtcagtatgacagatcttgtgagcgcggaagatgacacagcaaaaaagaatgtttatacggataaccactcgggtatttccgcccgtcagcgtgactcaaatgtcagtatgacagatcttgtgagcgcggaagatgacggcgcagaagacgacgttagtctctgcgtgctatcaagcttttcatcttacagacagcaaaaaagaatgtttatacggataaccactcgagtacttccctcccgtcagcgtgactcaaatgtcagtatgacagatcttgtgaggcggaagcatgtctccgcgggctaccagctcttgggtcatggtaacaaaaagcg

SEQ ID NO: 81396 - DNA, 192 bp, Glycine max
  Peptide Sequence Number=SeqID_173081
atggcacttatcagtgacatgcccccaagtacaagtatttcccctcatgagaaactagaagtacttactaacaaagtttatactatttccatgcaatgtgaatgtttttcaaaggatttactctctggtaatcgattaccagaggatgtaatcgattaccagtggccaaatacgttttacaacagctactaa

SEQ ID NO: 81397 - DNA, 291 bp, Glycine max
  Peptide Sequence Number=SeqID_173082
gcttagaagtcaagattacctcagagaagctacaaaaggagggattgagggagttttctccaccgaatccttgaggaggattttgaggattccagtccgattacaaggttcttctcggtctggacgtttggcggcaagcaacgatggctcgtggtggccaccgatggtcgtgggtggtggaaaagaaggcgttagggtttgggtgggcgtttggagaagaggagatgcaattccctcttgggttgaaattgcgcttagcatgccccttctcgctcagtgcaattctctcag

SEQ ID NO: 81398 - DNA, 309 bp, Glycine max
  Peptide Sequence Number=SeqID_173083
atgttgcggaaccttacgaattacgtaaccatcccttttttaccttccggaatgttacggaactttacggattgcgcactaacacttccttttaatctccggcatgtcacgaaacttcacggattgtgctacgatgcttttcttttggctttcggcatgtctcgaaacttcacaaattgcttaacgatgggtgccaaatacctcgaagtggtcaaacgagggtcgcatcccaacaacggatggtccccggatgaaattaggggctacatctctaatgaaacaagtgaggtttacatgcatgttacataa

SEQ ID NO: 81399 - DNA, 152 bp, Glycine max
  Peptide Sequence Number=SeqID_173084
cgagctgggcgcgagaagagacaaatgactcgctgggcgagcttacggcgtgctgggtgagcacatctctgactgatcctcttctagggtttcctatcatgctaagcaagatgcatgcctcgcttagcggatgtcattcgctaagcgcataa

SEQ ID NO: 81400 - DNA, 294 bp, Glycine max
  Peptide Sequence Number=SeqID_173085
atgttacaatgcgaagggttttcctctaagctcagatatgattttgaaattcccaacggtgagaatgttcgaaattggattgtgaacatggtacaaacatttcacgacgatccaacggtgaacgagtccaagatcgttgttttttctgagacaggtttggtggactgcgggaaaaagaaaggatctccgcaaaagtattggctcatgaagcataggttcttgaggatcttgagtttgttcttcatgaacaaccaaattatcttgagtgggagattcaataacaatatcttgtag

SEQ ID NO: 81401 - DNA, 474 bp, Glycine max
  Peptide Sequence Number=SeqID_173086
atggtgacgtattatggatgcaagttaagcatgtttcagaacatgtttggaatggggaagaagaccggaaattacacatcagaggagttgtccctacgtattaaggggaagaagaaatcccagaggaaattattcatttccttcgacaatctggaattgttgggagtcaaaccacaagaaggtaaaattaaaggtagtgtggttaaattaagttggttggctcaccattttgcacaaataaataaccatgatgacgaagaacaagtacgaaggtttacccgtgcatggatactaagattcattggaggtgtcttattcgttaacaaaagcagtaacaaagtttccctaaggtaccttcaatttttacgtgactttagagactgtaacacatatgcatgggacctgccgtacttgcttttttatacagagagatgtgcagtgccaccaattataaaactaaatcaatcggaatga

SEQ ID NO: 81402 - DNA, 363 bp, Glycine max
  Peptide Sequence Number=SeqID_173087
atgtcaggatttatacgcaattctcctcaaatttcagccagcccgcatcaattagaccttgcaccttacgattcagagccctacaatgctccatggaacgccctggggcttctccgtgaccagcacacgttgcgttcgagttgtattctcggagaaatggaggttgatgaaccttggctggggttatggctaccattgaattatcaagtagatatgggatcaagtttagcatatgacaacggaatttggggtgaaccctacaggctttctcgctgcaaaattcatttcttgttggtgttcttttggtttgtgctaaaggtggtcttcgtcattggaagtgcagtagacaggctttgtggttga

SEQ ID NO: 81403 - DNA, 315 bp, Glycine max
  Peptide Sequence Number=SeqID_173088
atgaatagatgtggtataagtacaaacaaggtccctgtggattcaacactcggacttcccagcactttactacttgtgacaatttggtacccttgccaacgagtcaacaagactgcatctggagacgttgttcccatcaatttaaaaattgaagctacttgtcgacgtaacaacactgcaagaagaagaagggaacaagacacagaagaaagcagttacacctcacctcctctttctccagatcacgctgaaatggtcggggaaccggcacgaagagtcaccctagaggacttctccaataccgccactcctcag

SEQ ID NO: 81404 - DNA, 147 bp, Glycine max
  Peptide Sequence Number=SeqID_173089
gtgctccagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 81405 - DNA, 534 bp, Glycine max
  Peptide Sequence Number=SeqID_173090
atggcttctagaaagagaaagagcattggtatgaggcccacatctcagtatgacacaaggagattctcttcattagatgcttggaccagatatactgataatgttctgggaagaaaaattttacctgagaggaaagtagagctgtatcacactaagctagatgactttaaggccgagctggagaggcgtaatttccataaacacctcaccaatttagccgatggaagcatagacctagctttggtgaaagagttctatgcacatttatatacttctgaggaccgtccaccaaagcaatccagagtcagaggtcatttggtgaagattgatgctgacagtctcaacgcattcctggagacacctatggtattagctgagggggagactctacccacatactccagatactgcaggttgcctacagacttcagagagatagaggctgctttatgcatacctggccgagggttcatcctgaactttgagggccatcctaggaggattctcaggaaggatttgactgcactagctcaa

SEQ ID NO: 81406 - DNA, 171 bp, Glycine max
  Peptide Sequence Number=SeqID_173091
atggaaaatcttcacgaaatcgcccacggaaaagggaaaaaagggaggtggttgccgcccagctcgcccaggcgagctgggttgcttccaccagatggcaccaccttttgttggaacatcctggaaggcccaagtgggtctgattactatttgcacaccccaatttactaa

SEQ ID NO: 81407 - DNA, 408 bp, Glycine max
  Peptide Sequence Number=SeqID_173092
atgactgagagggaaatgatcacgattatggtagatacgctgcctatgttctgctacgagaagctgataggatatatgtcggccaactttgcagacctcgtcttcgccagagaaagaatcgagtccggactgaggaaaggcaagtttgaatacgcctccaatgctggccccaacagcaatagaagagccccagtggtgggcacacagaaaaaggaaggggatacccacgcggtcaccaccgccccaacgtggatgaaaacgccccaaaatgctcaaaactcataccaacacaaccacttgaacttttcgatccgagctggaagttccctcccaactcaagtagaagggcctgccacaacagaaaaaatgcatgcgcaataccatagtggagccccggccagccaataa

SEQ ID NO: 81408 - DNA, 231 bp, Glycine max
  Peptide Sequence Number=SeqID_173093
atgaatgcttatggtgacaagcaatcagacttggggatcattgacaaggtactaagaaccttgacaccaacattcgatcatatagtggtggaaattgagcaaggaatactggaagctcaagagatgaggctcaatgaaagaaactcacaaagattagctgagcaagctatgcaagcccaaacaaccaaagggaacaactatgatggtgtcaagaataagaagggaaagtga

SEQ ID NO: 81409 - DNA, 237 bp, Glycine max
  Peptide Sequence Number=SeqID_173094
atgatgacaacaaaagatgatgacaaaggtgatgaaaaaaaagctcaaagatcaaagaacaactcaagtgaatcaaagaacatctcaagtgaatcaagaacaagtcaagagttcaagaatcaagaagaattcaagaatcaagaagaaagcctagaatcaagaatcaagattcaagatctcaataatcaagatcaagattcaagactcaagaatgaagaaaagactcaatcaagataa

SEQ ID NO: 81410 - DNA, 911 bp, Glycine max
  Peptide Sequence Number=SeqID_173095
cctttcgagggctacgtaccctcgccatcagagggctacacgccctcaccctcagaggactacacgtcctcgcctttagagggttacacgccctcacttgcagaggactacacgtccttgcctttagaggactacatgtccttgacttgagaggactacacgtcctcaccttcagagggctacacgccctcgccttcagagggctacatgccctcaccttcagaggactacacatcctcacctttagagggctacacgccctcgccttcagaggacttcacatcctcaccttcagagggctacgtaccctcacattcaaaggcctacacgccctcgccatcagaggactacacgtcctcgccttcagaggactacacgtcctcgccatcagagggctgcacgccctcgccttcagaggactagacgtccttgccttcagaggacttcacgtcctcaccttcagagggctacacgccctcgcttttagaggactacacgtcctctccttcaaagggctacacgccctcaccttgggtactcgtaccctcgccatcagaggactacacgccctcaccttcagagggctgcacgtcctcaccttggaggactacacgtcctcactttcagagggtggcacactcgccttcaaagggctacacgccctcaccttcagaggactacacgtcctcgccttcaaagggctgcatgccctcaccttcagaggaatatgtgtcctcaccttcagagggctgcatgccctcgccttcagaggactacacgtcctcgccatcagagagatgcacgccctcgcctttaaagggcgacatgtcctcgacttcagagggctgcatgcctacgcctttagagggctacgcgtcccaattttagtaggctctacatccgcaccttaa

SEQ ID NO: 81411 - DNA, 285 bp, Glycine max
  Peptide Sequence Number=SeqID_173096
atgaagaacagtggaaaattttcacgaaatcgcccacggaaacatctcagaagcgttacggaagcgcctcggcttggattttcttcacggaaacaatttttctcactaattttaagtgaatctcagataccaggagggggaaaagaaggaggtggttgccgcccagctcgcctaggcgagctcagctcgccagggttgcttccaccagaaggcaccgccttctgttggaacatcctggaaggcccaagtgggcctgattgctatttgcacacccctgtttactaa

SEQ ID NO: 81412 - DNA, 201 bp, Glycine max
  Peptide Sequence Number=SeqID_173097
atgatgcatcttaagtacagagaatggagaaggaagagagagaggagacgccacttcaaggagaagatgagtctagaagaagctcaccactataggaggccatggataagagcttggaggaagaaagagatgaatgaagggagagggagagaagagcatgaaattttgtgctctaagagagctctgaaatatgaagtttaa

SEQ ID NO: 81413 - DNA, 453 bp, Glycine max
  Peptide Sequence Number=SeqID_173098
atgcagaggaactcgccttcctcctctagcgatacttatttcttgccacaaccatcctttttctccgaaaaacctttcattggaatattctcgtttggagtggggatcactttgtcatttttttcttccgctatctttaccttccctttaacgtttgcaggttgtgtcggcaggcttagacctacgcggcctacccgactcaacggcattaactgctccccctccatgattggcaagcgggttcgttttcacgttgggccggtcctcttaaaacgtcagccatccggcgtctatcaaatgttggaccttgtatttaagggccaggcagtgttcggtggagtggcccggggtttttcccatggtatgcgcaggttgcgtcagggttataccactttgggaaaggaggctggtagatcttcccgggagatatcacagccatctggttggcgatga

SEQ ID NO: 81414 - DNA, 225 bp, Glycine max
  Peptide Sequence Number=SeqID_173099
atgggaagaggaggaagaggagaagggaataaatttgaaggtacccagggcatagagctcatccctgtatattctgtaagggttagggtcgatgctatgcatggtgaatgtgtgctaagcacgatgaatttcaagcacatgtcaggtgtgctaagcacaaaggtaacccatgctaagcatgtgaagggcatactaagcatgaagacccatggagtgctagtttag

SEQ ID NO: 81415 - DNA, 1041 bp, Glycine max
  Peptide Sequence Number=SeqID_173100
atggcggttcagagctccacttccagcgaatcgcaagcttcggagaacgttatgcatcgccatttctttttatggagagagtttctgtggggagctgttgcgggtgcatttggggaaggaatgatgcatccagtggatactgttaaaactcgattacaaagtcaagctattctaaatggaattcaggttgatggattaaaaggcttttacaggggtgtaacacctggtattattggatctcttgctactggcgcaacatattttggtgtcatagagtccacaaaaaagtggattgaggattcacatcctagccttaggggccactgggcacatttcattgctggagctgttggtgatactctaggttcttttgtgtatgttccatgtgaagtgatgaagcaacgcatgcagattcaaggcacaattgcatcttggagttccgttgtagtgaatgatggcatcgcaatcaagcctggcacacaaatatatggttattatacagggatgttacatgcaggctgttcaatatggaaagcacagggcttaaagggtttatatgcaggatatttgtctacattggcaagggatgttccatttgctggcctaatggttgtgttctatgaagctttgaaagatgctaaagattatgtagagcaaagatggatatctagcccaaattggcatgttaataattcagttgagggcctggttttaggaggattagctggtggtctcagtgcatatctcaccactcctttggatgttgttaaaactagactgcaagtgcagggttcaactttgaggtataatggctggttagatgcaattcacaatatatgggctacagaaggcatgaaggggatgtttagaggtagcgtccccaggattacatggtacattccagcttcagcgcttacattcatggctgtggaatttctcagagatcatttttatgaaagagtgcccaatgataatttggaagatgttggtagattatcagtagaccataaatctgcaggaggtttaaaagtttctcattaa

SEQ ID NO: 81416 - DNA, 1065 bp, Glycine max
  Peptide Sequence Number=SeqID_173101
atggatcttgtaggaccgccaaaggagtgtataggagaaaatcagctacccttgagtggagtgatacctggtaaaaaagtccaaaccggtgatgctcagaaagaaaatcctacaaaagggccttttgaagctttatcagcaggaaaatcttcccatattgttggttcaggaccgccaaaggagtgtataggagaaaatcagctacccttggatggagtgatacctggtaaaaaagttcaaacccatgatgctcagaaagaaaatcctacaaaaggggcaccatttgaagctttatcagcaggaaaatcttcccctattgtcgattcaggtgatatccgccgtgctgatgctgaatgtaacaaatctaatattgaaaaaagtgatcttcggagtgttcaggaaaacttaaaccttcattgtaaatttttaccctcttcatttcctgcttggaggggtcaattccaaattcttcagactgctgtatctagtgaattttatgatgggcttgaggcccaaccaccatgcattgttaacaagaaagcatacaaattttcaacagaaatgccatcagtccttcaactggagtcacttcctgtgttgaatgccttgactgacatattccaggataattctcctaggcttcaggatattgcattgtatttctttccatcagaacttactgagaggtccagaaagaacctggatagcatattgaagtttttgaatgctgagaaatcaatgctgagaagttatattaatggagtagagttgctggtatttacctcaaatcaacttgacatggactcaaagggtgctatagctgcagtaaatgctggacatttcctgtggggaatgtttcgccaaaagaaaattgataaagctattgaaagagtgcctgacatggagccagttgatatggacatcgatatgattggaggaaaggatgtggtggagagagctgatgtcgttcgaaattgtaaacctaagagtgcctctttgatggaggattataacaaactggacgttcctccaggctttgaagaatttaccaaaatgtctaaatga

SEQ ID NO: 81417 - DNA, 633 bp, Glycine max
  Peptide Sequence Number=SeqID_173102
atggcgtgctcttgcatatgtgcctcatacaaagtgacacatactggagacatggtggtgcggattaatagaactcaccaagggtggaccttgggttttgcgagccctttggagtaccaactagggaattatctgacttgggttttggtcgccatgcttttgcatacatgccacttgtcgtgggtggcacaaactggagacatagtggccgacaagaccaatgggaagcaacaacactgtgtcaaagatgggccaaaagtggagccagttccaattgttgcttcttcctctattgagagtcttcctttctgcgaaggaatggactacttctctttgggcaaggacatggagattgctaatttctgggttgacgaatttatgaaggtcaatgtcgagtcccaaaaggctcaaattgagtgtgccaaatttgaatgggctttgattgaagccaccaaggccaacaacagcctgctgcaatcaattgaaaattccaagaagtctcttgaagatacagagacaaagttaaagaaggccgagatccaggaagaggccttaaagactagtgatctcgacgaggctgagtctgagatcataaagactcaagaagctaatttcgagaaggctttcccttag

SEQ ID NO: 81418 - DNA, 621 bp, Glycine max
  Peptide Sequence Number=SeqID_173103
atggattctgccaaagtctttctccagagaagtttggcgattctggaggagaatggacagtggcatcaagaggctttgcacaaggtggagaaaaaggaccttgacggcaaggtggagagcattgcggttgagagggatgggccttcaaaggtagttattgatttagaagctcaacttaaggagtcggagtacagtaaggagcttgaggaggagttgctcgtttacaagaaggaggccgtggagcagcatgaaaaaggattcaacaaggatgttaagcaggccaggttcttcgccaaggaccttgacatgggtctctttgaccctttcaaggatgtgaaggatggtgtcttgcttgacgaggaagacattgctgcagaggaggaggctgttgatgaggcagggtgctgcagagcaaggcggccttgtaactatgacaattatttttatttttcttcaatgcacatgctttcctttgatgacgaacttcgcactgtttatgcatgtcttgtgtgtatgtcatgctgtcatgatgatgagtgtggaatctttgacggtgtaggaagagtacaaaccaagggtggaccttgggtttttgcaccaagggcggaccttgggttttaa

SEQ ID NO: 81419 - DNA, 110 bp, Glycine max
  Peptide Sequence Number=SeqID_173104
atggtagtgagaaatgcaactatagagaaacctagagaagaatgggatgatgatgaaagaagaaaggttcaatacaaggccaaaaatataatcacttctgcattaggcat

SEQ ID NO: 81420 - DNA, 960 bp, Glycine max
  Peptide Sequence Number=SeqID_173105
atgtgttgtgggaggtctggcggaagatggttcttccgcggatggcagcggaagaaggttcttccgcgtgattccgaggaagaaccatcttctacgagaaggaaatggaacatctttgacacacgcggaagaaggttcttctgtgggaacccacggaagaagcttcttccgcgggtgtctaggacgttacatttccttctcgcggaagatggttcttccgctgccatccgcggaagaagcttcttccatgggagtgctcggatgaaggttcttccgcctgtttctgcggaagaaggttcttctgcgataaggatttctttcctgcggaagaaccttcttccgcgaaacttggaattgcttcaagattcactggagaaaccctacaagtacgcaacctcattagtgcctcgagtcaaactctacctcatcaaagatgaaaaattggaaaagacaagatggggtcagattgtcgtgtacgttcgacctgagcgggttattcgacaatttggctacattccgaccgtccctccgccgtcggttagtgattctttgacggatgatgacatagacgaccagtggctccatttttcagaccatttggtaggtgcgggggagatctgtgtagttcttgggcaggtggcgccagactacatggactggttctttcggatatcccacccgtttgtgacgcctaccgaagagactgctgagccgagacatcatcctctccctcatgttgaggagttcgtcaagccacctatccctgaggtttcagtcgcgtctgatctccctacgcattcagtggttgactgccaaggatgtgcagcgattgctgaggaattggagcgggtcatcaacctcaagatggtcactgaaggcactgacttatatgatatcatggctcgttgtctgaggatagctagaggtgatgccgcagataagagtcttaggccgcgatag

SEQ ID NO: 81421 - DNA, 274 bp, Glycine max
  Peptide Sequence Number=SeqID_173106
atggatgaagatcaatggacatattatagtacgatgtccgaagaagttgatatggattttaaagatgaacaagattgtggtgtgaatgaaggacatgttgattattcagacgcttttaatacttctcaggtgtttgcaactcgagaggacgttttgcagtgggctcgaacggttgcccatgaaaacggttttgttacagtaattatgaggtctaatacatacactggtagtagaggaagaacttcatttgtgttaattgggtgtgaaaggagcg

SEQ ID NO: 81422 - DNA, 117 bp, Glycine max
  Peptide Sequence Number=SeqID_173107
atgggggtgcgctcaagaaacttcatccagaacattctagaaggaatcatcctcaagaagcctctgggcggcaaccacctccattttgttaacaaatggcatccggggcttccgtaa

SEQ ID NO: 81423 - DNA, 255 bp, Glycine max
  Peptide Sequence Number=SeqID_173108
atgaaatctgatgatgagtggataacaaaagagggagatgatatttttgatgaagacaatgtccaagttgagcaacctcttggtgaaaatggtagtggaaataatattgacttggttggaggaagtttaagtgatccaactttggatgcatttgatattgacaatttgattttgaatgacaatgttaaagatcacttctcaatcgagaaagagcttgaagatgatggagatgaagatgatgatgatgtttattga

SEQ ID NO: 81424 - DNA, 180 bp, Glycine max
  Peptide Sequence Number=SeqID_173109
atgatgagtattgaagtagctgatggtggatccatgtggggtccttgtgtcgaaagtctatttggcaatgtggaagtcaagcaacttgttccaatggtggttgttaatggtggtgcaagtcgagaccatttaatactcatggaatacattgtggggattataccaaagagtgaaagataa

SEQ ID NO: 81425 - DNA, 426 bp, Glycine max
  Peptide Sequence Number=SeqID_173110
atgcaggaaggggggcaaatttctgctattccatgtttgtctgagtgtggagacgttgttcttcacgaagtagtcccacatctttgctgccgtggtgaagggtctgagattgaggacgatattagactcaacaaagcctatgatccaagtcatggcttgtgcatctttgacctctcatttggcatgtgcctccttgtgcatagttttgtcaggagtagaattagttccgtcaacatgaccccaaagctccttgcctttgataaagatctggaactggaatgcccaggtggagtaattctttccattaagatgaacaaagaggacatcatattttttagtagacatgatgctcttgtgaacagtaccgcgcaaaaggctagaactgggaacttggagactgggagtgcaacgaagaaaaaaatctag

SEQ ID NO: 81426 - DNA, 765 bp, Glycine max
  Peptide Sequence Number=SeqID_173111
atgatagattggttgcctgttggcatgtggaagaaaaagtttgtcttactcttgccaatcactactgttgagacttggattataaacaaattcttttggtctttgttaattcaagaatgttattttttggagctgatgaaagtgccaagagtggagtcaaaattcagagtattctctttcaagattcagtttaggactcagattacagagtttaagaagagtttaaacacagtgaacgctgcctgtgaagaggtccgaaactcgttcaaactgaaggagattatgaagaaaattctttatttgggtaatacattgaatcaaggaacaacaaggggatctgctgttggattcaagttagatagtcttttaaaactaaccgaaactcgtgcttcaaacagtaaaatgacactaatgcattttctttgcaaggtcctagctgacaggtttcccggactccttgattttcaccttgaccttgtaaacctggaagcagccactaagatacaattgaaatcattagcagaagaaatgcaggcaatcatcaggggattagaaaaggttaaacaggagcttgttgcatctaaaaatgatggccccgtgtctgaagtttttcgtaaggtagcccacaaagaggcaacaactaaggtgggctacgggagaccgcaagtaaaaattggagctgagttgtgttggaccactggagttaagaacttttctttagctaccagtttcaatgcaattaaaggcaatacatcagtgatttaa

SEQ ID NO: 81427 - DNA, 303 bp, Glycine max
  Peptide Sequence Number=SeqID_173112
atgttcatgagaataattgttgcagacaatattaagacaactttccctaagaccgataatgctaaagagtttatgggattggtgggagagtgctctcagacagctgataaatctattgctgggacattaatgagtacattgaccaccatgaagtttgatgaaatgaggcttaagaatcaaggaagtcactcagtccattatataagccaccaagggaatcaaggagctggaaagaaatttatgaagaagcatgataaaggcaaagggtcattaaagatcaatgacgactctttgcaaatctag

SEQ ID NO: 81428 - DNA, 372 bp, Glycine max
  Peptide Sequence Number=SeqID_173113
atggcttctacaagtggagatgctactccaccatttccaaaaaccgcaaggctcatggaggagataattaaacttggtgagcaaatgagaagaatgagttatgaagatgaagaaaggatggagagaatgagaaaggagaatgaagagagtttggaaagaatacacagaagtagtgaagctttaagtatgaggggtatgaagaagatgagggaggaaagaggaataagaggtatagagagagaagaaatcatagaagatatggaggtagacaaaagaaaggaagagattgagggagtgaaggtgagcatccctacttttaacgggacttatgatccagaagtgtatcttgagtgggagatgaaggttgagcaa

SEQ ID NO: 81429 - DNA, 504 bp, Glycine max
  Peptide Sequence Number=SeqID_173114
atgacgatgatgtcgacgttgtggtggcgggtggaagaacctcgctcaaatgtggaactttcttcttctaaaaccctaaacacaaccaatgaccatgattccacttcggaatcacatcaaatgactccggaagaggttgaacccaatagagaagacgatgtcgttctgaccgcgaaacgaaaaaggaacgacgatgtcgtcgaagactgttcgttgcatctactatggaagaccagcctctactcctactttcagagccacaacagatcgtgcaaccacgacggtgtgtgccgctatgtgcatgacaaagaaaagctctgccttcaccccaacaacacgtgggacctgaccatcgagcgcacgaagaaggcattgaagactgaggcgggcgagaagcgtgccatctcggaggaagtgatgatgacggaggcagccatcgacgatgacaataacgattgtggcacaaatcacacgcttagcaaatgcttggtggatttgccgtga

SEQ ID NO: 81430 - DNA, 243 bp, Glycine max
  Peptide Sequence Number=SeqID_173115
atgacaattttgcttggaggaatgatatcttggtgggatccaatttcaaccatgatgatgctcacaaaattcgtgttcttcctgtcataccctaatttcgtccggggacctttgcttgatgatatgcgacctttctttggtccttgtgaggaacgacaagtcatggtcacccgcgactctcgtcaaccgagaggagcgaaattagtgtcatacactgattttcgtccgaggacctttgcttga

SEQ ID NO: 81431 - DNA, 483 bp, Glycine max
  Peptide Sequence Number=SeqID_173116
atgtgtcatgagtggctatcaatagaagcttataataagacatatcatcattttattgaaccagtccaaggaccacaatattgggcccagtatacacaccttgttccaccacataaaagggtccaaagaggaagaccaaagaaaaatagaaggagatctgtagatgaggacaatgtcacaggacataagctaaagaggaaattggctgagctttacatgtggaagaaatatgttgcaccatcaacttcaaatgaggatgaccacctattatctcaagatgaacaagctttgaatgaggctgaagaagctgctgctcatgttcaacaagattcggtggagattaatttatctcagcctcatttgtcacaagatagtgacatggagttgatggtccctgcaacaattgttccaccaatagcaaggaataagctaaccataacaagagccaaacaaaggaaggttgctgagtttgaaggttgctga

SEQ ID NO: 81432 - DNA, 444 bp, Glycine max
  Peptide Sequence Number=SeqID_173117
atgacgggaaagggagttagagtttgtcaaaaggtaacaattgtcaaacttatagatttgaagaagatagataatgaggctacattgagggtggagaggtcaaaaacaaaatctgtgtcattgcctttggtttctactcaacaccaaatggatacaaacactcttggtgttgatccaaaaaagagaaagacatcatctgtagaaaatgtctttaatttgcaagttagagagacacttgatcatgaaattgctaggatgttttactcttcggggctgccttttcatttagcaagaaatcctcattataggaaggcatttgcctatgctgccaacaatcagatcagtggttaccaacctccagagagtggacctatgtttttaaaggccatcgattgttcaaatgcgatcaaagacaaggatttcattgccaaacatatgagggag

SEQ ID NO: 81433 - DNA, 114 bp, Glycine max
  Peptide Sequence Number=SeqID_173118
atgattgagggtaatcaggacggaggggatacatgcatagaggtgggaagcaacaaagagggcgcatgtgccgcaacaatggacctcattggaatgatagcggtggctgcctag

SEQ ID NO: 81434 - DNA, 1791 bp, Glycine max
  Peptide Sequence Number=SeqID_173119
atggagtctggtgatgagattaatttgaacatagaaagtgggaataatgggaagagtggtggtgatgggttcgttgataggagtaaggtgcggattttgttgtgcgataacgattccaagagttctcaagaggttttcacgcttcttttgagatgttcttatcaggttacctcggtaaagtcggcaagacaggtaattgatgcactgaatgcggaggggcaacatatagatatcatactggctgagcttgaccttccgatgaagaagggcatgaagatgttgaagtacatagcacaggataaagagtttcgccgaatccctgttataatgatgtccgcacaagatgaggtatccgttgttgttaagtgcttgagacttggagcagcagactatctactattatgggagatgcttaagattttggaagagcctcattgcataccaattatcaggctacctcatctgtgcaacagtttaggggcaatgccgaacactcttggacttgtagagaagaacatcttgaattatgattttgatctggtagtatctgacccgagtgatgccaacacaaacagcaccaccttgttctctgatgacacagatgacaagtccaagagaagcactaatcctgaggtaggaatatcagtccaacaagagcaagaggtgggtttcttttttcaactttgggcgttctttgcaaataattctacctttcagagtgtaaacattgacatacattctactattgcaattgctgctgctgttgaggaacctccagatgctcatgcatcagaatgcgggcctgatgtggatggagttaatgatcaccaaacagcacatttttcatctggtccgaagaagagtgaactaaggataggggagtcatcagccttcttcacgtatgttaaagcatcaatacttaagagcaacttggaaggggttgttaatgtagacaaaaatggtgctacacatgtgaggatggaagttatgcatcaaacatgtgctcaacaaggggtgaatgaccttcaaatacgggaaaatggagaggcatatgaaagtcaatcgcaagatgacttacccagcagcactagtatacctgattctttgtctattgagaggtcttgtactccacctgcatcaatggaagtttcacagcaaaagcactacagggaagaaaatttacatcagggtgtgatgcatccaagaaatgggactcattgttccgagcttgaagtatctggcatggcttcccaacaggtttatccatattatatttcaggggttgttaatcatgttatgatgccttcatcagcacaaatgtatcatcaaaagaatatccaggacctacagaatcatcctagctcagctatgatttcacagtacagccatcttccccaaggtggtcctcatggaacggggatgacatccttcccatattacccaatgagcatatgcttacaacctggtcagattcctaatcctcattcatggcaatcatttggaaactcaagttcatctgaagcaaaattaagtaaagttgataggagagaagcagcattgatgaagttcagacagaaaaggaaagagcgctgctttgataagaaaattaggtatgttaaccggaaacgacttgcggaaaggcggcctcgtgtgaggggtcagtttgtcagaaagttgaagggtgctaatgcggatcttaatgggcagcctgcatcgattgactatgacgaagatgacgaagaggatgaagatgaccagggagcaagagattcttctcccgaggatgcttga

SEQ ID NO: 81435 - DNA, 471 bp, Glycine max
  Peptide Sequence Number=SeqID_173120
atgaagtcagaatgcactaatgttgagggcctacttatttttcacgttgacctcgcgtttaacgcaggcttttgcgctaagtgcacatctgagcttcctcgtgggccttctcgggctaagcctgggttgcacactgagcaaaactgcacgctgagcctggatttgcccactaagcaagagtgcgcactgagctttataaatgaaaaagatcccctgaaagaagccaagttcacaaagttagatgtaaggagtgattgtcaagcaaagatcagatttaaagtggaaatggtcacaaaggataagggcaattgcattgatgatatggtcaactcaggcataagtgtaattgatgctttcaattacatgtcacaaggagtagaaggcactgagaatgttggatttacaaaaagagattgttacaatcatatgaacaagcaaaaaatgatgatgattgaagctggagatgcttaa

SEQ ID NO: 81436 - DNA, 222 bp, Glycine max
  Peptide Sequence Number=SeqID_173121
atgcccacgttacaaccttgcaacgcgcttcttcatggtcttgtcaagacccagatgttcgattccctgtgggaggtgtacgtggacatgatgtcgcgcaggttttcccccaccgtcatcacctacggcattttgatgaattgttgttgtgcccagggtgattttagcaacgcacaaaagatgttctacgcaaaatggggggtaccgagctcgaattcgtaa

SEQ ID NO: 81437 - DNA, 1767 bp, Glycine max
  Peptide Sequence Number=SeqID_173122
atgaagaggcactggcgcaactggagccacgacgacgaaggcgaaggcctcccagattcggattccgacacgcgctccagccggagattctctctcacgcgcctcatggcaatctttctcttctctctcttcctcttctccctcatcttccttctcccacatcctcccatccaatcagcttcaacagcaaagactctgcaccaattcaagcaaactcaacaagttttgtttcgtcgaatgtatgcattgcataagtcaatgaatgttggagatcccacattcaccaaggatgatatgatcaaaatactgaccccttgcagaggtaacgttgctgattctgttgagttgcacaaagataaactacttggtggccttatagcagatggatttgatgaacaatcatgtctcagcaggtaccattcggtcacatacagcaaaggactatcgggaaatccttcatcatacctcatttctagattgagaaaatatgaagctctccacaaagaatgtggaccttatactgaatcctataataaaacggtgaaagatctgaggtctggtcatgtaagtgagtccccagcatgtaaatatgtggtatggatttcatatagtgggttagggaataggatattgaccttagcttctgtgtttctatacgctctcctcacagatcgagttctattggttgatcctggagttgatatggtggatcttttttgcgaaccgttgccacatgtttcctggtttctccctcctgatttccctctcaacagtcaatttcccagttttgatcagaaatctgatcaatgttatgggaaaatgctgaaaaataaatcagctacaaactccgttgttccctcttttgtctaccttcatctagcacatgactatgacgatcaggacaagcttttcttctgtgatgatgaccaagcttttcttcagaaagtgccatggttagtggtgagaacagataactactttgccccatctctattcttgatgccgtcttttgagaagcaactgagtgatctctttccaaacaaggaaacagttttccatttcttgggtagatatctgttccacccaaccaacaaagtatggggacttgttagcagatactatcaagcttatttagctgacgttgatgaaagagtaggcatccaaataagagtgtttgatactagaactggaccatttcaacatgtgttggatcagatcttagcttgcactttgaaggagaatcttttgcctgatgttaaccaaaagggggatattgttaattcaccaggaaagccgaaatcaaaagctgtgctgatgacatccttgagctacggttattttgaaaaggtgagagacatgttttgggaacacccaactgtgacaggagaagttgttggcatttaccagccaagccatgaagggtatcaacaaacagagaagaagatgcacaaccaaaaagcttgggcagaaatttacctcttgagcttgatggatatgttggtcacgagctcgtggtctactttcggctacgtggcgcaggggcttggagggttgaaaccgtggatactgtacaagcccgagaatggaacagctcctgatcctccttgtcaacgtgccatgtcgatggagccatgcttccatgctcctcccttctatgattgtaaggctaagagaggaactgatactggtgcacttgttccacatgtaaggcactgtgaggatatgagctggggtcttaagcttgtagacagtaatagttggcaataa

SEQ ID NO: 81438 - DNA, 300 bp, Glycine max
  Peptide Sequence Number=SeqID_173123
atggaaaacggcgtttacatgttgggggttgcagaagacggagacaagaacggaactgtgagacagtgcaatgcggagcttgtggatatccacgggttcgggtcaggtagggaatcggtgggtagagtggttgcaatcaacgaagaggtcttggagacggtgcgggtccacatggcgtgggtcggacgcgaggtgaagaggggtgaactgcgcgtggccgctgtttgtcgctatttcgtgagcgctcacgagagcctcgttgccgttggtcttgtgggtaaacttatcggggattcatga

SEQ ID NO: 81439 - DNA, 699 bp, Glycine max
  Peptide Sequence Number=SeqID_173124
atggatgaagaacagtggatgcatgacagtataatgtctgaagaagttgatatgaatgaacaaaatgaagatgaagccgttaatgaaaggagtggtcagtatagggccaagaagaaagattcggtaagaacagatactaacagtagaaaatgtgggtgtccctttaagctgcgtgggaaactagtggttggaggccaaagatggatggagcacaatgtcaatagttatacagcaatcaagcaaatatacaatgcaagaagtgcatattgttcttccataagaggtagtgatactaaaatgcaacaactaatgaagcttcttgaacaggatcagtatattcattggcatagagtaaaggatgaagatgtcgtacatgatatcttttggtgtcatcctgatgcagtgaagctatgcaatgcctaccaagggttatctgagcccgaagccaaaataaccgaagagatggaaaccatatccaagcggtttgaagaacttaatgtttgtggcaaagttactctaaagagcaaacttcgggaaattgcctaccctactctaaactctatgtgtcatcctccaaaaaaggtcaaaacaaaaggtgttcaaaagaaaccgatgaccaaacatcaaagatcaacaaaggcaagcaattccaagaaggactatgttgatgttggatcaatttcattcatgcaatcatga

SEQ ID NO: 81440 - DNA, 296 bp, Glycine max
  Peptide Sequence Number=SeqID_173125
ggtacatcctttgtggtacaagtagagggtacatctacttgggttgtaatactgagaacaagagagggtacatctcttgtggatcagttcaagtggagggtacatccacttggttgttcaaagagaacaagggagggtacatcccttgtggatctttgcttgtaaaggattttacaaggtacactgaaagtaatttaattaaacttgacatacggataaatggtgactgtgtggagccattggctacaattgtgcacaatgataaggcatttgaactgaagaggaatgacccataa

SEQ ID NO: 81441 - DNA, 54 bp, Glycine max
  Peptide Sequence Number=SeqID_173126
atggaattttgcttaatagttgacgatgcagacacaacaacgccaacggtttga

SEQ ID NO: 81442 - DNA, 635 bp, Glycine max
  Peptide Sequence Number=SeqID_173127
tgactcgacagctcttggcgatgtttagccagatgcagtcccagtttcagtcccaaatgcaatctcaaggacttgcactgctttcggagcctctggttggtccctcaagtcctcgagtaagcacaaaggagagttgtgttgatccctcaggaaacgatcttgagacggatgactcagacaggtacgacttgtatatcaaagcaaatcctgcctgcctggttgccctaagaagagtttataagggatccactgttgttcataacacttctttgttgcctagccaagtaaaggtgggtgtggaggaggttaaagatccagatgctcccattcctgtacccactaatgaggttacatgggatgccaccgtgttcggggtctttaatccagacttcccgctctacataaagcacgaagacctctccgaaattgcacacggtggtcaatgtctcagcatacagcatctgactgaaacaagtatgcgagcggggaattctgatctgtatggattcctcgagccacaatccattcagaggctagacaactaccttaaggggataattaacaatgctttaaaaggtcttgatgatgctccacagtctaaatcaaaggctcctgctaggtggattgtcgtcaag

SEQ ID NO: 81443 - DNA, 423 bp, Glycine max
  Peptide Sequence Number=SeqID_173128
atggcttctccacctacctcgcctcctcctcctcctccttccgacgcatcagctttgccgtctgccgtgaagtggacacgcaaagcttcacgtggacatcatgtacgagaactggaagaaggtccctactgctcagaaggacttgatttaggaggatattcagcggaatttgaaatcccagaggcttctgacagtaggatgaaaaagaagttacttcagactgtcgacgagagattgaggcagtttaaattagacctcacgagaaaatgggcccttgtagccaatcaggacggtgtggacgacactgtctgtgagaaatatgacataagcaaggaaaaatgggcccaattttgccagactcgtagagacccttcttgggaggatgtgcggaaaaaggccttggccatccagaaacagaacact

SEQ ID NO: 81444 - DNA, 853 bp, Glycine max
  Peptide Sequence Number=SeqID_173129
atggttataattagaggtttgagtcgggctttaggtagggttataggaagagccctcgggaaagaagtaaatattgatttggatgaagctccccagcggcaaaggcccacaacatctgcatgtaggcaacgagaagctgcaccagttgctgaggatgttcaacacttggatcatgcagttgataaggtccatgaacatgttgaagaagcagttgttgatgatgtagttcctgatgccgagggttttcccaacaggccccacgacacatcggttcttattggctatgttcatcatgttgcagtgaccgtttggaatgaagatttatcctcctatggaaggaaggttgagaaatttggtaggcctgttccagagatcgaaggcttagtcgctgccgaaactagtagtttccatcttcctgtaggagaagtgactatcaccctcaatgatgtgacatcgttgcttcatctgcccatcacatgtgccttccatagcttcgagcctcttcatatggaaaaagtcatgttgatgttagttgaattgcttgaagtcagtgcagatgaagcaagagctgagacaagtagaagctatgcatgggaagttgccgccttagtccatatgtataacaatttgaatgatgcgtccaagaacagcgccagacaacttgtaggatgtatcacacttttacagtctgggaagacattactagtgtcgacgtatcgggaacgtttggatagattgacgtctgatgctgtgtgctggattccttatggtgaccaccatgcaattagagaattcgagttgatttctttattttctggacatatccgatggggtccatctgttgtcatagata

SEQ ID NO: 81445 - DNA, 258 bp, Glycine max
  Peptide Sequence Number=SeqID_173130
atgagaacgcaagccctagtactttcctcgcactctgtttttcttgttcttcctcgcgcttcggttttcttgttcttcctcgcttcttcttcttcgcgacctcacggtacaggcttttgtaactgcacgttacccaggtacagcctcacggtggtcactgtaaggaggttcgtgcttgcaagttgcaaggtgctcaaggtggtgactttcagtccgttggtgttcacaaggtgttcgcaaggtgcttcgtgctcctaa

SEQ ID NO: 81446 - DNA, 393 bp, Glycine max
  Peptide Sequence Number=SeqID_173131
atgtcacatcaagaatacattaatgtcatccttgaaggccttttgagggagtatgatcttgtaattgcagtaattgaaagcaagtttgagtctcctctgattgctgaagttaaagcactcttactagcacatgagtcatgtatcctggagtcacaaaaaaggataatcatatcttctccttcaattaattacactcaagatccatcttcgaatcttaatccttatcagaacaataatttttcttttgattcatattttgtgccaaacaattcctatggatttgattttgatcaatctcacaatagtaaccctaatcctggcggaggcattggcggtggaggtggtcgatgcaacaacattcgtggccatggaggacgctactcgaatttttag

SEQ ID NO: 81447 - DNA, 282 bp, Glycine max
  Peptide Sequence Number=SeqID_173132
atggctacttcaagttcaaatcgccagtgctactggctactcccaactgcagcgcaaatcgccagtagcactagcgctttcaactgcaaaaaagttgtccctcctgcaacgcttcctgctgcacgtagtatgagcaaacaatcccctaccctcaacttgccagtcaaactggtgagtccaagctcctgcaaggcaccaacagcactggcgacaccagtgtcaggtgtcacgtcaccaagggaagcgccaatacgagctgcgatttgcatgtgctctacgtaa

SEQ ID NO: 81448 - DNA, 270 bp, Glycine max
  Peptide Sequence Number=SeqID_173133
atggtgagatatgataaagatatcattagatggtgtcggaagattgatgcccaacagattgacccatcttctgatgaagcacatccaagtcttcactcccattgcagattgactggccaatggccaagctaccttcctggtattcacagcaaaccaaccaccaccttcaagttcatgcagaagaaaggcaaagttcctcctcacactaaacctatgcctcaccctggtcctaaggacaacattgtcctacgtccaattccttacgattga

SEQ ID NO: 81449 - DNA, 322 bp, Glycine max
  Peptide Sequence Number=SeqID_173134
gcatcgaaatgtagacagtgacaatggtggttgtggaagtgacggtggtaatggtggtggaatggtggaggtgatagttgtggtggtggtagtggaggaatggttgtgctggtggcggtggtggaatggttgtggaggtggtggtggtgtaggtggcaacaaggtgtggtggtggtggaatggtggtggtggaatggtggtgatggttgcggtggtggaggcagcgacgatgatggttgttagaattgagccagtaggattttatagaggaccaagtccaactcttgagatatttggagaccttgctttctttaggagatga

SEQ ID NO: 81450 - DNA, 177 bp, Glycine max
  Peptide Sequence Number=SeqID_173135
atgtcctctagatgcaaatccgctatcattgcagagcaagcgtcattgtcgcaggagaaatataggaaagagaggagagcacgaaggggagagaaaaggagaacaagaaaaagggaaagagggcatgatgatggtggtcgtgtaaacggtagtgtcgctgctaggaggttgtactaa

SEQ ID NO: 81451 - DNA, 330 bp, Glycine max
  Peptide Sequence Number=SeqID_173136
atgtgcttgttggtggaggggccttgtgtggtggtggcgtgcacgaataatggtgtagagggaggggtcgtgcgcgattacaaaggtggtggtgtcacgcacgcaatggttaagttgggtggctatggttgcacgacggtggtggttttgagtgcgtgggggaagatgaagtggttggtgcgagggtgggggagtgtgggagtagagcatgtggcgaaagagggagaaggtgcaggggtgagtggtgtagacagtgatcatagcggtgaagaggtaggtgtcgggagagggaaggtggtcaaagatgagttgcgcataggtgaggtttga

SEQ ID NO: 81452 - DNA, 633 bp, Glycine max
  Peptide Sequence Number=SeqID_173137
atgaatttgaggaatgatggtggggacccctcgatgctggagcagatggaatacatgaggaggcagatggcacagatgaaggacataaggagggagaatgttgaagtaagaatggaaaatgcagaggcgaggaggccaggggaatcattgaaagagtaccttacgaggttcaatggggtgatcgttcgagtggtcaaatcggacgagaggatgatcgtggcagccttttttaagggtttgcatagtgaatcgttggtgagacgaaaaccagataccatgaccgatgccttcttgaaaccttgtggaaactggaataaggggggagtcaatcattcttcgaggcgtgatggagggggaggatggagtagacagacacgatcaaaggagggagcaaattttgaggagtggggttatgttgacctcgatacaactttcggtggaatggaggtcaaaaagatcatggtcaaattcgcacttgacgatgaatcggccgaaataatcagtgttaaccaggaaatcaagtgcaaatgttatgaggatagtctcaaagccagaagggggatttacggatcaatgaaacactacggagtcaactttgtggaattggacccacggagagatttcatagactaa

SEQ ID NO: 81453 - DNA, 399 bp, Glycine max
  Peptide Sequence Number=SeqID_173138
atgactgaagacattgtcgtcttcgaaatgtgtgtggattaccatgtagggcgtcttcgcgtgccatcggactcacaggtcacgatagcagaattgtgtgtatggataaccataagtctcggccagaagatgctgacatctccggaaagggtgcagatgaccacattggtctctgcttgtcaatcggacttggggtcttcgaatgacgaggtgcggataaccgtaaggtgtctccgcatgccacctgactcacgggtcggggtagcaaaagtgggtggggcgtctccgcatgccattggactcacaagtcacgatagaaaaaggtggggtggtcgacaaaagtggggcttttgctcctacgtatcctcaatttgtgatgaggaactcagacctacatag

SEQ ID NO: 81454 - DNA, 195 bp, Glycine max
  Peptide Sequence Number=SeqID_173139
atggaggttgatgaaccttggttggggttatggctaccattgaattatcaagtagatatgggagcaatgcggaagacagactttgtggttgattcagggatggcctttgtcgataactgggcggtgggtaaggagaaggaatggcagtcacagcatgggcttctccctcattctcaccctcttcatttgccctag

SEQ ID NO: 81455 - DNA, 88 bp, Glycine max
  Peptide Sequence Number=SeqID_173140
gggtggtcgacaaaagcgggacttttactcctacgtatcctcaatttgtggtgaggaactcagacctacgtagttcttgcgaaaagcg

SEQ ID NO: 81456 - DNA, 570 bp, Glycine max
  Peptide Sequence Number=SeqID_173141
atgaagttctcgccagacgtcgagaacatcataactgtgcatgctgaccagaggacgaccaaagaatgctacatgaccagccataggttgcatccttatacaagggaaaaagccttagaagtcatccactatgtggagactaggatgaaaaccgaagaggtggaggagctagagctcaattcgagaactaatgatgacaatcaagtgaagccagtaaaggagacatccaccttccagctaagacctaaggaagaacaaacatgcttgggatcgatgcaagctttcattgtcataagttatccatatgtaaagatgcaaagccatttgcccaaaggaagacatagatgggggaagagaggtgtcaggaaaattgactactccacttggcattccaatgtggtcatggttaagaaaccaaacaagaagtggaggatgtgtgtggactacacaaatttgaatcaagcatgcccgatggatgcatacctgcctggtcaatggagcaactggacacatgatgttgagttttctaaatgcatatttcgactacaagcagataaagatggatcctag

SEQ ID NO: 81457 - DNA, 258 bp, Glycine max
  Peptide Sequence Number=SeqID_173142
atggtggttatgaggattactaggatgaaaagaaacttcttatggggtggtgaggagcaggggaggagaaaaatagcttggggtgaaactttagccataaaatacagaaggatcttcttaaattcagagcaacaaaatgattgtttcaattgggagttgcctgtggttgataagttctttgaggaattgaatggggcgactttggttcatcaacaacaacacaagttggcttggagaaatggctcaggagctatataa

SEQ ID NO: 81458 - DNA, 441 bp, Glycine max
  Peptide Sequence Number=SeqID_173143
atggatcgttgccctccacaaccatacaaccctgttataatgcagagtaggaatgaaatgcagcaatccgaggatttgaggaggctatgtggcgcggaatgtgaggacaaatggtttgataagttgagtgagtggaaattaggggatgggggatgtggggagttggacgtggagtttgtgtggcgcagaggttgctttgtttgggaggagtcacaagtgaatcagctgaaggctttacttgtccgggaaccaagccaggaaaatgaagaagcaactgaggaatgggtgtttggaggacaaattcttgttgcagatttggaagctatatattccaccgaagttgaggaatctgcagaccatgcgttcatgaattgtaggaagatctatcccttatggaaaaaaatgctttgcttggctaagatgttgttctgtcctacttga

SEQ ID NO: 81459 - DNA, 222 bp, Glycine max
  Peptide Sequence Number=SeqID_173144
atggtggtggctaggctagtgagggatcacgagcacctagatctagagttgggagcggggcatgatgctggtggtggtgtaatgttcaaatctaacaggtccaaacagtcagaggataccctccaacaaatggtagtagccatacttgacaaggctcaagtggagaaggacaaaggcccggaggcactcccaagaatcttgattgctgaagacccaaactaa

SEQ ID NO: 81460 - DNA, 525 bp, Glycine max
  Peptide Sequence Number=SeqID_173145
ccggaggaaggtgaggatgacgtcaagtccttatgccctgggcgacacacgtgctacaatggacgagacaaaggatcgcgatctcgcaagggtgagctaactccaaaacccatcctcagttcggattgtaggctgcaactcgcctgcatgaagtcggaatcgctagtaatcgccggtcagccatacgacgatgggactatgaagaaaggtgacagagtttattttatggctagtgggaaggattattttgctgatgaaattggagttttgtctcctagtcaactacaagttgaagaattgtatgctggtgaggtgggctatctatctgcatcaataagaacagtagctgatgctagagtgggtgacactgttactcactatggcagaaaggctgacaattcactccctggatatgaggaagccactcctatggtgtcctgtggcttatttcctgttgatgctgaccaattccctgatctgtgtgatgcacttgagaagttgcaactcaatgatgctgcacttaag

SEQ ID NO: 81461 - DNA, 169 bp, Glycine max
  Peptide Sequence Number=SeqID_173146
ggttgtcatcatcaaaaggggggagattgtggaagcaatgtcttccaaggttattttgatgatgccaaagaatcaagagttaagtaaagtttcaagcaaagattcaagaatcaagtttcaagtttcaagaatcaagtttcaagtttcaagaatcaagaatcaagaataa

SEQ ID NO: 81462 - DNA, 339 bp, Glycine max
  Peptide Sequence Number=SeqID_173147
atggtgaagagaaggaagttattgagcatggaaaatcgtcgtggattgcgctatgagtgctcaagcaattctaagatacaggagaagtttctagaggggttaatatccactaacgtgaaacaaggtctccttcctagcagaaaagtgttctttctaatctctagccatctcaaatgtagagagacagaaagaatagtcaaggaagtgaaatcttgtttctctcctcttccaaggaatcaaagtgcattggagagaagtctcactatggagaaagatatgcattgtttatctattatttgtgagaatcataggtttcaagatcttgttgatttcctataa

SEQ ID NO: 81463 - DNA, 825 bp, Glycine max
  Peptide Sequence Number=SeqID_173148
atggagaatcagcaactcacgttttggaagtccaattatgaaattgatgactatccatttgcacctacgtgccaattttcttcatatgattattgcagctggggtaatgccaatgatgggtatcattggccatatgaatttcctttgcaagatagctatcttgatgctatcccttatatgaagtgttattatcctcatgacattttgtatgaaagtactcttcccattgaaccaacctcactaagcataagagactatgacttttcagatgttaaaaatgtgctttctgcgttgaacgaaaccgatggttcggatcataaacctgctttttcatcatgcaatgatggagaaagtgtagatgaaatgcaggaagatttgaagggtaagaaatgcagagaagagggaattagtagcagtgcgaaaatgttgtcaaggaaaaccgtttctcaatacttttacatgccaatatctcaagccgcaagagagctcaatgtgggcctcacacacttgaagaaaaggtgtagggagttaggaattcagaggtggccacataggaagctactgagtcttcaaaccctaataaagaatatacaagagcaaagagagaccgggggccatgaaaatgatgaaaaaactagggctgccattgagatcttggagagagaacagaggaaggtggaggaaatgccggatttggaacttgaggataatacaagaaggcttagacaagcttgttttaaggctaactacaagaagaggaaactcatggggatgaggctcattgaacccgattcttctcttagtggtctatttaacaagtattga

SEQ ID NO: 81464 - DNA, 90 bp, Glycine max
  Peptide Sequence Number=SeqID_173149
atgaggatagggcatgagaacaacaatgagcaccagaatgaaggatttgtgaatgagggtgatgagcgcaagatcgaggacaatgtctaa

SEQ ID NO: 81465 - DNA, 1269 bp, Glycine max
  Peptide Sequence Number=SeqID_173150
ggtacctttgttccctatggtcgtgatgacatactcaatactgccattggcaaatcggagcacccaagtcgtgttcgtgcagtaaggtctggtatgaaaattagtcaatactatggaagggcaccacgtggctccaacagttcctctacatccatcacccaacaacaactggctgagattattggaagccttaaggaagagtggaggaatgagttggaacaagaaaacaaatggagcatagagaaaatgaagcaagagttgaagcaggcgatcaaaattgacacaaaggggaacaatggtgaaattgctgtcaatccatcaagggaagaacatgttgctcatgtgataccgactatagggtttgtatatgcaagcgtggcatatccagatgatgtggtaagggtcaatgttgaaaaagtttttgacggtgatgttcaagtgccattttcgacatcagaaattaagtatgtcaggcagaccctttacacattcattgcttggccaacaaatcttgttaaaattgtatcacatgaggattcatatattactccaaacaaagtggttgaacctgttcaaaggtcaaataatgttgttctaggtgattcgttgcatcacttgattaggaccatgtgtgacatttacgagaagcctgttgagctattgtgggatgggactaaatttaggattccaaatgtagatgcatccttcttcttaacatattatgatgtaaatgaaataatatcagttgaaaacagaagactctgtcgttatcatagtgatactgatgatagatttgctagaagacctgttttaccaaggacaccaaaagaagtgttggctgctaaaggtgtgaagccaacattgtttcccaaccttaatactcttgcacttgttgagggaaagcggggaggaagggttctctatcctaggtgtaatgtcaggtacgagctctaccctttctaccatgtcactgcttcccctccttcaccttcaccttcaccaccaacacttcttcctccttcaacttcaccaatttccccaggaagcagtgggatctcagctggaacaattgttccaattgtggttccaattacgattgttgtgcttatatttatagttagaatttgtttcttgagtagaagagcaaggaagaagcagcaggattctgtaaaggaaggacaaactgcgtatgacatcaccactatggactccttgcaattcgatttcagcataattgaagcagccacaacacaagttctctgtggataa

SEQ ID NO: 81466 - DNA, 201 bp, Glycine max
  Peptide Sequence Number=SeqID_173151
atggagatgcagcggaagacaaaggagaagagtgggccttctgggcgctcagcgcacttcctctcggttggaaatgggcttagtgcagctttgggccgctcagcgcaattgccctcggttggaattgcgcttagcacgcctttctcgcttagcgggagaccaacaattattattttgaagatcccaacggtccgactgtag

SEQ ID NO: 81467 - DNA, 579 bp, Glycine max
  Peptide Sequence Number=SeqID_173152
atgccttatgttgacctactaccatctttgatcagcaaccagatggttatggtgaaccccgagaagatctatcaatctcccttccccggatggtacaatcccaatgcaacctacacctatcatggaggtgttccaaggcattctatagagctgtgtgtggccttcaagcataagatgatggcacccccagactctattcctatagtagagcaatttaatgagatggtagcctggcctgggacccaaccttctcttcataaggaagacgaaggtcagacagcccaagtacctcagcatatggaggatgagtcatctgaggccaccatcccagagccatttgatataggagaagaggcagaggagacacaggctacttcagagccttctgcaccagtggtaaacctgcccccacctcagcctgcagcagacacctccactcctcttctgcagatgccaaaggacccaactacaccagtcctagctgtggacacttctcctcccactactccagtgcttcagctgacagatgaggaagatggtcagacacaggacacacaggaccagtcacaggaattttga

SEQ ID NO: 81468 - DNA, 477 bp, Glycine max
  Peptide Sequence Number=SeqID_173153
atgggaataaggggttgcattaattataatcccatactggccataagacaaccaggctaccctatgagaggggcactgtcggaagagatcatcgtgcctttcatcgcacagggttttagtgaaggcaatgaaaaaatgcttcagagaatccgaaaagcgtggaatacagtggaaagaaaagataaggagcttaggggaagcagcaatggtgtcatcggtgactatcataaatggttgaaggctcagacgcaagggataacttggctcctgaagctaaagagtccaagtggggaagaagctaaagtccccgaggagagcgaagaagtgcaagccttgaaagttgagcttgaaagattaagagtggtcaaggaaaagctgaagacggcaatgaccagggttaggaaagagtgtgacgagctaagggatatcaacatgactacggccgaagcattagaatgggaaacaaagagagcctga

SEQ ID NO: 81469 - DNA, 213 bp, Glycine max
  Peptide Sequence Number=SeqID_173154
atggaggtcatgatgatgatggtggtgatagttgatggaagtagtggtggtggcggcgacaacaatcatgatggtgattgcaacggtggtcacaacaatgacgctgaaggtcatggtgacaaaggtggtggcggttgtgatggtggagatggtggcaacgaatatggtggtggcagtgatcatgatgttgatgggttaattgagatattttag

SEQ ID NO: 81470 - DNA, 840 bp, Glycine max
  Peptide Sequence Number=SeqID_173155
atggacttcttttcaaatgagagttttgaatgcattcaggcatttgagaactcaaatctcattccttttatgtctttgaaatcgcctgtctattctgaattagttaaagccttttattataaccttgaaattcaagaaagcagtttgatttctgaggtttttgggataaaaatggtcattgaccaatccctattctatgacttgacccaattatctagtgaaggtgtaccatttgaaggtacactgaatgatgattggaaatttgatttctctgtgcatgatgcccgccggttggtttgcaccaaccaagcggatatgaccggaaggctacttgtcggatcattgacttttgaaagccgcatccttcattatctcattgtgtgtattttacttccaagatcttcaaaccttgcacaggcactgcgattaaatgctccactgccatatccacacctagtcactatcttccttcaacactttaacatccctcttgattttgaaccttatgttccaatcaagagatcctttctgataggtgctgttgtggttgcatcttttgattaccgcaaagagcgtgatggctcttgggtaaaaaagggtgctcaacctcatgatgatgaaggagacttaccagtaggagaggattcccctctccttcagagtatcttggacaggtttgatggacttcaaacctttgttggcgaaaggtttgatgctttggaacaacaagtggacatgcgtttcgacggaatggactcaagggtcaccaaggttgaagaagatgtcactttcatccgcacatgctttgatctaccaccaccaccactaccatcatcttag

SEQ ID NO: 81471 - DNA, 737 bp, Glycine max
  Peptide Sequence Number=SeqID_173156
atggagaagtacattgcgactatgagaagaagcgattcccgaccggtgacggcgacctcggtggctattgcggcgtgctactctttgaattgcatgctgaggtttttcatctcgttcacggttcgagggaactcccaatctaggtcaatgtcgtggaacccgaaggtgcacgcgagggtgatggtggagttgatgaaggtggcgcgcgcggtggattttgcgttgatgagagagaagagagtggcgttggagttggtgccgccgatggagatgagggtggtgatggtggagccaagggtggtggtgaactttgtgaggtttgtggctgtggagtttgaaacgtgtgcgcgggtgacagttgaacaagtgcggcgggagaagctgttgttgcaagagagagaatgggaactagaggctgagttattccttatgagaacactattaccaaattgccccttgaattggttgtgggctcctattaaatgtttggactcctctagcccacgtgcttatccggcgcttgttagagtagaattgagagagttgtcggagactacccctcactttgcgctactagctgaaggtggtgatcacgatgcttgtcattttgtcgaccaactaagggtggtagctgtcgcaacctaccctttggcgggaaggcaaagcaagatagaaaggcatggggaaggtattagcaccccacacgctcgtcacaagggacaacaacctttaatcga

SEQ ID NO: 81472 - DNA, 222 bp, Glycine max
  Peptide Sequence Number=SeqID_173157
atggcaacacctaatgccccattaggtcagcaatgggatgtacctggagcaatccctcctatgggtgatttattaggtgttgatttgcgtcacgagttttctgcagaggctgaggaacaagggcggagacagcgcgcaagaagaaatccggatcgtcaagcccgaaggtgggatcgaccatgtggcacatcctcgcgccatcacgaacaccatgatgactga

SEQ ID NO: 81473 - DNA, 375 bp, Glycine max
  Peptide Sequence Number=SeqID_173158
atgccaccgcttcccatggaaccaacacaacaacagttagaagcacattgtaaagcttacattttgcggctgattggtggggttttaatgccaaacaagatgggaaatcgggttcatttgatgtacctcactatgttggtggatctcgaacgagtcaggcggtatagttggggatctgcttgtctagcaacgttgtacagggaaatgtgtagggccactgaccctgatgccaaaaccatgggcggttttcttgtgaaattcatatctccactttttggatgctttggagtcgacagcttccgtagacttctccatatggacagcctgcacccctctaatttgtttctcgatagtagaatggcaccaagcggatag

SEQ ID NO: 81474 - DNA, 324 bp, Glycine max
  Peptide Sequence Number=SeqID_173159
atgcccacaaccctagtgaaggagatcccataccccttggtgccgtcaaagaaagagagggaacactactttgctcgtttcctcgacatattcaagaagctagagatcaccattccatttggagagaccttgcaacaaatgcccatgacccagttagccacaggaggggattgctcccaattttcttccgagacagcctgggtttgctaccgtggtggagctcgcactaggcatggggagcagttgaccacctactcccagtacctccacacctacccagaccatgacaccatcgcaaccaagctgagcaccccaggagggtga

SEQ ID NO: 81475 - DNA, 102 bp, Glycine max
  Peptide Sequence Number=SeqID_173160
atggaggcatgggtcacacttggcagagcacaacttaattttggtgagcctgataatgctattgaaagctttgaccgtgctttagctctcaaggtcctgtag

SEQ ID NO: 81476 - DNA, 456 bp, Glycine max
  Peptide Sequence Number=SeqID_173161
atggggttctttcgttattatttccggcagagggcacttttttacgtgaaaagcatgccatgcagtgaccaactcgccagaaccagtggcgagtttggtcttagtgagcaaatcgctcatgctgctggcgatacattgcgtagggaaccgccagtcaaactggtgagttccaatggcttgagggtgcagactagccctgcgagagcaggcatggcagtgcagggaaagcagggtgcaggccaaatcgccactcccattggcgatttgccttgcactgggatcgccagctatgctggcgggttgcttctacgttttgaaaattttcattcatcctcttccattataaaagctgaaggtccgagtgaggagctgccttcctttgcttgctctttgttattcttcttccctactacactgcattcttcttattgtgttgctgtattttgtttttggtaa

SEQ ID NO: 81477 - DNA, 692 bp, Glycine max
  Peptide Sequence Number=SeqID_173162
atggctaaaccatcatccgatgctgctattgtaagtgcaacgaggaaaaataaggcagacccaggctggaaatattgtcattcactggtggaaggagatacaaacaccattgtttgtaatttctatggaaaaatcacaaagggaggaataaccagagcgaaacaacacctgattgggaagtcgggtaacgttgcagcttgcaagaaaactccaccaaatgtagtcgaagagttgaaggaatatatggctaccaaaaaaagtgggaccacttatagtacttctggcagtggtaatatgacaaatataagagattttgaatttggtaaaccaattggatgtgatggaagtgaagaagatgagtttgcggactcttgtaatgctgctgcaagtgcaaagacaaagtgtgggactaaaaaaggaccaatggacaaattttgtaagaatccagaaaatgcaatcaaccggagaaaaatggagatgctgagacaaatgaacataagagagtcaatggataagaatgaagtattgaaggtgcatcgacatattgcttgcttttggtaccaagcagccattggtcaatatgggccacatttgtccattcctagctatcatgacatcagagttccactcttgaagaaggaagttgaatatactaaaaatttgatggaaggccatagggagcaatgggtcaa

SEQ ID NO: 81478 - DNA, 306 bp, Glycine max
  Peptide Sequence Number=SeqID_173163
atggatcaagatgatgataatgatgttggaaatgatttggcgaaaaaagcaaaaacaacaagtgttgctgttacccaaacttctaaaaaacaggcaatggttgttggatcttcatcaaggaagcaaagagcagtccaagaaaatgttgaggatctagattttgaggagaatattgatcttgaatctgaagaagaagaaatcatggtcaattttgaggtgtctgatggggaagagggagagagacatactccattaccatatgataacaacgaagatgattatgttgggattagagaagatgattag

SEQ ID NO: 81479 - DNA, 666 bp, Glycine max
  Peptide Sequence Number=SeqID_173164
atggcaaagttcccacttgatccaatgttgtcaaaaatgattgtggcttcagaaaattacaagtgttcagatgatattatttctattgctgctatgatttctgttggaaactcaatattttactgtccaaaagataaacaagtacatgcagacaatgcaaggttgaattttcacactggaaatgttggagaccatatggcatgtctaaaggtctacaattcatggaaggagaccaattattcaacgcaatggtgttatgagaattatatacaggtaaggagtgtgaaacgagctagggatatccgtgatcaactggcaggtcttttagagagggttgagattaaactaacttcaaatgataatgatttagatgccatcaagaaatccattacatctggtaaacttataaaactaaaaatttcttgcaatggtttttcccacactttgcacgactgcaaaagaatggatcatattgaatggttaaacattcacagactgttcacatacatcctagttcagggctaccacaggtgctggatgccaacctcatcatatctagcgatgactattaccaatatagacaacaaatgtaatatggccttcaggagaatgaatgaagaagatcgagtgatcagccatgccaattgtggcaaggcagaactgtaa

SEQ ID NO: 81480 - DNA, 180 bp, Glycine max
  Peptide Sequence Number=SeqID_173165
aagttgcatgagagggttaggaaccaaatagagaaccaaacaaaggtgtatgcaactaaaggaaatagaggaggaaaggagctagttcttagtgaaggggattgggtcttggaaaggatcaataacaatgcctataagttggacctcccagaagagtatggagttagcaccacgttttaa

SEQ ID NO: 81481 - DNA, 822 bp, Glycine max
  Peptide Sequence Number=SeqID_173166
atggctctccttgaaggtggcaagtcaactaagatccaagtgccatttctgagtaatgtattatactcagcctttataacaataagccaagttggatttgaaagagcaaaattggtggttttgggttcaagagaaggttctgaagttgcattgagttgtgtgggtgcactgagtggtgtggatgattcaggttcagtaggtcaaaatgatggtttaggttcattacttgtaaggatggtgaagacaataagggttaaggtgatgttaggtggttatgggcctttgatatggaacctcattgttgctggaagaagaatgaagctggttgataagatagacactagaaatgaaggcatgctcccaataatgaagaggcatgtcaacttgagagagtcattgagaaacttggtgaagggtttgaactccccaccccaatctgattggacagctttaataggaagattaaatcaaacccaagtagatgtaccttctacttgtaccacaaaggatgtaccctccaatgtgttaagacaaagatctcaggttgttaaacctttgatactttgtgaatggggatacaaaagaattctcagacgggagaagggagacacaaaagaattcaggcggttagtccttcgttcttttggaaaagggagaagagagacacaaaaagaattcaggcggttagtccttggcaaattctttttggcaaagggagaagagaatgaaaagatgaatagcataagttttcaaggtttggaaaaccagaaagcttttggtacaaagaagaagaagaagttcaaagagattcaaggcttgtaa

SEQ ID NO: 81482 - DNA, 186 bp, Glycine max
  Peptide Sequence Number=SeqID_173167
atggcttctacaagtggagatgctactccaccatctccaaaaaccgcaaggctcatggcgcagatgattaaacttggtaatcaaatgagaagaatgagttatgacaatgaagaaaggatagagagaatgagaaagaagaatgaagagagtttgggaagaatacacaggagtagtgaagctttaagt

SEQ ID NO: 81483 - DNA, 630 bp, Glycine max
  Peptide Sequence Number=SeqID_173168
atggacagtttgatgatctcgtgccttatctggagtagattacgatctttatccgaagagcaagagagaatcactgagattgtgacacatggtccagcatcagagcgtcgatttccaccacaagagtttcacatgcttcagtcaagtgttgaaactcgaggttttgacagacgaagggaggctgttgaagcgcaagaattttcccaacaaattgaggagcgtgaccatggaatgtattactcgccaccaacattttctcagtatccttcacagatgtatcagtatctgtttgaaggtcatcacactaatatgtctgcaagcgaacattcgtttggtggtgttgcagaaacacatcctcatttttcatggccgactatgaccccttcacaacaacatgatgccccaatggcaacacctaacgccccattagctctacaatggaatgcacccggagcaatacctgatatgagtgacttattaggtattgatttgcgtcaagagttttctgctgaggctgaggaagtagaagcggggaggtatcgcggcagaagaaatcctgatcatcaagcgcaaagatgggatcgaccatgtggcacatcctcacgtcaccacggacatcataatgaatga

SEQ ID NO: 81484 - DNA, 417 bp, Glycine max
  Peptide Sequence Number=SeqID_173169
gttgcatttgaccccggcctgagagctttcgtttggggtagccgaatgggcacctctaggttgaatgcttcctcgagaatcgtgcttgtgcaagttggccttggtttgtgctatgcacttgtcgcacttctatcctgcttggtggacttcattctgaaatctgaacatttcttccatttggatgtagcccttgggttgtttgcgcaatttgtgtatgctaccgggagcatggaatgcaacactacctcgggattgagatttcggatctggacggctgtgcgcccaaatttgtccatgaactttctgagggacttgttgtctacttgtcgtagattggccaaggcggccgaggtcaatgctgctcccttgagggatgttgggaagatacgacatagaattgcgtcgttgttggtctag

SEQ ID NO: 81485 - DNA, 357 bp, Glycine max
  Peptide Sequence Number=SeqID_173170
atgactaggtggatgactttaaagaaccttgtgctaaaggacattgggacacaatgctctgatggtgtctcatcacttaatgagtgcattaataagaatgaccaacaagacatggagcaagatagggagcaaggaattgagggaggtatcaactatgataataaagaaactgaggatactaatgaaaataattctgaaggggcggctcaaggacttgagaggcctaaagcaaattttgtggaagcaatgccttccaagattattttgatgatgccaaagaatcaaaagtcaaacaagtttcaagaatcaagatcaagattcaagaataatcaagatcaagattcaagattcaagtaa

SEQ ID NO: 81486 - DNA, 183 bp, Glycine max
  Peptide Sequence Number=SeqID_173171
atgaagaatgaatttacctgttacttctacaataagtttggacacatgaagaaagaatgtccaagatatgatggatcaagagaatgtttaggaccttttgggctttttctcaaagagtgtggaattgttccgcaatacattatgccaggcaaacctagcatgaacggtgtagcagaacgatga

SEQ ID NO: 81487 - DNA, 138 bp, Glycine max
  Peptide Sequence Number=SeqID_173172
atgtctaacttgacatcaagattgaaagcacttaagctagagcttggtgaagacctgctcgtgcatttagatttgatctcacttcttgcacactttggacaattcaaagaagagaggctgcaaaaagacaaatcctga

SEQ ID NO: 81488 - DNA, 489 bp, Glycine max
  Peptide Sequence Number=SeqID_173173
gatgcacaggtcaaagttgagtatgtgaaaagattgtatgaccaagtgaaggtgcaaattgcaaagaagaatgaaagttatactaagcaagccaacaagaaaaggaaggaagtggtacttgaacctggtgatgatcctggacatttgagggcaaatgttttccaagaaggagggaatgatgagaatcctgaaattggccaaatacaggctaaaggtccaagtggagaagggcgaaggcccaattccttgttgaaccaatctcagacttatcaaggtaatccttgtggcgtctaccctgacttatcttccttcaccggaagtggcgtcatccaaacctccgtagcctgtatcaaacgatccgctcctactcaggttcacatcaggtttgctttgataccattctgcaacgcccctaattgtcgacttctcaacgacttacactacaacacttcacatggtgacatttcactcaacatccttattggatag

SEQ ID NO: 81489 - DNA, 618 bp, Glycine max
  Peptide Sequence Number=SeqID_173174
atggaagaacaattggcttttgtttctactgctaaggaggaaggtgctacaatccaagttgaagcttttgtgaaagttgtggatgacaacattgttaataaggtcattattgatctcataaacactggtgttatgaatgaatctccagaggtgtccaacgcagctatagctgatgaggttgtccatcaagacaaagaatatgcgtccaatcagtccacaaccttaaatgaagctatgttaagggagaagggtgctcctgatgctgttatcgtctactcaactagttcaagtcctaccccactcaactatgctcgtccctctgctatgactagagatcaagtacaaaagatgataggtcaagcaatggacttcttttttcaacgacaaaggctagaaaatgaccagtttaggatatcaatgcaaaacaccatcaccacacaattctctaacctcgatggtgttctactccagaatctacaggttcaaatgactatgttaggagttattgctgcccttgcaccccttgctcttgttcaccaaccaccaccccctaaaccaacaccaccatatgttgaaccaacaccaccaccactatctccagcaccacctcaagtttaa

SEQ ID NO: 81490 - DNA, 1204 bp, Glycine max
  Peptide Sequence Number=SeqID_173175
atgttgaaagaaaactctcaaagggtgttattgcttacattgaaagataagatgagagcaaaagaccatagttggctttgtgttagccttcgacaagaacctcatcaggaatttggcaattctggaggagaacagattgtggcaccaagaggcaatgcaaaaggtggcatccttggaggcggagctcaccaagtggccaatgccatcgttgcttttgctgaggttgtaagggcgaaccaccaattgtcttccaaggctgagaagatggacctgggtggcagagtggagagcatggtggctaagaaggacgggcttgccaagaggattgctaagttagaggcccgacttagggagtcagagtccaaattggaggagtctaagctatgggttgccaaggaaaggaaggccagcaaggagctcaaggaagagctgattctgtacaagaaggaggtcgtagagcaacatgagaaaggctttcaaaaggccgtcaggcaggccagtttctttgcgaaggaccttgacttgggtctctttgatccctttaagaatgtgagggatggtgtcttgcttgaagaagaggagattgatgcggtggatgaggctgctgatgaaaggcaaggtgctatggagcaagaagatgatagtagaatgacacggagtaatcttaggtttgatttcaacctgattgaaggtcttgtcacagatctagtggggcttccttctgttttgtggagcttttcccctgatggttgtgagaagttgtgtttgaattgcccctggttgaaagtcttgcctaaccagtatggggataggtcgcttgacctattgtgttcctcttctaatggttatgaggacggaccaaggggatgccttgagttaggtagaagtatgcaccaagggcggaccttgggttttgcaagaatgtgtaccaagggcagaccttgggttttgcaagaatgtgtaccaatggtggaccttggcccaccaaaccagtctcagaaaaacgacgatctcgaacccgttcaccgttggatcgtcgtgaaatttgagtatcatgttcgcaacacaattaagagaattctcaccgttgggaaatttgatatcataattctatcggagcagtcggaggaaaaacttgaggaatctcaaggaaccgctatagatgccgctatcgttgtcggaagacacgtgagtccgctcagag

SEQ ID NO: 81491 - DNA, 345 bp, Glycine max
  Peptide Sequence Number=SeqID_173176
atgacgtcaagatctgacaacgactatgggtacaattgcccttctgcgagcgtaacatattttatgcatcacacgctttcttggaaacttcctagaagacttatcaaggtaatccttgtggcgtctacccggacttatcttccttcactggaagtggcgtcatccaaaatctctacaacctgtatcaaacgatccgctcctactcaggttcgtgatgaggacataaccaagggcaaggaccatgaagcacttgaagggcccatgactagaggcagacttaaacaagccacacacgtcatagagacaaggctggtcatttatataactgccattgatgatgattga

SEQ ID NO: 81492 - DNA, 204 bp, Glycine max
  Peptide Sequence Number=SeqID_173177
atgtggataaccacgacttcgatagacatgacgaagggtgaggctgatgaggagagcggttatgggttacagttggtggtcaaagaaaggaacaatgggttggggttggaaaggaagaaacatgggagaaagagtcaaggagtgactaggaacatgtttcgtgagtctgcatctaatgtttcagacaatagcaaaatggaataa

SEQ ID NO: 81493 - DNA, 1380 bp, Glycine max
  Peptide Sequence Number=SeqID_173178
atgtttagtataggtaaaatctcaaagatttttagaaagggtgttcacttccgcgagcagcaccgtgacgcgaatctcgaagccagagcgaacctcgtggttcaccgaggacaacaccgaccgcatcgacttccagaataccatagcggcgacgctgatacacttcgcgtgttggaagatttggtcgcaggagtccgccgccttgcgcgcggcgcgctctgcgccttcgtacagtggattcgttcctccgccgtgatcggaattggagaggagcacggcgaaggcgacgacgacggagatggaaatggcggagagatggaatcggcgatatgtatagtaacatctgctgtcatatccttcacatactccactattgggctaggccttggtattggaaaagttattggtatgaattcatgctattcacatgtccatcatgatgatatttgttcatcttcaatcactggacacagtgaaatcccctccatcagagtaaaaaacaatctaggcaccgtggtttctaaaaaaggatatgtgctaaatactaccgaggcagagactttgctttcaactactctgatacatgaggttatgcatgttcttggttttgatccacatgcctttgctcattttagagatgaaaggaaaagacaacataatcaggccgcaaaacgtgtacacatggaaaacaatagtcccagagttggatttttgaagtcaccttcaagtaaggaggatgttaaccctgatgcttatggcaatgggtttgttactgctagaacaaaactggaaacacccttaaaaggacgagcacactctattattgaccaggtgacgaaagttgggaattctatccgcagttgtggttatggagaaggtcaaactcagagctttgatcttcctattaagaaaaggatggtcattgaggagatattcatatggcatggtgcttcaattggtttctggcgtggggatgtcaaatttgtaattgatgatgttgggaaactaaaactaactattttctatgttgttccctgtgtgcttgatagagtgtactcaggtttgacacagaagatttcttctgggggcttcttgaagaagacattattcaactttgcttattcatataagcttaataacatggagaaagggcttagacatggagaggcatctccacttcttgatataattgtgtttgacaagcaaggtttagggggtagagtacgtcatattttgtctggagccgcacctttatctgcacatgtggaaggttacttacaggtggttacttgtgctcatgtcctacaaggatatgaagatattatagacatctttatggtccttgtactagattatggccttgatgtcttgtcactctaa

SEQ ID NO: 81494 - DNA, 609 bp, Glycine max
  Peptide Sequence Number=SeqID_173179
atgatccttaagaatcaaggaagtcacttagtccattatgtaagtcaccaagaaaatcaaggagctggaaagaaatttatgaagaagcatgataagggcaatgagccattaaagataaatgatgcatcagtgcaaatccaaaagaaagcatcagagaacagtaattgccacttttgtggtaaagctgaacaattccagaaggattgcccaaaacataaggcttggttcgaaaagaaagaaagacaattaaatagaaaggtgaaagttgtcaggtctgataaaggtggaaagtactacgaaaggtatgatgaaactggggcaaccccaagttcattcgctaaattccttcaaaaacatggtatttgtgtgcaatacacaataaaaatcaaaggacatagattttactgtcctaatcatagcatgagaattgttgaaactggaaatgcaaggttcattgaaaatggtgaaatcaataggagtacaattccatggaatgtgaaaattaaagaagttagagttaaagtgaaagtgagtgttcctctacatgttgttccaaacaataatgaagaagagcaacacaataatgagtctatgattcaaaatgtataa

SEQ ID NO: 81495 - DNA, 702 bp, Glycine max
  Peptide Sequence Number=SeqID_173180
atgaggtacaaagggtgtcatcaggaggtgccgagggaggatccggagtggttgtgggagctgatggtcctcatcgatgtcggctatgagaaggtgtatacaggtcttttgaaagggatctttggctatggcgtagtggtaggtgctggtggtggtgggttgaaaggggtacgggcagagcagcgccggtcagccaatttatcctcctataatctggcaagggcaattgtgtgggataaagacagaggctggaaagcctggacctcgtggtgtaactccaggtggagaccgaaaatgaagcagctaaggagggaagatgggggtgacccgatgatacggtttgcaatctgctcaaagctggtgagctctttacgggtcattgtagtaagagggtgcgaaatgagattccaaggcttggagcatggtggaccaggaggtgaggaagccattgtggtacatccactggcacctcaagtttcagatggggtctgggatggacgaggggaggtgtgggtggtgttttgggagaaggtgggggatggtaagggaggcaactcgatccatgatggatttgagcttactgttcaactctgcatgaccctgagaaaaggcagcgactgcttcatcgaggcgctcaatggaggcctgacgggtgttatgctcaggcatattgttgttgcaaggataggtagggagaggcag

SEQ ID NO: 81496 - DNA, 147 bp, Glycine max
  Peptide Sequence Number=SeqID_173181
atgaatgcaagaatgcacgaatttggtgagggagatgatgcaggcagtgttctgaaaatttcaggcaaagcgctaagcgagccagagagacgtttggtttctcaaagaggttcgcttagcagaactgcgcgcttagcccaagtttga

SEQ ID NO: 81497 - DNA, 465 bp, Glycine max
  Peptide Sequence Number=SeqID_173182
atggagggaaattcagctcttggaattgacctcaccgatagaccttttctttgggttatgcatcaagacaataagagggtataccctaatgaattcttgggaagtaaaggtaagattgttggttgggctcctcaacagaaggcactgaacaaggagggcaatctccaaaatggcaactgtgagaggctggatgcgaacaaggctgaggaattgaacatggaagctgacatgatgagggaggcgcttgaagagaatgttgtactctgtgagccaaacaataatgctgagtctggtgaagttgtagtcgtcaatcatggcaaagaggtgcaacaagaaattcaagaaccaactcataagaacaaagaagatgaacaaattgatgaatctttgcacctcgacttgcctatttgtgatcatatagaagggcatatcctattggcgatagagagatcgagactcagataa

SEQ ID NO: 81498 - DNA, 348 bp, Glycine max
  Peptide Sequence Number=SeqID_173183
atggatgagtggagttcaagcttaggtcatgcttccatgtatggattccttgagcctcagtccatacacaatgcaaaggatagacatactgaatgtcaacaatacattgaaacatgggtgaaggaatcccaacgagaggtttacctaggagcctacttgaatcatgcaatgaagactttaaagactaccgtggatggtaaaactaatcaatctgcacctcaatggattgaagtaaagtggtttggtgatggaacaccattagacaaggagaccataacaacaatttgcaacaaatgggtcaacaaatttgaggttcgacaactacactcatacaatggattgagttag

SEQ ID NO: 81499 - DNA, 201 bp, Glycine max
  Peptide Sequence Number=SeqID_173184
atggacgaagatgagtggatgtatgaaataatgtctgaacgagcggatatggattatgaaaatgcagaagcatgtggtgcgaatgaaccacatacaaaggatcaagctgaaagttttgatgatgccaaaggattacatgaatcatatgcttctcaaagatttactcaagacaaagcaattagagatattcaagatggatga

SEQ ID NO: 81500 - DNA, 372 bp, Glycine max
  Peptide Sequence Number=SeqID_173185
atggctaggaccagaggattaggtcgtgccttaggtcacgttactggcagaggtgtgggccgaggagatcgtgatgattccgatgatgctccacaacgtcgaaggcctaccgcatccgcacgaaggcagcgagtccctgtgactgcggcgcacgatgagccagtggtccctgcgccagatgtagaggttgacgtatttctggatgacccgatggcaccagccgatgtagaggacactggggcagacattcctacagacacaggcgcgcaggctgctgaggatgagcatgagggatttccgggtggtccgagtgacctatccatgctgactcagtatgcgaatcacgttgcttgcagcatatggacaggaaag

SEQ ID NO: 81501 - DNA, 1008 bp, Glycine max
  Peptide Sequence Number=SeqID_173186
atgcagtcccaaatgcaatctcaaggacttgcattgcctccagagcctctggctggttccttagctcctcgagtaagcacaaaggagagttatgttgatccctcaggaaacgatcctgagacgggtgactcagacaggtgcagcttgtacatcgaagcaaatcctgcccgcttggttgccctacgaagagtttataagggatccactgttgttcataacactcctttattccctggccaagtaaagctgggtgtggaagaggttaaagatttagatgctcctgttcctgtagccactgatgaggtttccttagtggggcagacaattcacacattccttgcttggctgatacatctggtcaagcctttatcacaacaggcagttgtgtctctggcaaaaccacctcaaacgccggatcctggggtcgatgatctgctttatctgatgacattgatcatcccagagtttttcttgaggccttaccaagttacatgggatgccaccatgtttggggtctttaatccagacttcccgctctacataaagcacaaagatctctccgaaatcgcacacaatggtcaatgtctcagcatatcagtgttacagttgtggattttgcatctgactgaaacaagtatgcgagcgggaaattctgatctgtatggattcctcaaggcacaatccattcagaggcagtttaaatcagacctcacgaggaaatgggcccttacagtcgatcaggacggtgtggacgacactgtctatgagaaatatgacataagcaaggaaaaatgggcccagttttgccagactcgtagagacccttcttgggaggatgtgcgaaaaaaggcacagaccatccagaaacaaaacactgcccctcacgttttgtctcgtgggggttatgaatatttggagcagaagctcctagctgagaagaccaagaagaagctagaggaagctgcacaatcaggaatcgttgatggcgtcatcgacccttcatccccc

SEQ ID NO: 81502 - DNA, 600 bp, Glycine max
  Peptide Sequence Number=SeqID_173187
atggaagctgaagcagagatcaagcaacgagattatgaggaaggaggagaattagcttgcacagaagtagatccagcttcaaagataggagctacaggctcaatagtaggactagaattagcattgagaagagaactagagttggaatttgaatctgttgtgggatcaacagaagtaggactagcaacagaattgctagagagagagctaggtagttttggtgtagtggtgcttgagattgtaagtgaacttaaggctatggattttaggcaacctgaggtgctattggtaaagaaggttcatgaatttgaggtgagaaaaacgccacttgaggcattagtagatatgggactaaatggagagtacaatttgaaggagttaatgagattgctgaaaaaggtgccaggtcagagtctgaatgagataaatcagttgtatcatgtgagagttgatgactcattagcatgctacaatggtgtcaccgactctactgttgcaatcaaccgaatgtatggaagcatcatcgaaaactcaagcagttcaagaatgaaattgagttgctatgccaacttcatcatccgaatttggtcactctattag

SEQ ID NO: 81503 - DNA, 399 bp, Glycine max
  Peptide Sequence Number=SeqID_173188
atgacatctcatctaaaaggtgttgcaaaatcaactatgtcagatcaaatacctaaggagttgtgtgagtacaagagagataatcctgcaagcacacaaaaagacttgcaaagatggcttgagggaaattttgagttgaaagttagtcaaggaacaatatcaaacacacttaagcggtcagatgactatctctctgttgaaatagaaaagggaagagcagagatcaaaagacacaaaccagcaaaatatcctgacatggagaaagttgtttatgagtggtttctccagcatcaagaacgtgtgaatatcacaggagaattaattttgcagaaggcaagagatacaatgaaactcgtgtaccctcatgatgattcagattttaacttctctataagatga

SEQ ID NO: 81504 - DNA, 789 bp, Glycine max
  Peptide Sequence Number=SeqID_173189
atggcgatggctgctgctctgcgtcgcgaaggaaggcgtttgacccaaccaatcaacgccctccgttcctctctcatctctcaagaccaatcccctcatggcgcgcgcttcatttccactcaagtggtgagaaaccgaatgaagagtgtgaggaatatccagaagatcaccaaggccatgaagatggttgccgcatccaagctgagagccgttcagaccagagctgaaaattcccgcggcctctggcagccgttcaccgctcttctcggcgacaatcccagtgctgatgttaagaaaaacgttgttgttaccatctcttcggacaaaggtctttgtggtggaatcaattccacgtctgtcaagataagcagggttttgtacaaattgaattctgggcctgataaagagacaaaatatgtcatattgggagagaaggctaaagctcaattgttgcgtgactcaaggaaacacattgtgctcagccttactgaattgcagaaaaatcccctgaattacactcaggtgtctgtcttggcagatgacattctaaagaatgtggagtatgacgcattaaggattgttttcaacaaatttcattctgttgtacaatttttgccaacagtgtcaactgtactgtctcctgaggttattgagagagaggctgaatcaggaggaaagctcggggaattggattcatatgagattgaaggtggcgaaacaaaagctgaaattcttcagaatctggctgagttccagttttcttgtgtgagtaattttcaaaaactttga

SEQ ID NO: 81505 - DNA, 174 bp, Glycine max
  Peptide Sequence Number=SeqID_173190
atggataacatgcttatactgcaacatactgaacttaaggcttcgtttcagaaaaacatcaatatggctaaccacaggacaagtttaggtttacaaggaattaatgaaacattgggcttaatccagattttggttgtggacttgaagagggcaaataaagcagcgcttacctaa

SEQ ID NO: 81506 - DNA, 327 bp, Glycine max
  Peptide Sequence Number=SeqID_173191
atgcacaagtatagaatagccttcctagatgcacatcttccatggtggcattgccgaatgaaactaccagaaaatgcacaacaactggcacttgcagacatggagaaatcaagtgaacaagcaacaacaactaagcgtcagaggagaagaagaagaagcgactcagcatgggaaaccaacagctttgtaaaccctaatttatttggggaagaagaaaaagcaaccttgcaggagagagaatttatagatgcagacctcagtgccacgttggacagtctacgtggcactgaattgccacttatgcacctcactaacgccgtcacttga

SEQ ID NO: 81507 - DNA, 558 bp, Glycine max
  Peptide Sequence Number=SeqID_173192
atgaggtatgatgactttcctgagagttttatgaatgaagacaagaagcttaacctgactattcttgataagctccctcgaaggttgttggccaaagcaattgttactttacacaagtcttctactttaatggaggacttgccagctattcccaatttgctgggatggacaccctcgatgaagcttacacaaatgctggccagggcgactgctgttgcacaacacatggtcttgtgcaagtcttcatttcaccaggagatcccaaagctaaataagtccttagaggtgatgaaatctaagaaggatgagtttcttgtcgtaaaccttttgttgactactgataatgaaggtctgaaggttgagaagcaaaaactgaagaggagtgtcaacttgattagtgaacttaaggataagattaataatcttgaggatgctttggaaaaagttgaaaggaagagggatagtgatagggctatagatgaatatgaagttcttttgaggagtgcttggatgaaggtgattgaggaacacaatgctggtttcaaaaaagctatatga

SEQ ID NO: 81508 - DNA, 864 bp, Glycine max
  Peptide Sequence Number=SeqID_173193
gcaaaaggccaccttagggcggttacagcttgcccaggcgagctgaaacttaaccctgaagcagtgagctcgctcaggcaagctggtcccttagccttgaagttatttggtggcccaggggagtcaaatgttggcctgggcgagctggggcctaggaaaaacaaggaaaagacccttttgccctcctttcttggaccaattactttaaaccacaacaaaagaggagagttggctactcatagccatggaggagaagcttttgatggaggacgaatcaaaatgcatccaaagctgtcaccacgtctcgggtctctttctctctctatactttcaaaagtgtggaagcctagactaggacaaaaggcttccaaaattctcccgataaagctaattgtggaatctcctttacttgatctggacttcaaaaaggatcctacaaaacataagcaagcaacccaaagattaagcgcaaaagaaggagatgattttgctgagaatgatgccaaggtgcttgacaataaggttccctttgtcggggcgataggtgacatggatgatgagaaggtgccaccctcggtggtgaagttgttttttcaaaggtctagttatcttagttcgatgaactctggtgagaagtacatcaagtctcaagacacagtaattgtcgaagaggtacctttacccctgctcgtggaggagctcacagaagatcaccaccgtgagaaggaaaaacttctccttcaaccaccatcaatggccataaacgacgacaaaacaccaacaatccagttagaaaaaccaccacaggagcaggcgtctgccatacttagaatgcctatcatggggaccctaaaaaatgagtag

SEQ ID NO: 81509 - DNA, 618 bp, Glycine max
  Peptide Sequence Number=SeqID_173194
atggaagaaacatattctggtatcactaccaacatcaacaacgagcttcatagtaagccaaagcccaggattgattatactctgaaagctattggtggaagtttaacggctattcctggaatctcggatatgattgatgatactgtgaactcaattgttactcacatgctccaatggcctcataggattgtggttcaacttggtggcattcctattgataccagtgaattggagcttaaatcccagggaaaacttgcactgactgtagtgaaagcaactgctttaaagaatatggaaatgattggaaagtcagatccttatgtagttgtgcatattcgaccattatttaagtataaaaccaaggttcttgataaagacattgggcaagataagcgattgggaatagcacagttaccccttattggtctagaaatacaaactgaaaaggagatcgaattgaggctactgccctcacttgatacacttaagctggttgcgctagaagcagaaaagaagatactagaagaaaggaagaaactgaaagaagcgggagtgataggatgcacaatggatgtactagatggagcagtatcagtggtagggtctggtgttggactg

SEQ ID NO: 81510 - DNA, 297 bp, Glycine max
  Peptide Sequence Number=SeqID_173195
atggcagcagaatggagaagaaggaaagatgatgggagacgccacttcaaggagaagatgagtcaagaagaaaggagagatgtttatggtgcttgggagcagtatcttggcttggagcatactgacaatgctcctaaaagatcatatgttgttaatcagaaacatggtcccacgcggcacattccaaggactgtcaaatttcttggaagtccatgtgaaatggtgacatttccacatcccttcatgcataaaaaagtgatgaaatgtcccatagtggctacctgcagtacattttaa

SEQ ID NO: 81511 - DNA, 333 bp, Glycine max
  Peptide Sequence Number=SeqID_173196
gaggattttgaggattccactccgattaaagtgttcctcttggtgtgggggttcggcgacaagaaaaggtggcttgcggcggccaccgatgctcgtgggtggtggagaaagaggtgccaattctcgctcaacgcaattccttctcgggttggaattgcgcttagcgcacccttcgcgcttagagaggcatcaaaagttgttattttcaaaatcccaacgggtgttacaaatagtgcgaccttttttggtcatgcagtatctaaagatgggataagcataaatataaagaaagtggaagcgattcagggttggcctaagcctacatcgatgtaa

SEQ ID NO: 81512 - DNA, 132 bp, Glycine max
  Peptide Sequence Number=SeqID_173197
atgccaccattgtgttgctcactgcatcactgcatgcctgtcgcgttgcactctcgcgctctcgttcttgctctcactcatagctctactcactctcattcttgttttaggtcaagaaaggcaagaagctag

SEQ ID NO: 81513 - DNA, 336 bp, Glycine max
  Peptide Sequence Number=SeqID_173198
atgtggggcacttatcttcgaggactcattcccgggatctggagcgtgccttcagcagatatggaaggatacattcacaaggtgcttcaagtcaaatcctccagaaccttggaactggaatgtttaattacctttgaggttcctgaccctacctcaatcctcactgttttgtctaccacccaacctgtatctactactaatgtcactagccatactaagtcttcaccatccacttctccagatttgtccaacccgcaaccaaccacttcatccactattcctgatactcagtctctcactaccaatattgaccagcttcaaactactgtgttgtag

SEQ ID NO: 81514 - DNA, 615 bp, Glycine max
  Peptide Sequence Number=SeqID_173199
atgacgaaaggagaccgtgtgcatgccaatggacctctggcaaggtactgcctatgtcgacgtatcacaagcgtctggatagactggccagagagggttgtacaacagtttggctacatccaaactattttgccacatcctactgtgtctatggtctctgatgaagaaattgatgatagatggatgcagttcagtgagtacattgcacctgtagggcaattatgtgcagttcctggccactgttcgccagattacatggattggttctacatgaatttgcccccattcatgagtccggcacaaccaggggatcctcctagagtttcgtcgattcagcaatatgacacatttgttaaaccatatgtgtatcagcaaccgatggcgacagcggcacctaatgagtcagaagttgatgtgcatcatattcgacatgcagtggatggttttgtagcaattgctaataagttggaaaggctactgaacctgaggatcctgaccaaaggaacagaagcctatattgttgctgaagaatgtttgggcatcacaaaaagctacattagtcagccaactgtaggtcacagatcgaggcgtaggcggcatacggacgatcattga

SEQ ID NO: 81515 - DNA, 222 bp, Glycine max
  Peptide Sequence Number=SeqID_173200
atggggggtgcagtgatgatgatggatatcgttggtggcggaaataaagtgtttctcatgagggggaatacttgtatttgggggcttgtcacccggtttggaactactcaggggtttggaattactcaggttgatcaccattggagtgggggagttgcctatgcacgacagggtgaccctaacacttattgcctagttttcttaatagagagtgtcgtgtga

SEQ ID NO: 81516 - DNA, 336 bp, Glycine max
  Peptide Sequence Number=SeqID_173201
atgggtcaggataatagaaagcttggggcggttgacaaaagcgaggttgttgttcctacgtgtcctcaatttgtgactatgaactcagacctacgtagttctttcaaaagcaatggtgcggataaccgtaaggcgtctccgcatgctaccggactcttgggtcgtgatagcaaaaggtgtgtgtgggttaccatcgggtgtctccgcatgccatcggactcttgggtcatggtaacaaaaggtggggtggtcgacaaaagcagggcttatgctcttacgtatcctcaatttgtgatgaggaactcagacctacgtagttcatttatcatttattag

SEQ ID NO: 81517 - DNA, 278 bp, Glycine max
  Peptide Sequence Number=SeqID_173202
atggatgttgtaagagcagtatatattggatttatggatgtcatccctgctagagatagggggagcaacatggtgaatcacgcatccaccgctaagtgcagcttcatcgcgcttagcgcgaaggagaatctggcagagcatcagcatcaaggccgcgtgctaagcgcgagatcaggtacaatgctcagggcacagaattccacagcacaccacagtgcctatttcgagaaaatagctctggaggcagcaataggagcagcttttgcagagattcctag

SEQ ID NO: 81518 - DNA, 297 bp, Glycine max
  Peptide Sequence Number=SeqID_173203
atgtcaaatgagagtatctctgttggtcatctgcctgttggtcatctatctgctggtcatctgcctggtcctgttgctgatcctgatgctattggtgagctcctccctcaggcggttaatctctgcagcatcttcagcgcgactggaagatccttgcatatgctgcatgaagctgtcatttttgcatttgtaagtatgagcaaggtctccagtaccataaaggggtcccttatactttggtcctgcaactgcaacccaacaccgactcctaagtctttgttcttcagcagggtctaa

SEQ ID NO: 81519 - DNA, 372 bp, Glycine max
  Peptide Sequence Number=SeqID_173204
atggattcagtgtctccacatctctttttctcctccactttatccgatgctgttgaagatagagacacaaacaacgtaatctcttcatcatcgttctctaacccttttactactagttccacgactttagtggccaaatcagtgtgtgagagagaagaattgcggtttgatgcgctgctggtggtttggggcgaggttatgggttgttatggtgtcacaaacccttgtggccctccttcatggtcttatgtgtactgttctggagggagagtcactcagattcagaccaagaatctagattacagctgcaattccacaatctgtatccacggttgtttcaaggggaaatcagtgttacttaatcacctccag

SEQ ID NO: 81520 - DNA, 276 bp, Glycine max
  Peptide Sequence Number=SeqID_173205
atggccacagatgtcagggatggccaaaaactatggagaatagaggttggggaaggttggggatttgtcacaaaggagaacagtgggtgctactccataaacagaatgcacacaaattctccaattcacctgtatttgatcatgtcggggaaaatcaacacgtcaccgtcgaggaagccagcctcctcacgcacctcgcacacggtgattttcgtctgcaaagtcaaacaccgaagtcaacctcagatcgtagcgaaaaatcgcaaccaaacatag

SEQ ID NO: 81521 - DNA, 138 bp, Glycine max
  Peptide Sequence Number=SeqID_173206
atggttgcagagttagggcaacagacagtggagctctccaccttcgtcacacacgccactaatgacaagtcctctgatatgttttgtgggatgcaaccatatttggggtgtttaatggcaacttccctttgtacatga

SEQ ID NO: 81522 - DNA, 576 bp, Glycine max
  Peptide Sequence Number=SeqID_173207
tcaggtgcaccttttgagggcaccattgttgatgactggaaatttgattattctagtcatgatgctcgccgcatggaggatttgactctaatgtgggcttttctcaccggtcgtcagatcgactgggcccatttggttcggtaccgaatgcataaggcattacgggccaatgcacctctaccttatccacagttgataactttgtttctgcgtcattttcaaattccgcttgatgatgagccattcgttcaagtcaagcgttcctttgcaattggtgctggtgctgtgacttcctttggttaccgtaaggatcggaatggtcaatggctgaagaaagacgcactccctcctcaagatgagcgtactccttcacctcctcctcagcgtgaagattcagctctcctgaatgaagttcttaccgaattacgaggtcttcgttcttatgttggtgaacatttcgactcattggatacacgctttgcgggcatggatattcgcctcacacaagttgaagaagatgtctccttcatccgtacttgctttgatccaccaccaccgcctccatcatcctcttag

SEQ ID NO: 81523 - DNA, 285 bp, Glycine max
  Peptide Sequence Number=SeqID_173208
atggtggtggtgtggcggagtaggatcgatggagagaggtgtgagggaatggtttcgtgtgaaagagaagaaatgcagagacaagaaatggagagactgagggttcgttgtctgtggagggaagaaaaaaagaaagagagtgaggagtatgggaaaaagtgtggagggaagaaaaaaagaaagagagtgacgagcggaacttacaagacgagccttaaagacatagaaatcacggaagtgaatcttgtgtctctcaattgtaacaccttgaaattttcttcttaa

SEQ ID NO: 81524 - DNA, 305 bp, Glycine max
  Peptide Sequence Number=SeqID_173209
gtggtccgacggcaagcaaaggcggctcatggcggtcaccggtggtggtagaggaggaggttgaggaagggtttagggagcaaaggactcaccctacaactaacaactttcatgtaatgacgatgccaagtacaccgaggcatctacgggctcagtgtagcttgcaaagagagcgggttatagaggatcgaggtgaccattcagacatgtcgtccgaggagatgaaggagtattgggaactattgaggcagttgaaatcggcgtctgaggaggaaagtgacaattctttcgagagcacttattag

SEQ ID NO: 81525 - DNA, 399 bp, Glycine max
  Peptide Sequence Number=SeqID_173210
atgagtattcttgcttctttcatctatctatttttctactctgcttcactcgcactctctctctactctcacccacaggttttacctccgcaaccagcgggtacaatcactggtcataaccatttttcctcacaccggcattactcagtttgggaaagagactctgaatttgggtccaacaccgccttgaaagtcatcgttgtgactcacaatgcccagtgtggcatcaatctccagtggcatgtccatggtggcaaggtgggagaaatgggatatgtacgagaacgtgagatacagagaagagagaaaggatatacgggaaccgagaacgtgatcactaaggagagagaaataggatacatgaattatggaggagagaaaattgagattttattttaa

SEQ ID NO: 81526 - DNA, 342 bp, Glycine max
  Peptide Sequence Number=SeqID_173211
atgttgtacaacagatgtgtataccctatatttaacattagtttgacagcagagaccttctttaattacatcagcagcaacccaaaaataaacccccacacacctgccctttcagaaagtgaatgtgacaatgttgataagatatacaagaaggtgtcttctggagttagacctgctgccttgaacaaggtcaaagatcctgaggttaaggctttcattgagaagtgccttgctcagccaagggctaggccttctgcagttgagcttctcaaagatcctttctttgatgagattgatgatgatgatgacaaaaatgatgattgttcttgttcatatcaatag

SEQ ID NO: 81527 - DNA, 366 bp, Glycine max
  Peptide Sequence Number=SeqID_173212
atggcgaacatgatactgatgcaggcagaccagacagtgaactttaagttgatgatggtgcagccaatggcatgtccatggtggcaaggtgggagaaatggatatgtacgagaatgtgagatacaaagaagacacaaaaggagctacgagaatcgaatcgctaccacaaccatcaccatctctgccgccaccactactataattgttgtcatgaccatcgttgttgccaccaacttgattattgtcgccgccactggcagaggcgatagtcatgttggtggcaatgacggtggtcacggaggtgatcatagtagtggtggtagtggtagtagggatgatgatggtgacaatagtcatgttgggtga

SEQ ID NO: 81528 - DNA, 340 bp, Glycine max
  Peptide Sequence Number=SeqID_173213
atgactagaggcaatccatctaacttacaaccctttgatcttgagatagataggacatttcatagattagttaggcatcattttgtaccttttgagcatcctgagcattctgttattggtgagtctaagcattcagaggttggttatagttttgaacattttgattttgaacattctgagaacatggcacaacctccaccccgtgagaggactctaagggaaatggctgcacctgatttcacctacgaaagcttgtgcatccaataccctgatgaggatgtcccatgtgttcttaaaactggactaatccatttgcttccaatgtttcatggccttgcag

SEQ ID NO: 81529 - DNA, 72 bp, Glycine max
  Peptide Sequence Number=SeqID_173214
atgggtcgtcgtcccttgcctagctctggacaaatggaaagcgccgctgcaaggacagcacgtagaggataa

SEQ ID NO: 81530 - DNA, 466 bp, Glycine max
  Peptide Sequence Number=SeqID_173215
aagacgatgttagtctctacgtgcttttcaggcttttcgtctacagacaacaaaaaatttatacggataaccacctcgggtttttccgtcgtcagcgtgactcaaaagtcaatatgacagatcttgtgagcgcggaagatgacgcttttcagtcttacagacagcaaaaagtttatacggataaccactcgggtatttccgcccgtcagcgtgactcaaaagtcagtatgacagatcttgtgagcgcggaagatgacggcgcagaagacgacgttagtctctgcgtgctatcaggcttttcgtcttacagacagcaaaaagtttatacggataaccactcgggtatttccgcccgtcagcgtgactcaaaagtcagtatgacagatcttgtgagcgcggaagatacacagcaaaaagtttatacggataaccactcgggtatttccgccgtcagcgtgactcaaaa

SEQ ID NO: 81531 - DNA, 813 bp, Glycine max
  Peptide Sequence Number=SeqID_173216
atgagatcctgggtaaggggtcagtggatcccgtttgatgccgacgctatcggccaactcctaggatatccgttggtgttggaagagggccaggaatgtgagtatggccagaggaggaaccggtctgatgggttcaatgaggaggccatcgcccagctgctatgtataccggggcaggatttttcccggactgctgcagggaggcgagtgcgaatcatgcgcaccaacatgaccaccctgacccagatatggatgacgttgctcctcagcaacatcctgcccaccgatcataattccgaccttcccatgccgaagtgtcagctggtgtacgccatcctgacacggatgagcatccatgtggctcagttgatcgctgatgccatctatatttttgcaggactctgccagtcgttcggagtccccgttgcccctaccaagagacaggctcagggtgatgctccacaggccgcaggcgcgccaccaccacctcatcaggctggccaggctggggcatttgacatggagcagtatttacggcatttggttcgccagcaggcggccaaccaccgagcacatgtacagacccatgattgtctgtaccagatgagccttagcatgcagagccagggcttcgcttctttttcatgccctactccagaccagttcagggcagaggttgcatggcccggagattggcccgaggcccaagcaggagaggcacccccagaagctcccggcgatggagaagaggcccacgaggacgaggagatggtcgatttgcttgacttattgggagggagtggagatacgtga

SEQ ID NO: 81532 - DNA, 477 bp, Glycine max
  Peptide Sequence Number=SeqID_173217
atggggacgaatgcaagtggggatagggtcacgaccgaccgattgttgccccttcccggcgttaaacagggccctgggatttcccggataagtccaacagggccctgggataagtccaacagggccctgggatttcccgccttgatcacaggactctgtcagtcgttcagagtccccgtcacacctagcaaggtgattcggccgcccatcacccgagcttttattgagaagtattgcacacagagacaggcccgggggaatgctccacaggccgcagacgtgccgccacctcatcaggctggtccagccggatcgtttgatacggagcagtatttgcggcatttggttcgccagcaggcggccaaccaccgggctcatatacagacccatgattgtctttaccagatgagcctcagcctgcagagccagggttttacttcttttctgtgccctactccggaccagtttagggcagag

SEQ ID NO: 81533 - DNA, 378 bp, Glycine max
  Peptide Sequence Number=SeqID_173218
atggtggggtacgcaccttcaagctttgtggatttggacttcgccggggaaaggatcgaagcgggtctgaaaagagacaaatttgatcatcctattttgatgaatgagaaaactagggcaaatgaagaggataagaatgaggaaggaacccatgttgtagcttccattcctacatggccaaacttcccaccagcccaacaatgtcaccactcaaccaatatcggcccttctcattactcatcacccaatcatcaacaaaagccatccccaaatcagccacaaggcatgcctgcttaccacacacctaatgcccaaacaccacctatagcgcaaaccaaaaaggaatattgcagcaaaaagcctgtaggatcaccctaa

SEQ ID NO: 81534 - DNA, 207 bp, Glycine max
  Peptide Sequence Number=SeqID_173219
atggcctcctatggtggtgagctttcttctagactcatcttctccttgaagtggcatctcctctctctcttcctttctccattccgctgccattcatcttccaagaagcaaaggaatccattgatgaagaagatcctaggcctacaagctccaatggagcttgcatcagtgtctttttacaaaagagaaaatgtggaggttgtctaa

SEQ ID NO: 81535 - DNA, 48 bp, Glycine max
  Peptide Sequence Number=SeqID_173220
gggtccttagaagtaaaaccctcaccattaacactagatgaagaatga

SEQ ID NO: 81536 - DNA, 327 bp, Glycine max
  Peptide Sequence Number=SeqID_173221
atgaggggcaactgtcataccctaatttcatccggggaccattgtttggtggcatgtaaccttcgcttgaccacctcgaggtacttaacacccgtcgttaggattctctcaaaatccaagccgaggtgcttccgtaacgctttcgtgaagattcttcaccgttcttcgtcgttcttcggtcttcaaccgaccacaccttttcgggttttccaacattttcctcgaataaacgttggtggcgactccgcgcattttcgtttcttggatgacacacccgtgagccccgcatcgccttcccgccgaagggtaggttgcgacaattggtaa

SEQ ID NO: 81537 - DNA, 314 bp, Glycine max
  Peptide Sequence Number=SeqID_173222
gtgctgctactggtagaggcacttcaaattgcttgtcatacctcaagccatctgccccatttgatttgttagactctgaatggaggctcttgtttcttgttgaaattgcatattctggatggtcatttgtctcactaactcttctaaggaaggttgaggaggggcctcagttgcttgttgtctttgttgttgttgctgctactactgttgcattggaggaggaacatatggcttgcttggaccagcaacattctggaaaggagggacaggttgttgttgttgtggaggacttgtccatctcagatttgaagaag

SEQ ID NO: 81538 - DNA, 228 bp, Glycine max
  Peptide Sequence Number=SeqID_173223
atgatgacaaaggtgatgaacaaaaagctcaaaagatcaaagaacaactcaagtgaatcaagaacaagtcaagagttcaagaatcaagaagaattcaagactcaagaagaaagcctacaatcaagaatcaagattcaagattcaagattcaagattcaagattcaagattcaagattcaagatctcaagaatcaagatcaagattcaagactcaagattcaagaatga

SEQ ID NO: 81539 - DNA, 246 bp, Glycine max
  Peptide Sequence Number=SeqID_173224
atgtccaaatcttgtggatttgggatgaccggccctctcgatgagtcgatctcttgctttctcataagggtggacccttgggtacttgtacctatcaccttgagaggactacatgtcctcgccatcagaggactgcatgtcctcaacttcagagggctacacgccctcgccatcagaggactacatgtcctcgccttgagagggctgcacgccctcaccttgggtactagttaccctccccgttga

SEQ ID NO: 81540 - DNA, 147 bp, Glycine max
  Peptide Sequence Number=SeqID_173225
atgatagccctcaccattgaacataagaggcctatttatagaatttccctcacgaaatggaaagtgtttgcccaagagtttcttttgagagagcatttgacaatgaagttctcttggaatctctctcattttctattgagaggataa

SEQ ID NO: 81541 - DNA, 372 bp, Glycine max
  Peptide Sequence Number=SeqID_173226
atgttaggattcacaaacgattctcctcaaatttcagctagcccgcatcaattagactttgcaccttacgtttcagggccctacaatgctcaatggaatgccctggggctcctccatgataagcacgcgttgcattcgagtcgtatcctcggagaaatggaggttgaggaaccttggttggggttatggctaccattgaattatcgagtggatatgggagcaagtcatcataggacaccggaattagggtggatttttatagttgatttagggaaacttggtcgtataggaatggcagtcacagcatgggtttctccctcattctcaccctcttcatttgccccagttttctcattcgtccaagcaagatga

SEQ ID NO: 81542 - DNA, 291 bp, Glycine max
  Peptide Sequence Number=SeqID_173227
atggttgattcagaaatctataaacagatttacactccacatcaataccacaaagagatcagaagaaaaagacctcagtacagaccccctataaagaaaaacccaactcgtaggtattcaattagagcctttaattctagaaaacctactctcaataacgacagacatgttagaaagattaaggatactaaaacctatacaaaacaactagaatgttatgcttgccatcaaccaggacattattccagagactatcctaacaagaccaatctatttactagagaagcataa

SEQ ID NO: 81543 - DNA, 498 bp, Glycine max
  Peptide Sequence Number=SeqID_173228
atggctccctgtaagataaaagccacagttacattgtcccaggccagttatgactcatccagatttgtatcaagggatgcgtgggaccgttacacagataacatcatcgatcagaacattcttttgaagaggaatgtgaagctatacattaatgagtttgatgacttcaaaagagaagtcgagagaaggaactggcacagggagctcactaatttttctgatggaagcatcgatgtggcaattgttaaagaattctatgcaaacctatatgtccctaaggacaaagaacaaaagcaagttagggttcaaaggcacctgattaagttcgatgcggactccctcaacactttcttgaagactccaatggtcttggagcaaggggagaacttacctttttactctaggttctgcaggttgaggccagaccctcaagagctggcaggccggttgtgtatcctaggaaggggatttgttcttaacaccgagggcttgccgtga

SEQ ID NO: 81544 - DNA, 141 bp, Glycine max
  Peptide Sequence Number=SeqID_173229
atgcctcacaatggggagaccagtcagggtcacgctgttttgcgagaatactcaaaccggatgacccccaaggcctacactccgaagagtccgtcagggcctctccctcctgattcaggtccaacaaaaaaaaacatttga

SEQ ID NO: 81545 - DNA, 150 bp, Glycine max
  Peptide Sequence Number=SeqID_173230
atggagaatgctaagcatatggctataccaatgagtactgcttgctatttggataaagatgaaaccggtcagtcaatagacattaagcaatatcaaggtttcaatcaaatcccaaacaatcacatcttagtgccgttaaaagaagtataa

SEQ ID NO: 81546 - DNA, 285 bp, Glycine max
  Peptide Sequence Number=SeqID_173231
atggagtcaagaatgacaaaggttgaagaagatccttgtattttggctatattattatggtatttgaacaatttactatttccttatttgcatgaagttgtcatcatcaaaaagggggagattgtagaagcaaagcttcatggtgaatcaaaggtgattcaaaggtgttttgatgataacaatgatgatgacagaggtgatgacaaaaagctcaaagatcaatcaaagaacaaattcaagagttcaagaatcaagaagaattcaagactcaagaagaaagtctag

SEQ ID NO: 81547 - DNA, 375 bp, Glycine max
  Peptide Sequence Number=SeqID_173232
atggatgggcacacagatgcgaccctgatcaaggaattttatgtaaacctgtatgatcctgaagacaaatcccccaagcaggtcagagtgcgggggaagatgatcaaatttgataccgcctctcttaatgcttttttggagacaccaccagttctggagctaggggagcaatatactacatataccaggttctacagcactcgcatagaccctcaagagctggccgccagactctgcatcccagggaagggatttatacttaatgcagagggcgcaccctggaagctcttgaggaaggatttgactacattggcacagacctggagcatcctatcatattctaacctcaccccacctctcacacgtccgatttga

SEQ ID NO: 81548 - DNA, 1005 bp, Glycine max
  Peptide Sequence Number=SeqID_173233
atgttgtcttgcctcattggtgaaagttcaaatgatgacccttctcaccatcatggtggctttgatgctaccgatgaccaagggtctagtgttgtggttggtggcatcattgctattgctgacgttgttgccaccacccgtcccaacataagggtggacgaggccgagtcacctttgccgattccccccacaaatgtcattaacttggactcgaagactactactgtgcatgtttataatgaagtcagaagctactctactagctttttgacttatgagtcgattaccaacttcttagaagaagtcaagtttcgtctcattgatggtccaaatgtgatgatcatcgattcttgtcttaagagtgaacacatcttcatgtgttcctactcggccaagacacacttcatttctaacactgtttgtctcattttaggaattatgcccaagattgattaccaatccgtcaaaaagacacaggctgagaaagaagtagttgagaaagctaaggctgacaaaggcaagatgaatgttatggtggaagaacagtgggtacctcttgtttcactgttgaaaacttgttccattgcgccatcctcatccttagagacctctacaagcagtgtggcagtaggtgagacctttggtgtagcctcacctccccccaaaggagaaggctggactcctggccagccaaatcatggatactctgcatcaccaggcataagccatggtggaggctctatagcatcggcactagaacgtgctggaactaatgttggagcaggaatgggagttggagctggtggtggtggagctgaagaaggagtagaagaagaaggggcagaagcgtccgatggtccccgagccctagctttgcgggtccccggaaaagtgatcgtgggatcatccggggactcgaaggtcaatgagtatggaactactcctcaggccatgcacaaggctgtgataagtgcagggaatccgagcctggaggagttggactga

SEQ ID NO: 81549 - DNA, 597 bp, Glycine max
  Peptide Sequence Number=SeqID_173234
atggatgaggttgttgttggtggtaatgagggggacatcatgcaaggttttaacttcataaagttatgggctcaaacgtcagaggctaacaaacacaatatacccccagcccttgtcgacttggtgaaaccaaagaagaagaaagaaaatgaaaaagaggttcctgagaaggagatcccaaggattattaatgtggaaaagcctactactaagagtagagatgttgatgtgatacagccacataatattgatgagcttactactaactctgatgctgctaataagaatatggagaagccgaccacttcctcattttctccaactcctccaatccaagaccaaggtgaagagagtgttcctcaaaatactttgtctaaaagcgaagtggaggctagtttagaagaaaggaggaacttagtcaaagctctcaatgagaaaaactcgttaatgatcaagaaaattgagcttgttaaggccattgaaagtcttaacatgaaattcaacatttcaatcaaggacttgctaaagactaataataatgtcaatgcattgaacaatcaactgactactgaagaaaagaagaagaaaaactcatga

SEQ ID NO: 81550 - DNA, 123 bp, Glycine max
  Peptide Sequence Number=SeqID_173235
atggtgaaacagatcaagaaaattttaaaagattttgcgggggaggatgtgagacaatctcattctcctagggtgtctctagcaatatataagatattctctatcaggaacaattttatctaa

SEQ ID NO: 81551 - DNA, 654 bp, Glycine max
  Peptide Sequence Number=SeqID_173236
atgggaaaatggggcttacggcgacggcttccgaaagatccgttaggggttcttccggaacttccggaagaagctgttaagaaaccaaaggtctttcggaagaacccttcttccggaagtctcccggaacacctcttccggaaagtttccggaagaagtacttcttccgaaagaattccggaagaagggttcttacggatgacctttgagatttcaggaaaaacacgaggtttaggtcgtgctataggtagacttataggcagagatagacatgatgaccatgatgcaactgatgttcccgagaggcgtaggcctactgccttagcccgtaggcaacgggttcatcagatgattgcggatgcatgtgatatggctaaggatgttgctgacatgactgaggatgtccctgatctggctgaggaggcacctaagatgcgtgcggatgtacagggtgctgatggtgctgaggggtcagatgctgatgatgctgagggataccctggtgggccatgtgacccgtcagtgctgacatcatttgcggaccatgttgcacacgctgtttggagtggacatgaatgtcctgatttgaagttggtgtcacatgggaggaaggtgacattgattgggaggccggtgcctgagattgaaggactg

SEQ ID NO: 81552 - DNA, 306 bp, Glycine max
  Peptide Sequence Number=SeqID_173237
atggtagtagatgttactgaggttctttgtgagctagaacttactataaagaaagtgaaggtatctactacacctgatggaaaagtgatagatctgtttttcatcatagataccagggaacttctacaaagaaagaagcgaaatgatgagaatcctaaaacaacccaaatacagggacctatgaccccaggagtaggaccaaacagttggtggataccctccaacaaatggtatcaagcatacttaacaagacccaagtggagaaggttgaaggcccagaggcaaaggcactaccaagaattttaa

SEQ ID NO: 81553 - DNA, 285 bp, Glycine max
  Peptide Sequence Number=SeqID_173238
atgcctcagaaaaagaatccagatctgatggaacttgtttgtgggaagtctgctagagtcataggggatcttgttactcttctcacattgtgcaaaggacttcctcatgcttacgactgcaatttgcagaacaggtcatctcctctaaaatatgtttccagcaaaatctgtttagatttcttgaaaccttttctaagaattggtgaagagaccaaggcacaatgggaggatgatagctcaaactgcaacaagtttgaaggcaaaaattttagtcccatcaactag

SEQ ID NO: 81554 - DNA, 279 bp, Glycine max
  Peptide Sequence Number=SeqID_173239
atgagtattaaaggtggtgccggtggagctagcggaggtgttagaatctcaacctccagggaagccggtgggtctactactggtggttgcgactcagctggtgcaggctctgtccttgttggtatgggactaaggggcacaacctcgggagatctaaaaattgatccatggatactattggcctgttatgagacaactgctgctggtgggttggatgatgaagggatgtcttcagctcttgttctctttcttgaggccatctataagaaaagaatgtga

SEQ ID NO: 81555 - DNA, 255 bp, Glycine max
  Peptide Sequence Number=SeqID_173240
atggaattgcaagtcgacatgcggttcgatgccatggattcaaggatcaccaaggttgaagaagatgtctccttcatcccttgtcttgatttcagggattgtcatcatcaaacagggggagattgtagacaaaggatcaagctgaatgttttgatgatgccaaaggatcacatatttctcaaagctttattcaagacaaagaaattaaagatattcaagatggatgatcaagacagtctccagagtcttaggtag

SEQ ID NO: 81556 - DNA, 189 bp, Glycine max
  Peptide Sequence Number=SeqID_173241
atgggccttcagggcttctgtaaaattctcgtaaccctggggtgcatcaggaaacttcctgaggaaaccacctgcttgcctgggcgagctgggcggcaagctccgccccctttttctataaataggccgagggggctgttccaaaggacccctgacccctatgctatgcatttcaactatttttggtga

SEQ ID NO: 81557 - DNA, 241 bp, Glycine max
  Peptide Sequence Number=SeqID_173242
ggatgggttgtccctgtgtggttcagactttgtaaaggattttacaaagatagtggaaatctcaagtgggttgcttgagtactggacgccacaaggtccaacatatcctcccatatcaaatccttctaagtggcagggacttccttcaaagtctcgattgacgtggaccaccggtctctctgccccaggtggtctagtggccaaggatcatggtcgtgtggctttgcatgtccgcttcaag

SEQ ID NO: 81558 - DNA, 354 bp, Glycine max
  Peptide Sequence Number=SeqID_173243
atgtatcttttcttgttctcagtcacaacaacccaagtagatgtattctctacttgtaccacaaaggatgtaccctccaatgtgtttagacaaatttctcaggcggttagtccttcaaaactttgtgaaggggatacaaaagatatctcaggcgggagaagagagacacaaaaagaatttagacggttagtccttggcgaattctttttggcaaagggagaagagaataaaagatatagcacacttctgttttcaaggtttggaaaaccagaaaactttagaaagcttttgcaaaggaagaagaagaagaagaagaagttcaagaagatgttcaaagagattcaaaggttgtaa

SEQ ID NO: 81559 - DNA, 224 bp, Glycine max
  Peptide Sequence Number=SeqID_173244
ctaaaacccaaaggaatagaggagcaatggggaataagtggtgtcgcaacctacccttcggcgggagggcgatgcggggctcgtaggtgcgtcttccaagaaaggaaaatgcgcggggtcgccaccaacgtttattcgaggaaaatgacggaaaaaccggaaaaggtgtggtctacgaactttaagtatgaaaggttcgggagtggtatttacgcacggggaag

SEQ ID NO: 81560 - DNA, 141 bp, Glycine max
  Peptide Sequence Number=SeqID_173245
atggtaggtgatgaggacatctccaccaaggatataaccacgccaagaccaaatgacaagatgagcacttgtcataggatgaagattgtctttgccttcgcctcctgcacagcgtccaattcaaacaagcataatcattga

SEQ ID NO: 81561 - DNA, 477 bp, Glycine max
  Peptide Sequence Number=SeqID_173246
atggtagccataaccccaaccaaggttcatcaacctccatttctccgagaatacgactcgaacgcaatgtgtgcttgtcatggagaagccccggggcattccattgagcattgtagggctctgaagcgtaaggtgcaaggtctaattgatatgggccggctgaaatttgaagagaatcgcgtgtcaatcctgacattgacaagagatgccacacatggggcaattttgaaagctgtttgggtgcaagccattggtctgtttgctcaagcgacctgtgctcctgagtttggacttccaagaccgttcaatcagagattactcatcttgcgcattggtggggctgtcgtaaaacaacaaggacaacccttcccttgtgttcaagaatcccctacaacaagagacccacggtctcttaatcccttttcagaaataagaagaagagaagaagaaatctctcttaaaagagatagattgtaa

SEQ ID NO: 81562 - DNA, 434 bp, Glycine max
  Peptide Sequence Number=SeqID_173247
tgatcacgggactctgccagtcgttcggcgtccccgtcacgcctagcagggtaattcgcccgcccatcacccgagcttttatcgagaagtactgcacgcggagacaggtccagggtgatgtaccacaggccgcggacacgccgccacctcatcaggctagcccagtcggattgtttgatatagagcagtatttgcggcatttggttcgccagcaggcggccaaccaccgggcacatggctttactcctttcccgtgccctaccccggaccagtttagggcagaggtcacgtggcctggggattggcctgaggcccaggcagcagaggcaccagcaggggccccagcagaggctcccgatgaggcggatgaggcccgcgaggatgaagagatgacagatttacttgatttcttaggagggagtggagccgcatga

SEQ ID NO: 81563 - DNA, 429 bp, Glycine max
  Peptide Sequence Number=SeqID_173248
atgtgggcacctgatatctatgagggttcacccaccccggttacagcattcctttctattgcgcctaaaatttctatttttgctaatatttcacgtgtttctatttatggttcctatggagctacattgcaacaaatcttctgtttctgcagcattgcttctatgattttaggagcactggccgccatggcccaaacgaaagtcaaaagacctctagctcatagttcaattggacatgtaggaatacccccgttagccggcttttgtagcaaattctatttgttcttcgccgctttgggttgtggggcttacttcctagccccagtgggagtagtgactagcgttataggttgttgggcggccggaaggttgccacgagtaagtcagtttgggggaccgaaggctgttctccgtgcaccggacacgtag

SEQ ID NO: 81564 - DNA, 315 bp, Glycine max
  Peptide Sequence Number=SeqID_173249
ggtggtgtttgcgctttggctaaaggtagtttccctttaggattggtagctattttggtcattgatgcattttggatcattgtttgtaaatttgattcagaatcatcatcagattctgaggcaatgtctgcccaagattttttgattatttttggaaatttggtagatgacccagcctgggttggtgacccagaagaggttgatgatttcttagtggttggctccgaaagagccagtcttgatcctttgcctgtacttcgtcctccccttagggagattcctgatgccttaggaggcattaccacttttctgtaa

SEQ ID NO: 81565 - DNA, 334 bp, Glycine max
  Peptide Sequence Number=SeqID_173250
atgggaaccaaagattacaaaatcaaggaatccaaggacttagctacaatgacgatggaagttctcttcggtaaattacttgcatatgaacataagttgattcaacaatctcatgtagaagaaacagaaaagaaaagaaagggaattgcactcaaagtcaactcctcaaatgaagattacaaggatatgtccaacagtgaagaagaggcagagaatttcaacttaatggtaaagaagtttggaaaatttctcaagaaatccaaagacagaaaattctctaaatccttcaagaagattgagaacaacaacaacaacttcacatgctttaaatgtg

SEQ ID NO: 81566 - DNA, 522 bp, Glycine max
  Peptide Sequence Number=SeqID_173251
acaccagcggtcatcgaggaaggggagagcctgctctcttactccaagttctgcaagttgaggccagatcctcaagagcttgaaacccacctatgtatccctaggaggggatttgagctgaatgcagacgggatgcctctgaagattttgaggaagaatcttactactctggcccagacctggagtgttctatctttttctaacttagccccgacatctcatactttagatattactttggatagggctaagttaatctacgggcttgtaatgcagatgaatatggacttgggatccctcatcttagatgaccctttagtcactttttggggaacccgcaaatctagggccagaggatttgaggcaccatctacttcagctccccctacctcagctccttctacctctcctctctctccagcaccagcagctccagttcttctagatccttcttctcagagcttcgagccttccttgtctatgctgcagagcctgcatcagggccaactcctgatcatgtag

SEQ ID NO: 81567 - DNA, 852 bp, Glycine max
  Peptide Sequence Number=SeqID_173252
atgcagtgcgccgacgatctggctggcgaaatagatagtgtcgacgccctgttaaaatttggcggcgtgctcgcctttgccgatgatgaggatctggaagcgatcgacgtgggcgtagaacggcccggcgcgggtggcgcaggtgccggtgggcagctccggcgcgttatgcaggccaaataccgccgcaacgttatccagcgcgccagcgtcgatcaaatgccgggcaccgaagaaggtctattccgccggctggaagaagatgcacaccgtgccgggcaggtcgcctcacgcgctttgagcaggtgcgtgcatcacgccgcggttttgcgagctgaagggcacgtcggcgatttcgtcgatcggcagggcgtcaatgtcaccgcgcagcgcgatgatcggccccttgccgctgccaatctccgccacgacgccggttttcagcgccaacggcagcaggcgaatgcccgcctcttgcagccagcgggtcagccgggcggtggtggcgaattcgtgattggaaagctccgggttttggtgcagctcacgccgataggcgatgattttgtctgccaactggctggtcataggcttggctcacagtgggaaataaaccctaaccctagtgcagcggccgccgaagcaaaaagaccatctggtagcgttaagtggtttaatgaatccaaaggcttcggtttcattactccggaagatggtagcaaggacgttttcgttcacttctctgccatcgttagcaacggtttcaaaacgcttgctgaaggccagcgtgtagagtttgaaatcacgaacggtgccaaaggcccatctgccgctaacgttactgctatctaa

SEQ ID NO: 81568 - DNA, 765 bp, Glycine max
  Peptide Sequence Number=SeqID_173253
atgattcctggtcaagcccctattcctgagaaactggtccccaaaagacaacagggagtgaagatttctgaaaaccctagccttgcaacaagtcctagggaagtagacatggagatggataagaagatccgcagtattgtgagtagcattctgaaaaatgcttctgtccctgatgctgataaagatgaatcaacagaggaagaggatcaagccacagaggagacccctgcaccaagggcaccagaacctgctccaggtgacctcattgacctagaagaagtagaatctgatgaggaacccattgtcaacaagttggcacctggcattgcagaaagattacaaagcagaaagggaaaaacccccattactaggtctggacgaatcaaaactatggcacagaagaagagcactccaatcactcctaccacatccagatggagcaaagttgcaatcccttccaagaagaggaaagaaatttcctcatctgattctgatgatgatgtcgaactagatgttcccgatatcaagagggccaagaaatcagggaaaaaggtgcctggaaatgtccctgatgcaccattggacaacatttcattccactccattggcaatgttgaaaggtggaaatttgtatatcaacgcagacttgccttagaaagagaactgggaagagatgccttggattgcaaggagatcatggacctcatcaaggctgctggactgctgaaaactgtcaccaagttgggagattgctatgaaagtcta

SEQ ID NO: 81569 - DNA, 204 bp, Glycine max
  Peptide Sequence Number=SeqID_173254
atgaaaattttgatgaccaatacttcaacaccctatcatagaggagagcctgaaagatcatcctttcttacccataatgcattgggtatcatggctcatttgcagtcattaccatggtgcccaatgcatgcaattaagaaggcgatacagaccttccggcttcccgtgacaatgatgacgaaaacaaatgcaatgcatgagtga

SEQ ID NO: 81570 - DNA, 84 bp, Glycine max
  Peptide Sequence Number=SeqID_173255
atgaagaaacaacaatggaggagaagccatggagttgcagtggaagataaaggagaagaggtgaaaggaggtgccatccactag

SEQ ID NO: 81571 - DNA, 273 bp, Glycine max
  Peptide Sequence Number=SeqID_173256
atgactaaggcaatccaacaaatctcgcaactactccaagggggcatcttaaagaaaccccaacaggcgttcatgtgggaagaatgcaaaggaggctatcaaacatcaaaatacactgatgtaccaatcgaggagaggtttccaagacatgcattgaaactacaaccaagcgagagacaaaaaaccacaacaaagaccaaatttttgggaccacctcgcaaagttggaagaagccttgacaaaactcaccgaagtggtcatcaccaaccataa

SEQ ID NO: 81572 - DNA, 468 bp, Glycine max
  Peptide Sequence Number=SeqID_173257
atggcgcttattcctaaaattgatattcctattagtatgaagtactcaaaactcatcgagcaatctgcctttgttgaaggtcattctattattgataatgttctagtgacaatagaaactattcaccatatgaagtacaaagttaaaggaaaaactgttgattacaatgtgattgtcgctataaagggactaagaccttttttacttggggactctggagggaggtttattgctgcaagacctcaagtctatcaaggagatccgacacctcaagaagcaaaagtagtggctagtctaacagctctcaagtggatatcaaattcgcaattggcaaatgttattgtggagttagcttgcaaagcaaacatggaggcaataaacataaagaattttgcgaataacaaagctagagatagactaagacaatgccttgacaacaagaactctttaatcaattatcagacataa

SEQ ID NO: 81573 - DNA, 483 bp, Glycine max
  Peptide Sequence Number=SeqID_173258
atggttaaattggagggggacatcaaccaagatgtgactttgtataagaaagctttgtattacaactggcgttacgtcgatgccatgtatattcttggggttgcatatggtgagatgcttaagtttgatatggccattgtattctatgaacttgcctttcacttcaatccacattgtgtggaagcctgtaacaatctcagagttatatataaagatcgtgaaaaccttgaaaaagctgtagattgctaccagcttgctttgtcaatcaaacctaatttttccctgtcattaaataacctcaatgttgtatacactgtccaggtatatgagcatataacgtatgacaacctaaaccatatatccctggcctcatttactggaaggcaagagcagactgttataacatcttctttgtcaaaatcatttagcgtcatatgtaacgggtcaaagttgtatgaaccaaactacactggaagtttttag

SEQ ID NO: 81574 - DNA, 615 bp, Glycine max
  Peptide Sequence Number=SeqID_173259
atggacactgatttcgcagtgaggagcatcaatgccactttgagtttatcaaagattggtccttccttagaacccatgcccaattatgaccctgaagatgtcctagaattatatgctaatgcatggcctattgaggagggagttcttgataagcgctccaaagtgcgaggccaatggattccttatgacaccgatgctatcaaccaatttttagggaatccgttaatcttggaagaagggcaacaatatggatatacttcccgaagaggtcagactacaagttttgatgaagaggcaatagatgtcccaccaccaccaccacagcagccgccatccttggagtccatctcagcacacctacagaggatggagctccaaatccacacttacatgcgtcatttggcttatcagcaggcaacaaatcataggggccagatgcagttgaatgacaacttctactgctatacactgcaccagcatcaccaggaccctaacccttacctttggcctactcccaagcaatttagatctacagttgcaaggcctggagacaagcctatttttaaggagaaggaaattgagctccctaaccatgatcttcagaaaaagttgtga

SEQ ID NO: 81575 - DNA, 297 bp, Glycine max
  Peptide Sequence Number=SeqID_173260
atggcagaaccatcaaagaagcgaaagggagttgcgacttcatcagcagtctgtcgcaacctacccttcggcaggagggcgacacgggggctcacgggtgcgtcttccaagggaggaaggaaaatgcgtggagtcgccaccaacgtttattcgaggaaaacgtcaaaaaaaccagaaaggtgtggtctacaaactttaatcgtgaaatgttcgggagttgtttttacgcacggggaagggtgtttccctcgttcctacgtattcctcaattgcaatgaggaaatcagacctacgtag

SEQ ID NO: 81576 - DNA, 294 bp, Glycine max
  Peptide Sequence Number=SeqID_173261
atgtatgttttacgcactttggccattttgatgttgccaaagggggagagaaaatgggattgtcatcatctaaaagggggagattgtggaagcaatgccttccaaggttattttgatgaagccaaagaatcaagagttaagcaaattgcaaaagattcaagattcaagaatcaagtttcaagatcaagattcaataatcaagtttcaagaatcaagattcatgaacaatcaagatcaagattcaagactcaagattcaagaatcaagagaagactcaatcaagataagtactga

SEQ ID NO: 81577 - DNA, 165 bp, Glycine max
  Peptide Sequence Number=SeqID_173262
atggacgctagagattgggtggacaacaaccttggccgtcttgtttataactcaagcttacatgttttaactgttgagattgcacatataacatttttgtacagctcgcttagcgagactagtgcgctaagcgcaattcctaacttgagagggaaatttgcatag

SEQ ID NO: 81578 - DNA, 5223 bp, Glycine max
  Peptide Sequence Number=SeqID_173263
atgtcgaacgcgctgtcgtttacgctcccggctctcaacaaccctcagctaaacgctttgaatagccctaacaaggcgcgtctgcgccacggcctgagaatccgggttgttgcgtcgtgcatagagaggaagaggttcttggggacccgggtgcggccaagtgggtcggacaggatctggttgctgcagtcgggtcgggtgccgaagctgagggtggcggtgcggtcggcattctcggcggtgccggagaagccgctggggctgtatgatccggcgatggacaaggactcgtgcggggtcgggttcgtggcggagttgtctggcgagagcagccgcaaaacggtgacggacgcgctggaaatgttggtgcggatgacgcacagaggtgcatgcggatgcgaagccaacactggagatggtgccggcattcttgtggctctgcctcatgttgtggattttgagcttcctccgcaaggaaaatatgcagttggcatgcttttcttgccgaagtctgagaaacgaagggaggaaagcaaaaaaatgtttagcaaggttgctgaatctctggggcacacgattcttggatggcggtctgtgcctactgataatgcaggattgggaaaatcggccctgcagactgaaccagtgattgaacaggtgtttcttacaccaagtgctaaatcaaaagttgatttggaaagacagatgtacatattaaggaagctcagcatggctgctattacatctgcattaaacctccaaaatgatggcattacagatttctacatctgttcactttcatctaggtgtgttctcaagaggcaaccacattttcttgagaagactgttgtttacaaaggtcagctaacaccagctcagctgagggattattactttgcagatattggcaatgaaaggtttacgagctacatggccctgcatgggaaacaaccagtaactgaagagaagcaaggttggggaatgacttctgaggcattgagtttggatgctggattggatgcaatggttgagttgatacactcacggttttctacaaatactttccctagctgggatcgtgctcaacctatgcgtgtattgggacacaacggagaaatcaacacactcagaggcaatgttaactggatgaaggcacgtgagggtttactcaaatgcaaggagcttggtttatcagagaatgaattaaagaagcttttgcctattgtggatgcaaattcgtcagattcaggagcttttgatggtgtgcttgagtttttgcttcattcgggaaaaagtcttcctgaagctgttatgatgatgattcctgaagcatggcaaaatgacaagaacatggattctcagcgtaaagcattctatgaatacttctcagctctcatggagccatgggatgggccagctcttatatcatgtaacattttgggactatggttctatcacatgtcgatgttctcttcattttggttttatgatttggcactaatccaatctaatatcactacagttactgatggtcactatcttggagctacattggataggaatggactgcgaccaggccgtttctatgtcacccatagtggacgagttattatggcaagtgaagttggggttgtagacattccaccagaagatgtgcgtaggaaaggaagactaaatcctggtatgatgctgttggttgattttgagaagcatatagtcgtaaatgatgatgccttgaaagaacagtactctttggcaagaccttacgaggattggctcaaaaggcagaaaattgaactcaaagacatcgttaactctgttgatgaatctgaaagagtgccgccacccatagcaggagttgctccactatccaatgatgatgcggatatggaaaatatgggaattcatggtttattggctccattgaaagcttttggatatacagttgaatcattggaaatgctattacttcctatggccaaggatggcgtagaagccctagggtcaatgggaaatgatactccattggctgtcatgtctaaaagagaaaaactcactttcgagtatttcaagcaaatgtttgctcaagtgacaaaccctcctatcgatcctattagagagaaaatagtcacttctatgcaatgtatggttggtccagaaggtgatctgacagaaatcactgaggagcaatgtaaccggctttcactaaaaggtcctcttttatccactgaagaaatggaagccattaaaaaactgaattataagggatggcgcagcaaagttatagacataacttactcaaaggaatgtggtaagagagggttggaggaagccttggacaggatttgtgcagaagcacaccatggaattagtgaaggctacaccactcttgtgctgtctgatagagccttctcaaagaaacgtgttgctgtgagctccctccttgctgttggtgctgtccatcaacatcttgttaaaaatcttgagcgcactagagttgccttaatagttgaatctgctgagccacgtgaagtgcaccatttctgcacacttgttggttttggtgctgatgctatatgcccgtatttggcagtagatgcaatttggcgactgcaggttgatggaaagatcccaccaaaagcaagtggtgaatttcactcaaaagatgagttggtcaagaagtatttcaaagcaagcaactatggaatgatgaaggttctggccaagatgggaatatcaactttggcatcatacaaaggtgctcagatttttgaagcattgggtctttcgtcggaagtgattgcaaagtgctttgctgggactccaagtcgagttgagggtgcaacgttcgagatgcttgctcgtgatgcttttcaactacatgagttggcttttccttcttgggttttctctcctggaagtgcagaagctgttgctttgccaaatcctggggattatcactggagaaaaggtggtgaagttcacctgaatgatccacttgctatggcaaagcttcaagaggctgccagaactaacagtgtagatgcatataaacaatattccaagctcattcatgaattgaacaaggcttgcaatttgcgtgggcttctgaaatttaaagagacagcagttaagattcctattgatgaagtggagcctgctagtgaaatagttaaacggttttgcactggggccatgagttatgggtcaatatcattggaggcacacacagcattagcaatggctatgaataaaatgggagggaaatccaacacaggtgagggaggggagcaaccatctcgtatggagcctcttcctaatggctcaatgaatcccaaaaggagtgccattaagcaagtggctagtgggagatttggagtttcaagttactaccttacaaatgctgatgaactgcagataaaaatggcccagggagcaaaacctggtgagggaggtgaacttcctggccacaaggttataggagacattgctgtcactaggaattcaactgctggggtaggacttatcagtccacctccccatcatgatatttattcaatcgaagaccttgcccagctaattcatgatcttaagaatgccaacccagctgctcggattagtgtgaagttggtatcggaagctggagtggggataattgctagtggagttgttaaaggccatgccgaccatgtattgatctcaggtcatgatggaggtactggggcttccagatggactggcataaagaatgccgggctgccttgggaacttggcctggctgagacccaccaaactttggttgctaatgatctacgtggtcgcacagtcctccaaactgatgggcaactgaaaaccgggagagatgtggccatagccactcttcttggtgcagaagagtttggtttcagtactgctccgctcatcactcttggctgcatcatgatgcggaagtgccacaagaacacttgtccagttggcattgctacacaagatccagtacttagagagaagtttgctggagaacctgagcatgttatcaacttcttttttatggtagcagaggaaatgagagaaattatgtcccagcttgggtttagaacagttaatgagatggttggccattccgatatgcttgaatttgataaggacgttgttaagagcaatgaaaaactagagaacattgacctctctctattgcttagacctgcagctgaactgcggccagaagctgctcaatactgtgtgcaaaaacaggatcatggtttggacatggccttggataataagctcataagtctgtctaatgctgctttggaaaagggtcttccagtatacattgaaactccaatctataatgttaaccgtgctgtgggaactatgcttagccatgaggtgactaaacggtaccacctagctggtcttccaactgataccatccatgttagatttactggcagtgcaggccagagctttggtgcattcctctgtcctggtatcactttggaacttgaaggtgatagcaatgactatgttggtaaaggattatctggtggcaagattgtagtgtatcctccaaaagaaagtaactttgaccctaaggagaacattgtgattggtaatgttgcactgtacggggcgacatgtggggaggcttatttcaatgggatggcagcagaaagattttgtgtgcgtaattctggagctaaggctgtagtagaaggtgttggtgatcatgggtgtgagtacatgactggtgggactgttgttgtgcttggtaaaactggtagaaactttgctgcaggtatgagtggtgggattgcttatgttcttgatgtggatggaaaattccaatctcgatgcaacttggaacttgcagatctagataaggttgaagaggaagaggacattcttgcacttagaatgttgatacagcagcatcaacgtcacacaaatagtctgctagccaaagaagtgcttgatgattttgagaatcttcttcctaaatttatcaaggtgttccctagggagtataaacgtgttcttgcaagtatgaagtctgaggaaacctccaaagatgcattggtgcatgctgctaaagacgaccaagatgatgaagcacaagcagtggagaaggatgcttttgaagagcttaagaaactggtgatggcatctttgaatgaggaaccgagtcaggtgttctataaatgttttaaaggaacctag

SEQ ID NO: 81579 - DNA, 457 bp, Glycine max
  Peptide Sequence Number=SeqID_173264
atgcgaggtaaatttcttgcagataaattgttatctgatccagaaattaccaaaactgaaaggaagaagaggaataaaaagaaacaagcaaccactagaccaccaggtgaatcttcttctgttgattatccttcaactgaaaagcaacttgtagaagataacatggcatgtcgaggaggagaaggaaatagaccaccaaggaagactcttggtgactatgcttatcaacaaggaccaaagcattacaatagcatagtccttcctcctttcagcaataaggttgtggaattgaagccagcactactcaatctgataggctcacacccctttgctagaatggatcatgaggatccatacacacatttgtctaccttcatggagttatgcagtaccatgggagcttctagcgaagatgctaaagctgtctacctcagagctttcccattctccttgacag

SEQ ID NO: 81580 - DNA, 420 bp, Glycine max
  Peptide Sequence Number=SeqID_173265
atgagggagtcaaagatcaaattgagacgagaaataaaagctatgctaaacaagccaacaaagggagaaagaaggttgttttcgaacccggagattgggttgggtgcacatgagaaaagaaaagtttctggaacaaaggaaatcaaagcttcaaccaagggaagatggaccatttcaaatggagaatccgatttgaggacaaatccttctcaagagggagagaatgatgaggacatgaccaagagcaagggcaaggatccacttgaaggacttggaagacctatgacaagggctagcgcaaggaaagcaaaggaagctcttcaacaagtgttgtccatactatttgaatacaagcccaagcttcaaggagaaaagtccaaggttgtgagatgtagcatggcccaaatggaggaggactaa

SEQ ID NO: 81581 - DNA, 342 bp, Glycine max
  Peptide Sequence Number=SeqID_173266
atgacagagatacccaaggaagtgatccatgcatttggtcacatcgagaatccatcgcctccaaatgcactcagcctcaagacagagcgtcgacttagtcatgttaagtatccactgcctccaagtgcacacacactcactcaccaactaaaaattgctcatagtaccaattgtggtcatctaacaactctgaggactggccctcatcttttagtaacaactagtgacaaactgacacatgagcttgaaaaatcgcttctagctccacaatcacataatttgagaacacctgtactcttcaccacactaggtgtacattgtcacccgaccttcacttcatga

SEQ ID NO: 81582 - DNA, 66 bp, Glycine max
  Peptide Sequence Number=SeqID_173267
aggggatcaagacagaacccgtatgcgatgcatatgcaaaaggtgcaatacgggaatgtaaaaagg

SEQ ID NO: 81583 - DNA, 666 bp, Glycine max
  Peptide Sequence Number=SeqID_173268
atggaagcgcagacactaactccacaaatgcgaactcgacaatgtggttgcagtcacggaagtgcagcccagtttgcgacaaacacgaactcaggcagaaggagaaacaacaataacgccctgggagtacccttttcgggactctttcctttcctacttttcttcgacctgcgaaatcacggaagcgcaggccagtttgacacaaagacgatctcaggtagaagcagaaagaagaagaacgatagggttcaagcacgcggatacaacattcgggtggcatggcgcctgacacatgcatttaagaaggcgacacggaccctacgttggtttgacaaagtgaggggatcaagacgcaatccgtgcatgatgcagatgcgaaaggcagaacacggggatgggaaaatagggaggtggttgcctcctagctcgcccaggcgagctgggttgcttccaccagaaggcaccgtcttctgttggaacaccctggaagattgtgcaacaatgcttcctttcgactcccgacatattgtggaacttcacgaattgcgtaacgatgggtttcaagtacctcgaagcggtcaagcgaaggtcgcatcccaccaaacagatggtccttggatgaaattagggtatgacacaaattttcaaggattattcaatagttaa

SEQ ID NO: 81584 - DNA, 228 bp, Glycine max
  Peptide Sequence Number=SeqID_173269
atggggtccctagtccatatgctcaccctacctatgagggaaggagatttttccttacattggttgatgattgctcaagattcacttggctatttctgcttaagcacaaatctgaagcttcaatctatgtgcaacaatttttcaccatgcttttctcatcaacagaaccccttcaccattactacaacactgcttaccctacaatattctgttaaaaaaggaacctga

SEQ ID NO: 81585 - DNA, 312 bp, Glycine max
  Peptide Sequence Number=SeqID_173270
atgattttgtcacttgaggacaaaagtgcgaaagttgatgtctcgctaagcgagctcaatgcgcttagcgagtgtcatcctctaagcgaggcatcaacgcgcttagtggataggaggaatctggaagggaatctgtcacgcaaacacgtgctcagtgcgtcatcagctcgctcagcgagtcgtttgtcaccttccaggcttagcacgagtttggcgctgagtgaaaattcacttactcgcgctaagcgtgacgtcaaggagcttccttgctatggaaggctaaatcctcagttggggattcttgctgagtaa

SEQ ID NO: 81586 - DNA, 363 bp, Glycine max
  Peptide Sequence Number=SeqID_173271
atgttaggatttacacgcgattttcctcaaatttcagccagcctgcatcaattggaccttgcaccttatgctttgaggtcatacaatgctcaatggaatgccccggggcttctccatgacaagcacacgttgcgctcgagtcgtaacctcggaaaaatggaggttaggaaacctagcaggggttatggctaccattgcattatcgagtggatatgggagcaagtcagcataggacaccggaattggggctttgtggttgatttagggatgacctttgtggatagttgggtggtgggtaaggagaagggttgttattggctgagtaatgacattattgggctggtgggaaactttgccgtataa

SEQ ID NO: 81587 - DNA, 144 bp, Glycine max
  Peptide Sequence Number=SeqID_173272
atggaggtcgaggaaccttggttggggttatggctaccattgaattatggagtagacatgggagcaagctttgtggctgatttagtgatggccttcgtggatgattgggtggtgggtaatgagaaggctaacgtcgctgagtaa

SEQ ID NO: 81588 - DNA, 1521 bp, Glycine max
  Peptide Sequence Number=SeqID_173273
atggaccaggccggggcggtcggtggcgtaggcgccggcgacgctgggcatcgagtggcagttgatatgccagaccttgccgaacttctggtgggcgctgtccagcacctggcccagggcggcgtggtacggcttccagcaggcttcgatgcggtgcgtcacttcctcgacgctcagcttgcggtcgtacagcggcgtgccgtcgtccagcatgcgccagatcaggcccttgcccagcttgaccttgggcgaggcattgaccgcgccgggccaggcctggtcgagcagcagttcgtcgatttcgtccggggcgcgattggcatcgatgtaggcgcgcggaaagctcgcggcgatcatgggcacgcccatgtcgatggcgtcgccccacagatcatcaacccaggtgtcctcggcggtgcgcagggccccgaaatccacggcgggcgcgaaatcgggcgggacaggggttgggtaattcgcatatgggggtgttgcgttcgtgaatcggagacccccgcgcgccgcgcggacgcggcgggggccgaagatcgctcagtcgatcttcacgttggcttctttggcgatgcgcttgttcttggcgatctcggccgagatctgtttggcaaacgcttcggggctgttggcggccggctcggcgcccagcgcttccaggcgcgacttgacgtcggcttcggcgctgaccttctgcacggcggcgttcagcttggccaggatcggggcgggcagcttggccggggcgaccaggccgaaccacgaggggtcgttgacggcgggcaggccgacttcggcgaaggtgggcacgttcggcaggctggccacgcgcttgggcgcggcgacggccatggcgatcaggcggccggactgcacgtgcggcagggtcgagggcaggttgtcgtacatgacgtcgacctggccggccagcgcatcgttcagcgccgggcccacgccacggtagggcacgtgcatcaggtcggtgcccgaggccatcttgaacagttcgcccatcatgtgcgagaccgagccgttgccggccgaggcgtaggtcagcttgcccggctggctcttggccagcttgatgaactcggccatgtccttggcctgcaccttcgggttgatggtcatgatgttcggcacggcggccaggttcgagaccggcgtgaagtccttctcgccatcgaacggcaggttcgggtagatggccggattgatgccgtgcgtgctgacggtggcgatgcccagggtgtagccgtccggcgcgctgctggccacgaaggcgctgccgatcgagccgccggcgccgccgcggttttccaccaccacggtctggttcagttccttgccgagcttgtcggcgaacaggcggccgacgatgtcggtggtgccgccgggcgggaacggcacgatcaggcggatcggcttgctcgggtaggcgtcttcggcatgggcgatgcccgaggtcagcggcgtggccagggtcgcggcggcgacacagagacctag

SEQ ID NO: 81589 - DNA, 408 bp, Glycine max
  Peptide Sequence Number=SeqID_173274
atgtcagttttagaattatacatagaaaatgatgttgttggtggttatgtgtttcattctgcaaattctattagatcatgtggaaataatttatctaataatgagtcagaaccgccaagaaatgtaagcaatttacatgaggatgaagatgaagatgatgatgatgattatcttgtgtctaattcatacgttgaagactctttagatgaagatgatagtgttgatggtatatctgatacagatgatgaagtcgctgacatggttcaaccagttacaattgttcaaccaagagaaaatggaattcaaaatccattttggaatgatgtttttcattataacaatatcaattggagtcatcctgatgaggaggacatttgcggtttggagatgccattaaagatgctttaa

SEQ ID NO: 81590 - DNA, 282 bp, Glycine max
  Peptide Sequence Number=SeqID_173275
atgcaacaacttatgatgctacttgatcgatatcaatatattcactggcataggatgaaggatgataatgttgtatgcgacttgttctggagtcatctcgatgtaggtcttttcatgagagtttatgcactccccgtggttattgtgaccgatagagatttgtctttgatgaatgcagttaaaactgtattcccggatgctacgaacttactatgtcgatttcacattgacaggaatgtgaaggcaaagtgcaaaaccctggttgctcaaaagaaagcatga

SEQ ID NO: 81591 - DNA, 204 bp, Glycine max
  Peptide Sequence Number=SeqID_173276
atgggtgccttgatcactaacgatgactctagggactccaaacttgcaaaacaaattagatctaacaaaatccacaacaaccttagcattacaaaggatcaagctgatgttttgatgatgccaaagggttacatgtttcacaaagctttattcaagacaaagaaatcaaagatattcaagatggatgatcaagacagtctctag

SEQ ID NO: 81592 - DNA, 483 bp, Glycine max
  Peptide Sequence Number=SeqID_173277
atgtgggcttttcttaccggtcgtcagatcgactgggcccatttggttcggtaccgaatgcataaggcattacggggcaatgcacctctcccttatccacatttgattactctatttctgcgtcattttcaaattccgcttgatgatgaaccatttgttcaagtcaagcgttcctttacaattggtgctggtgccgtgacttcctttgggtaccgtaaagatcggaatggtcaatggctgaagaaggatgcactccctcctcaagatgaacgtactccttcacctcctcctcagcacgatgatttagcactcatgaatgaagtcctctctgaattacggggtcttcgttcttatgttggtgaccgtttcgactcattagatacacgctttgccgacatggaaattcgcctcacacagctcgaagaggatgtaggatacattcgtcatagtttcgatcttccaccaccacctccaccttcttag

SEQ ID NO: 81593 - DNA, 303 bp, Glycine max
  Peptide Sequence Number=SeqID_173278
atggctggaaagaaaaaggaacccattaatattttgcagtatgcggatgacacagtttttgtgggtgaggctgagtgggagaatgttattgttttgaaggctatgctcaggggatttgaattggcctcaggtctgaagattaattatgcaaaaagccagtttgggattataggaggtagagtcaattggcttctgaccagcagcagttatgggctaggatcattaaatctaaatatggtggttgggaagagcttcagtcgggcagagatagaaggggctgctcacactggtggagggacttga

SEQ ID NO: 81594 - DNA, 342 bp, Glycine max
  Peptide Sequence Number=SeqID_173279
atgggatcaagtcaaaagccttcacttaaaaataggttctatcaagtcaaggtcaagagcctagggatcaccagtctaaaaaagctagggaaattaaagggtcaacttcaatggcaagccttccgcaaagcctatggtaagatttgggacctagctaagtattatgatcagccgatgaggtgcttcacctttaggaacttccagctatcacctatggcagaagaatttgaagagatcctaggatgccctctagggggggaggaaaccatacctcttcacagggttctatccctcattaatttccaagatagtccaaatctcggcgcaggaattagaccatag

SEQ ID NO: 81595 - DNA, 477 bp, Glycine max
  Peptide Sequence Number=SeqID_173280
atggatttctacacatgcggatgtaacactgttcctgcatcttgtgcccttcacaaattgtttattgtcactgtgcttcgtgcatctcccacttgggcaaagttcctctattctcgtgttcctctttggggggatatgctaggtgcacccagcaattcattgaagcattctttcttttcactgagtctcttccgcaaaagcttcttctcttctctcttccccgacgagcttcttctccgcgaggcttctctggcagcccttggacccatttgcattcgagaagtactggtcttccggaaagctcccggaacacctattccgaaaagtttccggaacaagtggttgttccggaaacattccggaagaagggttcttccggatgacctttcagtggttccggaagcactttccggaagagcccttcttccggaatatttccggaagaaccacttcttccggaagtttttttttttttaa

SEQ ID NO: 81596 - DNA, 321 bp, Glycine max
  Peptide Sequence Number=SeqID_173281
atggagagagacgaagtagtggtgatggcggaggcaccacgatcgcacaaagaggggagttgctacgtgcacccagcattattgctggggcacccagcaaacagtgaagtggcgaaactgcccttcaggaattcttcttccggaagacactttttccagaaacattccggaataccctttttccgaaaactttccggaagaagaatttgtgatttccggaaatactcagaaactccttccggaagaatgtcatccggaatgtttctggaagaagcttcttccggaagatgggtcttccggaatgaacgtaattacgactaa

SEQ ID NO: 81597 - DNA, 468 bp, Glycine max
  Peptide Sequence Number=SeqID_173282
atggcattcttaggagaaacaagcagtcaaacaattgtgaactcgacattaggttttatttttcctaatggatccattgttcacaacggcagtggtgtttattttcaaattcccactccagtacccattcgagtacctaacacttgtgattttcaaaagttaaaaaccagaatacacaataccgttcagctaaccgacaaacaatatttggatgaaatttactaccggcagccattcacagatacagcgactatgacccctactcatgatgtcctgctatattacaacgagaggtggaacatgtcacaccaacatgagtttgttggttacttgttcacaggaaaaagtcccaaaaagtttgacattcctttcggatgtaccatggatgagctgaaggatttgatcaagcaagttgcgcctcatgggattcccccttatggtattcatgaaacacaaatggtaaggtga

SEQ ID NO: 81598 - DNA, 405 bp, Glycine max
  Peptide Sequence Number=SeqID_173283
gtcttttcagcctttgggtttgtgcataagattactacttttgagaagacagcaggattccaggcattggtgcaattttcagatgcagaaactgctacctccgcaaaggatgctttggatggaagaagcatacctaggtacctgcttcctgaacatataggaccatgtggccttaagatcacatattctggacattcagacttaagtgtcaagtttcaaagtcacagaagcagagactacactaatccttaccttcctgttgctcaatctgccatggagggaagtggacagcccatggtgggtttggatgggaagagactggaggccgagagtaatgttcttcttgcatctattgagaacatgcagtatactgtaaccttggatgtcttacacatggtactttaa

SEQ ID NO: 81599 - DNA, 2592 bp, Glycine max
  Peptide Sequence Number=SeqID_173284
atggccacactccaagcttcccttctctccaaaccttccctcccattcccgttcctgtctccgaaccactccccattctccctctccttcccccccacgcgccgcgtcccttccacgctcctatgttgcaccttccgccccgaacccaacccctctgaactggaacccgaacccggttcagccaacaccgaagaagaaccgggtataaattcacccgaagaagaaaaagaaggtgcagcttcggtttcagatttgggtttggaagaagaaggcgccgaggctctcgatagtggcgctgattcggagaagattgcgaatggaaggcggctctcgatagtggcgttctttgtggggctgtgggtgaaggcgagggagagtctgaagagggccttttcggagcttcttgattggtggccgttctggcgccaggagaagcgcctcgagcggttggtcgccgacgccgacgcgaatccgcaggatgctgccaagcagagtgctctgctcgttgaactcaataagcagaggatagatgaaaagttgtggattgtagttagatacatggatttggtgttattggagagtgtagttcatgtaatgctttacagaaaaaaagaaagatgtgacattagggaaaattcggctagtcctgaatctgtcatcaagtggtttgaacaaagggatcgagctgtggacagtagaggggttgcggaatatcttcgagctcttgtggtcactaatgctattagtgaatatcttcctgatgaggattctggaaaagcttctagccttcctaccctgttgcaagagttgaagcagcgtgcattgggtaactcagatgaaacttttgttagccctggaatatctgacaagcagccactacatgtggttatggttgatccaaaagtatcaaataagtcacgttttgcacaagagcttatctcaactattttgatcactgtagctgtggggttagtctggtttatgggtgctgctgcacttcaaaaatacattggaagcttgggtgggattggaccttcaggagttggatcaagttcttcctatgccccaaaggagctaaataaggaagtgatgcctgaaaagaatgtaaaaacctttaaggatgtgaaaggttgtgatgatgcaaagcaagaacttgaggaagttgtggagtacctaaaaaatccatctaagtttacacgccttggaggaaagttgccaaaggggattcttttgacaggagcacctggaactggaaaaactctgctagccaaggctattgctggagaagcaggtgtcccatttttctatcgagcaggctctgaatttgaggagatgtttgttggagttggtgctcgacgtgttagatccttatttcaagcagccaaaaagaaggctccttgtataatttttattgatgaaattgatgctgttggatcaacaagaaaacaatgggagggccacacaaagaagacattgcatcagctacttgttgaaatggatgggtttgagcagaatgagggaataatattaatggctgcaacaaacttgcctgatattcttgacccagctttaacgaggcctggcagatttgatcggcatcaaggaggaaaatggcttggaagtaaatatgggaaaagatgtgataccatagatgtgcgaggtcggcaagaaatattggaactctatctgcaagataaacctatagctgatgatgtagatgttaaagcaattgctcgtggtaccccagggtttaatggagcagatcttgcgaatttggtaaatgttgctgccattaaagctgcagttgaaggtgcagagaaagtaacagctgcacaattggagtttgcaaaagacagaatagttatgggtactgagcggaaaacaatgtttatatctgaagagtcaaagaagcttactgcttatcatgagagcggtcatgcaattgttgcccttaacaccgatggtgcgtatccaattcacaaggcaacaatcatgccacgtggatctgctttaggaatggtcactcagcttccctcaagtgacgagacatcaataagcaagaaacagttgttagctcgccttgatgtttgtatgggaggaagagttgcagaggagcttatctttggccaggattatgtcacaactggagcaagtagtgatctccacactgctactgagcttgcccaatacatggtatcaaattgtgggatgagtgatgcaatcgggccagttaatataaaagagcgaccaagttctgaaatgcagtcacgtattgatgcagaggcaagtgttgttgtgaaactccttagagaagcatatgatcgcgtgaaagcccttttgaaaaagcatgagaaggcattacatgtgctggcaaatgcattattagagtatgagacacttagtgcagaagaaataaggagaatacttctcccatatcgggaaggatggctgccagaacaacaggaacaagaagcagcagaaggggatctggaaaaaggatacgcagcgttggatatctgcgaagcaacgattcctgtgtacaacagcaagggtctgctattagagtatgatcgccctttgctaagggcctga

SEQ ID NO: 81600 - DNA, 156 bp, Glycine max
  Peptide Sequence Number=SeqID_173285
atggagtctagagaaaatgaaacagagttgaaggagaccatcaaaattgagttatcccaaaggggatcgcagtactcaccccccattgaggcggatatacagagcattgtgtcccgacatccttcagcacaaggttccttaaagcacttcacctag

SEQ ID NO: 81601 - DNA, 971 bp, Glycine max
  Peptide Sequence Number=SeqID_173286
atgaccggccctctcgatgagtcgatctcttgctttctcataaggttggacccttgggtactagtacctatcaccttcagaggactgtacgccctcaccgtcagaggactacacgtcctcgccttcagaggacttcacgtcctcaccttcagagggctacacgcctttgccttcataggactagacgtcctcaaattcagaggactacacgtccttgccatcagaggactgcacgtcctcgcctttaaagggctatatgccctcaccttcagaggactacacgtcctcaccttcagagggcttcacgccctcacctttagagggctacaccccctcatcttcagaggactacacgtcctcaccttaagagggctgcacgccctcgccttcagaggaccaaacatcctcatcttcagaggaccaaacatcctcatcttcagaggactacacgtcctcatcttcacagggctacgtgtcctcgccatcagaggactccatatccacaccatcagagaactcaagtttctttttatcagtttctgggccacccctgatattggagggcgaccaactgtgcaagcacagccagagagggaggctatcacgcagctactatgcataccggggcaagatttcacccgtaccgctgcgaagagacaagtgtggatcatgcgcaccaacatgaccactcttacacaaatatggatgatgttgctacttagcaaacatttcgtccagcgaccgcaatgccgatctccccctgcgaaagtatcgggattgcgcccacaagacacccaacagacccggagaagcccaacagggccctggggtgtccagctctggttacgagcctctgttagtcctacagggtgcccgttccccccagcaagggatcgcgcccgcaagacacccagtggacccggagaagtccaacagggtcctggggtttccagctctgattacgagcctct

SEQ ID NO: 81602 - DNA, 297 bp, Glycine max
  Peptide Sequence Number=SeqID_173287
atggctgataataccagaaatcaaacacatatttgtgaaattgaagaacgtctcaatacgcgaatggaagaacaattcatggatattggagcttcgttacagtgcacgatcgaggatatgtttcgacgccacgaaaattcttgctcatcaggttctagcgcgtcttcccggccctattcgtgtaacactaggcttgcacgcttggattttccccgattcaatggcgagggtgtcaagaattggatcatccagtgtgacactttcttttcggttgatcaaacccccgaagagtacaag

SEQ ID NO: 81603 - DNA, 504 bp, Glycine max
  Peptide Sequence Number=SeqID_173288
atgaacttggagtccatagcccaagtctcaagctatgtcagagaaggaagcacttatcatgacagttgggaagttacttatgaaaagcatgttccaagagctttttacaaggagaaaagtgttgagtatgttggtacaaagaagatagtgtatcacaccatgtgtgaaagggttaagatttgggcaaacatcaccaacaagagttttctgcataaggttggttcaaagacaactctttctgaccttcacaaattcattttgtttcatctgatggagcagttgctcttcgaccttccacacattgtcttcatcaacatcctcaagaacttgaggacactaggtggaatggacgacatatactacgcaactttggtcaacaagctgttttgggaacaaggtgtttaccatgttttaaaaaagattgacaaggattccaagcaccaagtcactgtgaaaggttcattcattgctaagcaacaacagtttagcaaggtggagctttag

SEQ ID NO: 81604 - DNA, 171 bp, Glycine max
  Peptide Sequence Number=SeqID_173289
atgaaagttgctcaaggtcacaatttttctaaaatgggctctaaacaaatcacgttcaaagagggaacttttataccatctaaagaagtgaatggtgaactggtgcccaaggaatgggatgagatgaaaaatgatgagaaaagaaaagtgcaagatgatcaaaaaaactaa

SEQ ID NO: 81605 - DNA, 372 bp, Glycine max
  Peptide Sequence Number=SeqID_173290
atgaatgtgttcacttccaactttgcagactggtccattgattatgatcacaaggacacaatacaaatgttgcatccaactaagaagtctaatgaggttacttcagcttataaggaggtagttgtctactctacaagttctagcattccaaaggacattgctcatatcaactactcaacccttgttattgtaactgaagaccaaattcaggagataatggctcaagccatgatgaagcaacaagaagaaactaagaaggagttagtgaaacaaaaagaagaaactagacaagagttgcaatccttcactaaacaacaaaggttgaagaatgagcagtatcaactatccatccaaaatttcattgcttcttag

SEQ ID NO: 81606 - DNA, 882 bp, Glycine max
  Peptide Sequence Number=SeqID_173291
atgcaatctcagggactttcactgcctcccgagcctctggttagtccctccggtcctcgagtaagcacaaaagggagttgtgttgatccctcaggaaacgatcctgagacgggtgactcagataggcgcggcttgtacatcgaagcatatcctgcccgcctggtgggtgtggaggaggttacaaatgcagatgctccagttcctgtacccactgatgaggtttccttagtggggcaggcacttcacaccttccttgcttggtcgacacatctggtcaagtctttatcacagcaggtagttgtgtcactggcaaaaccacctccaaagcccgatctggaggtcgatgatctgctttatctgatgacattgacaatcccagagctttttttgaggccttatcaggttacatgggatgccaccgtgtttggggtctttaatccagatttcccgttctacataaagcatgaagacctctctaaaatcgcacacggtggtcaatgtctcagcatatcaatgttacagttgtggattatgcatctcactgaaacaagtatgcgagcagggaattctgatatctatggattcctcgagccacagttcattcagaggtctgggcaatcgcagtttgagtctgaaagttacataaagacttggatgcagagttcaaaacgcgatgtctatcttagagcctacctaaatgggccagacaactaccttaaggcgattattaacagtgctttaaaaggtcttgatgatgctccacagcctaaatcaaaggctcttgctaggtggattgtcgtcaagtattttaatgatcctagaccattggacccagagagattaaaggcgttgcggatccagtggacacagtattatctctaa

SEQ ID NO: 81607 - DNA, 198 bp, Glycine max
  Peptide Sequence Number=SeqID_173292
atggaaggagttcaagaggttctgacactcaggcctcgcgctaagcacataattgttcatgcgctaagccgcgagtctcaagcgcttagcgctcaactcttacatcttaagctgattcattccgctaagctagccaaggctgagctgagccaaatccaattcgatctggatttggctaagcgaaagcctaaccgctaa

SEQ ID NO: 81608 - DNA, 300 bp, Glycine max
  Peptide Sequence Number=SeqID_173293
atgaagttctttcggaattacgaggccttcgcacctatgttggtgaacactttggattccttggatggtcgcatagatgccattgatgctcgctttgaaggaatggatacccgcatcactcagcttgaaaaggatgttcagattgggtggcttgtgtttggctctgtttcttggccattgctagggtttctggaagtttctaagagaaggagaagtttgggtgcagagaagtttctaagagatagagaatgtggaaagtttgcaaaaggtttgatagtgaaaggtcgaattgatttatga

SEQ ID NO: 81609 - DNA, 315 bp, Glycine max
  Peptide Sequence Number=SeqID_173294
atgacattctctgccggttttgcatatttggagggtgaacgtcttaataatgtggtttgggctttagaacggttccgaggtatatttttaagacgtgatgtctccccaggagttattgtgactgacaaagacctatcattgatgaatgcagtgaaaactaatgtgaaggccaaatgtaaatcattaattggtcaaagaaatgcttgggagtatgtcatggatgcctggggaactcttgtcgattgtccttcagagcagcagtttgatgaatgcctgaagaagtttgaaatgttggaacaagtggccttggaataa

SEQ ID NO: 81610 - DNA, 150 bp, Glycine max
  Peptide Sequence Number=SeqID_173295
atggaaggtgctaaaccaatgaaaacacctatgcatgcttccaatcccttaagcaaagacgaatcagtatatgtctatgtgttggatttcaatctgatcctccagaggtacatctcaaagctattaagaggatcttacattatctactag

SEQ ID NO: 81611 - DNA, 525 bp, Glycine max
  Peptide Sequence Number=SeqID_173296
atggtgggttacacaccttcgagttttatagatttggtcttcgccagcaaaaggatcgaagtgggtctgaaaagaggcaaatttaatcatcctgcttggacgaatgagaaaactggggcaaatgaagagggtgagaaagaaggagaaacccatgctgtgactgccattcctatacggccaagtttcccaccaacccaacaatgtcattactcagtcaataacaaacctcctccttacccaccacccagttatccacaaaggccatccctaaatcaaccacaaagcctgtctatcgcacttccaatgacgaacatcacctttagcacaaaccaagagcaccaaccaagaaatgaattttgcaacgagaaaacctccataaccccaaccaaggttcatcaaccttcatttctccgagaatacgactcgaacgcaacgtgtgcttgtcacggagaagcctcggggtgtcccattgagcattgtagggctctgaagtgtagggtgccaggtctaattgatgctggctga

SEQ ID NO: 81612 - DNA, 240 bp, Glycine max
  Peptide Sequence Number=SeqID_173297
atggaaaggtttgatggtcttcaaacctttgttggtgaaaggtttgatactttggaattgcaagtggatatgcgcttcaatgaaatggagtcaagaatgacaaagccttgtgttttggctatattattatggtatttgaacaatttactatttccttatatgcatgaagttgtcatcatcaaaaagggggagattgtagaagcaaggcttcatggtgaatgtgattcaaaggtgttttga

SEQ ID NO: 81613 - DNA, 457 bp, Glycine max
  Peptide Sequence Number=SeqID_173298
atgcaatcacagggacttgcactacctccggagcctgaggttggtccctcaactgctcgtgtcagcacaaaggagagttttgttgatccctcagggaacgatccagagacgggtgactcagacaaatgcgggttgtacatcaaagaaaatcctccccgcctgattgtcctaggaagagtttatgagggatccacaactgttcacaacatccctttgttgcatgatcaagtgaaggtcggtgttgaggaggttaaagatgcagatgctcccgttcctgtacccactgacgaggttaacttagtgggacaggcacttaacaccttccttgcttggctgacacatctcgtgaagcgtttatcagaacatgttatgtgggatgctaccgtgtttggggtgtttaatcaagacttcttggtgtacataaagcacgaagatctgtctgaaattgcacacggtg

SEQ ID NO: 81614 - DNA, 204 bp, Glycine max
  Peptide Sequence Number=SeqID_173299
gaatttgttgatgtttttctagaagaaattccatatggattacctcctttaagaggttttttcattagcttgaaaggaataagtgtggatgaagaaaatgtaaaggcaattagggaatttcttgtacttaagaatgctaatgaggactctaagccagttgcatactttagtgacatcgctatttgtggccaagggaattcataa

SEQ ID NO: 81615 - DNA, 162 bp, Glycine max
  Peptide Sequence Number=SeqID_173300
atgccccaaccatatgggatcaacataggcttaaaggagctctcaaaccgggtaacccccaaggcttacactccgaagagtccgtcaaggcctctccctcctaattcagttcacaactctgttagacaagtggcctcagatatcttaagaaggaggggttga

SEQ ID NO: 81616 - DNA, 336 bp, Glycine max
  Peptide Sequence Number=SeqID_173301
atgaaactggccaaatacaggctaaaggcccaagtggagaaggacgaaggcccaagtggagaaggacaaagcccccgagtggagaaggatgaaggcccagaggcagagacactatcaagactattaattgttgctgaaggcccaagtaatccttgtggcgtctacccagacttatcttccttcattggaagtggcgtctacccagacttatcttccttaaccggaagtggcgtctacccagacttatcttccttcactggaagtggcgtctaccctgacttatcttccttcactggaagtggcgtcatccaaaccttcgtagcctgtatcaaatga

SEQ ID NO: 81617 - DNA, 432 bp, Glycine max
  Peptide Sequence Number=SeqID_173302
cttggaggggttgatggggacctggtgctgagaatgacgaggataagggctatgtatgagtacgtgagctcagttgaaggtgggcaactagggatgtggtacttggagatatgtcgcgggggtcaggagaccttggggacgtcaggcgagctcctgacagtcaacaataaagaacaaagaccacaaagcaaggaggcttgtgtggttgctggccagctatggatcttgagtggtatctggaatttggcctctggtaatcgattaccaaggatcgcgatggcagcgcaattaatccatgatcacgtggagatggagtgcctagagggagtttgggagaccttcgaagtcaatgagaggtgtcgattccgtggctcgctaagtcgaacatctgctgcaaggatttgcgctaagctcctcaaaggctgcgcttag

SEQ ID NO: 81618 - DNA, 49 bp, Glycine max
  Peptide Sequence Number=SeqID_173303
atgaagaagatcttaggcctacaagctccaatggagcttacatcatgtg

SEQ ID NO: 81619 - DNA, 222 bp, Glycine max
  Peptide Sequence Number=SeqID_173304
atgatgataacaaaagatgatgacaaaggtgattacaaaaagctcgaagatggaatcaagaacaattcaagactcaagaagaaaaagttgaagcacacttcaagattcaagaagaaagttgaattcaagaatcaagatcaagattcaagattcaagattcaagaatcaagagaagacttaatcaagataagtatgaaaaggatttttcaaaaaacagagtag

SEQ ID NO: 81620 - DNA, 168 bp, Glycine max
  Peptide Sequence Number=SeqID_173305
atgttgcggaactttacggattgcgcaacaatgccctttttgactttcgaaatgttgcagaactttacggattacctaacgatgggtgttaagtacctcaaggcggtcaagcgaaggttgcatgccaccaaacaatggtccccagatgaaattagggattgtaaataa

SEQ ID NO: 81621 - DNA, 712 bp, Glycine max
  Peptide Sequence Number=SeqID_173306
ccttcccagacagcattcatttcgccgaaggtggacatgtcggagaggtagatgatggtctgcaggatcttcgacttgtcggaaccggcagcagccagcaggcggtcgacttcagcgagagccgacttgctctgttccgtcacgctcgtaccttcaccaacctggccggccagataaacggtgttgccgtgaacgacggcgccgctcatgcgcttgcccggctcgatacgcttgatgatcgccgtggagcgcgcgccggaacggcaatagccgagcatcgggcgctgcaattcatcgagcgcatccaccatgccggcaacggcatcggcatcgacgccgtagcggccgaccggcacatgcatgatcgtcaggccaagctgctctgcacgctcggcaatatcggcaaaaagcggctgaccgtcttcttcgccgtccgggcggtggcagacgatcgacttgaagccgagtgccttgatctcatccagatcggcgacgctgatctgtccagttaccgaatattcgtcgtctatgcgcctgatatccatgtcatgcctcctgaaaccggcgtccgcgccgctggccaggatggaaaagcgcagaccgaaggaacggctttcccccggctgaagaatattgaactcaccggcggcctcaagctcgctacgccccacccagcgatgcgaaaccggctcgatgccgagcacgttcgccg

SEQ ID NO: 81622 - DNA, 339 bp, Glycine max
  Peptide Sequence Number=SeqID_173307
atggaaatctttgttcaatcaattgatcccggtgtatggaatgccatcattaaacttcattttgttcctactaaatatgtgaatggtgaattaatacctaaagaatgggatgaaatgagagatgatgagaaaagaaaagtgtgcaaaaatgaaaaagaaatttggaatatgcttgaggtcactcatgaaggcacaatggatgtgggaagagaaagaaagctcactctcgtatatgaatataaagcatttcgaataaagaatgggaaaaccatttcaaaacttcaaacaagattcactcacattgtgaaccatcctacttggtctaggaaaaatgtttga

SEQ ID NO: 81623 - DNA, 57 bp, Glycine max
  Peptide Sequence Number=SeqID_173308
atggttacctcaaagccttacactggggcaatgaggggcatcgtgcatgagcctcag

SEQ ID NO: 81624 - DNA, 108 bp, Glycine max
  Peptide Sequence Number=SeqID_173309
atggcagcactgggtggctttaccgacatcactggagcacagaatagcatcgatatcgaaaatcttaaatggaaaaataaattgtctttggaagggatatctttttag

SEQ ID NO: 81625 - DNA, 427 bp, Glycine max
  Peptide Sequence Number=SeqID_173310
gtctgagttcctcattggaggatacgtaggagcaagagcctcgcttttgtcgaccacaccaccttttgttgtcatgacccaagagctggtagcctgcggagacaccttacggttatccgcacctcgtcattcagtgaccccaagtgtgattgatgagcaaaggccagtgtggtctgagttcctcattggaggatacgtaggagcaagagcctcgcttttgtcgaccacaccaccttttgttgtcatgacccaagagctggtagcctgcggagacaccttacggttatccacacctcgtcattcagtgaccccaagtgtgattgatgagcaaaggccagtgtggtctgagttcctcattggaggatacgtaggagcaagagccttgcttttgtcggccgcccacaagatctgttatactgaccctgag

SEQ ID NO: 81626 - DNA, 443 bp, Glycine max
  Peptide Sequence Number=SeqID_173311
atccagtgctgatgatggatgagtctcctcaagagaaggtgcagatggtggagatggctgaggggtctgagttggagtgttctcctcctctgctactgctggtgatgatgctggtgttgtgggctcctcagtcacaggctcctgggctgtggaggccccaccccttccagaggaagaaggctgggcaagcccaagccctaaaggctctgcatgatgatggactaccctctatggatgctctagagcatggagtgaagcatctgaggagtgctggaggaatcactggaatatctatggaggaagaaggaggaagtgtagaagaagaaggtgttggtgcctctaatgctgctatgaaaaggaccttagatctattccctctggccttcctgggtcctctaaaagttactgttggatcatcaagattccaacagttcttaatataa

SEQ ID NO: 81627 - DNA, 450 bp, Glycine max
  Peptide Sequence Number=SeqID_173312
atgggagaaccccaggccactcaaccaatagtgcatggtcttcaaagcaaggtccaaagtttgatagaagccggatggctgacgtttcaagaggaccggcccaacgtaaagacaaacccgcttgccaatcatggagggggagctgttaatgtcgtcaagtcgggtaggctgcgtaggtccaatcctttgaaggatgtaacgacccctagaaggtttatctacgaggccctacaaaaggggggcgtaattcctcgcggtgggcacgagaaggattcctgtttgatgcatcccggcgtgccacatagcatggaagcatgtttagcagtaagagacctgttgcaacatatgatagaccaaggccggctgaaagacggcgatgaggggggtgaagaacaacatatatgcatgcaattcactgatgaggaaggtcttagaaagcctaaacctttg

SEQ ID NO: 81628 - DNA, 537 bp, Glycine max
  Peptide Sequence Number=SeqID_173313
atggtagtcataaccccagccaaggttcatcaacctccatttctccgaggatacgactcgaacgcaacatgcgcttatcatggaggatccccaagccattccattgagcattgtagggccctgaagcataaggatggaccctcgggtactagtaccctggtcttcagaggactacacgtcctcgccaacagagggctgcacgccctcaccttaagaggactgtgtgtcctcactttcagaggactgcatgtcctcaccttcagagggctacacgccctcgccatcagaggactgcgtgtcctcaccttcagagggctacacgccctcaccatcagaggactgcatgtcctcaccttcagagggttacacgccctcgccatcagaggactgcatgtcctcaccttcgtagggctacacgccctcacctttagaggactacacgtcctcgccaacagagggctgcacgccctcaccttgagaggactacacgtcctcgccaacgtagggctacacgccctcacctttagaggactacac

SEQ ID NO: 81629 - DNA, 2535 bp, Glycine max
  Peptide Sequence Number=SeqID_173314
atgaagctaacattcagaacgcttccctacgatgatgacaatatgaaagatgccaaaattagcaaatctggagaaaatcttaccggtccaatgtgcaatgggacacaatgggatgatgattgttcttggagcgagtggtattctgcagaagatcctgttaaaggttttgaactcattgcaatatggtcagagaagatggttgaaagttctatggaaatggctgaacttgaaaatgcttcgcctcatgaagctgagaagtggttgatctctctaagacttgaaggttccagtgggaatcgggttggattcgcatctgagttgtgtcttctggttgatgcattgcaagtgtcatttgaggcacaatttatggaagattttgtttcagttgaaaatccaggttctgataatttaaaatcaatggtgatacctccaccaacagtcagagaccgtgtgctgaaagaactgtttattgaggagggactgtaccagagaaagagagttagagagagagaggatgtgagagagggtgagtggactacggtgaggaagagagggagaggtaacctgagagtagtatctaccgagagaaaggatcctagacagagctacgggggagccaggcaacggcaatatgctaaccaagtatacccaaactggaggaacagagcggacataacgtccttttacttcacgaggtttccagaggaggtacacgaggcggagctatggaaccacttcaagaagtgggaggatgtgagagagatatttgtatccaaacagaggaacaaagaaggaaggagatatggatttgtaagattcaaaggagtggatgatgtgagtagacttgaaagacaacttgacaacaccatcatcggaggactgaaacttcatgtaaacataccaaagtacgcaagaggaaagctggaaaaaggagagagcaataatagatggcaggggaccaaccaaaaacagaaggaagggatgaagaccatagcaactactgcagcacataccacggtacccacaaggacgtatgcagtgatactggcgacacgctcgggtaacgcggggcaacacagaaacaaagtcacaactcaagccagacacggaggatcacattcttctattcaattagacatcccgaaggaggaggataaatggtacaagaatgcatgggtgggaagactaagaaaaccagagatattcgaaaggttggaagatgagttaacgtggattctagggtctgacgtcacgcctaaatacttaggtgatgacatggtcatcctccctggtctccaggatgcaaaggcagaagaattgatcaaggaagaaatagacaatggtgcttcactgttctattccctggagaaatggaagccggagatgagactgggtaacaggttggtatggatgcattgctggggtatactgttagccgcatggggtattgagcacattcggaagatcatagtagcggtgggggagttagtggatgttgatgatgaagttgaagaactccgacgtctcgatagagctcgggttcttattagaactccgtggtgcccaacgatccaccactcggtaaccgttgatatccatggcaagtcgcatctagtcttcatggtggaggagacctccagggtgaccgtcgacgaagccaacgacggcagcaatgaccctcggtccgacagattccccagcggaaggttaggaacagaagatcccctgggtaatgaccaatacggcccaacccacgagaaccctgtgacagatgtcacagatgccaaccaaacaggggccacaccagacccacagacggatgttcagacatgcaacgaggggcagcaaacaccaaaacagcaagttacgctggaccaaatcgaaagggattgcgcagatacccaaactgaaatcgcagtcaacaagaaggggagaagaaaataccgatggtacactactggggaaaaaaggggagttcacacaagccctcaacctcaacaggaaaaaggaagtgactggaaggtgtattcaaggggaaaggggtgcagaaagaaatggaccccaacaaacagccaacagatctcatcgaacccagactcaaaggacctcgacccacagtctacaacaagaggaggcagcactgttgggaaacaaaaatactccaccatgaatatcctgtcctacaacatcagagggctggggagaggggctctatggggagacacagacttgagctgggaaatataccctgccatcaattcagctggtggattgttgtgtatttggaatgacggcatgtttaaggctgctgcaaagagagaactatggttatccatcaagcagattaaacaacttcatacagatggaaaatggtgtattgtgggggattttaatagcatcaaacacccagatgagaggttgaccatgtcacaaagagagggggacagcaacagtatctcagaattcaatgaatggatttcagatcttgaagttgaagaagtgccaagcgttggcagaagattcacatggatttga

SEQ ID NO: 81630 - DNA, 243 bp, Glycine max
  Peptide Sequence Number=SeqID_173315
atggttacctcaattctttattgcgggaaacgattatttagcttgatcagtggtattccatctatttttgaagttgtgactgataggaaaccagttaaggacaagccaactacggatagtgaaagcaagtataggggaagtgccaagattaaacaagtaaataacacaagagaattgttaacccagttcggtgcaacctcacctacatctgggggctaccaagccagggaggaaatccactaa

SEQ ID NO: 81631 - DNA, 1560 bp, Glycine max
  Peptide Sequence Number=SeqID_173316
atgggtacattgcctcaccaaaaggatgaagggggcgttcgtcatacctctactactgcaacattggatgatgtcgttggtgtaataaagcatttgactcaaacgctggaaaacatggacaaccagaacagaacaagactggatgcaatagaaaacactaaccacacaatgttgaaggccatctgcaacttcgtcaggcaagaccagcatgagtcaacgaaagatgctatggacgatgtagcaatgagtggaacccaaaatacttgtgtcaatgatcaaagacttccgtgtgaaaaccctaagaagccgacatccaccccgacagtaaagtcgatgaaaaacgaggcatactcgaaatcgatgggaagttttaaaaatattgaaacaatattcataccaggcgacgacgatgatgaatttatcaagccgttgccaataggaatgaagggaagtaaaagcagctactcgtctccgagaacactaaacctttcaggaccgaaccaggtcaacaccatagataactcctccccaccggaaccattcatgagcaactacgttactggactgacagcaaaggccaagaacaacaaagaaaccttaatggcgcctaggaagttgagtttcccccaacacagttatcggacttcaaagaagccaaaaattgagcaacattcagaacatttgaatgccaaaaaaatgcaacaaactaggggcagttcgtctagaaacatgaccaacaacaaccaaagccggatgtttcataggtgtcgcacgacttccagtaggggatacacacacactattcctaaggacatgccctgctgcttcaagccaactgtggacatgaatcttatatttgaggagacacaggtttgtgcgtatgtgttcaaccctaatctggacccgagcgggaaggaaattctatataaggtaggaaacaacttgggcacacgacaaacctttcagtcgttgtgtcccaataagccagtaagggaggaggtatatggatcattccaaactatgcattttgcaaaaacatgctacaaagtactgacaacattcgaggttcttaaatttggttttcaatgcattgcagataatactattcatgtgtttgaaggttgcttacagccaactgtaccgcaccaggagtgtttggtgtcacccgcctttgcggtggatgtcattaatggaagtccagtggaaactctgattgaacattatggaaaggattggatgcctccattttcggacttgaagctcgcgaatgtgatgcttagtgttctggaaattgtgtttccaacacaagaattcgttattggctttgatggaatggattgttgggatattattgaagctagaggaatcccaaattgtggatccagtgagaaatcaacattatgggtccttgaatggatgcaaatggaggagtcttttgtcagtcttttgtatagagtgctagaagaaaaggccgtcagaatgaaggtgacaatgatcctgctgttagggacacacaaccagtgcaggggagagttgattacaaatgcagagcgcaactag

SEQ ID NO: 81632 - DNA, 708 bp, Glycine max
  Peptide Sequence Number=SeqID_173317
atggactcagcatcaggggaggcaccaccaccaccccaacccacttcagtagaagctccaccaccatcaggctcttcagctccagccacatcagcaccagcaccaacacaacccgaaggatcatcgccggcgccgctgagtcgctacgaatcgcagaagcgacgagactggaacactttcttgcagtacctgcagaaccacaggcccccattaacgcttgcacggtgcagtggcgcacacgtcattgagttcttgaagtatttggaccagttcggaaaaaccaaggttcatgtcaccgggtgtccgtacttcgggcaccccaaccctcctgcaccctgcacctgccctttgaagcaggcgtggggaagccttgacgccctcatcgggcgactcagggcggcctacgaggaaaacggaggccgccctgagtccaacccattcggcgccagggccgtcaggacttgcctcagggaggtaagagaaggtcaggctaaagcaagagggatcccttatgagaagaagaagcgaaagaggaccaccatgacggtatccgcggtgagtagtggtggtggtagtagtagtgcagttgctgctacgagtggcggtggtgacagtggtgataccattattggtggtggagttggttctagtgctagtttagcttctacaacaactgccacagctaatgttactacaaccacagtatag

SEQ ID NO: 81633 - DNA, 599 bp, Glycine max
  Peptide Sequence Number=SeqID_173318
atggacatctcaaacatcttgatggcccgctccacagaagaaccattctatgattctcctgtagaagaagaaccatttatctcaaagggttcatcctccaagtcaaatgcaagaccttggtttacccttgatgatactcctccaagagaatggagaaaaaaactcatcgagatgggagcatggctcgatacaaaattcatgaaagatgcagatccttacaaagtaattgaagaattttgttgtcggatgagaggaacattaaaggaatggtatcacaatctaagaactgtgcgtcaagaccagttccatgaattgggatctattgtagctgttctaggaactctccatcaagaatttattggagaaggaaagatcattgaaagaaagatcaggcaagaattctttgaaatgatgggctgtttttgtcaacttggcctaaaaccagaagaccggtataaaactgatgcaatcgtccctaggaagggaccagtcactagagccatgagcaagaggctccaagagaattgggctagagctgctgaagaaggctataaggttctcatgaaccttagggtagatttcgtagcgcatgggccaag

SEQ ID NO: 81634 - DNA, 515 bp, Glycine max
  Peptide Sequence Number=SeqID_173319
atgactttcaagattctcaagatccctattcctagttatcaattcaacacaagctataaacctcagaagaatctaatgaaactagaacagaatcggacgaatctaaggaacaatctaaagaatcttcaactgaagcagaaaaatcttattctaacgaggaataagagaagaagaaccagtgatctcaaagggttcatcctccaagccaaatgcaagaccttggtttacccttatgatactcccccaagagaatggagaaaaaaactcatcgaggtgggagcatggctcgatacaagattcatgaaagatgcatatccttacaaagtaattaaagaattttgttgtcggatgacgggaacattaaaggaatggtatcacaatctaggagttgtgcgtcaaaaccagttccatgaattgggatctactgcagctattctaggaactctccatcaagaatttattggagaaggaatgatcattgaaagaaagatcaggcaagaattctttgaaacgag

SEQ ID NO: 81635 - DNA, 213 bp, Glycine max
  Peptide Sequence Number=SeqID_173320
atgacggttagagtgaaagcaaaagtgagtgaggaacgacaacgagaaaacaagcacactaggtcaaatgttgaagaaagggcacaaaatcttaaaggtcgtcaccatagcacaactgtttgggtggagttgggaagtggccacgttcaagtgctcaagaagagcatactagaaggcggtcaaggggaagatgagacccaagacctcaaatag

SEQ ID NO: 81636 - DNA, 426 bp, Glycine max
  Peptide Sequence Number=SeqID_173321
atggggctagttagaattgttacacaatctgaacagtttgatggggatggtcctgtctggaagaaagctcaggttgttcccaaatcgagaaaagatgactcaggctctaacaacgacatgaagaaaattcctgttaagaacaggatggaacggtggaaagcaacaggagttgtggcattgtctgaatgcaacttggaggtcatacctgatgaagtgtgggtttgtggatcttctgcaagagttctagattgcaacaacaattcaattacagatgtccctgatgaaattgcacgtcttaccggtctagatgtttcagtctcttctccttctcgtttgggaaccctatcagagcagtcagaggaaaaactaaaggaatctcaagaaatcgctagagatgtcgctattgctgtcacaatacacacgtga

SEQ ID NO: 81637 - DNA, 442 bp, Glycine max
  Peptide Sequence Number=SeqID_173322
atggcattgccaaaaggaagaatatgcatcttgttaagactgcttgaacattattacttcatgccaatgtacttgtccgacattggggtcttgataagcttgctgcttgagccatcaaatgtgtttttcttggatattccagattatagaaagattaccgattccaatactcttcaagaagtttttcctattccctatcttggtccatcaccttctttgcaagaatcagagtcaactataggttctaccatagatattcctgacaatcctccacttgagaagactcaaagatcacccatcgtatatcgacatcatcctcgaattcttgacgtagaacttgaaggtaatgaaagaccatctgaatcatgtcttactccagtagataatccgaccatggacctactcgaagagaatcttgactcgcccattgctcttaggaaag

SEQ ID NO: 81638 - DNA, 350 bp, Glycine max
  Peptide Sequence Number=SeqID_173323
ggtacatcctttgtggtacaagtagagggtacatctacttggggttgactgagaacaaaagagggtacatctcttgtggatcagttctagtggagggtacatccactaggttcaaagagaacaagggagggttattccaagatcatgatgaagaccaagtcaacttgtgtctcatgacaaaatctgatgagaataacaaagaagattctgtaaggaagaaatggtacatagacagtggatgttccaagtacatgacgagtgatgtatccaaattcacaactattctcccaagaaaagtggacatgttacataggcgacaacaacaagggcaaaattattggagtcagtaa

SEQ ID NO: 81639 - DNA, 828 bp, Glycine max
  Peptide Sequence Number=SeqID_173324
ggaaaggaaaaggcattggcagatcaagaggaatgggcctcgtttattgacgtcttcgccctattgatatttggtgtcatcctcttcccatatgtggagggattagtggacctagcagcaattgatgccttccttgcttatcaccatatcaaggaaagcccagtcattgctattttggctgatgtctatgacacgcccacctgtccactgcaaggccaccgcttatgcgccgagaaaggaaaggtgaactgggagcaactcttggctagcgtggaaggaagaactggggttttgtcctcatgcgaaggattctcaattgttcccttaatgggaacaaggggttgtatcaattacaaccccatcctcgccataagacaacttggctaccccatgagaggagcgccatcagagaaaagcatcatgcctttcattgttgggggtttcagtgaccccaatgcaagagtacttcaaggagctgcaagagaggaagagactgaaactccagaggagagtgaggaagtgcaaaccctaaaggcggaacttcaaaaagcccaaatagtcaaagagcagttcaagtcaacggccatcaattacaaggaaaagctaagcctagcagcgactcatgagcaaaggctagaggacgagtacgccaaggtgtcaatcctacaagcggaaagggaagctagggaaagggtgatcgattcattgcacagagaagcgatgatgtggaaaaataggttcgcctttactttgaatgggagtcaagagctcccccgactgctagccaaggccaaggcaatgggggatgtgtactcggcccctgataag

SEQ ID NO: 81640 - DNA, 111 bp, Glycine max
  Peptide Sequence Number=SeqID_173325
atggctcggagctctgagaagaaggatccaaaagaattggagttgctggagctagagggagatgagagggattcaaaggtcagagaatcagatgtgactcctcgggcctag

SEQ ID NO: 81641 - DNA, 492 bp, Glycine max
  Peptide Sequence Number=SeqID_173326
atgaaggttcatatctcctcaccttcaaaggactacatgtcttcaccttcaaaggactacatgtcctcgccttcaaaggactacatgtcctcgccttcagagggctgcgtaccctcacctttagaggactacacatcgtcacctttagaggactacacgtcctcgccttcagaggactacatgtcctcgcctttagaggactacacgtcctcgccttcagaggactacacgtcctcacctttagaggacgacacggctgcacgccctcgccttcagaggactacacgtcctcacctttggtggactacacgtcctctccttaagaggactacacgtcctcaccttcagaggactacacgacctcggcttcaaaggactacatgtcctcacctttatagggctacacgccctcgccttcagaggactacacgtccttgccttcagaggactagacgtcctcaccttcagagggctacacgtcctcgcctttag

SEQ ID NO: 81642 - DNA, 201 bp, Glycine max
  Peptide Sequence Number=SeqID_173327
atgggggtgcaaatagcaactagatccacttgggccttccagaatattcctctcgaaggtagttgcttcaggaggaagcaacctagctcgcctggaaaatccaagccgaggcgcttccgtaacgtttctgtgggtgatttcgcgaagattttcaaccgttcttcgttcgttcttcgtcgttcttcggtcttgaaccggtaa

SEQ ID NO: 81643 - DNA, 174 bp, Glycine max
  Peptide Sequence Number=SeqID_173328
atgtgtgtgatagtgtcatcgacacgcttcttaacattcaaggatctagctgagatgggtatacgagcccagttatatccaaggtctgacggtaagaaaatatacttgtctctagcatgtctactttgtcaagaaatgagaagacaagtttctatcagtgtccgcgccgtgtga

SEQ ID NO: 81644 - DNA, 306 bp, Glycine max
  Peptide Sequence Number=SeqID_173329
atgtgggaatacaaaacaatgcacccagatgttaatagcaacttgtctcaaatgaaacaaatgaggttgttaccaatatattacaagcctacccttcggcagaagggcgacgcgagggctcacgggtgcgtcttccaagaaaggaaaatgcgcggagtcgccaccaacgtttattcgaggaaaacgtccgaaaaaccggaaagacgtggtctacgaactttaagtgtgaaaggtttgggagttgtatttacgcacggggaaggtattagaaccctatgcgcccgtcacaagggacgacagccttaa

SEQ ID NO: 81645 - DNA, 144 bp, Glycine max
  Peptide Sequence Number=SeqID_173330
atgggtactttgagggatccacgatgtcggatacaatgtcctgacatcctgcccgagaatactggagttgctgtacaatgcaagataaaagtcaagtgcagaagtgaagctgcaggatccacgatgtcggacacgatgtcctga

SEQ ID NO: 81646 - DNA, 204 bp, Glycine max
  Peptide Sequence Number=SeqID_173331
atgaaggttgagcaagtctttgcttgccatcatacaagtgaggaaaggaaggttcctttggctacccttagcttccaagggtatgctatctattggtggacttccctagttaaggaaagaaggattcatggggatcctccagtagagtattggaatgacttgaagagttcccttagggaggaggcacatgccctcctactataa

SEQ ID NO: 81647 - DNA, 459 bp, Glycine max
  Peptide Sequence Number=SeqID_173332
atgtttattcgaggaaaacatcggaaaaaccaaaaggaaaaggtcaaaggtctacgtattttggaaatgagggtttgggagtcattcacgcacggggaaggaactcatgggaccttgtacttcagccttctcacgcttatttatagcaaaagaggggtggaggttgcacagaagcttgcccaggcgagctcagctcacccagacaagctgcttgcttactctagaagtaacttgctcgcccatgcgagttcagctcgtccaatcgagctcgttacttcatctctaagctttctagtgggcccaggggaaatgaggggaggaggttgcacagcagctcgcccaagcgagctgcttgcttcctccagaagtaaccttgctcacccaagcgagctggttacttcatccctaagctttctggtggcccaggcgagccaggggcctgaaaaagtcaccaaatga

SEQ ID NO: 81648 - DNA, 447 bp, Glycine max
  Peptide Sequence Number=SeqID_173333
atgtttgttaaatttctcattttcttctgcaaagcttcaatttgtagcctcaaatcagccactaccattgtttctcttgagacagaagacgaattagaaattcgaatagctgcacgtcttccatggtggcattgccgaatgaaactaccagaaaatgcacaacaactgccacttgcaaacatggacaaatcaagtgaacaagcagcagggactgagcctcagagtagaagaagaagaagcaactcagcgtgggaagaagaagaagaagaagaaacaaccagcaggactaaattgcctattcactcggcgtctcctctctctcttccttctccattccgttgccattcatcttccatgaagcaaaggaatccattgatgaagaagatcctaggcctacaagctcaaatggagcttacatcatgtggtatcaagagcatcttcatctag

SEQ ID NO: 81649 - DNA, 258 bp, Glycine max
  Peptide Sequence Number=SeqID_173334
atggtgggttacacaccttcaacctttgtggatttggtcttcaccggcgagaggatcaaagtgggcctggaaagaggtaaatctgaccatcctgctttgatgaatgcaaaaaatggggcaaatgaagagggtgagaatgaaggagaaacccatgttgcgactgccattcctatacgaccaagtttcccaccaaccccacaatgtcattactcagccaataacaacccttctccttaccaaccacccagttatccataa

SEQ ID NO: 81650 - DNA, 321 bp, Glycine max
  Peptide Sequence Number=SeqID_173335
atggaagagagatctttactttcagaaatagcagttactgaaattctgatatcaatgaggacagatgtcgtaccggatgtcacgacatcacgcttcagaacatggagattatatttgactggtgacatcaaggtggctcacaaaacactcaagtcccaaaactcacaaaataactcttcaatcccggacttggttcagaactcgtgcagccttcatgtttatatagcagtgtgcgtatctgggctgcaacagcttgcgttggatgagatctatcattctcctgaaaaatctgcacttaaagatctaaaagatcaagtttga

SEQ ID NO: 81651 - DNA, 279 bp, Glycine max
  Peptide Sequence Number=SeqID_173336
gttgtaccatttgtggtggtgctcatgaatccggccattctattaccttttgaagaacaaacgcaggaagttagttacatgggaaatcaacaaaggcaaggatacaaccaaggaggattctcaagtttccagcaaggtccctacaatcagcaaagacaatggggatcacaccctggtaatcaattcaataaggacctgggtggaccttccaacaggctgcctcaacaagggcctaatatcttccagatgtggaagcaattccttccaaggttattttga

SEQ ID NO: 81652 - DNA, 175 bp, Glycine max
  Peptide Sequence Number=SeqID_173337
atggcatgcaacctttgcttgaccgcttcgaggtacttggcacccattgttgcacaatacgtgaagttccataacgtgccggaagtcaaaagagagcattgttgcacgatccgtaaagggatgcaaatagcaaccaggcccacttgggcattccaggatgttcctctagaaggcg

SEQ ID NO: 81653 - DNA, 638 bp, Glycine max
  Peptide Sequence Number=SeqID_173338
ggctacacgccctcgcctttagaggactacacgtcctcaccttcatagggctgcatgccctcacctttagaggactagacttcctcgcctttagaggactagacttccttgccttcagaggactagacgtcctcgccttcaaaggactagacatcctcgccttcagagggttgcacgccctcgccttcaaagggctgcacgccttcgccttcagaggattacacgccctcaccatcagaggactacacgtccttgccttcgtagggctacacgccctcaccttccgagggctacatgtcctcaccttcagaggactacacgtcctaaccttcagaggactacacgtcctcgccttcagaggacaacacatcctcaccttctccttcgtagggctacacgccctcaccttcaaaggactatacatcctcgccatcagagggctgcacgccctcaccttcagaggactacacatcctccattttagaggactacacgtcctcgccttcagagggcttcacgttctcacctttagaggcctgcactccctcgccttcagaggactgcacgtcctcgtcttaagaggactacatgtcctcatctttagagaactacacgtcctcgccttcacagggctacaa

SEQ ID NO: 81654 - DNA, 318 bp, Glycine max
  Peptide Sequence Number=SeqID_173339
atgaggttctttaatggtgattttccaccatggagatgcagcggaagacaaaggagaagaggtgagaggaggcgccatccacttgggaataagccatggaagaaggagcttcaccaccaagatgagccttggataagaagcttggaaggatgcttcaatggaggaaaagaaagagggagagaaagagagaggggggagcacgaaattgaaggaataaaagagggagagaagtggaactttgaagtagcttccttgagaagctttcttgagaaaaattccttgagaagcttctttgagaaaacttccttgagaagctag

SEQ ID NO: 81655 - DNA, 588 bp, Glycine max
  Peptide Sequence Number=SeqID_173340
atgattccctacggcgaacacaaagaggattcatgtttaatgcatccgggcgtactgcatgatatggaaacgtgtccagtggtaagagatctagtacaacaaatgatagaccaaggccatcttgaggtcaacaatgagggggaagaggaaaaacatatacgcatgcagtcgacagataaggaaggttctaaaaggcctaaacccttggtaatacacttcaccaaaggcacggcttcgcaaaggccccgacacccctcggcagtgtcgggtgttaggcctattccgtttgcttacaagaacagtcacgcagttccgtggaggtacgcccctccgggcggaaaagcaaaagtgaccgaaggacagaatgtcaaggtgatccccacaccggacgaggaggttccaacggaggaatttaccgaggggagagaaggctgcggcaagaaagaggtatcacttgaggaggccagcgagttcctccacattatccaacaaagcgagttcaaagtaagggagcaactcaacaagaccccggctagagtctcccttttggagttgctcatgagctctgagcctcaccgagctttgttg

SEQ ID NO: 81656 - DNA, 468 bp, Glycine max
  Peptide Sequence Number=SeqID_173341
aggaaaatgcaaggatcatgcatgagtaaacatgaaaataaaaggaacgatacgttcattacgatgccatggagagatgcttatgcgatgcatgacatgaatgcatttacggacacgagagcccggaaaatcctctcttcttacttgcacatttgggggcacagtgccccatgtatcatcccctttgaaaacacatattgcggcagtagggactaccagcaacaacatgctatcaaagagaaaactctagatgagggttcactgttatcaagcaagtcggagacccagcatgaccacagattcacctccactccttatgttcccatggacccggtggagtctccaactgtcgcaacctacccttcagcgggagggcaacgcggggctcacgggtgcgtcttccaagaaatgaaaatgcgcggagtcgccaccaacgtttattcgaggaaaacgtcgaaaaaaccggag

SEQ ID NO: 81657 - DNA, 165 bp, Glycine max
  Peptide Sequence Number=SeqID_173342
atggaggttgaggaaccttggtcggggttatcgcaaccattgaattatcaagtagatatgggagcaaggcggtgtttggcattggatgtgcggcagactggctttgtggctgatttggggatggcctttgtggttgattgggtggtgggtaatgagaagggctga

SEQ ID NO: 81658 - DNA, 432 bp, Glycine max
  Peptide Sequence Number=SeqID_173343
atgcattatcttattgtgcatattcttctcccccggtcatctaatcttgctcaggtctttgaggaggacctgatagtcatgtgggcattcttaaccggtcgtcagctcgactggcccatcttgtatgtgaaacgttccttcgctattggtgttggcgtggtcacctcttttggctaccgtcgagacatagatggtcaatggttgaagaaagatgcgcaaccacagcaagaagaacgcactccctcacctccgcctcagagggatgactcctctgcactcatgcatgaagttctctcagaattacgtggtcttcgcacctatgttgatgagcgctttgattccttagatagtcgcctcgatgccatcgatgctcatcttgctgggatggacactcgcatcattcaacttgaggaaaatatgagcttcatctga

SEQ ID NO: 81659 - DNA, 129 bp, Glycine max
  Peptide Sequence Number=SeqID_173344
atgacgccacttccagtgaaggaagataagtcagggctaaaggcccaagtggagaaggacgaaggcctaagtggagaaggacaaagcccccgagtggagaaggatgaaggcccaagtggagaaagatga

SEQ ID NO: 81660 - DNA, 321 bp, Glycine max
  Peptide Sequence Number=SeqID_173345
atggaacctggacagtggttgctcatgacacatgacatgcaaaaaatctatgttccaatccctagccctatgtctggtggggtggtcacttttggaaggaatcaaaaagatctgataactggtgtagatacaatgtcacctttaacaagggtatgtgtatcatccaaaacaaggacaactcttcagtcttctttgctaagagacaaggaaatctctataagagtaaacttggtgatctgtccagtcaaaaggtgtcatgcttactctaagtcaaagagcatcattgggtatggcataagaagcttggacatgctagcttga

SEQ ID NO: 81661 - DNA, 195 bp, Glycine max
  Peptide Sequence Number=SeqID_173346
atgcagacgttggtttcaagcctacagtccaaatttgaaggcgatccaacagttaacgaatctgagattgaggttttaccaaaacaggccttggatcttcttcatcaatggagttctttgcttcttgaagatcaatggcaacagaatggagaaggaggaaaggtgattggagacgccacttcaacgagaagatga

SEQ ID NO: 81662 - DNA, 328 bp, Glycine max
  Peptide Sequence Number=SeqID_173347
atggcttcccgtaagagaaaagccacatcttttgtgtctcgggccgggcacctgataaaatttgatgttgattccctcaacaccttcttggagactccaatggttgtggagcaaggggagagcttgccctcttactccaggtttgctagactgaggcctgatcctcaagagcttgcagcccggctgtgtatcccttggaggggatttgttcttaatgccgagggtctaccatggaagctcctgaggaaagatcttaccactctggcccaaacctggagtgttctatcttattctaacttgaccccgacatcccatactgttggatcaa

SEQ ID NO: 81663 - DNA, 165 bp, Glycine max
  Peptide Sequence Number=SeqID_173348
atggaggttgaggaaccttggctggggttatggctaccattgaattatcgagtagatatgggagcaaggtggtgtttggtattggatgtgcggcaggcaggctttgtggctgatttaggggtggcctttgtggttgattgggtggtgggtaatgggaagggttga

SEQ ID NO: 81664 - DNA, 120 bp, Glycine max
  Peptide Sequence Number=SeqID_173349
atggatactggtgtaggtctagcgatttatgcagcttcaccatctttggatgaagcagaagggtttctagaagtttctaagagaaagagaaggttttgggtgcaaaggtttcttaggtag

SEQ ID NO: 81665 - DNA, 225 bp, Glycine max
  Peptide Sequence Number=SeqID_173350
atgttaaaacgacgaacgcctaatgttaaaacgaaaggacgtacctcaatggataagtgccaaagacgatctccacaaacacgatctccacaatgtggttgcagtcacgaaagcgcaggcgactttgacacaaggagaaagaagaagaacgatagggttcaagcgcaaggagaaagaagaagaatgatagggttcaagcgcaaggagaaagaagaagaacgatag

SEQ ID NO: 81666 - DNA, 534 bp, Glycine max
  Peptide Sequence Number=SeqID_173351
atggcttctaggaaacataaaagtattggttcaagacccacatctcagtatgacacaaggagattctcttccttagatgcttggaccaaatacacagataatgttctggggagaaatattttacctgagaggaaggtagagctttatcacattgagctagatgactttaaggctgaattggagaggcgtaatttccataaatgcctcaccaatttagtcaatgggagcatagacttggttttggtaaaagagttttatgcaaatttatacagttttgaggatcatccaccaaagcagtccagagtcagaggtcatttagtgaagattgatgttgacagtctcaacacattcctggagacacttgtggtattagctgagggagaaactctacccgcatactccaaatactgcaggttgcctacagacttcagagagataaaggttgccttatgcatacttggccgagggttcatcttgaactctgagggccatcctaggaagattctcaggaaggatttgactacactagcttag

SEQ ID NO: 81667 - DNA, 624 bp, Glycine max
  Peptide Sequence Number=SeqID_173352
gaatctagcttcaaaggaagcattgtgtgcctgatggtagcattatgtgtagcgattgcacttgtattgttaagggtgatcttagcattgacagtgttcaaaccaaggcaccccattaccaatgtggattcaataaggcttcagaacatgagcttgggcatggacatgtttagcatgagtgtaaatgtgaacttcacattggaagtggatgttttagtcaacaaccctaataagcttggattcaattactacaatagctctgcccaactcaattatagaacacaattgattggggaagctcctatccccaatggagacatattagttgaggagattaagggacttaacttgacactcactgttatggctgatcgtttggtctccaattctaaggtcaccaaggatgttgcattgggttcattgcccctcaacaccttaggaggagttgcagcgtttgcggaggaagtgagagcgttgggtgagagggatgacagtgagaatgggcacaagaagaggggtaattcttgtgccgacttccttgctaaacttggcgctgcattggatgatgctttgtgcatccttgaagttgttccagggggtttgataattttttttggtggctga

SEQ ID NO: 81668 - DNA, 75 bp, Glycine max
  Peptide Sequence Number=SeqID_173353
atgactgcgaatgaatgtaaaagtatgttctattctaattacaaagcaatatacgtgagcaagctcaagtactaa

SEQ ID NO: 81669 - DNA, 951 bp, Glycine max
  Peptide Sequence Number=SeqID_173354
atggatcaagacttggctatgatagaagtttccgtggaagccatcgcatccctcactcagtactatgaccagccactaaggtgcttcacagttggggactttcatgatgcaatcctccctaggaagggaccagtcactagagccatgagcaaaaggctccaagaggattgggctagagctgctgaagaaggccctagggttctcatgaatctcaggagcacaaaatttcgtgctcttctcttcctctcccttcattcatctccttcttcctccaagctcttatccatggcttcctatggtgaagcaaaggaatccattgatgaaggagatcctaggcctacaagctccaatggaacttacatcatttcagttggtatcgactgtagaagagttcgaagggatttagggatgcccgctaggaggaagccgtatctattttctgggttatacccctccatggtaagagtatcaaaagtggtcaaaatctcgacacaagaattggaccgagtaaagaaaaacagaaatagggtggttgggataccaaggaagaacttggaagagaaagtaaaagctttggcagatcaaggagaatggacttcattcattgatgttttagcactattggtgtttaggatcgtcctctttccaaatgtagatgggctagtggatctagcagcaatcgatgcctttcttgcttatcagcacaacaaggaaagcccgatcgttgctattttggccgatgcctatgacatgttcgaccggagatgcgagaagagtaggcgagaattgtctgttgcacacccgctctttatgtatggctggtctcccactcttttcgtcatgaaagtagacccgtctgtcccctacaaggtcatcacatgcttagcaatccatccactaagcgcacctctcttacggctgagcgcgaggaagaatgtggaagaaggatga

SEQ ID NO: 81670 - DNA, 342 bp, Glycine max
  Peptide Sequence Number=SeqID_173355
atggcttaccaaatagcaaaagttccccgagtgttcgatactcggttcttaccgttttatactacttgtgcaatctggtgcactttccggaagccgaacagtaccctatgcaatagccgggcgaggctcacgggtgcgctttccaaaggaggaaagatgcgcgaagtcgccaccaacgtttatttgtgggaaacgtcggaaaaaccgaaggaaaccggtcgaaatgaaaattctaagttcgggagttgtatttacgtcgacaaaagcggggcttttgctcctacgtaccctcctttggagaggaaatcagacctacgtagttctttcttatgcgtgaatcaa

SEQ ID NO: 81671 - DNA, 606 bp, Glycine max
  Peptide Sequence Number=SeqID_173356
atgaccgatagatttctggctggatcattaacctttgattgtcgcatcatgcactatattatcgttagaattttgcttccccgtccttctaatttggctcaagcctctaaggaggacttgattttgatgtgggcttttcttaccggtcgtcagatcgactggcctcacttggttaggtaccgaatgcataaggcattacaggccaatgcacctatcccttatcctcaattggtcactctgtttctccatcattttcaaattcctcttgatgatgaaccttttgttcaagtcaagcattcctttgctataggtgctggtgcagccacttcatttggttaccgtaaggatcgtaatggtcaatggctcaagaaggacgcgttacaagatgagcgtactccctctcctcctcctcagcgtaatgattcctcaacccttttgactgaagttatttcagagttacggtgcctccgcacctatgttggtgaacgattcaattctttggatgttcgctttgaaggcatggatacccgcatcacccaacttgaagaggatgtgacttatattcgtcagagcttcgatcttccaccaccaccaccaccttcttag

SEQ ID NO: 81672 - DNA, 123 bp, Glycine max
  Peptide Sequence Number=SeqID_173357
atgggtgggagtgacaactgtgattgtggtggtgttgatgacgatgatgatgatggtgggggtagaatgatgattgaccccatcggtcagactggttcgaccatgacccagaggtctggttag

SEQ ID NO: 81673 - DNA, 273 bp, Glycine max
  Peptide Sequence Number=SeqID_173358
atgtggcataaaccttcattcttcattgttgtcgcaacctacccttcggcgggagggcgacgcgtgactcgcgggatgcgtgttccacgaaaggaatacgcgcggagtcgccaccaacatttatttgaggaaaacgtcggaaaaaccggaaaagacgcgatctacgaacttttaagtgaaaggttcgggagttgtatttacgcacggggaagggtgtttccctttgctcctacgtattcctcaatttgtgatgaggaaatcagacctacgtag

SEQ ID NO: 81674 - DNA, 694 bp, Glycine max
  Peptide Sequence Number=SeqID_173359
tgttcctcttggtgtgggggtccaacggcaagcaacagcggcttacaacggccaccggtgctcttgggtggtggaaaataaggttttagggtttgggagacgtttttgggagaagaggagagtgaaaatccgcaagaatttgggcttagcgcagcccccctgcactaaggctcgcttagcgcacctttgggtcgctcaacgcaattcccctcgattggaattgggcttagcgcagctttggcccgctcagtgcaattcccctcggttggaattgcgcttagcgctccattctcgcttaggtgttacaggagctggtgatggtggtggtgaatatcatcaactggacggatctcagtgcttattactagacgtgatgaccacacaaatgcaacatttgctgaaccgtaacaatgaagagctctacaaacgaatagaaggactagagcaccaaatgaatccaaatgctaggagaccttatggtgggaatagaagggccaatgatggatcaaaccgaatggaggggcagaatagaattgagggagtaaaactcaatgtaacccctttcaaagatagaagtgacccagatgcctaccttgactgcgagatgaagattgagcatgtattctcctacaatgattacaatgaagagaagaaggcaaagttagcagcacttgaattctcagactatgctctt

SEQ ID NO: 81675 - DNA, 345 bp, Glycine max
  Peptide Sequence Number=SeqID_173360
atggagctctaccacactaagtttgatgattttaagactgagttggagaggcgtaatctccataaacgcctcaccaatttggttgatgggagcatagatgttgctttggtgaaagagttctatgcaaacctatacagctctgagggtccttcaccaaagcaagccagggtgagaggccatctagtgaagatcgacactgatagcctcaacatattcctagagacacctgtggtgttggcagaggttgatactttgcccacatactctagatactgcaggttgcctttagaacctagggagattgagtctgccctatgcataccaggccgagggttcatcttgaac

SEQ ID NO: 81676 - DNA, 316 bp, Glycine max
  Peptide Sequence Number=SeqID_173361
atggcagacacgactaataaatcacacattatcttgctttcaaatagtctcccaattgatacacaaagtatggcatttttaggagaaactagcagtcaaacgattgtcaactcaaggttggctttcatttttccaaatggatcaattattcacaatgatactggcgtttacttccaaacttcaactccggtgcccattcgagtaccaaatagttgtgattttgcaagcctaaaaaccagaatacacaatacccttcagctatccgacaaagaatttttggatgaaattcactaccggaagccattcactgatacag

SEQ ID NO: 81677 - DNA, 369 bp, Glycine max
  Peptide Sequence Number=SeqID_173362
atggcggaaggacaactggttatagtgttaggggaagaaaagatactagtgagttgtccatcctctacaccctatgtggaagctacgaaagagtcattggaaacatcttttcaagcactagaaattgtggacaatgcttatatggaagctcctccgatgcaatcgcatttatctggtgcctccttgatggtagcccgagttatgttgagggatgggtatgagcccggaatgggtttaggccggaatagtgataacacgacaagcttggtgaggttcattgaaaaccatggaaggtacgatctgggttatgagcctacacaggctgacaagagaagggtcgccttagaaaggaaaggtgggatcctctag

SEQ ID NO: 81678 - DNA, 333 bp, Glycine max
  Peptide Sequence Number=SeqID_173363
atgaacgcctccaaactcatgggtggaggatgcatgaacgaaaacgcaattcatgaggctccgaaaaagggtagagactggagaattgcactaaaagatcactacgcacggctccaaactcgagggcggaggatgaatgaacggtccaaactcttgggtggaatatgcatgaacgaaaacgcaattcatggggattcgaaaaagggtagagaatggagaattgcactaagcaatcactacgcatggctcaaaactagtgggcggaggatgcatgaacgaaaacgcaattcatggggctccgaaaaaagggtagagaatggagaattgcactaa

SEQ ID NO: 81679 - DNA, 300 bp, Glycine max
  Peptide Sequence Number=SeqID_173364
ggaataggaagaatcaaaagaattctcagactgtgtcgtgttgaattctttgacaagggagacacaaaagaattcaggcggttagtccttccttcttttggaaaagagagaagagagacacaaaaagaattcaggcggttagtccttggcgaattctttttggcaaagggagaagagaatgaaaagatgaatagcacaagttttcaagttttggaaaaccaaaaaccttcagaaagcttttggtacaaagaagaagaagaagaacttcaaagagatttcaaggcttgtaaagaattgtaa

SEQ ID NO: 81680 - DNA, 468 bp, Glycine max
  Peptide Sequence Number=SeqID_173365
atggcacctattccaacaagacataaggcacccgtgtccgctccaaagttatcgctcaaagaaggaaaagaggaagttctcttctcatgtggggactacccaaacattccgttgatagggacgaggggttgtattaactacaatctcgaacttgctataagacagttagggtacccaatgaggggagcaccgacggaagagagcctctcgcctttccttgtgagagatttcggcgtgcaaagtttcaagattaacatccatctcaagaatcaagattcaagattcaagttcaagaatcaagatcaagattcaagactcaagatctcaagaatcaagatcaagatctcaagaattaagatcaagattcaagaatcaagaatcaagactcaagatctcaagatctcaagaatcaagatcaagattcaagactcaagattcaagaatgaagaaaagactcaatcaagataa

SEQ ID NO: 81681 - DNA, 123 bp, Glycine max
  Peptide Sequence Number=SeqID_173366
atggccttacgggaagtttcgatgatgccaaagtattacccaaagatggttgtcatcatcaaaaagggggagaatatgaatgaatatcatacaggttttggtgatgccaaaaaggttacttga

SEQ ID NO: 81682 - DNA, 396 bp, Glycine max
  Peptide Sequence Number=SeqID_173367
atgtctcttgccactctctttggaaaacttcaagaacatgaaatggaacttatgagactccatcaacatgaagagaatgatataaagagaaaaagaatagcattcagagcctcatcatcttttattcaagaagaaagtgacaaagaggacttgactgaaatagaagaagatgatgatgatttcagactctttgtgaaaaggttcaataaatttctgagaaacaaaagaaataaaagaaaatcaaacatcaatacaaagaagaaagaagaagactcctccttagccccatcatgctatgaaagtaatcaaccttggcacatgagatccgattatcttgtctttgaaagaagaattgaaaaatccgacaagaggaatctcaaaaaaaagaaagcatag

SEQ ID NO: 81683 - DNA, 186 bp, Glycine max
  Peptide Sequence Number=SeqID_173368
atggagagaagaaaaagaccaagaatgagctggctagagaaaacagaaaggaggcaagtccaagcaaaagggaggaggtgccatatccattgtgaaaacatcattgtggaaggaaactgtagtgttgtaattcagaggattcttccaccgaagcacaaagatcctgagactgtgactattccatga

SEQ ID NO: 81684 - DNA, 294 bp, Glycine max
  Peptide Sequence Number=SeqID_173369
atgaagcaaggcttcacggtgaatgtgattcaaaggtgttttgataaaaacaatgatgacaaaggtgataaacaaaaagctcaaagatcaaagaacaactcaagtgaatcaaagaacatctcaagtgaatcaagaacaagtcaagagttcaagaatcaagaagaattcaagactcaagaagaaagcctagaatcaagaatcaagattcaagattcaagatctcaagaatcaagatcaagattcaagactcaagattcaagaatgaacaaaatactcaatcaagataagtattaa

SEQ ID NO: 81685 - DNA, 195 bp, Glycine max
  Peptide Sequence Number=SeqID_173370
atggggcaaaacacaccaaaagattatgatgatggatggctcaaattcccacaaagtcaaactcctcctccttttgcaacaagttggatgtggaagggctaccttgttaaaatctcttataaagcgcctgtagaatcctgcatgaccaagaaaagatcgcacctctcgcacgcaagaggggtaaggcaattgtga

SEQ ID NO: 81686 - DNA, 306 bp, Glycine max
  Peptide Sequence Number=SeqID_173371
atgaaatcgtttcaagattatgatgaagaccaagccaacttgtgtctgatgacaaaatctcatgaaaacaacaaagaagaatttgtaaggaagaagtggtacatcgacagtggatgttccaagcatatgacagaagatgtatccaaatttataaccatttcccccaagaaaagtagacatcttacatacggcaacaacaatatcagtaaaatctcaaaagagttagaagttgaaaatggaagttactggaagttgaaagttgaaaacggaaatggaagttattggaagttggaagttggaatttga

SEQ ID NO: 81687 - DNA, 267 bp, Glycine max
  Peptide Sequence Number=SeqID_173372
atgtcgaatcataagagtactgagtcagcactaaagaaccttgaagtacagatgggacaactggccaagccgatagctgacaagtcatcaaacagctttggagcaaatacggaaaataatcctaaggaggaatgcaaggctgtgatgaccatgagtaaaaggtttgtggaagctaaggatgaagaaaatgtggtagaaaaggaacaactgagtgcaaaggtaggtgctgaggttaagaaaaatgatgtgaagggaaactggaaataa

SEQ ID NO: 81688 - DNA, 180 bp, Glycine max
  Peptide Sequence Number=SeqID_173373
atggatatctgtgaagataatgacattcctgtaattttgggaagtccattcatgttaactgcaagctacatagtggatatagggagaaagaagctggagctgggctttgaagatcagaaaattgattttgatttatttgttgaagacaagcctgctctggaacaaaatgtttgcttacag

SEQ ID NO: 81689 - DNA, 525 bp, Glycine max
  Peptide Sequence Number=SeqID_173374
atggatggctcgctaggccagaagattggcttagcgagagggcggaatttgaaatcccagaggcttttgatagtaggacgaaaaagaagttactttagattgtcggtgagagatagaggcagtttaaatcaaacctcacgaggaaatgggcccttgcagccgaccaggacggtgtggacgacactgtctatgagaaatacggcatatgcaaggaaaaatgggcccagttttgccaaactcgtagagacccttcttgagaggtataagctcctggttgagaagaccaagaagaagttggaggaagctacacagtcaggaagcgttgatggcgtcatcgaccctccatcccccgtcagaagccacgtgaagcggaaaatggcccgcaccaagaaaacaggggagataacgactgaggccgcaaaggaaatcgctgagaagatcgattcctttgaggagctggcgtcacagggatctttcgtccccatggacgtcaggatgttctcaccgctgctattggacgtctag

SEQ ID NO: 81690 - DNA, 244 bp, Glycine max
  Peptide Sequence Number=SeqID_173375
gcttgtagtgagtttcaaaacaaggaaagggaaacaaggctcaaaagggctatcaaaggaattaattcaagcatcaacaagaatcaagccaaggctattgtgcaagcaatcaatggggcaaaacacaccaaatgattatgatgatggatggctcaaattctcacaaagggcattgggtagaagactccaagtagattgggctagagatccaagggaaggccctaaggttctcatgagccttagg

SEQ ID NO: 81691 - DNA, 521 bp, Glycine max
  Peptide Sequence Number=SeqID_173376
atagcaagaagaatttttatacggctaaccactcgggtatttccgcctctcatcgtgactcaaatgtcagtatgacagatcttgtgagcgcggaagatgacgcttttggtcttacagatagcaagaagaatgtttatacggctaaccactcgggtatttccgccggtcagtgtgactcaaatgtcagtatgacagatcttgcgagcgcggaagatgacacagcaaaaaagaatgtttatacggataaacactcgggtatttccgccggtcagcgtgactcaaatttcagtatggcagatcttgtgagcgcgaaaaatgacgtaaatctccgcgtgccaaccggcttgtcggccgcgattgacgaagggcgcagaagacgatgtcagtcttcgcatgctatcaggcttttcgtcttacagacagcaaaaaagaatgtttatacggataaccactcgggtatctccgcccgtcagcgtaactcaaatgtcagtatgacagatcttgtgagagcggaagatgac

SEQ ID NO: 81692 - DNA, 96 bp, Glycine max
  Peptide Sequence Number=SeqID_173377
atggatgaaccaattccaaataggcttaagaaatgctcattgtgtagaactgaaggacataatcggagcaactgtccatacaaacaaattatttaa

SEQ ID NO: 81693 - DNA, 348 bp, Glycine max
  Peptide Sequence Number=SeqID_173378
atgaagcaagtatcaatcaaggcaagtttttctggtcatgcgtctcaaggatgtcaacaaagttttcaaccactggggttctcatcatatatacctcaatattcatttcaagtcccttctacctcaaatgttttttatggctcctcacaaatgtttgccaccactttcaacactcctccatctgcatataatcttgcaccatcgagttcttgttatcgtccatcattacctactcaaatacgtgacataagtcacaaagatgaggacgagaataaggacgaggatgaggataacaataataacaacgatgacgatgatgatgacaacaatggtcatcatgttccttaa

SEQ ID NO: 81694 - DNA, 372 bp, Glycine max
  Peptide Sequence Number=SeqID_173379
atgttattgattgttaatggtgcttttaatgtgaagcttatggttaaaattagaggtttgggtcggactttaagcagagttataggaagagccttagggagagaacctcaagaagcaattgttgatgatgtagttgctaatgttgagagttttctaggcgagtcccatgacacatcagtgttaatggactatgtttatcatgttgcattaactgtttggaatggagagaggtggtatgagaaaactagtagttttcatctgtcggaagaagaggtgactatcaccttggatgatttggcatcgtcgctgcatttgcttattgaaaggatagaaaggttgctcaacctaaggatagtgactgaaggaacataa

SEQ ID NO: 81695 - DNA, 677 bp, Glycine max
  Peptide Sequence Number=SeqID_173380
gtcttttcctcagatgtgatgcattccttggaattatcgccatcgacaaagatctagcattggtgaatgcagtgaaaattgtattccttaagacaaccaatttgttgtgtcagtttcacattgataagaatgtcaaggcaaagtgtaaaaccctagctggtaaaaacaatgcatgggattatgtcatggaagcttgggggagtttggtgtattgtccttctgagcaagagttcgatgagtgctttaagaagtttgaaattgtttgttcaccatggccaatgtttgttgactatgtcaaccaaacatggttgattccccacaaagaaaggtatgctttaaaccaaattgctgctgagtttgagcatgtacattatgttgacaaaaacccttctcgttatggatgtatcatgagaactactcacggtcttccatgtgcatgtgagctagctagatatgttgttggcatcatgccacttgagacaatccatatgttttggcggaggctaagtttttcagaccaagggttatctgagcttgaagtcagcataatcaaagagatggaaaccatatccaagcggtttgaagagcttgatgtttgtggcaaagttactctcaagagtacactttgggaaattgtctactctgatttaaactctatgtgtgctcctccagaaaag

SEQ ID NO: 81696 - DNA, 1314 bp, Glycine max
  Peptide Sequence Number=SeqID_173381
atgggttgtgctaattccaaaccaaagggatgccaacattgtcactgcaacaccccttattattcttcttctatggctagaagcttctcggtgcatgtacatcacccacctcaaaccaaaggagacagttaccatgttgtggcactgacatcaaccacactaggttctctggaccaggatgtaccccacaacaacaactaccatggcaatggtttaaggtttcccaatggcaaggtcattggtagtgacagtttcaggccccagaatcaggatcatgatgatgatgatgatgatgacgaggttgaggttgaggagaagaagaatgagccaaagacatggtctgaaatgattgaacaaatgttgccaaaagctatgatgaagtctccaatctcaacacctccttgtgagccagagacaatcaacacatgggaactaatggaaggacttgaagacacaacaagccctttcagatcaccaaagcacttcaagagcttctcttttgatgtcaatgtcaacaggcatgttgatgttgctgatgttgatccacccttaattcagaatggcaatgattcagccaaaccaatatcggtttcagattctgatgatgagcctcaagagaatcaagagagcatggacagaaaaaggttcttctctattgaggaagagatgatcagtgatgatgttgtttcttcattcaagaaatcgtcgcaagagaagcaagagggcatggatagaaaggggttctctgttggggaagagaagatcagtgatgatgatgatgttgttgtggatttgaagtcatgtgggaaggacaaggtggtgttgtatttcactagcttgcgtggcgtgagaaagacttatgaggattgctgccatgtgaggctaattctgaagggcttgggggtgagggtggatgagagggatgtgtcaatgcattcagggttcaaggaggagctcaaggagctattaggccatggatatggtaagggagggttaggattaccaagggtgtttgttgggaggaactacattggtggagctgaggaaattcagcaactgcatgaggaggggaaacttgagaaattgcttgattgttgtggaaagattgaagatggtattgatggcgatggactatgcgaggcatgtggggatgtgaggtttatgccttgtgaaacttgttatggaagttgtaaaatctactatgaaggtgatgaagaagaagattatgatggtgaggtggtcagattttgtttgtacagtgaggttttggtgtggttgatcatgttagagaagaagaaggagataaaagagtga

SEQ ID NO: 81697 - DNA, 542 bp, Glycine max
  Peptide Sequence Number=SeqID_173382
acattgagagacaaagagggatttcagaagatcacatagagaatttagtttctattgtgattattcaccgtccttattttatggaacaaggaaaactctggtctagaaatgaagctcaagtctggggaacctttgaagtatatcccttggaagaaagttatcgtcatcagctagcaaggcatctctgtgagatcaacaattactcatacaaaaatgtagatccaaatctgcccagttcatctcaaaggccaaaggaaagttatcctactgataggataataccccagaatactgatgatggtcaaatccgaacagagttttatgttccagaacctgagtttcaaaaggcagaagatttagctgatgattattcctcattagaacaagattggaaagactataatgctcaattaatggaggacttattgcacaagaagagatatcgttatcatcacccgatgtatagaagtctcaccagatcagaggataaggatgaccgtaatcttatcctagtcattgtgtgccatgtgtcagtcgtttaa

SEQ ID NO: 81698 - DNA, 207 bp, Glycine max
  Peptide Sequence Number=SeqID_173383
atgcagaaactagaggaagttggaagctctgtcaaggctcggataaagaagataatgcaagctgatgaggatgttggaaagatagcactcgctgtgcctgttttagtttctaaagctctagaactatttttgcaagatctttgtgaccgcacttatgaaataactcttcaaagaggagcaaagaccatgaattcattgcatttgtaa

SEQ ID NO: 81699 - DNA, 279 bp, Glycine max
  Peptide Sequence Number=SeqID_173384
atggaaaatagcaaaaagaaaaaagaaaagagaaggaaaaacaagttctttggaataaacaaatatctaaaccatatgataacaaaagatgatgacaaaaagctcaaaggtcaatcaaagaatgagttcaagatattcaagatagaatcaagaacacttcaagattcaagaggaaagttgatttcaagaatcaagattcaagagatcaagatttcaagaatcatgattcaagagatcaagattcaagactcaagattcaagaatcaagagaaggcttaa

SEQ ID NO: 81700 - DNA, 220 bp, Glycine max
  Peptide Sequence Number=SeqID_173385
atggaagatattagtttttcaccagaaggaatttaccctatttcttcaccaattaatgagtctccttctccttcaccttcaccaattgatcaaactcattcacctattcaagttgatcttgcaccttctccttcacctgttaatgttgatcatactccttcacctcatgaagatgaagttaataatgtggaggcacaaggaggaatatgtaggctgaaaa

SEQ ID NO: 81701 - DNA, 993 bp, Glycine max
  Peptide Sequence Number=SeqID_173386
atggccccgaggaagcttgcctcaaagagatctaggaaggacaaagcggctgaaggaaccagttccgctcctgaatatgacaaccaccgttttaggagcactgagcaccagcagcgcttcgaggccatcaagggatggtcatttctctgggagcgacgcatccagctcagggatgacgagtacaccgacttccaggaggagatagttcgccggcgttgggcatcactggttacccccacggccaaaggagggcgtgcgagatatgcgatcctgggtgaggggtcagtggatcccgttcgatgcggatgctctcagccagttcctgggataccctttagtgctggaggagggctaggaatgcgagtatggccagaggaggaaccggatttttcccggactgctgctggaagacgggtgcggatcatgcacaccaacatgaccaccccgactcagatctggatgactttgctgctcagtaacatccagcccaacgatcataattccgacctccccctgccgaagtgtcagctggtgtacgccatcctgacgcggatgagcattcatgtggctcagctaatcgcagatgccatctatatatttgcaggtatggcgcctatcaggcaccctctggacccagataagtccaacagggccctgggatttcccgccttgatcacaggactctgccagtcgttcggcgtccccgtcacacctagcaaggtgattcggccgcccatcacccgagcttttattgagaagtactgcacacagagacaggtccagggtgatgcaccacaggccgcggacgcgccgccacctcatcaggctggtccagccggattgtttgatacagagcagtatttgcggcatttggtttgccagcaggcggccaaccaccgggcacatcctgcagagccagggctttacttcttttccgtgccctactccggaccagttcagggcaaaggtcgcatggcctggagattggcctga

SEQ ID NO: 81702 - DNA, 516 bp, Glycine max
  Peptide Sequence Number=SeqID_173387
atggagaaggaagaaagatgtgtagaagcaagcttcatgatgatgaaccaagcaattttgatgatgccaaaagcccaaatgattgattcaagatttcaagatcaagcatcaagaattcaatccaagattcaagattcaagagaagaaatcaagaagcaacaagtcgagacttcatataggataaggtacatcctttatggtacaagtagagcgtacatctacttgggttgtaatactgagaacaagagagggtacatctcttgtggatcagttcaagtggagcatacatccacttggtgtttcaaagagaacaagggagggtacatcccttgtggatctttgcttgtaaaggattttacaaggttattggaaatttcaagaaccgatggttgcttggggactggatgtaggcacgggttgttgctgaaccagtataaatcttgtgtttgtcttcttcttccctacacttttatctttccgctatgcacttttgattttcgctttacttttgtctaa

SEQ ID NO: 81703 - DNA, 294 bp, Glycine max
  Peptide Sequence Number=SeqID_173388
atgtcatttcctgaaactcacaagggacttatgaatgatgcttctagctcaaatttcaaccctcaattcgattatattacagaagattataacatgggattcccccctcgtgaaaaagtcattactccagtagatttaactctaggagaaaacataaaatcaaaaggaaaaaggatgtctatagaaccaacattcaatatgccatctcttttatcaaatataggaagtattgacccacaactacttccaaattacatagaacaatggaattctgctgtaataagagactataag

SEQ ID NO: 81704 - DNA, 165 bp, Glycine max
  Peptide Sequence Number=SeqID_173389
atgggggagattgtggaagcaatgtcttccaaggttattttgatgatgccaaagaatcaagagtcaagcaaaatccaaagattcaagaatcaagtttcaagaatcaagattcaagattcaagtttcacgaatcaagattcaagaataatccagatcaagatttaa

SEQ ID NO: 81705 - DNA, 372 bp, Glycine max
  Peptide Sequence Number=SeqID_173390
atgtgtaatcagttgcagcaaggcaggctaagtgtaatcgattaccaaaaagatagatccttcttgatcggtgttggtgtggttgcctcctttggttaccacaaagagtgtgatggctcttgggtaaaaatgggtgctcaaccaaatgatgatgaaggacactttccggttgaaggagacccttctctccttcagagtattttggacaggtttgatggacttcaaacctatgttggtgagaggtttgactccttggaacgtcaagtggacacacgattcgaggtgatgaactcaaggattgcaaaggttgaagaagatgtcaccattattcgcgactgctttgatttacctccaccaccaccatcagtttag

SEQ ID NO: 81706 - DNA, 123 bp, Glycine max
  Peptide Sequence Number=SeqID_173391
atgagcaagaggctccaagaggattgggctagagctgttgaagaaggccctagggttctcatgaacctaaggggtaccctagaaattaagggcaccctaccctacaagttaagggtaccctag

SEQ ID NO: 81707 - DNA, 60 bp, Glycine max
  Peptide Sequence Number=SeqID_173392
gtggacttggaaactgtggagcctcaggctcaacagagtgaacaaacaagtgggttctaa

SEQ ID NO: 81708 - DNA, 174 bp, Glycine max
  Peptide Sequence Number=SeqID_173393
atgtcagtgatggtgtcaatgggacgctccttaacattcaaggcaagaaggaaagatggtttgaatactcatcaagatctagttgagaaagcttgttatactttgtctagaaatgagaagatgagtttttgtcagtgtatgtgccatgtcaaagtcccacaaggatactcttaa

SEQ ID NO: 81709 - DNA, 630 bp, Glycine max
  Peptide Sequence Number=SeqID_173394
atggctacaccaccaagctcccctcctcctcctcctcctcctgattcaacatcacattcaccttctaccatgaagaggacaagaaaagtgacccgactgagatcattggctactagaccagttggggcagagaaacccctagtccaagtggatcctgcaactgggaaagctaatggtccccacagaaagaagttaagaacatatttggggatcgtcactcgcgataaggtggatgtgacatacgagaattggaaacaagctggatttgatatccctgaagcatctgatttgaggatgaaaaataaaatacttcagaccatggggaagcagtggagacagttcaagactgattcaacgttgaaatgggatgtgcgaaagaaggcacaaaccattcaaaaacaaaacattgcctctcacgtgttgtcttgtgagggttgtgaatttctagaaaacaagttaatggaggagaagaaaacaaaacaactggaggaagctgctaaatttggaagcactaacatcgtcattgatcctccatctcccatcagacgacacatgaagtggaagatggcctgcaccaagaaaactgaccaaatgacgtctgaggcaacaaaggaaattgatgacaagatt

SEQ ID NO: 81710 - DNA, 111 bp, Glycine max
  Peptide Sequence Number=SeqID_173395
atgggtttgactgagaacaagagagggtacatctcttgtggatcagttctagatttttacaaggttgaaagaaatctcaaggaccgcaggtcgcttggggactggatgtag

SEQ ID NO: 81711 - DNA, 274 bp, Glycine max
  Peptide Sequence Number=SeqID_173396
agagctaaagctttgcatgcctagtgattctagagagagaaaggtccaagttccagagagttttgagagattttgctgtgtgaagatctacagagaccagagcttgaagaggaagaggcttcctggttatggaaagctaaaatcctctgttggatcttcccttggaaactggtctgattctgatgaccttgataggacagggctaagttgtcatactatcacgaggaatgaagggagagggagagaagagcacgaaattttgtgctccaaatga

SEQ ID NO: 81712 - DNA, 2312 bp, Glycine max
  Peptide Sequence Number=SeqID_173397
atggcgcaacccaccggattgacggagctggggtcgccggtctccgtcagcgtgatcgacggcgaagacctgcgcaacgccgcgccgcagattaacctgtcggaaaacctcggcagcgtgccgggcctgcagatccaaaaccggcaaaattatgcgcaggatctgcagctgtcgatacgcgggttcggtagccgctcgatgttcggcgtgcgcggggtgcgcatgtacgtcgacggcattcccgccaccatgcccgacggccaagggcaaacctccaatatcgacatcaattccgtcgaacgcatcgaggtgctgcgcggcccctattccgcgctgtacggcaacgcctcgggcggggtcatcaatgttgacaccattaccggcacccagccgccgacgctggaggccggcggctatttcggcagtgacaacacctggcgctacggggtgaaagcgaccggcgccaccggcgacggcacccaggccggcgacgtcaactacgccatctccggcacccgctttactacccagggctaccgcgatcacagcgccgcgcggaaaaacctcggcaacggcaagctcggcgtgcggctggacgacgtcagcaccctgacgctgatgttcaacagcgtctcaatcgatgccggcgatccgggcggcctgaccgaggcggaatggaaggaaaacccgcgccaggcgccgcgcgcggatcaatacaacacccgcaaatcgctcgaccagacccaggccggcttgcgctatcagcgccagatgagtgaacgcgacgaactgaccctgaccgcctaccacggcgagcgccacaccacgcagtaccaatcgatcccgatggggccgcagctcaaccccacccacgccggcggggtgatcgtgctggaaagaaaatatcagggcattgacactcgctggaagcatgaggatactctcgcatcgttaccggtaacactgatcggcggtctggattatgaaaccatgaccgaacgccggcaggggttcgaaaactttattctgcgagacggcacagtggactacggcgagaaaggcgaccagcggcgcaacgagaagaaccgcatctggaacctggatccttacctgcaaacctcctggcaactgacgccgcactggacgctggatgccggcctgcgctacagcacggtcagcttcgactcgaccgactattacatcacgccgctcaacggcgacgacagcggcagcaagcgttaccaccagtggctgccgatgggctcgctcaactacaagatcaatccggcgtggaacctttatctctccgccggccgcggctttgaaacccccaccatcaacgagctctcataccgccccgacggccaggcgggcctcaacatcggcctgcagccgtctaccagcgacaccgtcgagctgggcagcaagctgcgcctcggcaacggcctggtgagcgccgccctgttccagaccgagaccgacaacgaactggtggtggcggaaagcagcggcgggcgcaccagctatgccaacgccggcaaaacccggcggcgcggcctcgaactggcgctggatcaggagtttgcgctggactggcgcctgaatatggcctggacgctgctggacgccacctaccgcagcgatatgtgcggtaaatccggctgtacccccgccggcaatcgcctgccgggcatcgcacgcaatatgggctacgcctcgctggcctgggcgccgccggaaggctggcacgccggcgcggagctgcgctacatgagcgacattcaggctaacgacgccaacagcgcgcaggcgccctcttacaccgtggccggcgtaaacgccggttatcgctttacctggaaccgctgggcgctggacgtcttcagccgggtagacaatgtgttcgatcgccgttacgtcggttcggtgatcgtcaacgaaggcaacggccgctatttcgagccggcgccgggtcgcaactggggtggcggcgccaccttcgtcactatcgccgcttatcgtcataacggcgctatttgccgcgctgagcgggctttatctgctcggcggcggcatttggctggccaagttgggcggttcgctgtattacatcatcgccgggctggtgctgctggcgacctcctggctgctgttccgccgccgcgccaccgcgctgctgctgtacgcggtattcctgctgggcaccactatttgggccctgtgggaagtcggcccggacttctgggcgctgacgccgcgcctggacgtcaccttcttcttcggcctgtggctggtgctgccgtttatctacc

SEQ ID NO: 81713 - DNA, 294 bp, Glycine max
  Peptide Sequence Number=SeqID_173398
atgccaaggcaggcacggaagccgaggaaggaacagcagcaacagctagccgcagatgcaccaccaccacctctccagcaaccatcatctctagagtccatctcagctcacatgcagaggatggaactctatatgcagcatttggatgaccaacaagcggctaaccatagggcactaggatcccagtccttacccatggcctactcccaagcagttcggggccacagttgcatagcctggagacagacccagttttcaggtaagggtagggcccgcagaggccccaggagatga

SEQ ID NO: 81714 - DNA, 272 bp, Glycine max
  Peptide Sequence Number=SeqID_173399
agaagaatgaaagctatgccaagcaagccaataagaacaggaaggaagtggtacttgaacccggtgatgatcctggacatttgagggaaaatgctttccaagaaggagggaatgatgagaatcctaaaactggtcaaatacaggctaaaggcccaagtggagaaggacaaagcccccgagtggagacggatgaaggccaagtggagaaggatgaaggcccagagacagagacactatcaagactattaactattgtcaaatgcccagattaa

SEQ ID NO: 81715 - DNA, 92 bp, Glycine max
  Peptide Sequence Number=SeqID_173400
atgtgggtgtttgacccagagccctgcttgcgtggaatcgacgagcaaggacaaaaaggaatcttcaagtggcgcggcgaggaatccgcggg

SEQ ID NO: 81716 - DNA, 197 bp, Glycine max
  Peptide Sequence Number=SeqID_173401
ggagaccagttagggtcacgctgttttgcgagaatactccaaccatatgggatcaacataggcttaaaggagcactcaaaccgggtatatttacccacaaggcctacactccgaagagtccgtcagggcctctccctcttgattcaggtccaacccagaaaacatatttgcacataaactctatctatgaactataa

SEQ ID NO: 81717 - DNA, 342 bp, Glycine max
  Peptide Sequence Number=SeqID_173402
atggggagttcatggaatcagtgggtcttccacaacaaaaagttccagcaggtgcaagagaccttatctaaggcatcttccatccagttaccttcagaaagtgtgctacatcggcctggtttcaagcccaagagctggattcatcttcctaaaggctttattaaagctaattttgatgcttctactggtcttggtgtgctttttcgtgatcaaagtggagaaatcctagcagctgcctctcttctgctcccccattgtcatgatcctctcactgtagagactattgctttcaggtgggaaatagacaactttggctttctcctctgccatcttcgaatctga

SEQ ID NO: 81718 - DNA, 468 bp, Glycine max
  Peptide Sequence Number=SeqID_173403
atgcttttaagaaaaggttttcatcaagtcaaggtcaagtatggaagtaaccagcttgcaaaagttggggcaaaagatggattgagtttacatagcttctttggctactgccaacacatgattgagctaagaacagatgaaggtcgacatgggggccatgaaagagcaaatgaccacaatgatggaaggcttgatgagtatgagaaaaatgatggaggtcaacacgactacaatcgttgttgcaagtaccgccatgaggtggacccgactcacccatctggcctcaatcaagtaaatcatccagtctcgaatatggtccagagcaagcattccttcccaccatatggcttgcctcccaactatgcatcacccaatgttgcacacactcccaatgagaatgtcgataactccgctcccatacccattaagagacaacaaccccaatttggtcatgcacaggtcccttaa

SEQ ID NO: 81719 - DNA, 519 bp, Glycine max
  Peptide Sequence Number=SeqID_173404
ggtacgtctacttgggttgttgactgagaacaagagagggtacatctcttgtggatcagttctagtagagggtacatccactagtttgttcaaagagaacaagggagggtacatcccttgtggatctttgcttgtaaaaggatttttacaagggtctatccaagcttatgcagatgaaatgaacttcctttccggggctgaaatggttatcaatgctacagtttggaaagaagtagcaagaatggacatgggtggagtccgcaagtttgaagaatctgctgatggttacaacaagatgcagacttacagaagtacgttgcttgacccaacaaggaatctgaggaatcgtgtaggtgtaggtgatttaactgctgaagacataatgctcattcaaacccaagtagatgtaccctctacttgtaccacaaaggatgtaccctccaatgtgttgagacaaagatctcaggctgttaaacctttgatactttgtgaatggggatacaaaagaattctcaggcg

SEQ ID NO: 81720 - DNA, 285 bp, Glycine max
  Peptide Sequence Number=SeqID_173405
atgtctagtcctgcaaacttaacggttgagatctccagtcctcagcgagggagtggaatgctagcatctatgaagaatgataagcataagcataagccacacatcaccaaggtgtacacccgcaaacagcgagcaaaagaagcaataaccatgaaccaccagcagcagggcgcacaaaacccaaggggtacaaaccacccaacagttacaacccacccaaagggtgtaaaccatccaacagttacgtttcacccaaagggtgcaaggtcagaagatgtgaattaa

SEQ ID NO: 81721 - DNA, 432 bp, Glycine max
  Peptide Sequence Number=SeqID_173406
atggttgtggcgactccgcgcgttttcctcccttggaagatgcactcacgagcctcgagtcgccctcctaccgaagggaagtcggaagatccatatcacttccttaaatgcatacatggggcactgcactgccaaatgttgcaagtaagaagagataatctttcgggctctcgtgtccataaaatacatttgtgtcatgcatcgcataagcatctcttcatgcattcatccatttctcccatggtagacgttagagtagtgcttcacgcaggactttttcattctagcgaacatgggatcaaatcaaacacctttgttcaagaaaaagtaatatcaagtcaaaatcaagagcttagaggtcaccagtctgcgagagttggggcaattgatgggtcaacttcaacgaaaagcctttcgcaaagcctatggtaa

SEQ ID NO: 81722 - DNA, 570 bp, Glycine max
  Peptide Sequence Number=SeqID_173407
atgggtttgaagagaaaaaaaggaagtgatgatcaactcttagcacgtggaggaggaaggtttgatggtggtgacttgagtggtgaaggttcaagaactgtagttggaggtggtggaggtggtttgattgctggcttgctgaaggcacaatatttcttggatcctctctttagacacaccacttggagcaacgacagtcaagggagtgattttcattggagtactggaagtgatgatagtggtaagtgcatcatccggtatgggctaagaagaaacttcaaccatcagaggttcaacaacatcaacttgtggtctaagatgagcatcaaggttattgaacaactccttagatttgagcttctcttgttgttgcttgactccgacctctttttgtatatccatgagttgccagttgggcttgtcctacttgcatttaagttcagaagccatgccttgtcctggaacccaatggttctgatcagaagagaaaaggcactcttgaagtttaggatggtgtgcgcaggctgtgccaatgactcttcctattgctgctttaggataacggtgtag

SEQ ID NO: 81723 - DNA, 405 bp, Glycine max
  Peptide Sequence Number=SeqID_173408
atggcctctggaaagagaagagcttccacctttcgacctcaggaaccctatgacacctcacggttcgtttctgaggtcgcttgggagagatatgagcagaatatccatgccagaaacatccttccagagaggaatgttgagctacaggttactcagtacgacgagttccgacaggagctcgagcggtgtaggtggcaccgggtcttgactaggcagctagataaccacattgatgtggccctggtcaaggaattatatgctaatgtctttgatccagaagaaaagtcccctagacagtgcagagtgtggggcaagctgattaagttcgatgttgtgatattgaacgagtttctagagacccccgtggttttggagccaagggagcaatattctacatactcttga

SEQ ID NO: 81724 - DNA, 402 bp, Glycine max
  Peptide Sequence Number=SeqID_173409
atgacaaaggaggaaggtcacgaaatgagggatttcgataaccattgccacaaccagagccactggccagcatgtccaccagtgcagatccgccttgccatgctagattggagcagtgatggaagcttcgtaggagcacctccactcgagggcgagggaaaggctaggtctaagggtgcatcatctgttggcgaattagagactagccctcttgaccctgttttagaggagaaagtattaggtctaggagttgggtcgaagctgttggtggaaagaccaagggatgactatatgggactagagaccttgctcatgattatcaaggtggagatagtagtctcacgcaaaaaaggaaagcatcaagtagttattcacatgattcataagagattatccaattga

SEQ ID NO: 81725 - DNA, 486 bp, Glycine max
  Peptide Sequence Number=SeqID_173410
atggtatcaaggtatgcgttaaaccatattgttgctgagtttgagcaagtgaattatactggcattgccaattcttgttgtggatatattatgagaactaatcatggtcttccatgtgcatatgagttatctagatatgttgttggtagcataccacttgatacagtccatatgttttggcggaggctacgtttttcaaaccaaggtttatctgagtccaaagtttgcataaccgaagagatgaaagccatatccaagcggtttgaagagcttcatgtatgtggcaaagtgacattgaagagtaaactttgggaaatactctaccttgatctaaattcgatgtgtgcttctcctgaaaaggtcaaaacaaaaggtatgggtgaagattcatggtctttggttcgtaatcatttgctgaaagaagttgtacaatggtttgatgagtatatagacctgctaggtggcatagacaaatatgagcattaa

SEQ ID NO: 81726 - DNA, 1071 bp, Glycine max
  Peptide Sequence Number=SeqID_173411
atgagggagaaacccttcaacgtcgacgaccgacaacatcaacacgcaggccctaaatcagtgttgactgattatgcttatcacatggcatccaaagtgtgggcaggagaggttgttgacttattagttgagttgcttgaagttagtaggcaagacgcaaaagatgagactgagcaatgtagagggccatatgtttgcctagcctggttgcaagacatttatcgtagcaaatgtgacacaagacaatggataatagtagctcaagcatatgtgctgcatcttgtaggttgcacactatttgctaacaagagtgccacacatatcagtgtgcatgccacaaaacatcttgcaggatatatcactctcttgcagtcttggatctacgggtatttccctatagttgcaaatattattgctaatgaggattaccatgagaggaaatcacgtgcttgtcgctggaagtgtgggaaggcattaccagtgatgaccaatcgtaagcacttggataggctgacgccagatgctttttgctggataccttatgttgatcaccatgctttcaaagaatttgagctcatttcactattttctggacatatcaaatggggttcatctattttttctcaataccttgcaccgattggagagttttgtagttttcctggtcagtgtgcagcatgctacattgagtggttttataggatgtctcacccattcatgagtctgccacaacttggggagcctcctagacatccacccatggtgcatgataatatatatattataccaaatccacttgtgttgcccgttcaaacaacagctatgccacaactgcctgcacctacagctgttgatgcaaacatgcctcgacatgcagtggttgcttaccaaaagatagtagaaagcttggaatacatgataaatatgaggatggtcactactgaaactgatgcatacactctgactaagcactgtttaagattagccacaagtgtcactgagcaaggaaatgtttatgttcactcaagacgaaggagggatacacaggacaaagatggtggtggacgatga

SEQ ID NO: 81727 - DNA, 1416 bp, Glycine max
  Peptide Sequence Number=SeqID_173412
atgggaactagtgaatggcatatcgagcgaagatctagcttcggcactgaatcccccttagcaagagaggcaggaaatgtgcctgaaactgggtcactctctattgttgtgcttggcgcttctggggatcttgctaagaagaagacatttcctgcacttttccatctataccggcagggattcttaccagcagatgaagttcacatttttggctatgcaaggacaaaaatatctgatgatgaattgagaaaccggttgcgtggctatcttgttccaaacaaaggtgcttctccccaactgttggaggatgtagagaagtttttacagctgatcaaatatgtaagtggctcttatgattctgaggatggatttcgcttgttggataaagagatttcagagcatgaatatttgaaaaagagtgttgagggtttatctcggaggcttttctatcttgctcttccaccttcagtatatccatctgtttgcaagatgatcaagacttgttgcatgaataaatctgatcttggtggatggacacgtgttgttgtcgagaagccttttggtaaggatctagaatctgcagaggaactcagtactgagattggaaagttgtttgaggaaccacagatttatcgtattgatcactacttgggaaaggaactagtgcagaacttgttggtacttcgctttgcaaatcggtttttcttgccactttggaaccgcgacaacattgacaatgtacaggttctttgcttggttgctatggaaaaaccagtttctctcaggcctgagcacattcgggatgagaaagtgaaggttcttgaatcagtgctccctattagagatgatgaggttgttcttggacaatacgaaggctataaagatgacccaacagtacctgacaagtcaaacaccccaacatttgcaactgttattctgcgaatacacaatgaaagatgggaaggtgttccgttcatactaaaagcagggaaggcactaaattctagaaaggcagagatcagggttcaattcaaggatgtccctgccaaacccaacacaacccgacccatgaacacccctatacaggtcaagcaacctggactggagatgtcaacagttcaaagtgagctagacttgtcatatggacaacggtatcaaggagtaaccattcctgaggcttatgaacgcctaattcttgacacaattaaaggtgatcagcagcattttgttcgcagagatgagttgaaggcatcctggcagatcttcaccccacttttgcacagaattgatgaaggggaattcaagccactcccctacaaaccaggaagcagaggtcctgcagaagcagatcagttacttgaaaaagcaggctatgttcaaacacacggctacatatggatccctcctaccttgtag

SEQ ID NO: 81728 - DNA, 288 bp, Glycine max
  Peptide Sequence Number=SeqID_173413
atgagtgttaagcatctccaagtggtcaaccaaggtaagggtggtggtgctaaagccttcacaacacgtgagaacaaggtcatggaaggaggggtagaagagggagaggagggtgagagtttgttgagggaggaagggatattgggagagtgtggtggctcaaggggtgaagtgagccccctaattcaagggcatgaggtcaaagttggtgaagcggggcttacccttgatggtcaaggatcgaatacggggaagcgggtggtggcacgccaagggaacacaacgtag

SEQ ID NO: 81729 - DNA, 570 bp, Glycine max
  Peptide Sequence Number=SeqID_173414
atgctcaagcaattcctcagaaaactccctcgcaaggcatctaaactcaactcggacgagtcatgtcgagccgactcatcgcgctcggacgattccccacgtgtcgctggcaaaaacagccaccatcccggcgacggaggcccctcctccacgaagaaaacatcctcgtcgacggtttttccgacaaaatgcaatggtagtgaaactgtgcgtatggctcaatcactcattgttacttgtcatgctggcactggttgggctgtggaggatgccgaggacaagatcatgaaacgggggcaggaggcagagagaaggaaggagaaagaaacgggggcaggaggcggagagagaaacaggtgcggggacgttgacatgcggcagtcaacgtctgagcttaacggtcaacgtctaattgagaacccttatttgcaaaaccctcagaattatctcgtgacttcaacctcttgcaaaaccctcgcacacccacttgtcggagtacctcctcctaatgttgtggtacatcgagtggcgtgtctctcagaactgcttcctgctagtgcatttctttag

SEQ ID NO: 81730 - DNA, 639 bp, Glycine max
  Peptide Sequence Number=SeqID_173415
atggatgaatatctttcactagtgctgcaagtggccatctccaagtgctatcatgacacctccaaggttacagatgagctagtgcagatcatccttggtccaggtctggaacctggagcagcagaggtctttctcgagtttatttgttactctggtggccctcttcctgaggaactagttcctcaagtaaagtgcccgattttgatagcatggggtgacaaggatccttgggaaccaattgataatggaagaaattatgaaagtttcgattctgttgaagacttcattgtccttcccaatgttggacactgcccccaggagagtcaaattttcaaacccaccaaccctgatttggatttggcatacattcctatagtcctatcacacttgactcgaactctggcttggagtagtgctcagcaggggggctgggggggatttgtgctcaaaaacaagctgaggtacttaaaagatgtcataaagcagtggagtaaagattatgggttcattaatgccaaggggattcaaaaaattaagcagaagctaaatgaagtggaagatctagcctctaatagaagtctatctgaggatgagattaaggctaagagagccttacagcccctctgctttttaacatag

SEQ ID NO: 81731 - DNA, 341 bp, Glycine max
  Peptide Sequence Number=SeqID_173416
atgccagagcttttcttgaggccttatcaggttagatgggatgccaccgtgttcggggtctttaatctagatttcccgctctacataaagcacgaagacctctctgaaatctcacacggtggtcaatgtctcagcatatcagtgttacagttgtggattctgtctgggcaatcacagtttgagtctgaaagttacataaagagttggatgcagaattcacaacgcgatgtctatcttggagcctacctaaatgggccagacaactaccttaaggggattattaatagtgctttaaaaggtcttgatgatgctccacaacctaaatcaaaggcttctgctag

SEQ ID NO: 81732 - DNA, 306 bp, Glycine max
  Peptide Sequence Number=SeqID_173417
atgtgtcacctaactgcatatgtttgtgtttactacgacgaccaaatttgcaatactaatgagggcaccaccttcgttagtaacaacacaaaaactttcatggtcaacaagttatttgccataatctgtcacaataataacccaccaggcaaccaacatggctcaacctctaatcttgaggacttatcagatgaatacgagacttgttgggtcaaaaaccatgacagtgatattgactcctcttccaggcccgaaggatgtaacctgtctccatcccacgaacctatattcaaacgggattggtaa

SEQ ID NO: 81733 - DNA, 321 bp, Glycine max
  Peptide Sequence Number=SeqID_173418
atgttgatccctcagggaactatccagaacacgggtgactcagacaaatgcaggttgtacattgaagaaaattatcctcgcctggtttccctaggaagagtttatgagagatccacaaccgttcacaacatccttttgttgcatgatcaagtgaaggtcggtgttgaggagtttaaagatgaagatgctcccgttcctgtacccactaacgagggagctgtgggacccgcgaaacctgtagataggctggatcatgaggtcgatgatcccctatatttgatgacattgaccattccacggctttttttgaagcccttgtag

SEQ ID NO: 81734 - DNA, 363 bp, Glycine max
  Peptide Sequence Number=SeqID_173419
atggtggttgatgaggtgaagatgaagagatgtaacgaattacacacaaaaaaacacacaagttttgatgatgctgagaagaattcacttgataatgattgtcatcatcaaaaagggggagattgtgaatgttgctttcaagatcacttcaacaaatattcaatggttaagcattgcttcaagattaagacaaggttgcttcaacaaacaagcattgcttcaagattcattcaagatcagtttttgcctcaaaacacattgtttccagcatgtcaaggctctggtaatcgattaccaggcagtgtaatcgattaccaaaagataagtttgcaaattagcttcttaacagggtttgaaatttga

SEQ ID NO: 81735 - DNA, 405 bp, Glycine max
  Peptide Sequence Number=SeqID_173420
atggacaaaaatattcttgactctctgttcttaaatatccactttcatggccttgacatgaaagaaggatcaatcccaacagctttgatttataggatccagtacaaggtcatgaatacttgtgcgtctagagtcctattgcaaccacaaaagggagaaacaaccttatttatcactgatatgacaaaagccaatgtctctttaccaagagtaataaaatgggatgaagtaactctccctgaaaaatgggtcatggagaaggccacaccgtctgatccccgacctactccaattattgaaaaaattaaacaagataactccggaaagaacaacctacaatcaggaacaggagtgatgcaatcctacctcgcaagggcattggctagaagactccaagtagattga

SEQ ID NO: 81736 - DNA, 102 bp, Glycine max
  Peptide Sequence Number=SeqID_173421
atggaagaagaattctctcttcaagagaagaatattacaatgaagatcatagccttgcatgtcttgaaagcactttgttttaaggcaaggcttggtctttag

SEQ ID NO: 81737 - DNA, 180 bp, Glycine max
  Peptide Sequence Number=SeqID_173422
gctgaatttgatatccctgaagcatctgatgtaaggacaaaaaagaaaataccacagactataggggactggtggagacagtttaagcctgatttgacatccaaatgggcacttgcagccgacaaggacggtgtcgatgacactgtatgtgaaaagtacaacattagcaaggagaagtag

SEQ ID NO: 81738 - DNA, 675 bp, Glycine max
  Peptide Sequence Number=SeqID_173423
atgaagccaaggggttacatagaatccgatcatgtacaagatgatgtgccttaccaagttgaggaaatgtcacatgtcaacaaagtcattaaagttgaaagtatttctagattgcaagatttaagaggtggtgttgaagaagtagaccttgctaatttgttgacaaatgaaaaagaatcaaataatttgaatggagagtcaaacaatattgaacaagataatgaaggcaaattagaagatgactttgaaatatatcatcaggtggtgttgatcctccctgacccctgtcacatgactccagtgggaaagggacaactgcaaagaaaaaacgatatgtggctagactactaccaccttgagatagtctgccatcatctaccccattctcatcttctatatttatcccagttaggcctcccaatgttgcacctacaccatctcgacctccgactaaagttacaccatcttcatctcatgtcgatgcacgtggaccgtccccggtttcatccatctaaggttgcggaaaaggctgtcactttgtccattaggcaacaatttggtcagccttggcctacatggggagcgattccaaaagatcatcaagaactttttttccagcggtttaggttagaggagcttggtcaatctgcatacgtagatgaggtctttcaatga

SEQ ID NO: 81739 - DNA, 255 bp, Glycine max
  Peptide Sequence Number=SeqID_173424
gacctcattgaagctcaaagatccagcctccatagaagccccacaagcaagcttccattagcagctctagcccaatcatcttggagcctcttagtcatggctctagtgaccggtaccttcctagggatgattgcatcaggctttgaattcacgacgttgcgcttagcgccaccctcacgcttagcgggagtaagtggatttgagcttagcgcaagtcgtgcgctgagcctggctgaggacaactgttgtgcttag

SEQ ID NO: 81740 - DNA, 447 bp, Glycine max
  Peptide Sequence Number=SeqID_173425
atggcagtgcagctgatccgtgatcgcgtcatgatggagtgcctagagggtgtttgggagaccctcgagggcaacgagaggtgccaattccgcggcatagttcgactcactgctacatcgcttgtacatccagagcaacccgcacgcacacttcagcagcctgtggagtggatactacctacgcctaccccatatcgactagttgagcccgttcaattgatagaggtgtcatcctccgaagaggatcctgaaggggacccagagaagtcatctcctgaacctgctatgcatgcccctgacttaccagaggatgatgaggacccacttcctgatgttgattctccagaggatattatgccagcacctgaggccgactctacagaggagagtggtcctagagggatggcaaatagcgacgactcttcatcacagcagacgactccttag

SEQ ID NO: 81741 - DNA, 315 bp, Glycine max
  Peptide Sequence Number=SeqID_173426
atggttaaagaggagtgtaaggaggtaagtgtctcctccaagagacaacctccacattttctcctttgtaaaaagacacttgttagcattgccacatctcttaggcttgagtttattcctcaagtaaaggagttgttggatgagggtttggttcacaagagcattaaatccttgtgctttgttggtgcccaaaatagggactcattaggtgttgaggaaaaaagcccagagtttcaagaacctcgggatttgaggtcaaatccttttcaagggggagggaatgatgcaatcctaccccgcaagggcattggatag

SEQ ID NO: 81742 - DNA, 503 bp, Glycine max
  Peptide Sequence Number=SeqID_173427
aaaggaaagttgtgtcgatccctcaggggcaggccctagacactggtgactcaaagaaatgtgggttgtatgtcgatgagaatcctcctcgactggttgaccttggaagagtttatgaagggtcgatgaccatccacagctttcctttgggcaatgatcaagtgaaggataaacagggagctaagggaccgacgaaacttgtagataggctggatcctgatgttgatctcctatacctgatggcattaaccatccaacaacttttccttaacccgttgcaagtgtcatgggatgttaccgtgtttagggtgtataatgatagcttccccttgtacataaatcatgaagatcttttagaaatagcacttggtggtcaatgtctcagcatctctgttatacaattgtggatcatgcatatgaccgagacaagtatgcgagcggggaatgcctctatatatggattcctcgagccacaatccatacagaaatatgggaaatcataa

SEQ ID NO: 81743 - DNA, 312 bp, Glycine max
  Peptide Sequence Number=SeqID_173428
ggaagcattgatgtggcaattgtgaaggaattctatgcaaatctttatgtctatgatgacaagtttcccaagcaagttaaggttcgagggcacttaataaaatttgatgttgattccctcaacaccttcttggatactctagtggttgtggagcaaggggagagcttaccttcttactccaggtttgcaagactaaggcctgatcctcaggagcttacagcccgactatgtatccctcggaggggattttttcttaatgccaagggtctatcgtggaagctcttgaggaaagatctcacaactctagcctaa

SEQ ID NO: 81744 - DNA, 618 bp, Glycine max
  Peptide Sequence Number=SeqID_173429
atgggccccgttcatggatattctcgcactgttgatcttcaagggagtcctctttccaaatatggatggccgacctatatgacaccttcgactgaagatgtgagaagagcagtacgaggattgtttgctatactccagctctttatgtatggtttgttccacacctttttcgccaagaggatttccgaatgttcccttgatggggacgaggggttgcatcagttacaatcccgttcttgctataaggaaacttggctaccctatagaggggcaccactagaggaagagctcgcgcttgtcatttcacgaggtttcgataagaccaatgtggagacacttcagaaggtctgcaaggcatgggaggtggtgcaaaagaaggacaaagaactcaggggcagtaacaatgagcccattggtggctaccgtaagtggttaagagcccacgtgcaaggtttggattggctcccgagttggagaaccgctaaaagggaggaagttgaggcaccggatgaagacgaagaggtgcaggcccttagggtggaactcgagcaagctcaaacaatcaaagaaaggttcaaatcagcagctcttaaaatccgaaagagaatgccgaactga

SEQ ID NO: 81745 - DNA, 345 bp, Glycine max
  Peptide Sequence Number=SeqID_173430
aggaatacatctacttgggttgttgtaactgagaacaagagaggatacatctcttgtggatcagttcaagtggagggtacatccacttggttgttcaaagagaacaagggagggtacatcccttatggatctttgcttgtaaaggtttttgcaaggttgaaaagaactctcaaggaccacaggggatatttgatcacttattctgctaatgaaggtaatatccaagtcggaaggcaaaggagaagaggagaggggaggcaccatccactagggaataagccaaggaagaaggagcttcaccaccaagaattgccttggataagaagcttgaagaggatgctttaa

SEQ ID NO: 81746 - DNA, 639 bp, Glycine max
  Peptide Sequence Number=SeqID_173431
atggcagaaccatcagagaagcgcaagggatcctcgagtcgacgccaacgacattccgaggctcaggaaacgcaaattccctcctccattccttcttcctcattgttctcaatggaagaacaaaggatacggtacacaaatattttctcttctcattccattattgatccaaaattcattgacatggatttcttttcaaatgagagttttgaatgcattcaggcatttgaaaactccaatctcattcctttcatgtctttaaaatttcctgtttatactgaattagttaaagccttctattctaacctagaaattcaagaaggcactttgatttctgaagtttatgggataaaaatggtcattgaccaatccctattctatgacttgacccaattatctagtgaaggtataccatttgaaggaaacttaccagttggggaagattcctctcttcttcaaaggattttggacaggttcgatggtcttcaaacctttgttggtgaaaggtttgatgctttggagttacaagtggacatgcgattcgatgagatggattcaaggatcaccaaggttgaaagagatgtctcttacatccgcacatgctttgatctaccaccaccaccaccaccatcatcttag

SEQ ID NO: 81747 - DNA, 105 bp, Glycine max
  Peptide Sequence Number=SeqID_173432
atgtggaaattgattaaggaaaggatggaaaataaggttaagtggtggctggacagaaatatagaaatggcaataactgaagctacagggctccaaatgaggtga

SEQ ID NO: 81748 - DNA, 84 bp, Glycine max
  Peptide Sequence Number=SeqID_173433
atgtcgtcaaagtacttggctaacctcaagatgaagaatgtaccagccattactttaggtcgtcacgtgaaaatcaaagaataa

SEQ ID NO: 81749 - DNA, 486 bp, Glycine max
  Peptide Sequence Number=SeqID_173434
atggaagtgtcagttgaagccattgcatctcttacccaatactatgaccaatcgctcagatgcttcacttttggggactttcagttagcaccaaccatagaagagttcaaggggatcttaggatgcctaataggaggaaggaagccatacctcttttttgggaatgaagtagcgggaataccgaggaagtgcttagaggagaaggcggaaaccctggcaagccaaggagagtgggtgtcattcatggacgtattagcactgctagtgtttgggacaatactatttccgaatgtagacggacttgtagatcaggtagcgattgatgcctttcttgcttatcaccacagcaaggaaagccccgtcactgctgttttagcagatgcacatgatacattcaacttaagatatctatatgtcccctacaaggtcattgcacgtgttcaggaaaggataaagaaaattgggaagaactcttggcaggcatga

SEQ ID NO: 81750 - DNA, 112 bp, Glycine max
  Peptide Sequence Number=SeqID_173435
acataatatcaaaattcccaacggtgagaatggtcagaattgggttgcgaacaaggtgctcaaagttcacaacgatccaacggtgaatgagtccgagatcgtcattttttga

SEQ ID NO: 81751 - DNA, 744 bp, Glycine max
  Peptide Sequence Number=SeqID_173436
atgtcgcagaggggatcgttgatgccaacacatattcagccagatatacatgggttaggagcacgagtgagcacaaaagggagcaatgcggagagtgttctcaacccatgtctgcctaatgatgttgctcctgtcaaaccccctatggggttgtatgtgcaacgccaagattcaattgagttggtggccttgggaaaaacatatgatggaggctcgaccatacacaatgtggcttatgcagacgatgtcgtaagggttagtgttgagcaagttattgacggtgacgctgaggtcccattcccaacatcagagtttaacatgagggcagtagtccaactaaagacactgaagttgttgaagcggtcaacgatgttgttgatagatgaccccttgcgcgagttgattaagagcctagttgacatttatgagaagcctgtagagttagtgtgggatgttactaaatttggaattccaaatgcaactgcatcattgttcgtaacgtgtgctgatgtgaatgaaataatatcaggcgtacagtgtttgaacatagctatactacaattgtggaccatgtatatggaccaattgagtcaaagagatggtgtaggatcggtgtatggattccttgagccgcaagctatactgaatgcaaacgataaacgtggacaatgtcaagaatacattgaaaaatggcttaaggaatcaaaccgagatgtctatctaggcgcttatttgaatcagtaa

SEQ ID NO: 81752 - DNA, 510 bp, Glycine max
  Peptide Sequence Number=SeqID_173437
atgactactctaacacagatatggatgacgctgctactcaacaacatcctgcccaacaaccataattctgacctccctctgtctatgtgccagttggtagtacctgtcatccctagcaaggtagtccgtccgctgatcacccgagctttcatcgagaaatattgcacccctaggcaagcgcagggggacgcacagcaggctgcagacacaccactacctcaacagcctgatctggcagccaaccaccacgggcaggtgcagttgcatgagtgcttctaccatttcagcctcagccagcaggggcagggctccactctttttgtatgccctaccccagagcagttcggggctgaggtcatgtggcctagagattggcccattgaggagggaactaaacccgcaggatccccgagcgaagcggaggaagcccacatggatgaggatatgaccgacctgctcggttacctgggagagggcaaagccacacgactaaggtcgccacacttgtga

SEQ ID NO: 81753 - DNA, 357 bp, Glycine max
  Peptide Sequence Number=SeqID_173438
atgagtctacacgaagctcaccaccataggaggccatggataagagcttggaggaataaggagatgaatgaagggagaggaagagaagagcacgaaattttgtactctaaaagagctttgaaatctgaagaacatggtacgggtcagacgattggcgtaggacatgaatctcatggtctttactgcctcaagcctaatctttcttggcgcagggcattctccatcagtcttcttgtcctcatactcctcaacagaatggcattgccgaaaggaagaataggcatcttgttgagactgctcgaacattattacttcatgtcaatgtacctgtccagcattggggtgatgcagttttga

SEQ ID NO: 81754 - DNA, 234 bp, Glycine max
  Peptide Sequence Number=SeqID_173439
atggctatttatagaaaaatgcgcgagctagagctcgcccaagcgagccagttacttatggctgaaggaattagcttgcctaggcgagttggttgcttaggcttgaaggcatttcatgacttaagcgagctagatgctagcctgggcaagcttgggtccagaaaagtccacaaaatgacccttttgccccttttcccttgtaccttttgttttcttgatcaaaacccaaagtga

SEQ ID NO: 81755 - DNA, 534 bp, Glycine max
  Peptide Sequence Number=SeqID_173440
atggcgcattcttctgttatagtcttcctctgcactctccttctcttcttttctccgtcaattcgtgcctccgacgatgacgtggcgctgcacgcgaagaagctcatcagagacctcaacttgttccccgacgctgacgtcaacatcgttcccgttgctaattgcaccctccaaccccgcaggatcgtcgagaagcgcctgaggttcccgaagctgctagcttcggattccgagccttcggttgaggatttgggtcaccacgctggctattaccccattcagcattcacatgccgcaaggatgttctactttttcttcgaatcacgcaataggaaggaggatcctgtcgtaatttggttgactgggggacctgggtgtagcagtgaattggctttgttttatgaaaatggccctttcaaaattgctgacaacttgtctcttgtgtggaatgagtatggttgggacaagggatcaacttaccatacgtctgccacaccctacaatcaagttcaggaatttcaactgactgtgtga

SEQ ID NO: 81756 - DNA, 243 bp, Glycine max
  Peptide Sequence Number=SeqID_173441
atgtatattaatattaaacagaagaagattgcatgggtatcttggacacaatgctgtgcttctagagatgtaggaggattggggatcaaagatttgagaattttaaataattctctactaatcaagtggaaatggtacatgtttcaccaaccagaacagctgtggaataggatcctgatttctaaatatcagggctggagaggattggatcaggggcctcacaaacagcatttctccacctag

SEQ ID NO: 81757 - DNA, 261 bp, Glycine max
  Peptide Sequence Number=SeqID_173442
atggagcacattgttcaaatgaatggaagattgaagttgaatgttaccacaaccaatactgggatattttcagtactagaagtattaaaggataggaagctagaactcttaccagcaatggttagggaacaagagctagatgtcttactgaaagggtccataaaggttcatagacgttccaatgacgatggcggaaggtggctgacggtggaggacgacatcgaacgacgaccagtggtatacacagtgactaggcactga

SEQ ID NO: 81758 - DNA, 849 bp, Glycine max
  Peptide Sequence Number=SeqID_173443
atgggacgtgctacatcaagtaagacccacaaggcatttggaggacaagggatgttttaccatcccatccccatcacaatggaaaatttctctatcgaccatgcactacttgacttaggtgcgagttgcaacctcatgcctcgttctttcttattagagaagattggtcaccttaacctaaatcccaccaacatgactctacaattttccaatggaggaccacaagttccaatcattctaggaagatccttcatgagaaccactcatgtaaccatcaatgttcgtaaaggagtctatacgcttagagagggcaagaaacaaatccttatcaacggacagctcatttggagcaccatgtactcgttgttcaaggaggtggcgaggctgcaatggggaggtggttgtcgcccagctcgcccaggcgagctcggttgcttccaccagaaggcaccaccttcttttggaaccttcaggaaagccgaaaatgttgtgaaactttacggattacgcaacaatgcttgtttcgtgggttctgaagggagcaaacaagatgacgaaggtaaaacctgcaaagattttcaaaataatcagcatcggacgaccaacatcatcccgatattaccggacatgttcgccttggttgacgaaggtgtggataaccacgaggtatctccacatactaccggacccttgagtctgacaatagaaacgagacttttatgcagtctcggccgaaagaagctgacatcttcgggaaagtctcggccggaagacgctgacatctccgggaaaggtgcagatgacgatgttagtctctgcgtgtcaacgggatcgcttgcctctagctga

SEQ ID NO: 81759 - DNA, 312 bp, Glycine max
  Peptide Sequence Number=SeqID_173444
atgccaaccttcaaaacattcaacaagaaaacaaccatgatccacaataccctacatcttctacaccaaataagaagacaaaaagaaaccaagaaaatgcaaaaaaagaaggaatgcaagaaaagagaaaccaatgacgacgatgatgatgagttgcgagaagcctttagttccatgtatgacaaaagcggtggtagtggtgataacaatagttgtggtggctgtggatctaatggtggtggtgatggaagtagtagtagcaacactgacaacaataatgataatgactataacaacaatggtaaatggtga

SEQ ID NO: 81760 - DNA, 348 bp, Glycine max
  Peptide Sequence Number=SeqID_173445
atgaatgtgctaagcctgcgtagtggagctgaaaagcctgatgggcttagcgccactcatgcgctaagccaaggtgcgctaagctcaggcatgaaacacacagaacctagggactatgaacacacaaaagaactcattaagcgcaagggcttagcgagttcatcaaaacccaccaaaaattctcagaaaggcatgaactcgctaagcgcacaaggaagaaagggtgaagtgggaggaatggggagggttgggggtttaaggatgtttacgaaactgcctacagttatggattgcacgcttagcacacagtctgacaacaataataacattaaagggctacgtgcttag

SEQ ID NO: 81761 - DNA, 150 bp, Glycine max
  Peptide Sequence Number=SeqID_173446
atgaggaagagcaaatggaggaaggaatatgcgtttcctgagcctcggaatgtcgttggcttcaacttgaagatcccttgcgcttctttgatggttcctccatttgaggaagtgcagggacgcgttgtaattgattacaacattaggtaa

SEQ ID NO: 81762 - DNA, 864 bp, Glycine max
  Peptide Sequence Number=SeqID_173447
atgctcttgataccacatgatgtaagctccattggagcttgtaggcctaggatcttcttcatcaatggattcctttgcttcttggaagatgaatggcagcggaatggagaaaggaacagagagaggagacgccacttcaaggagaagatgagtctagaagaagctcaccaccataggaggccatggataagagcttggaggaagaaggagatgaatgaagggagagggagagaagagcacaaaattttgcatcccaagaagcttgggatgaggtttgtagaacacgaatggatcatggctagagtgccaccagcagtaaacatgggtcagatgaaagaagaagcggaagatgaagctcaccaagagcccgtgtaccaatggggtccttctgagtctcttatgattcagaagatggatgccatgtttcaccaccatcaagagcactcagccgatgttcacagtaccttagaaaacatcaccactaggctagagagcatagggactaggctaacccttagtaacctctttaacccgaatgaggatgaagcggccattggccaaacaattgcaaaactcttcaattggcttttccgtagccatcaaggagaacccaaaggtgaagaagaagaagatgaggtagaagaaagaaccatgctagaggaagagatgaaagcacaagccaacccttcaacccaaggtatgcaatcctcacttaatcctccgttgtttgattttagcaagctaagcatccataagcaagaagactgtgagaggatggccaaattcgagaaatacatggaaatgctacaagggaagaaggaggaaccacctattgaaaaactcacatgggacgtgctacatcaa

SEQ ID NO: 81763 - DNA, 972 bp, Glycine max
  Peptide Sequence Number=SeqID_173448
atgaagaacgaaagagcagcacctcgcggaagaatggaagaagaagaggcacttgaaggagggagaagcagcagctcgcgcagaagaagaatcaccaagaagaagaaaagcctcgctgaagaaggagaagaagaaaagcctcgcggaaaggaagaagaaatggctcgctggcaacaacctttttcaagcatggagaagttcctgaatcaaaattctgttcgggattcactaggggttgggaaaattcattttgtttcttgtagcactaaagtttctctggctatgtttgtggattggatgaggaatcttgaaattggtattcctccccttcttgaggatggaaccaatttgcttgtttatgccggggaatatgatctcatgggtaactggcttgtcggtaactcaagattggtccgtgccatggaatggtctggtcagaaagagtttgcaacctcacttaaagttccttttgttgttgatggatcagaagccgaattattgaagatctatggacctctaagtttccttaaggtcttctttttttctctctaccccacatacactttgtctttgttgcaaactggcctgcgcttccgtgactacaaccacattgtggagttcgtctttgtggagttcgtctctgccacttatcgattgagctcaaagaaaactgggaaaggaaagagtcccagaaagggtgtgaatcgattttggaagtccattgtggttggccttaagactcccagggcgttcttcttctttctccttctgcctgagttcgtctttgtcgcaaattgggctgcacttccctcgaagaaaactaggaaaggaaagagtcccggaaagggttggaatcgattttggaagtccattgtggttggctttaagactcccagggaagccatcaaagtcgctgtcaaggttcgttgttgcttctgttctgtgtgctggttagtgataagtgctgattag

SEQ ID NO: 81764 - DNA, 167 bp, Glycine max
  Peptide Sequence Number=SeqID_173449
atgaggttgaagcgctaccgaatcgcaaccgcaatcattccttacttcgttgcttgttctgcgttcttcgcaccatcgaaactggccccgacgggtgcagagaaacgcgagggactggaaccagagaaatggcacgcaagccgaggcaggattttagcatttcaaag

SEQ ID NO: 81765 - DNA, 321 bp, Glycine max
  Peptide Sequence Number=SeqID_173450
atggaagacagaaaatcgaataggcaccacaaacaacgaggtttgataagcctagatagaggatcgccacaagaattgggtgaattccttataagatcagttggttcaaggaagaaccctagcagagacaatgctcacacttttgacaaaaaccacaattgtcctcttcattcagttccaaaagtcaccatatgctccaaagcttttgggccttttgcgctcttgctcttgtcatgggtcctcctatgccttgtattgggtcttgggcttccatctggtcatgagtctgggtctggtggttgtcatgggcttggactttga

SEQ ID NO: 81766 - DNA, 117 bp, Glycine max
  Peptide Sequence Number=SeqID_173451
atgcaatggcagttccaaagtcagaaaagatgcaaagacaagctaaaactaacaagaaacaagtgtagaaccatggttacctcgaaagaaaatgaaagaaagtgcttgggacgttag

SEQ ID NO: 81767 - DNA, 147 bp, Glycine max
  Peptide Sequence Number=SeqID_173452
atggcagcggaatgcagaaggaggaaatgctattggagatgccacttcaaggaaaatatgagtcaagaacaagctcaccaccataggaagccatctatggttcagcccactaatccaagatcaaatccaagattctccactaagtga

SEQ ID NO: 81768 - DNA, 117 bp, Glycine max
  Peptide Sequence Number=SeqID_173453
atgactgtgaaaaagaggctaagtcatgaagcgctagaagtgatagttgagcttagctcatcagttgggctaagtgcgcatccacggctaagcatagcgtcaacgcacttagcatga

SEQ ID NO: 81769 - DNA, 246 bp, Glycine max
  Peptide Sequence Number=SeqID_173454
atggcagcaagtcagcctacgacatcaggattgggcgcttgtgctgggattggagttgccgacgaggcgagactatgtgggagccgagttttgagtgggaggcctttgtggttgagcgggaaccctttgtttgacgggtgccggattggaagggtttccgacatgggccgaatagcttggttggtgtggggaatattgctaagtgttgtgaggagtttgctgggacttaggccaagtaggagctga

SEQ ID NO: 81770 - DNA, 495 bp, Glycine max
  Peptide Sequence Number=SeqID_173455
atgggatcaagtcaaaagccttcacttaaaaagaggttctatccagtcaaggtcaagagcctagggatcaccagtctaagagagttagggcgattgatgggtcagctccagcggcaagcttttcgtaaagcttacggtaaaatctgggacctagccatggtagaagtctccacagaggccattgcctccctcgcccagtattatgatcagccgttgaggtgcttcatctttagggacttccagctatcaccaatggtggaagaatttgaagagatcctaggatgtcctctagggggaaggaaaccatacctcttctcagggttctacccctcattggccagaatttctaaaaaagtccaaatctcggcgcaggaattagaccgccaaaggcaagtcgaaaatggggtggaaggaataccgagaaaatatttggagcaatcgacgcttttctcgcctatcataaccacaaagaaagcccggttgttgctatgctag

SEQ ID NO: 81771 - DNA, 300 bp, Glycine max
  Peptide Sequence Number=SeqID_173456
atggggacaaataaaaatggaaaaagattatatcaagtcaagattaagggcctagatgtcaccaaccttaaggagttgggacggttgatgggacccctccaaaggcaagccttccgcaaagtgtatggaaagattttagatttgatcgcagcggagccgttgagatgcttcacgtttggggacttccaaatagtaccgactgctgaagaatttgaggagatattaggatgccctcttgggggaagaaaaccgtatcttttcttcgggtttcttccctccttgagcaagatcgcagctgtg

SEQ ID NO: 81772 - DNA, 661 bp, Glycine max
  Peptide Sequence Number=SeqID_173457
gggtgttgaagtattggccatcaaaatttccattcttgcgaacatgggcaaggtatatggaaagatctgggatctgacgatgatagaagtttcagttgaagcaatcgcatctcacactcaatactatgaccaatcactcagatgcttcacttttaaggactttcaattagccccaaccgtagaggagtttgaagggatcttaggatgctcgataggaggaaggaagccataccttttttctgggaataccaaggaagttcttggaggagaaggcggagactctggcaagccaaagggagtggcgatcgacgcttttcttgcttatcaccacaacaaggaaagcccaatcattgctattttagcagatgcgtatgatacattcaacttgagatgtgagaagagtagtgcaaggattgtctgttgtatgcctggtctttattggaaagaaggaggggcaggagcgttatgctcatgtgaaggatttccaaatgttcctttgatagggatgaagggtcgtattaattataatcccgtgttggccataagacagttaagataccttatgagcggtgcgccattggaggagaccatcgcacctttcatcgcacgaggttttgatgaagctaatacaaagatgcttcagaggatccgtaaggcatga

SEQ ID NO: 81773 - DNA, 1065 bp, Glycine max
  Peptide Sequence Number=SeqID_173458
atggcggaaccatcaaagaagcgaaaaggtacttcaagtcggagtcaacggcattccgagactcaggaaacaccgattccttcctctattccctctgcctcattgttttcatccaaagaacagcggatatggtacacaaatctcttttcttctcgttctattgttgatccaaaactcattgatatggatttcttttcaaatgagagttttgaatgcattcaggcatttgaaaactccaatcttattcctttcatgtctttaaaattgcatgtttactctgagttagtcaaagtcttctattcaaaccttgaaatccaagaaggcactttaatttctgaagtgtatgggattaaaatggttattgatcaatccctattctatgagttagcccaattatccagtgaaggtgtaccatttgaaggtacactgattgatgattggaaatatgaattttctgtgcatgatgcccgccggttggtttgcaccaaccaagcgaatatgaccggaaagcttcttgccggttcattggcttttgaaagccgcatccttcattaccttattgttcgcatcttgcttcacgagatcttcaaaccttgctcaggtttacaaattgattgggcacatcttgttagatatcgcaagcataaggcattgcgattgaatgctccattgccttaccctcatcttgttacccttttccttcaacacttcaacatccctcttgattctgaaccttatgttccaatcaagagatctttccttataggcgcttcagtcatagcatcttttggctatcaaaaggagcatgatggctcttgggtgaagaaaggtactcgacatgttggtgaagaaggacatgatggagaggattcatctctcctttcaaagataatggacaggtttgatggtcttcaaacctttgttggtgaaaggtttgacactttggaattacaagtggatatgtgcttcaatgaaatggagtcaagaatcacaaaggttgaagaatatgtatcttacattcgttcaagcttcgatcttccaccaccgccgccaccatcatcttag

SEQ ID NO: 81774 - DNA, 315 bp, Glycine max
  Peptide Sequence Number=SeqID_173459
atgaaggtctgggtgatcggcggtcggatcaccttagtgggggtgacgggaaccccgaatgactgtcaaaggcccgtgatcaatgccagaaaccctagggcccggttagacttatccgggtctagagggtgcctggtcaaggtggtcatgctggtgcgcatgatccgcacccgcctccctgtagcggtccgggcgaaatcctgccccggtgtgcataacaactgggcaatggcttcctcgtcgaacccgtcagccctgtctcctctgactgaactcgcactcatcgcgtcctccaacactagcggtcacccatga

SEQ ID NO: 81775 - DNA, 279 bp, Glycine max
  Peptide Sequence Number=SeqID_173460
atgatgcttctctttagattcacctgcatagaaattgttagagtgaagttgggctggttcatttgctggttgaggttcttgacactgctttccttatctcaatgtaatggcactcacatttttgggattctggacagattgagaaggattcgaccatctaaggttgggatgattcctccacccgggattgtacctgttgctggagagcataagcttcaggatgttcaattgcttcagattgttgcacagaagggaaaaggtctatgtggtggtaggtag

SEQ ID NO: 81776 - DNA, 411 bp, Glycine max
  Peptide Sequence Number=SeqID_173461
atgttgagtcagcatcccaatatgttaaactacactgactctgtgatgaagagagaatctcctctatccctgcattacaaactgtttgaagggacacatgtcccagacattgtctcgacatctgtctcgacatcagggaaagctgctgcttcaggtgctgtgtccaaggatgctctgattgctgaactcaaggacacatgcaaggtgctggaagcaaccatcaaagccaccacagagaagaagatggagctagaactgctgatcaaaaggctctcagagagtggcattgataatgaagaagcagctgaggaagaaggagaagcagctgaagaagaagaagaagctgctgaggaagaggaagatgcagcagaagagacagaatccgatgatgattctgaagccaccccatga

SEQ ID NO: 81777 - DNA, 453 bp, Glycine max
  Peptide Sequence Number=SeqID_173462
atggccaagttcgatccagacatagtcctcgaattttatgccaatgcttggcctacagaggagggcgtgcgagatatgaggtcttgggtgaggggtcagtggatcccgttcgatgcagatgctatcggccagctcctgggatatcctttaatgttggaagagggccaggagtgcgagtatgtccagaggaggaaccggtccgatgggttcgatgaggaggccatcgcccagttgctgtgtataccggggcaagattttgcccggactgctgccgggagacgggtgcggatcatgcgcaccaacatgaccaccctgactcagatatggatgactttgctgctcagcaacatcctgcccaccgatcataattccgacctcccctctgccgaagtgtcagctggtgtacgccatcctgacgcggatgagcgtccatgtggctcagttgatcgctga

SEQ ID NO: 81778 - DNA, 303 bp, Glycine max
  Peptide Sequence Number=SeqID_173463
atggcagaggtctccacagaggccattgcctccctcgcccagtattatgaccagtcgttgaggtgcttcacctttggggacttccagctatcacccatggtggaagaatttgaagagatcctaggatgccctctagggggaaggaagccatacctcttctcaggattctatccctctttagctagaatttctaagatagtccaaatcttggcgcaggaattagaccacagaaagagtcctctttccaaatgtggatgggttggtggacctagcggcgatcgacgcttttctcgcctttcatga

SEQ ID NO: 81779 - DNA, 171 bp, Glycine max
  Peptide Sequence Number=SeqID_173464
atgcagtggatgtacccggttgagcgatacatgaagatcttaaaagggaccatggctactccacctgcctcgcctccccctcttccctctcctcctcttcctccttctcctacagtagcatcagtgcctacgtccaccttgaagcggacacacaaagcgacacggctatga

SEQ ID NO: 81780 - DNA, 435 bp, Glycine max
  Peptide Sequence Number=SeqID_173465
atgactaggggcaatccaggtgatttacaacactttgatcctaaaatagatagaacctttcatagattacttaggcatagtgtgcatcctgatcattctatgcatttcgagcattgtgagtattttgagcattctgagtattccgttgttggtgattctgaatattctgattttgagcattcaactactaattttcacactgaaaacatggctcaacctcaaccttgtgagaggacacttagggagatggttgcacttgatttcacttatgaaagcttgtgcattcaatatcctgatgagggtgttccatatgttttcaagactggactaatacatttgttgcccaagtttcatggtcttgcaggtgaagatccttataagaatcttaaggagttccatattgtttgttccaccatgaagccccctgatgtctag

SEQ ID NO: 81781 - DNA, 402 bp, Glycine max
  Peptide Sequence Number=SeqID_173466
atggcctctggtaatcgattaccaatggagaccctcgaaggcaatcagaggtgccgattccgtggcacgattcgactcactgctacttcattagtacatccggaggaacccgcacgcacgcttcaacagcctgtggagtggatactacctacacctactccatatcgactagtggagctagttcaagtgatagaggtatcatcctctgaagaagatcctgaagaggacccagaggagttacctcctgagcctgctgtggatgctcttgactttccagaggatgatgaggacccactccctgatgtggattctccagaggatatcatgtcagcatctgaggcagactctacagaggagagcggccctggagggacaacaaatagtgaagactcttcatcatag

SEQ ID NO: 81782 - DNA, 735 bp, Glycine max
  Peptide Sequence Number=SeqID_173467
atgggtactccctccgtcaatgagtaccgtcactctgaagtggtgaataaacccaaagagtcagaatgcgtcgagagtcgaggcactggaaaaggaattaaagctaatttgggcgagggtggggtctggggagggtggtatgggaggtgcccacttctcgtcacaattataacacagaccgtgttaacgcttatgggccatttccttagagtgggtaccggtgagggtaagaatggtggatgggctatgtggatgatggtgattgaggctggtggccacgggcaaaaactgaggcagcgatcttcgagcttatcttcctccgatgatgtggttggcgaggcactcaaactcatggagtgtatggtgatagtcgaagaattgggagatcttgaagatccatcccatggcgttgttgccgtcgaaatgagagacgtcaagtttgatgtggtggtgggaagaaaggggaaaaagggtggtgggggtaagggcgggggtgaaggtggagggagctacaactactcttgtatggagtcgaggcgcaaggagaggtcatggtgggtctgggttagacggagaaccgcctcttccaagcgattggtggtcttggagcagggggtctcttcttacgctgatgccgccagcaggattggcgagataggtgtgccgctattcgcaatagcgagaagcgtgcttggcggagagaagatggtgccgccattgtcgttggcgagatag

SEQ ID NO: 81783 - DNA, 330 bp, Glycine max
  Peptide Sequence Number=SeqID_173468
atgactgaatttgttatgtgttgtatatttcaactctgctgtctgaatgcaaagacacggcacagtgatgaagtgaagtggtgcatcaacctcaatctcagtaaatttgccgcaccgaaacttattcatgggtccattgggtggatgcagtatagcaatatgaaggaaggagacaatgtatctcgccagtgggagcagcgagacagcttccacgtcagctatctcgccaacgacaatggcggcaccatcttctctccgccaagcacgcttctcgctattgcgaatagcggcacacctatctcgccaatcctgctggcggcatcagcgtaa

SEQ ID NO: 81784 - DNA, 2130 bp, Glycine max
  Peptide Sequence Number=SeqID_173469
ggtacatctacttgggttgctgtaactgagaacaagagagggtacatctcttgtggatcagttctagtggagggtgcatccactaggttgttcaaagagaacaaagaagggtacatcccttgtggatctttgcttgtaaaggattttacaaggttgaaaagatatctcaaggattgcaggttgcttggggactggatgagaggtagtagtggtggagatattaaggcatctcctcacatgcgacgtagccatagcgttgggtcactatcgtccccacctgtcgttattggctatgagtgggtgagggacgatgttttgaagtataagtcatctctcacctctgcgacaagtgtcactgctctgcaatgccaggtgaagttggcaagccctgaggactcctggaagatagtcatccaggcctgcgacagtgatgacttccctttcttaagggtggcattgggtagtccgcccttcttctttatgtataaatgcttgtttgaggaccattgcttcaaggtcctggatgcaggtgtcgtggctgatggtttgccattgatgctcaacaaggacggggagtcttgcttcccgttttactgtccactcgtgaagcaggccagacttgcaaatgggactatgccaccgtctactgctgctcccactgaaggaagtcaaccggtggttaaggttggccctattgttgttggtattgttgagattgctcccactgccccttcctctgtattggttaagaggaaacgagatgatggtgttgggctatcgggtcgcaagaagccaagggacccttcgtgccctaaggcaagctataaggttgacacccggtgtgggtcgcccttcaagtgtgcaagatgtgcctccgactccaccaatcttcaaggttcctgtgagcatgccaactgctttggttggttttgctgcggttccctcgtctcccatcgttgcactacacctttactaagtgtcgatgtggctaccattagtgcccttatggtgcctccctcttcctcttcagctccaatgatccttccctccactgcattggctttgacttcaacctcatctcgctcctatgtttccctggatcacatctacatttccaatgatgttgattccttgtcagccgagttccagcatgctacaaattttgccaaggctaaagttggcaaatggagggcgactgcttgcactatttggagagtggagcgccctaaggtagctagtgccaccgctgcttttgctgaggctatgaggttgaaccaccaactgtcttctaaagttggcagtgcgttggcgaagttgttgtgcaccaagttggacagtgatgaactatccaattgctacaaggacttgcaagaagagaaaaagaacttggctaagaaggtggatagcatggcgataaagaaagatgaacttgccaaggctgctagagaagggaaagccaacaaagagcttgaggaggagttgcttgtttacaagaaggagatcatggaacaacatgaaaagggctttaacgaagccttcaggcaggccgggttctttgccgaggaacttgacttgggtctttttgacccattcaaggatgtgaaggacggtgttttgcttaacgtggaagaaattgttgcggaggaggaggttgctgccatcatgatgataagtgtggaatctttgacgacacatgaagtgagacctagtcaaaatagaggtaagatcgtagtggttaaaggtcttgtcacccatctagtggagcttccttctgcttcacggagcttctcccttgatgtctttgaggagcttaatggcgtgctcttgcgtacatgtcactcgttgtgggtagcatgtactcgaggcttaatggcttgctgtcaccatgaatgggctatcccaattgagaccaagctttcccgcttagggatcttttctggcttcaccttaaactcgtcatacaaggtcaccagtctccttgtcgatggttccccaacttcaacggggatcatggcatttatgtcatatacccttagacttgtcgagtctagtgcgcaaggccctaaggatgactttgttggttgcctctgcctaaccgttgatctgaggatgttcaacaaaggtgactag

SEQ ID NO: 81785 - DNA, 261 bp, Glycine max
  Peptide Sequence Number=SeqID_173470
atgaactaccctatcaagcatgttttgcaaaagccaaaactcacaggaaggatggtgctagctctcaagctcaacttcaaggcctcaaacaaccagacaaagaggaagctcctatgcacaaagatggtacgtgctggctactactggctaacactcgaggcagacgcccttgacttcacaaagagatgcagacgatgccaagagtttgctgacattccacgtacccctcctgacaatctccacaatctgatctccccttag

SEQ ID NO: 81786 - DNA, 390 bp, Glycine max
  Peptide Sequence Number=SeqID_173471
atgaacgagttgctcaaattagccaagggctacattcagatggaagaaatgtctagattcaggaacgaagtcagacaagcaagacaaaagcgcgataagcgagaaggaagcactaagaccgacttacacaagttagacaagaggcacaagccagacaagagccattctcttccaaaaggacccgagtatgagcattacacacccctaatggccaatcacactataattctggaggaatctttcaacttggagaaactattggaccctaaaggacaagatagaagagcttatacaggatgggtacttagcccagcttttaaaaaggccagacaaccaccaagcaggagcaagacctggaggacaccaaaaggagcaatagaggaatcatga

SEQ ID NO: 81787 - DNA, 390 bp, Glycine max
  Peptide Sequence Number=SeqID_173472
atgaggtccttcaatggtgattttccaccatggagatgcaacggaagacaaaggagaagaggtgaaaggaggcgccatccactagggaataagccatggaagaaagagcttcaccaccaagaatgtgtcttggataagaagcttgaagaggatgctttaatggaggaaaagaaagagagaagtggggagcacgaaattgaaggaataaaagagggagagaagtggaactttgaggtgattcaaaggtgttttgatgataacaatgatgatgacaaaggtgatgacaaaaagctcaaagatcaatcaaagaacaactcaagtgaatcaagaacaattcaagagttcaagataagaatcaagaagaattcaagactcaagaagaaagtctaa

SEQ ID NO: 81788 - DNA, 441 bp, Glycine max
  Peptide Sequence Number=SeqID_173473
atgatgatgaacaagtgcaatgttgaggatgctgttgatggtgtgtctgatgttgttgatgagctagtaattgttaacacaaacaaacaagtgtctgattataaggatacagagttgctaatgctaacatatttttacttcctacacccgttatttgcttcctacattcgaaccccaacccaattgcaacattcaaacctcaaatgcataaagaacagcgagaatagaggtgcttacggtgcaactctacgtgagcgtgcctgttcgaagagggtttatgtgcgcaagagcaaggcagaagttgattgtgaggaggatcagctagaagcaaaagatgcagcaccaccagtgccaacgccgttggtggggttttgggtgataggtggaacaggaggcaccataaatatttttgtttattgggggtgcaggaagacaatatag

SEQ ID NO: 81789 - DNA, 489 bp, Glycine max
  Peptide Sequence Number=SeqID_173474
atgtcgttgttaacatcggtttcggaaaaaccgatttcgtctttgtcgcaaactggcttgcacttccgtgactgcaaccacattgtggagatcgtgtttgtggagttcgtctctgccacttatcgattgagggtgggaatcgattttggaagtccattgtggttcgccttaagactcccagggcgttcttcttctttctccttctgcctgagttcgtctttgtcgcaaactgggttgcacttccgtgactgcaacgacattgtggatttcgtctttgtggagttcatgtctggcacttatcgattgagctcaaagaaaactaggaaaggaaagagtcccggaaaaggtgggaatcgattttggaagtcacttgtggttggctttaagactcccaaggaagccatcaaaggtgatttgttcgtcttctttagtcgctgtcaaggttcattgttgcttgtgttctgtgtgctgctaagtgatcagtgctga

SEQ ID NO: 81790 - DNA, 762 bp, Glycine max
  Peptide Sequence Number=SeqID_173475
atgggtcattttactcatgatagttggaggtgggacatgaggtggaggaggaatttatttgatcatgaaagtcatttagctgtgcagtttatggaggaaatcagctctgttcttattcagagacaggaggatgtgggtcatcttttcttcaactgtaatctgacaaaaggcctgtggtgggaatccatgagctggatccgggtagtaggtccccttccaattacccctgtttgccatttttctcaattctatgatggctttggggcagttgtgaatcatagtacaagaagaaggaatgccttgagggggctgcacattgagggcagttgggtagacaaacctgctgtggttaaggctgtagtcctccagcatttccaaggcaaatttgctgaaccttccttgaacaaacccaatctagatggggtttccttcaatgttttatccagtaaccagagagatataatggggtttcatgaaaggtggatcggatggataaagggctgcctttcatcagcatccatatctattctagtgtatggaaccccaactgaagaatttttatcttttattgtttgcagaagtgaggaatggacaatttcaacagatggcaatgcagaaagcaggactacaaagcctgagacagatgcaactgttatgactaatactaacatactaatagcaactgacctgtaccaacagatgaggctgccctatacagaccagtatacactaataatcctccctcaagcccagggaggatga

SEQ ID NO: 81791 - DNA, 339 bp, Glycine max
  Peptide Sequence Number=SeqID_173476
atgatcgaaagttttcaacaacaagaacaaatgtcagttctagaattgtacatagaaaaggatgttgctggtggttctatgtttcattctgcaaattctgttacatcatgtggaaataatttatctaataatgaatcggaaccgccaagaaatgtaagcaatttacatgatgatgaagatgattattttgtgtctaattcatacattgaagagtctttagatgaagatgatagtgttgatgatatatctgatacagacgataaagtcaccgacatgattcaactagttacaattgttcacccaacagaaggtgtagaaggaattcaaaatccattttga

SEQ ID NO: 81792 - DNA, 243 bp, Glycine max
  Peptide Sequence Number=SeqID_173477
atgaaggaggttttcgatgccgtcaaactttccgttgcagtcaagaatgaaggaggttttcgatgcagtcaagatcaccggaaaccaccactggcagctgagtgtggaggttttcgggagaagccaagagagagaataggtcaatggagggtggttgctgcattggataagcagaatttgatttccatggacaacatcgttaagcttcaagagcattatgggattcataacttacttgggtga

SEQ ID NO: 81793 - DNA, 645 bp, Glycine max
  Peptide Sequence Number=SeqID_173478
atggcgtctggatcctcgggtcgcggcaactctgcctcgaaaggcttcgatttcgcttccgatgacatcctctgctcctacgacgactacgccaaccgcgattccagttccaacggcaatcacaccgatccggacgatttcggaaccgtggtatgtcgatgggttcaaggtcttggagttgctctaggggatgtggattctggtgtggattttcacaaatcaaggaggatgtttcccactactgcctataatccacctgaagattctttgagccaagatgtgattgcgactgtagagaagagtatgaaaaaatatgctgacaacctgatgcggtttcttgagggaattagttcaaggctatcacaattggaattatattgctacaatcttgacaaatctattggagaaatgaaatgcgatataaatcgtgaccatgtggagcaagagtcaaggctgaaatctcttgaaaaacatgttcaagaagctgggtctgttggtccaatcccgtgggtgaaagtggggggggctttgatgagggtgagaacctacttggatgcgattaagtcactgctaggttatccaagcataggcatgaggtgtcaggtatggggagcgtcatggggcaatagtttagtggatttctag

SEQ ID NO: 81794 - DNA, 393 bp, Glycine max
  Peptide Sequence Number=SeqID_173479
atggcgtttaatgaaaccaggtttccctacaccggtttgtctagaccctcttcagtttcctctaacaccctgtcttcgtctactcattgtagtctccagtttatacgcctagtttcctcttcacctactccttctccttatgtttctgttgacacatttacttctaatgaacattttgtttcctctccacctgcccctgattctagttctatacctattgaacattttgtttcagctgggcatctcagttctaatagcaccttaccttctattggtggaatcactagtgggaaatccgatttgtcggaaagcgcaccggatcgtcaagtatttaaaattaaaacggatgaatccgagtatcgaactcagggaactagtcttagacagggttaa

SEQ ID NO: 81795 - DNA, 621 bp, Glycine max
  Peptide Sequence Number=SeqID_173480
atgaagcaacaagtgttgaactttcctaatactcattatttgaccagcattacggccttgacgaatggtggttttttcaccaatgagtttgggttgagtcatctaattgatctggcacatatctcatatcatggtcaccacgtgctgaaaaaggaaagagacgttgaaaaagaagaaaaggcacgaatccagcagaaggcctacgatgatgtgtataaggcacatgcatctggtttcaaccattccctctaccaagttatttttcattgtgaggttctcgatgagtcaatttttgacattgacaaggatgtatataacaagcaattagtccttatagatgacagtatggaggacggtgcccttatcggttgggtgtaccctcggttgaagaggttattcagaagggttcgtatgttttctgacctcggtgaaagagagtattcaggaggctattttgggaggcaactgctaattaacataacgagttcatcctcatatgaagaggttattcaggagagaattgatgatgaacgtaatgagttcttcctcaaccgaatagagtattcgggagggaactgtaaaaaaatgacaagtataattgttgaaaaacgcatccattga

SEQ ID NO: 81796 - DNA, 474 bp, Glycine max
  Peptide Sequence Number=SeqID_173481
atggcttcgtctaaaggttgcttgagggagcctgaggagttaggttctagggttagaggtcctaggtcaaactttacttcacttatgggctcgttcgccgaaagggactcgactgatttttctaccttttttgatagcctgccagagcaagtggcgaataacattattcacaacatagagaggtttgctaacaacataattgttgtcatgaatgttgtggtcgggccttcgaagcatctgcacagaagagtgattacggagaaggagtatccgcctattacccttcctgggttctcatgggtagatgggaaagttggcactttcttctctcggtacaatgacaagttggacattgataatcttctcaggcaacttaccatttgtcgaataaagaaagataaacttttccctatcgatttgaggacatgctggactgatgttgatcctttggaccttgtatttttaagtaaatag

SEQ ID NO: 81797 - DNA, 507 bp, Glycine max
  Peptide Sequence Number=SeqID_173482
gcttgcagctggtgtctcgctaagcgaggcttgtgctgttagcgagaatcatgcgctaaacgaggcactcaacccgtttagcaagaagggagaatctggaggagaatctaagaagcatctgcgcgctcagcgcgtcatcagctcgctcagcgaggcgtttgtctcttcctgcgctaaaacagaggcgcaaaacagagcaaggaagccaaaaaccttagctttcaagaggatcttaggtttagaagtaaattctaggttcctagaggctaagttcgatgagacatccgagaacaaggccattaagggcaataatgacaagatcaaggtcatcgatgggatgaccaataagagaaagtttattcgctatgagagaatagggagtgtcgccagtgatgtatccatagagatcttgggcttgaaaaaggtgagtgatttgagtgtgccaagtgtggtgattggtggatctgagtttaatgagaagggtggatgtaatgggtatttccacaa

SEQ ID NO: 81798 - DNA, 309 bp, Glycine max
  Peptide Sequence Number=SeqID_173483
atgactggtgagagcattagtccttatatttgggctatcctcttgaaatgtcagccatcccgcgtcaatcaagctctgtaccttatgcttgaaggacacgcattgctcaatagaatgccccagaacacccccgtgatatgcacaagttgcattgggattgtaccatcaggggaagggagactagtagatcttcccgagcgggtaaggattgtgtgggaaacgaattttgtgggggaggcctttctggttgagtgggaaatctttgttggacaggcacctgtcgcaaccttcccttcggagggagggtga

SEQ ID NO: 81799 - DNA, 250 bp, Glycine max
  Peptide Sequence Number=SeqID_173484
gcaaggaacggtatctacagcacttggttcgccagcaggcggccaaccactggggcagggccagggtttcgttccttttgcgtgccctactccagatcaatttagggctgaggtcgcatggcccggagattggcccgaggcccaggcaggggaggcgcctgcagaggctcctggtgatgcagaggaagcctgcatggatgaggagatgacgaatttgctcggtttcttgggtgggagcagagccacatga

SEQ ID NO: 81800 - DNA, 294 bp, Glycine max
  Peptide Sequence Number=SeqID_173485
ggaaagctgctgctcaggtgctgtgtccaaggatgcttgattgctgaactcaaggacacatgcaaggtgctggaagcaaccatcaaagccaccacagagaagaagatggagctggaacggctgatcaataggctctcagaaagtggcattgatgatggagaagcagctgagcaagaagatgaagcagctgaggaagaggtagaagcatccgaggaagaagaagaagctgctgaggaagaggaagatgcagcagagaatactgaatcagatgatgattctgaagccaccccatga

SEQ ID NO: 81801 - DNA, 366 bp, Glycine max
  Peptide Sequence Number=SeqID_173486
atgtctgccagtgatcatgccattctacgtgatagagtgcatcaacccactaagaagaatttactggagttatcaacacaagacgttgtattggcacaaaataagttgctctctagacaacatgagatcttgacagaaaccctgagtaagttgccaactaacttgtctaatggtcaacctttacagccttctgttttgcaggtcatgggttgtaccatatgtggttgtactcatgaatccgatctttgcattccttttgaagagcaaacacaagaggttagctacatggggaatcaacaaaggcagggatacaatcaaggtggattctcaggtttcccgcagggtccttacaaccaacaaggatag

SEQ ID NO: 81802 - DNA, 195 bp, Glycine max
  Peptide Sequence Number=SeqID_173487
atgatggttcttcgggcgtctcatgtcgatctcataattacatttgtcatgcatagcataagtaaaaaacacgctttacggtgcccttaccgaatgcgtgccaaagctagagtgaagagtgaaatagcggaggtgcaaaagcagatgaaggctgacatggaggccatgaaagagcaaatgaccgggatcctctag

SEQ ID NO: 81803 - DNA, 210 bp, Glycine max
  Peptide Sequence Number=SeqID_173488
atgaagctttgcttctacactttggatgttctcatttgtgatcatcctaaagagttcatattcatgggtcagtgtgttaacatcaattgtgccttcatgttctatggcttcaataaagatttgcattcaggttttctagtagtggtaaccctcaccatcaaagataggtggcctatggatggagtttcctttgggaaacagagaatttaa

SEQ ID NO: 81804 - DNA, 268 bp, Glycine max
  Peptide Sequence Number=SeqID_173489
ccataacttcaacaatgggaagagatcccaagaagtttctccaactcttaaatgctataagtgtaatcaactcggtcacataaaggcaaactacccctcaaatgagtcatggcccaagaagaatgagaagaaaagctataaagaaagaagatccaagaaggcgtatattgcttgggatgacaatgcctcatccgatggttcggagaaggagatcaaccttctatccaaggactatgaaagtgatgagaacatctctcaagaagtttaa

SEQ ID NO: 81805 - DNA, 234 bp, Glycine max
  Peptide Sequence Number=SeqID_173490
atgaagtcgctgagagagaaacgcgaagaactggaaccggagaggcagcacgcaaatcgaggcaagatttcagcatccaataaggtccagtttttttcttcttttatggctgagtatgtggtcaagtcaaagaaaatgaaaaagaaacgtggaggaagaaagagagagctgtgctggaagtttctggagaaagagagagaagatttggccaccaattgtggtgtccctaaataa

SEQ ID NO: 81806 - DNA, 240 bp, Glycine max
  Peptide Sequence Number=SeqID_173491
atgtatgttttgatgatgtcaaaaagaaatcacttcattgtcatcatcaaaaagggaaagaatgtgaatgtacgtatacatgattttgatgatgtcaaagaagaatcaaacaaggctgcttcaaaggataagcatttgcttcaagatttcttcaagatcaagccttgccttaaaacaaagggtttcaaagtcatgcaaggctctggtaatcgattaccaggaagtgtagtcgattactag

SEQ ID NO: 81807 - DNA, 458 bp, Glycine max
  Peptide Sequence Number=SeqID_173492
gggtacatcctttgtggtacaagtagagggtacatctacttgggttgttgtgactgagaacaagagaggatacatctcttgtggatcagttcaagtggagggtacatccacttggttgttcaaagagaacaagggagggtacatcccttgtggatctttgcttttaaaggattttacaaggttgaaaagaaatctcaaggaccgcaggtcgcttggggactggatgaataggttattccaagatcatgatgaagaccaagtcaacttttgtctcatgacaaaatctcatgaaaacgacaaagaagaatctgtaaggaagaagtggtacatcaacaatggatgttccaagcatatgacaggagatgtatcaaaatttacaaccatttcccccaagaaaagtggacatgttacatatggcgacaacaacaaaggtaaaatcattggagtcggtaaaatag

SEQ ID NO: 81808 - DNA, 249 bp, Glycine max
  Peptide Sequence Number=SeqID_173493
atggctgagctaagtgactcaaaggtccgagaatctgatgtgactcctcaggccttgcacaagatcaacctagccctatccagagtaatatcagaagtatgggatgtcggggataggttagagaaagataaaacactccaagttttggccagagtggtaagattcttccttaagatcttcagaggcaagccatcagcattaagctcaaatcccctcctagggatacataaccgagctgccagctcttga

SEQ ID NO: 81809 - DNA, 333 bp, Glycine max
  Peptide Sequence Number=SeqID_173494
gctagaggagttcagttagattcgaggtccctggagagcttgagtcctgccattaatttggcttacattaagaagaactgttggaatcttgatgatccaacaataacttttagaggacccaggaaggctaggggagaccagccctcttcttctggagggggtggggcctctgcagcccaggagcctgtgactgaggagccaccagcactagcagaggagcagactactccagatcagaccccacaaccatctccatcctttacacctgctcctgaggagactcagccatcagcactggatcttaatgaagaccagccacaagaggagcaggac

SEQ ID NO: 81810 - DNA, 603 bp, Glycine max
  Peptide Sequence Number=SeqID_173495
gtcattaacttggcctatatcaggaaaatttgttggaaccctgatgatctgacagttactattagaggggccaagagagcgaggacaaggccagctgaggccccttccacatctacagctcctcctccagcatgtaccccagcagctccttctgccccagcttctgcagattttcagcgtcttgaagccatgcttcaaagcatccatcaagggcagattatcttattacagagtttacagatggtggcacctccagactctattcctttagtagagcagtttaatgagtgggtcccacaacagatggaggatgagtcacccgagactaccactctagatcccttggtcagaaggaagaaggcagatgaaacacaagaagctacagccacttcggagaaatctcttgaggccacttccgagccttcaaaaccagtggcagatacagcttcacctcaacaggaaacaaacccttccactcctgaggatcagactacaccagtcctgtctccaaacacctctcctacagctacccatgtgcttcacttaacagacgaggaggatgttcaaacacaggatactcaggaccaatcacaagatttttaa

SEQ ID NO: 81811 - DNA, 231 bp, Glycine max
  Peptide Sequence Number=SeqID_173496
atggtgagcttcttcttgactcatcttcttcttgaagtggcatctccaatcatctttcttccttctccattccgctgccatgatcttcaagaagcaaaggactccattgataaagaagatccagggttgacaagctctccatggagctacatcatgtggtatcaagagcatcttcgtctaagtgatattcttttgcttcctctatctttttgttcggtgaattcactttaa

SEQ ID NO: 81812 - DNA, 303 bp, Glycine max
  Peptide Sequence Number=SeqID_173497
atggaggctggatctttgagcttcaatgaggtccttcaatggaaaagaaagagagaaggtgatgtaagctccattggagcctgtaggcctaggatcttcttcatcaatggattcctttgcttcttggaagatgaatggcaaccgaatggagaaaggaagagagagaggagacgccacttcaaggagaagatgagtctagaagaagctcaccaccataggaggccacagataagagcttggaggaagaaggagatgaatgaagtgagagggagagaagaccacgaaattttgtgctccaaatga

SEQ ID NO: 81813 - DNA, 265 bp, Glycine max
  Peptide Sequence Number=SeqID_173498
gagtaaccagtggtgcccaccgccggtgccctatttcctcctggaaatcagtatactcgtcgtccctgagctggacgcgtcgctcctggagaaacgaccatcccttgatggcctcgaagcgctgttggtgtacagcactcctaaagcggtgactgtcatactccggagtggaactagttctgaaattctgatactgaggacagatgtcgtacaggatgtcacgacatcgcgcttcagaacatgcagattgtatatgacagtatga

SEQ ID NO: 81814 - DNA, 189 bp, Glycine max
  Peptide Sequence Number=SeqID_173499
atgaagatgctcttgataccacatgatgtaagctccattggagcttcggaatggagaaggaagacagagaggagacgccacttcaaggagaagatgagtctagaagaagctcacaaccataggtggccatggataagagcttggaggaagaaggagagggagagaagagcaccaaattttgtgctctaa

SEQ ID NO: 81815 - DNA, 230 bp, Glycine max
  Peptide Sequence Number=SeqID_173500
tcctccacaacaacaacaacagcctgtccctcctattcagaatgctgctggtccaagcaagccatatattcctcctccaatgcagcaacaacagtcaggcaaccaaattcaagtgcctccaccagtagcagcacctgcacctgaacctgtcaagcttcattctacacctgaaaaagaggatgagatagttgcacaaaagagaaagcttcctaacaaaatttttcatgcag

SEQ ID NO: 81816 - DNA, 1307 bp, Glycine max
  Peptide Sequence Number=SeqID_173501
accgccaaaagcaagtcgaaaatggggtgtttggaataccgagaaaatgtttggaggcaaaagcaagaatcttggcaggtaaaggtgaatgggccctgttcatagacattctcgcactgttgatctttggaggagtcctctttccaaatgtggatgggttggtggacctagcagcgattgacacttttcttgcctatcatgaccacaaggaaagcccggtcgttgttatgctagccgacctctatgacacctttgaccgaagatgtgagaagagcagtacgaggattgtctgttgtactcccgctctttatgtatggttagtttcacaccttttttgccaagaggtgaggcatgcctacccgttagaaagccaccgttcatgcatagagaaaggaagggccaattgggaccaactcttagcaaacaaagaaggagcatctgtcaactggttccctcgatggaaagaaggaagaaccggagttcttatctcgtgcagaggattttcgaatgttcccttgatggggacaaggggttgcatcaattacaatcccattcttgcgataaggcaacttggctacccgatgagaggggcaccactagaggaagagctcgcacctgtcatttcacgagggttcagtgagaccaacgtggagacgattcggaaggtccgcaatgcatgggaagtggtacaaaagaaggacaaagagcttagaggcaataacaatgggctcattggtggctaccgtgagtggttgaaagcccacgcgcaaggtttggattggctcccaagtttgagaagtgctaaaagggaggaagttgaggcactagaggaagatgaagaggtgcaggctcttaggacagaaatcgagcaagctcaaacagtcaaagaaaggttcaaatcagtggctcttaggatccaaaaggagaatgccgaactgagggatgtaaatgtagctaccaccaaggccttggaacaagagaccaagagggctcgtagggaagaacacggccggaacaagttccgaggggctctgtggggtagtaacaacgagcttaaactccgaagggaggaaagggaccaatcacgggtagacagtttgatcttgaaggatgagttgaaggcttgctcgaggtccaagagaagtttgtctcagcgtttatgcgagatagagaccaacatgttagccatcatcagcaagtaccaagaggaactaagtctagccacgacccatgagcatagggtggcggacgagtatgcccaagtgtacgcggaaaaggaggctagaggaagggtgatcgactcgtaa

SEQ ID NO: 81817 - DNA, 450 bp, Glycine max
  Peptide Sequence Number=SeqID_173502
atggaacttcaacatctcaaccaaaatgaagagaccgacaaaaggaaaagaagcatagcacttgaagcctcctcctcaatgcaagaagaagaagaaaaaaaagaatttgatgatgaagagaaattctcactctttgtgaagaagtttcataaatttgttaaaaataaaagaatggagagatgccataacttcgataatgggaagagatctcaagaaggttccccaacacttaaatgctataagtgtaatcgacccggtcacataaaggcacacagtcccacaaatgaatcatggccagagaagaatgagaagaaaacccataaagaaagaagatccaagaaggcgtatattgcttgggatgacaatgactcatccgatggttcggagaaggagattaaccttctatccaaggaatatgagagcgatgagaacatctctcaagaagattaa

SEQ ID NO: 81818 - DNA, 1187 bp, Glycine max
  Peptide Sequence Number=SeqID_173503
tattatgatcagccgttgaggtgcttcacctttggggacttccagctatcacccatggtggaagaatttgaagagatcctaggatgccctctaggggggaggaaaccatacctcttcacaaggttctatccctcattagctagaatttccaagatagtccaaatctcggcgcaggaattagaccacaggaagcaagtcgaaaatggggtggtcggaataccgagaaaatatttggaggcaaaagcaagaatcttggcaggtaaaggcgaatgggccctgttcatagacattttcgcactgttgatctttggaggagtcctctttctaaatgtggatgggttggtggacctagcaacgattgacgcttttcttccttatcatgaccacaaggaaagctcggttgttgctatgctagccgacctctatgacacctttgaccgaccgaagataaccggagttcttatctcgtgcggaggatttccgaatgttcccttgatagggacaaggggttgcatcaattacaatcccgttcttgcaataaagcaacttggctacccgatgagaggagcaccactagaggaagagatcacacctgtcatttcacgaggtttcaataagaccaacatggagacacttcagaaggttcgcaaggcatgggaggtggtacaaaagaaggacaaagagctcagaggcagtaacaatgggcccattggtggctaccatgagtggttgaaagcccacgtgcaaggtttggattggctcccaagtttgagaaccactaaaagggaggaagttgaggcaccggaggaagacgaagaggagaatgtcgaattgagggatgtaaatgtagttaccaccaaggccttggaacaagagaccaagagggctcatagggaagagcacggccggaacaagttccgaggggctctgtggggtagtaacaacgagcttaaactccggagggaggaaagggaccaatcgcgggtagacagtttgatcttgaaggatgagttgaaggcttgctcgaggtccaagaaaagtttgtctcaacgtttatgcgagacagagacgaacatgttagccatcatcagcaagtaccaagaggaactaagtctagccacggcccatgagcacaaagtggcggacgagtatgcccaagtgtacaccgaaaaggaggctagaggaag

SEQ ID NO: 81819 - DNA, 78 bp, Glycine max
  Peptide Sequence Number=SeqID_173504
atgggtttcaaggataggtctttagtctgcaagctcaacaaagctctctatggcttgaaacaggccccaaggcaatga

SEQ ID NO: 81820 - DNA, 1014 bp, Glycine max
  Peptide Sequence Number=SeqID_173505
atggccaagttcgatccagacatagtcctcgaattttatgccaatgcttggcctacagaggagggcgtgcgagatatgaggtcctgggtgaggggtcagtggatcccgtttgatgcagatgctatcggccagctcctaggataccctttagtgctggaagagggtcaggagtgcgagtatggccagaggaggaaccggtccgatgggttcgatgaggaggccatcgcccatttgctatgtataccggggcaggattttgcccggactgctgctggaagacgggtgcggatcatgcgcaccaacatgaccaccctgactcagatctggatgactttgctgctcagcaacatccagcccagcgatcataattccgacctccccctgccgaagtgtcagctggtgtacgccatcctgacacggatgagcattcacgtggctcagttaatcgctgatgccatttatatatttgcaggtatggcgcctaccaggcatccctttggaccagataagtccaacagggccctgggatttccctcgctgatcacaggactctaccagtcattcggagtccccgttgcacctaccaaggtaattcggccgcccatcacccgggcttttattgagaagtactgtacccagagacaggctcagggtgatgctccacaggccgcaggcgcgccaccaccacctcatcaggctggccaggccggggcatttgacatggagcagtatttatggcatttggttcgccagcaggcggccaactaccgagcacatgtacagacccatgattgtctgtaccagatgagcctcagcatgcagagccagggcttcgcttctttttcatgccctactccagaccagttcagggcagaggtcgcatggcccggagattggcccgaggcccaagcaggagaggcacccccagaagctcccggcggtggagaagaggcccacgaggacgaggagatggccgatttgcttgacttcttgggagggagtggagatacgtga

SEQ ID NO: 81821 - DNA, 309 bp, Glycine max
  Peptide Sequence Number=SeqID_173506
atgttgtggaagcttgggaggattgatggggacccggtgttgagagaaacgaggatatgggctacgtgggaatacgtgagctcagttggaggtgggcaacaggggatggtgggtttatgcgcgcattgtggatgtggaaaaactagttgtgcaccatcgcccgaccgccacctagtaccacatgtgatggagtggtacctggagatatgtcgcggggtcaggagaccttggggacgtcaggtggggtgctattgccccaaaaccaagcttgaccaatcccgacccaacccgggcatagtcggtcagtga

SEQ ID NO: 81822 - DNA, 459 bp, Glycine max
  Peptide Sequence Number=SeqID_173507
atggatgctagagtaggagctgtagatgtggaagggaggtcagctagccttgccctcgccctcctagcccttcagatagaaactgccaagttaatgatcaggctcaatcgctcgaaagtaaggttgtcaaagacaacccctctggctctacatagggcgatgatcagagaaggaaacccaagtctagtagtgttagactgggctatagaagtcatctggccagaaataagagctcctatgttcatgtccatgcgagagactaggccaaagatcaacctacctctgtccactatcagatcagaggtatgtgatgtgggggccaggttggagtatgagagaacactccacacctgggctaaagtagtcaaatctttcctgacaatcctcccaggatggccctcagtgttcaaaatgaaccctcggcctggtatgcataaggtagcctcaatctctctataa

SEQ ID NO: 81823 - DNA, 1008 bp, Glycine max
  Peptide Sequence Number=SeqID_173508
atgttgaaggaaggcaccaacaacgtttggtggcagcaacactggcaccacctggtcacgtctaaccgtgtggcctcgagacacaagcgtgtgtgggtgtgcgaagcgtgtgagcgtgctccggcggcgtttctatgcaaagctgacgcagcttctctttgttcttcctgtgatgctgacattcactcagcaaaccctctcgctagccgccacaaccgtgttcccattctcccgatctcaggttccctcttcagggaaccagagcacaatcacaaacgcgtggaacacgcgttcgtgaatgaggttgaggaggaagaggaaggggtttttgatgagtatgaagacgaggttgaagctgcttcgtggttgttgccacatcctatgaaaaataatgatgaaattgaggagaatgattgtggtgacgagggttttttgtttgttgatgagtatttggacaatcttgttgattgttgtaactcatgtggtcacaatgacaaccagtttagcaacgtttatcagcaccagcagaattacaacactgtccctcagaactatgtagtggttccagttcaggtgccgcagcattttcaacccggtttggactttgactcatcaaaagctgggttcagttacgatggttctcttagtcaaagtgtttcggtttcatcaatggatgttggagttgtacccgaatcaacagtaagtggcatctcaatgtcccactcaaagtcaccaatagggacaaatgacctatttcctccccttctcatgccttcacatctcacaccaatggacagagaggcaagagtcctaagatatagggagaaaaagaagacaagaaagttcgagaagaaaataagatatgcctcaaggaaggcctatgcagagactagaccccgcataaagggtcgttttgcaaagagaactgatgtagaagctgaagtggatcagatgttctccacaaaactattcaatgaagttggaggtagcatttttcccactttctag

SEQ ID NO: 81824 - DNA, 231 bp, Glycine max
  Peptide Sequence Number=SeqID_173509
atgtctaagttgtcatctatgaggctcattggagtcgcaggtgtgagaaaacacattattgaaatgagggatctagcgactcaacttaagtcactccaggaggaagagagacttgctctagaaattggtgaaggtgctcctaccatgactcaagataaggggaagaaggaaaagaaccatataccttctattgtcaaaattaagaaggagtctaggtgtttttttctataa

SEQ ID NO: 81825 - DNA, 3090 bp, Glycine max
  Peptide Sequence Number=SeqID_173510
atgtcaatgcccttgctcacaaacttgcaacacattgagacactcctcaatgcaccaaaccccaccgttagtgcatccattaaaagatggcactctgcattcatggccatctattgttcccgagctattatgtcacactccactctcaagaaaccaaacaaaaccaaagcaaaagcctcaccttcaccaacaccaacaccaacaccatctttcacagttgttgatttgaaccctcaccattcctttgatatagaccaaacagccctcaccgatattgtcaaagaaaaagagcttgagaaccttgatagatttggtggggttgaaggggtggctaaagcccttcaaacccacgttgagtatggtatcaaaggtggtgatgatgatgctgaagacatcacacgtagaagacaagtgtttggttccaacacttaccacaaaccaccttccaaaggcttctttcactttgtggtggaagcctttaaggatgtcactattctaatcctcatggtttgtgctgctctttcccttggctttggaatcaaggagcatggaattaaagaaggttggtacgatggtggaagcatctttgtcgcggtgttcattgttatttccttgtcagcagtgagcaacttcagacagaatagacagtttgacaagctgtctcaagtgagcaatgacatacaaattgatgtggttagaagtgggaggcgccaaaatgtttcaatcttcgaaatcgtagttggcgatgttatttgcttgaagattggagatcaagtgccagcagatgggttgttcatagaaggacattcacttaaagtcgatgaagcaagcatgacaggagagagtgatcatgttgagattagtagacaaaaccacccttttctgttctcaggtaccaaagtggctgatggatatgctaagatgcttgttacttcagttggaatgaacacaacatggggccaaatgatgagttcaataagccaagatattgatgaggaaactcctttgcaagagagattaaacaagctgacatcatccattgggaaggttggtttggctgtggcttttcttgtccttgttgttttgttggttaggtacttcacaggtaacacaaaggatgagactgggatcaaagagttcaatggaagcaggaccaagtttgatgatatcatgaatgctgttgtggggattgttgctgatgcagttacaattgttgttgttgcaatccctgagggtcttcctctggctgtgactctaactctggcttattcaatgaagaaaatgatggctgaccaagcaatggtgagaaagctctctgcatgtgagacaatgggttctgctaccacaatttgtactgataagacaggaactctcacacttaacgagatgaaggtgactaaggtttggcttggcctagaaccggtgctagaaagtgcctacacaaaggttgctccatttgttcttcaattgatccaagaaggagtggctctaaacactactggaagtgtgcacaagtccaataaatcaggttctgaatttgagttttcaggtagtcccacagagaaagcaatcctatcttgggctgtcttggaattgaacatggagatggagaacttgacaagaagttgttccatcattcatgttgagaccttcaactcaaagaagaaaagaagtggagttttgttgagaaggaaggtagacaacacagttaatgcacattggaaaggagcagctgagatggtactaaagatgtgttcaagatactatgatgcttctggcattgtgaaagatcttgacaatgataggatgttgaagtttgagcacattattcaaggtatggcttctagtagtcttcgttgcattgcttttgcacatgtagaagtagctgaggaggagcttgtagatgaagaagggaatgcaatggcgaaagtgaaagaaaatggtttaacattgttggggcttgtgggtattaaggatccatgtcgtcaaggggtgaagaatgccgtggaagcatgccaaaatgctggtgtgaatatcaaaatgatcacaggtgacaatgttttcactgcaaaggccatagcaaccgaatgcggcatacttcggcctaatcaagacacagatggagcagtgattgaaggagaggaattccgcaactacacgcatgaagagaggttggagaaggtggaaaaaatctgtgtgatggcaagatcttctccttttgacaaacttctaatggttcaatgcctaaaacaaaaaggccatgtagttgctgtcactggggatggaacaaacgatgcaccggctctcaaagaagctgatattggactctctatgggaattcaaggtactgaagtggcgaaagagagctcagatattgttatattggatgacaattttgcatctgtggtcactgtcttaaggtggggaaggtgtgtttacaacaacatccagaagttcattcagtttcaattgacagtgaatgtggcagcacttgcaatcaactttgtggcagcagtgtcagctgggaaagtgccactaacagcagtgcaattattatgggtgaacttgatcatggacacattaggtgctttggctcttgcaacagaaaaacctacaatggaattgatgcacaaaccaccagtgggtagaacaaaacctctcatcaccaatgtcatgtggaggaacctattggctcaagctttgtaccaaatagcaattttgctgacccttcaatttaaaggtgagtctatctttggtgtgacatcaggagtaaatgacacattgattttcaacacatttgttctttgtcaagtgttcaatgaattcaatgcaaggaagatggagaagaggaatgtcttcaaaggcatacacaggagcaagttgtttttaggcattattggcataacaataatccttcaggtggtgatggttgagtttctcaagaaatttgctgacacagagaggctaaattggggacaatggggtatctgcattggtttagccgcagtttcctggccaattggttgggttgtgaagttaatacctgtcccagataaaccattcctcagttttttgagtaagaagaaatga

SEQ ID NO: 81826 - DNA, 276 bp, Glycine max
  Peptide Sequence Number=SeqID_173511
atgggtcatctcaaatttgccaaattgaaaatgggtttcaatcaaaataaaaaatttaacacgagaacacaaaagggcatcgaaaagtgcaggaaaaaaaacagaggaacttacagggtcatcgttcgatgtggaggggttggtggtaaggaggaccgaaagggtggcaacgaagagaagagaaacatggcagaaatgaagatccggaacgagaacaagcttcgaaaactagatccacctctagctcctcttgtagcaaccgccattggatcttga

SEQ ID NO: 81827 - DNA, 672 bp, Glycine max
  Peptide Sequence Number=SeqID_173512
gaggtggaggagagggtgaacgagagagaggatttgggtttggtggttgatgaggttgagattgaaattgaaggtgatgatggcgatgggaattcggtggcgtcagggttcactaatgccgttgaggaggaagaagaggaggaggaggaggatgccggggaagaggcgctgaggtacctcgaatgggagattctcttggcggttaacaattcggagaggaatgtgaatggtgtgttggagcacgagggcaatgctgttggtggtgctgatttcttaacaattcaggatggttatgtgtatgccgcagagtatgatgttttgttcgggcagtttcttgagaatgagagtgccttgaagggaagccctccggctgcgaagagtgttgtggagagtctcccgttggtggagttgtcgaaggaggagttgttgcaggggaagaacgtggcgtgcgccatttgcaaagatgagattttgttggaggagaaggtccggaggttgccttgctcgcattgttatcacggggactgcatttttccgtggttgggcattcgcaacacgtgcccggtttgtcggtttgagctgcccacagatgatccggactatgagcaggggaaggtcaatagggctgctcgtggtctgttggagcttgcggcagcacggatgcaattttga

SEQ ID NO: 81828 - DNA, 1611 bp, Glycine max
  Peptide Sequence Number=SeqID_173513
atgagcactgaaagtgctgaacatgatgccagtgttgttgatcttgaaggtgttgctgtttcatcacccagtggaaatgtgatgggagatctgggtgatgtttacagcacaatgctcacaagccttgatttgggtttggcttgtttctctgagaaagtttccaacttgagcaattttgtgatgcatgtggaaaccaaggagtgtgaacttgaggccttggagaaagaggatcacattggtgaaaagggtctggagtttgatctgttgtctgtggtgttggattcagaggtgagagagttggagggagtgttggacacccttcaaggtggggttgatgaggctagagagtgggggtgttcttgcactcatttgggagagggttttgttgcaatgcaagagaagttgggtgattatgaacaacagttgaagcagtttgaagaggagtttaatggcattaagatgcagtcagccagttttcagaggaatttgtcttccttaaaaaaggcagaaaatggtgaaatcatcagagaggatgataaatctttgagtgcaaatgcagagataaaactgcaaacagttgagcaacaaagacatattctgagaatgctagagaaatcattggcaagagaaatggatcttgagaaggatataaatgattcgagagaaattcaagaaaatttaagactaaagatgttcttttcagagcaagagtttgttaacatggagggagaagcaattgatgtttgggaaagatggcttgaggcagacaatgcaagtgagattctgttaggaatttcaaaaggccttttaggtaaactccacatttctcagttcagtttaaatggtcaaagtcatcgtgaatctgagcttcgagctaatctaaaagatgctgaagataaactaacctttgccaattctgaggtctctgctttaagtaataaggtctcttcacttgagaagcaactaaaagaatcggaatttcagctactgaatgcaaaggcctctgctgatgaatatcagaagcagtataatgttaagtgttctgaagcaagagacatggggagtgttattgttgaactgaaagaagctgtatataatgcggaaagtagggctaatagtgcagaaactaagtgtaagttattgacagagactaattcgaaactcgatgaggagctggctcttttgagaggctcatctacaagagcagagttgctagagaggcagttgaaagaatctaatctacgattgcagaaaatgacagcatctgctaaaggtagtcaggagaaacaaagtaagttgtattccacaattagagatatggaaaatgtgataaaggatctcaagtcaaaggtttctaaagctgagggtagggctgatagcacagaggacaattgtatcattttgtcagaatctaatgccgagttgaatgaggaactcagctttatgcggagtcgattggaaagccttgaggggtcccttcaacgagaggaggaagtgaaaatggcaactgtagaggacattggaaagcaggccaaatttttcaaaaaattggtaacacagctggctgtcgagagagagcgtcttaagcagaagattgatgccctggtatag

SEQ ID NO: 81829 - DNA, 213 bp, Glycine max
  Peptide Sequence Number=SeqID_173514
atggtcatgacgttgctcacggtggtggtgatagcggttgacggtcatggtggtagtagtggttgcggtcatgatggtagtagcggttgcggtcatgataattgtgacgaaaataatatgactatggtgatggtcatggaaaggaagagtgcgaaggaaaattgcacagtaccaccgttatttgcatgctttccatggaatcacatcttttga

SEQ ID NO: 81830 - DNA, 75 bp, Glycine max
  Peptide Sequence Number=SeqID_173515
atggatgatcaaggagatggaggaacttgtgcagctaattttgatcggtgggtttggaagagatttggttcttga

SEQ ID NO: 81831 - DNA, 3791 bp, Glycine max
  Peptide Sequence Number=SeqID_173516
ttctacaattttgcattcccgacatcctaatgatcaaggacaggcctctgttttggcaaactttctggaaaatcggctatttgttgaggctgcttcaaaggatgagtatatcaaccgacagacaattatgcaacgattggatacacaactcaagaagttgtatgccccaaaatgcagccaagtaaatagctctattgcttgcacatcccagatggtgccctcttttgggttattgcaagctaggtctaatggaagtgtaccagaacctgcttttcataacgtggctggtcctatcaccaatgcaaccaattattgtgcagtgcctgtagataataaaaatagcttcccaaatggagggttgtcttattcttcttttgttccccaaccggtttttttaccagataaccatccatccatcgctacatgcactgatttggatgtgcttcctaactcttttgtttctggtgggagaagcaatttgaaagcttgctccaagtcaattagttcctattttcctcagcgacaggcagacgattggaagacgcttctggtgaagtatggagattgttctaggactacaacgggaaaatccgtccaatctgaatcttcaaatttgatgacccctcaagatgccttgagggaattttcaaaagtttttgatcttcctcctgtcccgagaagcctaggagatattaggcaacatcaacaccggaagcgagattttcaacggaatttaaaaccttttatgcagccatatgggcttcctggtaaaactaatatggcccagcctaatgcattctccaatcaaggtgaacgttgcagtcaaatgttggggcataaaacattgaaacaaccacaacttttcaaaagaagtctcaatggggatcaacagttcacttcagggagctcagtagatctttttggtttagatgattctgataatatgaattcatgtggtagttccaaagtttcggttgaacagaggatcatgcttgaatatctttatttgaagaattttaacaatatttcacggggtaatgttatgaaatatctgcattcaacagtttgtcttaaagggacatgtaattgtggatggtatatcaagctattattgcattttgatgactgtaaagatgatggttgtcgtacgtgttactcttggaaattgcatggcactgatattcttgggggtcatttgaaatttcctgatattatgggttctgttgaaagaaaaaatgacgctccttctggaaatactgaagccatgctaccacctgaaaaaagaagaaaaatggagcccgcttttggtgtccctttaattaataatgcaagtttggatcagtcgactcagaaaatggttcaccctcgttcttctgaagctctttcagaattgccattgagccaaaaagctgatcaagagatggagatgtcaccaaatccaacagctaatagtgtacatatggaggacaatcaaggaaaaatcaggttgaaccaagatgagataaatgctacaaaagaagccattaagccaaaagttgatgaagagaaggaaaggaagtccccaaatccaacacttaatactgcatatatggaagacataaaaggcagaattgaattggaccaggatgagataaatgctacaaaagaaatcattgagccaaaagttgatcaagagatggaaaggatgtcccaaaatccaacagttactgtagatatggagggcatacaagccataaccgggttcaaccaggatgggataaatgccacaaaagaagtcattgagccaaaatttgatgaagagaaggaaaggaagtccccaaattcaatagttaatactgcagataaagaggacacacaaggcagaactaagttcatccaacatggaataaatgttgatctagagatggaaaggaagtcctcaaaaacaacacatatgcaagctgatgcttctcttaacagagtacaatggttgaagaatcaggaagtgatgtttacacatgccaattatgtggaatgggaacactttcttttgcccccgtgccaatctattgcttttgttgtggcatccgcatcaagcgaaacgcatgctattactatagaagagaagaagatgatacacagcattgcttttgcagtgtttgctttaggacttctcgagtgggttgaatgcaataaatgcaaatgttggcagcatcaaatatgtgcactctacaacgataaaagagatttggactacagagctgagtatacatgtcctatatgccgcttaaaggaaattggaaatggaatgcatgcacccttaccgaagacagcggctatgtttagtgctaatgacttgcccagaaccatgcttagcgaccacatagagagcagactttttaagcgtctctggcaagaggatgaagattgggcaaaagcagggtataagaatcttgatgaggttttcgaagcagaaagtctttctgttagagttgtgttatccgttgacaaacaattgaaagtgaagaaacagtttctggacatatttggggaggagaattacccttctgaatttccttatacattaaaagtaagtccagaggttattcttctgtttcagaagattgaaggagtggatgtatgccttttcgcaatgtatgctcaggagtttggctcagaatgtggctatcctaatcagcgttctgtgtacatttcatatctcgattctgtcaagtattttaggcctaaaagagtgactaaaagtggagaagctcttcgtaccatcgtttaccatgagatattggccgctgaagaaaatatcgttgttggtttaactaacttacatgatcatttctttgttactactggaagttgtgactccaaggtaacagctgctcgtttgccttactttgatggggacttctggtctggtgctgctatggataaagccaggcacattgaacaagagtgtggaggagattataaaatgatcttcgataaagtagtatcgaaaagatgtttaaagtccatgggacatgtaaatcctccttctgaaggaactgccaaagacattctagtgatgcataaagtcctcatggatgacgtccttggtgatactaaggagaatgatatcatccttgataatgggttatttgattcccgacacaactttctgagcttttgccaaaggaacaggtttcagtttgactcactccgcagagccaagtattcctcaatgatgatcctctaccttgtgaagaatcctactcttctgattgttggaacaacatgccgcgtttgctctaaaaacaatgtgtcccagcgctactggaaatgtgagaattgcccggaattcactgtctgttctgcatgctacaacgagagaggtgctagttgccatgcacacacgttgagtgaagcttattcaccagcgcaatctccttcagggaatcaagaattgcagcagaactcagcaatgatactccatggccgccttagtgaagctgactctagaagatatttccaacagcttattgacggtgtagattattgccacagtaagggacctgaaaatcttttacttgattcactaggaaatataaagatttccgattatggtttgagtgcatttcctgagcagggggcgagtatccttcggacaacttgtgggacaacttgtgggagtccgaactatgtggctcctaaggtactcagtcataagggttacaacggtgctgtggcagatgtttggtcctgtggagttatcctctttgtcctactgactggatatcttccttttgatgaactgtatg

SEQ ID NO: 81832 - DNA, 630 bp, Glycine max
  Peptide Sequence Number=SeqID_173517
atggcatatagattctactcaaaaaagcaaatagggtttagttctgttactgagcggtttttcatggaactcaacacccgtcgaattgataccagcgccactagaagtgaaacactaagtatcattaatgggatgcggtacctgaagcttggggttaaaactgagggtggattaaatgcttctgcttcttttgttgcaaaagcacaccctataaaccgtcaggctcataaacggaaaagtgagcttcaccatgctctatgcaatatgctttcaaacatcctagcacctcttgcagatggtgggaaaagccagtggccaccttctggtgtagagccagcactaacattgtggtatgaagctgttggacgtataagagttcagctcatgcattggatggataaacagagcaagcacattgcggttgggtatccattggtaactcttcttttatgtcttggtgatcctcaaatatttcacaacaacttaagtcctcacatggatcaactctacaaacttcttagggaagggtgtcaggaggcatatgtaagtgtagatgatgtgagacatagtggcatagggattaggaagttagcaaatgagactcttggtgaatcaagagctggactttaa

SEQ ID NO: 81833 - DNA, 411 bp, Glycine max
  Peptide Sequence Number=SeqID_173518
atgaagtcgctgagagggaaggagatcgcgttggtgaaagtgcagtggggacccgacgagggtgattcaacctgggagttagaggatagggtgagagaattagaaacgcgagggactggaaccagagaaacgacacgcaaaccgatgcaggattttagcatttcaaaagccaaaagttcagaagcttttccctctccctcacgttgctttttctccccttcttcctctcctgaagcctccatcaaagctccaaactttactcaccatttctgctccaaatcgcaaaaggaagccattttcggagtcgtgaagcgcacctctacgttgtgggacttcgaatttcaagtttgggtagacttcttctcacataaatttttgtgggtattgggttttgggagatatgatgggtag

SEQ ID NO: 81834 - DNA, 417 bp, Glycine max
  Peptide Sequence Number=SeqID_173519
atggagaagggattaaagcctccatttggactatcttcatgcgattcatttttctccctccaagaacattatctcgcaaatcccaacggtcaaagcgtgcgcaattgcatttcgaacaacatatccaaaattcacaacaatccaacggttgacgaaaccgggatcgtagttttaccaagacagctctgggtttctgcgagaaaggaaaggctacaatgcgaggggttctgcctcttttttgtggtgactatttcatgcatatatttatgcattgggtattcccattcaaagaagtgtgcggagacagacaagcaagctcttctcaagttaagagatggtttcattcatggaaggcagattctatcttcttggaaaggtgaagattgttgcaaaaaagaatctcatgcaacaatttaa

SEQ ID NO: 81835 - DNA, 213 bp, Glycine max
  Peptide Sequence Number=SeqID_173520
atggaagattctggcgtttggggagagtatatgatgatggttatggaaatgggaaatgggaattggggagtgtttggttggttggagcggaattgcgttgcgacaaacgcaaaaggaaagaatctacgttgggctgtcacgtgctgtgccgacatgacccaagcgcggtttgaaatggcaatccaaactaaagtcattatcataaaagtctag

SEQ ID NO: 81836 - DNA, 402 bp, Glycine max
  Peptide Sequence Number=SeqID_173521
atgctccaaccatatgggatcagcataggcttaaaggagcactcaaacacggtgacccccaaggcctacacttcgaaaagtccatcagggcctcttcctcctgattcagggttcacgctcaacacaatagcatatcaatttcacaaaaattggcaaaggctacaacgccaaaggtatttctctcatctcaaagatgatatcaaaattcccaacggtgagaatgctcggaattctgctgcaaacgtatttctcaaattttacaacgatccaacggtgaacgagtccaagatcatcgtttttctaagacaggttagatggcctacgggaaaaaaagaggattttgggagaagaaagaaaaaacgaaattgtgaggcagaggaggcagaggagtctgaaaactga

SEQ ID NO: 81837 - DNA, 264 bp, Glycine max
  Peptide Sequence Number=SeqID_173522
atgacgcaggttcggggcgtgggggtgagcaaggttgttgcggttatgtacgatggagtttcggccacggtgaaggagattttgaaggaggaagggtgggtggggcttacccgtggaatggggccccaggtgctgcatagtgcttgtttttcggcattggggtatttttcttttgagacaacgaggctttcgattttgcgggagtatcttaggaggaaggagttgggtgagagggaaattgaagtccctgtttccgatggctga

SEQ ID NO: 81838 - DNA, 399 bp, Glycine max
  Peptide Sequence Number=SeqID_173523
atggctacaccaatgagtactgcttgctatttggataaagatgaaaccggtcagtcaatagatgttaagcaatatcgaggttatctaaacacaaaggaagggttgtccttgtgtggttcagacattgtaaaagggattttacaagatagtggaactctcaagcgggttgcttggggactggacataggcacaagggccacttgtccaacaacgggtggaagtggatcgatgcttcaacacaaactctcttgctggagaagtgcgcctatccagcttctggcgcttccgactattttagacacgtgcggaaggggcgggcgggaggtgggttcaatgggagaagaagtcccacatcaggttaaggaatacaaggtttataaggaaaatgttgaacattag

SEQ ID NO: 81839 - DNA, 609 bp, Glycine max
  Peptide Sequence Number=SeqID_173524
atgacttctacaagtggagatgctactccaccatctccaaaaacaacaaggatcatggcagagatgattaaacatggtaatcaaatgagaagaatgatttatgaagataaagaaatgatggagagaatgagaaagaagaatggggagagttttagaagaatacacaagagtaacgaacctttaattgtaagggttgaaaatataaagcggagagaggatagatcatctaattcttctcatgcaaaagatgagggatatgaagaggatgagggaggaaggaggaatgagaggtatagggagagaagaaatcatagaagatatggaggtagacaaagagagaaagggattgagggagtgaaggtgaagatccctacttttaaagggacttatgatccaaaagtgtatcttaagtgggagatggagtccaacattcagctcactagagaacttccttataatgaagaaggaccaccaatatgcagacataaaacactggaatatgacccgaggccattagcaaaaagcacttgcaaatcgcaagattctatacaattaaaggcattcctcgcacactcacgtaggaagcaccaataccatagctcaaaataa

SEQ ID NO: 81840 - DNA, 177 bp, Glycine max
  Peptide Sequence Number=SeqID_173525
atgggtgaggaagagaaaaaaccagaggaaaacaaagtggaggagaaaaaagcagaggaagaagaaaagaaagaagaagagaaaaaaccagaggaaacaaaagatgacaaggaatccaaggaggaatctgtgccgccagaaatcgtgcaaggcataaccttcgcccattggtgttga

SEQ ID NO: 81841 - DNA, 153 bp, Glycine max
  Peptide Sequence Number=SeqID_173526
atggataacacaaaaggcaaccagaaatctcttgctgaaattatggggtcttcacagaaatctcttgctgaaattatagggtcatcacagctatcgagattgcatcttataatgggtggagaaagttatggattgaatgcgactccaagttag

SEQ ID NO: 81842 - DNA, 249 bp, Glycine max
  Peptide Sequence Number=SeqID_173527
atgcattgtttgcttgatttgggggctgtatgggatggccataggcctgccttggattatgactatcatttgaacttgctgcatcatgatgggcaccttgcatctaggaaatggctccaaagaagttcccagctaaaagggcaaggaaaaatgcccctggagaaggttctagtgctaccccataggtggatgtggagttcaatagacataagagaggcgggtccagttgagggatggagagtacgttga

SEQ ID NO: 81843 - DNA, 159 bp, Glycine max
  Peptide Sequence Number=SeqID_173528
atggagatcgtaaacttaggtgttggcgaggaaagaaaagagctcaagataaaagaagaggtgaaaaagcaagctgtcactggctttttggctgtggctcgatactcggaatgggttgccaacattgtgtcagtccctaagaaggatgggacggtgtga

SEQ ID NO: 81844 - DNA, 162 bp, Glycine max
  Peptide Sequence Number=SeqID_173529
atggagacactggtggcggcaattgcggctgcgttgttctccattattcatttcatacttaacagggcctacatcatggagggcgaggaggccaaaatcatgggccaaagcgtttgtctccaagggagaaaaggagaggagtcgccaccaacgtttatttga

SEQ ID NO: 81845 - DNA, 192 bp, Glycine max
  Peptide Sequence Number=SeqID_173530
atgtcttcttctgatgtctttatgctcctggtattcagcaaggacagatatatgattaagtccaaaagctttaacacgtgtggtatgagggaaaggggaagggtgtatgaacagggaatgatacttgtgtctataagaaaacaatgcggtgttaatggtgtaacgagtaacctactaggcaaggctgcctaa

SEQ ID NO: 81846 - DNA, 246 bp, Glycine max
  Peptide Sequence Number=SeqID_173531
atgtacatagaactatgtcgggcatcatcagaggttggtaaagttataggtggttgtgccatactattgcaatcatgggcttggtaccgcatgccttttattgcaccaagagtctcacgacctcaaacaacttatccactggctaaaagatggaaaggtggtagattagaatataaggctgcacctcatggtgacttagtcggatatagatctcgtatagatcatatggagagccatggggtataa

SEQ ID NO: 81847 - DNA, 1455 bp, Glycine max
  Peptide Sequence Number=SeqID_173532
atgagtaactctacagagagaaagccacatgcactgttgacaccattaccacttcaaggccatatcaacccattgttgagattagcaaagctgcttcatctgagaggctttcacataacctttgtccacactgaatacaacattaaacgcttgctcaactcaaggggtcctaaagcccttgatggccttcaagactttcattttgagaccataccagatagtcttccccccacatatggtgatggtgatgtcactgaagacgcagtgtctcttgctaaatcagtgagagagaagatgctcgtaccctttcgcgatcttcttgctcgtcttcatgattcttccactgctggccttgtacctccagttacttgcttggtttctgattgttggatgttttttactatacaagctgctgaagaactttcacttcctattgctctattttcaccgatcagtgcttgttccttaatgtttgttttgcactaccgttctctttttgataagggtctcctaccactcaaagataagagttatttgacaaatgggtatttggacacaaaagtggactggataccaggaatgaaaaactttaaactgaaggacttgcctgagattatatggaccatagatccaaatgacttcatgttaaaatttctcattgaagtaggagataatatgcaaagaagctctgctattattttaaatacttttgctgaacttgagagtgatgtattgaatggtctcacctctatgttcccttctctttaccccattggccctctcccttcatttttaaaccaaagtccacagaaccacttggcttctctaggttccaatctttggaaggaagatactgagtatcttgaatggcttaaatccaaggaaccaaagtctgttgtttatgtgaactttggtagcatcacagttatgtctccagagcaacttttggagtttgcttggggtttggccaacagcaagagaccctttttgtggatcattaggcctgaccttgtcgtgggtggctcaatgattttatcatctgagtttgtcaatgaaactttagatagaggcctaatagcaagctggtgtccacaagaggaagtgctgaaccacccttcaattggtggattcttgactcattgtggatggaactcaacaattgaaggcatttgtgctggcgtgccaatgctgtgttggccattttttgctgatcagccaataaactgtagacacatttgcaaagaatggggcattgggattgaaattaacaccaatgcgaagagagaggaggtggagaaacaggtcaatgaattgatggagggagagataggaaagaagatgaggcaaaaggtcatggaattgaagaagaaggcagaggagggcaccaaactaggtggtctttcacacattaacttggagaaagtgatttgggaagtgctgcttaaaaaaaattag

SEQ ID NO: 81848 - DNA, 219 bp, Glycine max
  Peptide Sequence Number=SeqID_173533
atggtgcttacatcagcacgtcttaaaaggtcagcattcaaagatggtgcttacatcagcaccgtcttagaaggtcagcattctaagacagtgctaacatcaacacgtcttagaaggtcagcattcaaaggtggtgcttacatcagcaccatctttaaaagaaggttcaaagagttattacaatatttgcatcctggtgtgaaggtaccctctaggtga

SEQ ID NO: 81849 - DNA, 162 bp, Glycine max
  Peptide Sequence Number=SeqID_173534
atgtatttcaaagaaacaacaagtaatgttgatttaagtcaaggttcctcacaagagactatgactaccactagtactagtagtattgctcaagttgatgttatggatgaatttatacatttgaagatgaagatatgtcactgttggacagtgactcaataa

SEQ ID NO: 81850 - DNA, 273 bp, Glycine max
  Peptide Sequence Number=SeqID_173535
atgttttcggaacagcttctttcgaaagttccggaagaacccctaacgggtcttccggaagcctccgccgtgagccccctttccccatttttttcggcgtcttctcctctcgtcttctaccctaagcaatggggagttagggagactaacctcgaaggctcgttcgcggagaagaagaagaagcttggctcgcagtgtcacggaggagcaacaggaattggaagaagtaaagaagcaggaagtggtcttctgggaagaggagcgcctttttaa

SEQ ID NO: 81851 - DNA, 225 bp, Glycine max
  Peptide Sequence Number=SeqID_173536
atgtctgtaaatgagggttttcagtggggctctaatcccttcactttcaatggggtatcacagaaacgcggaatgaagaaagttgcctccgatctcttcctatatgcagatggagatatgcatgctcctgaaaacgttgatagaagacgtggtgcagttttgactttgcaagaattgctcaggctgggtattgatgttgaagcttcatgccaagtacatgactga

SEQ ID NO: 81852 - DNA, 1572 bp, Glycine max
  Peptide Sequence Number=SeqID_173537
atgagtaactctacagagagaaagccacatgcactgttgacaccatatccacttcaaggccatatcaacccattgttcagattagcaaagctgcttcatctgagaggctttcacataacctttgtccacactgaatacaacattaaacgcttgctcaactcaaggggtcctaaagcccttgatggccttcaagactttcattttgagaccataccagatagtcttccccccacatatggtgatggtgatgtcactgaagacgcagtgtctcttgctaaatcagtgagagagaagatgctcgtaccctttcgcgatcttcttgctcgtcttcaggattcttccactgctggccttgtacctccagttacttgcttggtttctgattgttccatgctttttactatacaagctgctgaagaactttcacttcctattgctctattttcaccggtcagtgcttgtgccttaatgtctattttgcactaccgttctctttttgataagggtctcataccactcaaagataagagttatttgacaaatgggtatttggacacaaaagtggactggataccaggaatgaaaaactttaaactgaaggacctgcctacctttataaggaccacagatccaaatgacttcttgttaaaatttctcattgaagaaggagataatatgcaaagaagttctgctattattttaaatacttttgctgaacttgagagtgatgtactgaatgctctcacctctatgttcccttctctttaccccattggccctctcccttcatttttaaaccaaagtccacagaatcacttggcttctctaggttccaatctttggaaggaagatactgagtatcttgaatggcttaaatccaaggaaccaaagtctgttgtttatgtgaactttggtagcatcacagttatgtctccagagcaacttttggagtttgcttggggtttggccaacagcaagagaccctttttgtggatcattaggcctgaccttgtcgtgggtggctcaatgattttatcatctgagtttgtcaatgaaactttagatagaggcctaatagcaagctggtgtccacaagaggaagtgctgaaccacccttcaattggtggattcttgactcattgtggatggaactcaacaattgaaggcatttgtgctggtgtgccaatgctgtgttggccactttttgctgatcagccaactaactgtagacacatttgcaaagaatggggcattgggattgaaattaacaccaatgcgaagagagaggaggtggagaaacaggtcaatgaattgatggagggagagaaaggaaagaagatgaggcaaaaggtcatggagttgaagaagaaggcagaggagggcaccaaactaggtggtctttcacacattaacttggacaaacttatgatatctgtatattggatatctatattgcaaaccaggttgagaccacggagaactgagtttggtgatacaaaactgagagcaccccatcctatttatagagtctgtccatcacagagctcaacttgttatcagaacgtgagatag

SEQ ID NO: 81853 - DNA, 429 bp, Glycine max
  Peptide Sequence Number=SeqID_173538
atggagacattgttcacttctcttgacgtcttggagcttgtcaaagaagggtatgaagaactagtagccacaacaaaagctacagtcacacagtgtgaagaattgaagaagaaaaaaatcacaaatgttggagttctaggcatgattcaaagaggagtctcaatagccaaatttccaagaattataagagcaaaaccagtaatcaagcatgggaaattttgcagcaagagtttaaaggagattcaaagatcctatgagcaaaggttgttacaacgtattgaaatgtcaattgaaaaggccgaggaagaggtagaaactcttgtggaaatggaagaggcacctatggagggcaaagaagcgatgaaggatcaaatagatggtgtggaatttgcgaaaggagctctcatgaagagaaagattgttggttaa

SEQ ID NO: 81854 - DNA, 606 bp, Glycine max
  Peptide Sequence Number=SeqID_173539
atgtgcctacatccacgggaaagtgcagctcctcatcatcacattgatcatgaaattacaagttcaatacaagcagtagctagctttgatctctcttgtcacacaccacaagcaccaacaaagccctctaaggaacaacataagattcaagcgcctacaaagaaggttaatgctaatggaactgtggaggaaccagaaaagtctagtaagctaagaacttccattggaaagaaatcagctaaagtttctaatagcggactccctggaaacttggtcaaagttactctaagtaatagaaaagtaaaagatggaagtgttcaatgggcttcactcccatcatctatttcgaagattggaagggaagtaatgaaacacagagatgcgacacagatagcatcaactgaggctatgcaagaggctactactgctgagagtttactgcaatgtctaagttccccaaacaagcaaacaaagaagaagaacaacaagaagaagaagaacaagaagaagacaacaaagactaaggtcgggaagaagaaaaagaagttgtacctaggtaacgtggctacgtttcacggtcgcgaaaaagctctacaaagaagctga

SEQ ID NO: 81855 - DNA, 120 bp, Glycine max
  Peptide Sequence Number=SeqID_173540
atggtgcttgagagtgtaagtggaattaaggctgtggattttaggcaacctgaggtgctattggtaaagaaggttcatcaatttgaggtgggttcagtcaaattgaagaaaaaagggtag

SEQ ID NO: 81856 - DNA, 800 bp, Glycine max
  Peptide Sequence Number=SeqID_173541
caaatctcctggctgagaagaccaagaagaagctggaggaagctgcacagtcaggaagcgttgatgacatcatcgaccctctgtccctcgtcagacgccacgtgaagtggaagatggtccgcaccaagaaaataagggagatgacgactgaggccgcaaaggaaatcgctgagaagattggatccttcgtcccccatggatgtcaggatgttttctccactgctattagatgtccagagcaccttggacgtgtccatgctgctggaggaccagctagaggagtcgacacagaaaaagtgactcagcagctcatggcattgttcagccagatgcaatcccagatgcaatctcagggacttgcactgcctctagagcctctggttggtccctcaggtcctcgagtaagcacaaaggagagttgtgttgatccctcaggaaacgatcctgagacgggtgactcaaacaggtgcggcttgtacattgaagcaaatcttgcccgcctggttgccctgggaagagtttatgagggatccactgttgttcataacactcctttgttgcctggccaagtaaaggtgggcaattcacaccttctttgcttagctgacacatctggcaaagcctttatcagaatggttgtgtctccggcaaaaccacctcaaaagtcggatccggaggtcgatgatccgctttatctgatgacattgaccatccgagagcttttcttgaggccttaccaggttacatgggatgccaccatgttcgagatctttaatccagacttcccgctctacatatag

SEQ ID NO: 81857 - DNA, 336 bp, Glycine max
  Peptide Sequence Number=SeqID_173542
atggccattctgcctaaggaacacctagttgtctggttttgttcattgcataacaagctagacaactatcttaaggggataattagcagtgctttaaaaggtcttgatgatgctccacagcctaaatcaaaggctgctgctaggtggattatcgtcaagtgtaatagacaaaaaggaagcactgagtgtggttattatgtcatgcactggatgtccaccatcatattaggaattttcaggaataactggaaagcgtattttaacaatcctagaccattggagacagagattaaaggcgcttcggatccagtgggcacagtattatctccgagttag

SEQ ID NO: 81858 - DNA, 348 bp, Glycine max
  Peptide Sequence Number=SeqID_173543
atggagcgttgcagcaaaggctgtgactttgccattaggcaacaatttggtcagccttggcctacatggggagtgattccaaaagatcatcaggaactttttttccaacgttttaagtcagaggagcttggtcgatctgtatatgtagatgagatctttcagcaaactcattttcgaaaggataatggtcaatttgtcgatgatagatctagaaagacacatgaagaatttgaggctagattatctcaagctaggtctgatgctgcatcaagtgttggtgaatcacaactcactcctttagaccctgctgaagaacaaagacttaggagtcaatcttgggttgtagct

SEQ ID NO: 81859 - DNA, 390 bp, Glycine max
  Peptide Sequence Number=SeqID_173544
gaagaatttgaggctagattatctcaagctaggtctgatgctgcatcaagtgttggtgaatcacaactcactcctttagaccctgctgaagaacaaagacttaggagtcaatcttgggttgtagctgtgggaccaaagcataagggacgcctttatggtattggagaccttgctcatacttacaaatgcggaaatgatagtttcatgcaacatacacaaggatcttctagtcgcactgaggatgctgcagagatcaatcgactgcgggaggagttgcgtcaatcaaaggagaaaatgcgtgtttttcaatcagttgtccttcagttcctatctcttgaagcgcggaacattattcatcaacaacaacaacaacaacctcaccaacaataa

SEQ ID NO: 81860 - DNA, 381 bp, Glycine max
  Peptide Sequence Number=SeqID_173545
atgatccagacacgagtaactcggacaaatacgggttgtactttgaagaaaatcctccccgcctggttgccctatgaagaatttatgagggatccacaaccattcacaacattcctttgttgcatgatcaagtcaagggaagctatgagaccggcaaaacctgcagataggccggatcatgaggtcgatgatcccctatatctgatgacattgaccatcccacaactttttctgaaaccattgcaggttatgtgggatgttaccgtgtttggggtgtttaatgaagacttccccttgtacataaagcatgaagatctatctgaaatagcgcgcagtggtcaatgtctcaacatctctgttatacagttatggattttgtaa

SEQ ID NO: 81861 - DNA, 243 bp, Glycine max
  Peptide Sequence Number=SeqID_173546
atggctgaagatcaacctaggagggttacccttgaagattactctagctcgactgtgccgcaattcttcacaacaaagagatggctacattcatttaagggaaacagactcaagacttgggatgaagtggtggagaaatttttgaagaaatatttccccgattctaagacggcagaaggaaaagcagccatctctttatttcaccagtttccggatgagtctctaagcgaagcacttgaatga

SEQ ID NO: 81862 - DNA, 501 bp, Glycine max
  Peptide Sequence Number=SeqID_173547
atgcctctacacaccccacaacgatgtcgtaaagggacccttcattctggaacctctccacctttcgagacgactcagacttggaatcgcttgagctcaactcgtgggaatgagctggtgtacgaggttgtgagatttgtgggggagaattataggagcgtgcaaggtgagattttgatgtgtcttgagcagcttgggggaagaatgatggaggatgtgggtgagttgaacacgttggtgaggtatttggagagattgggggagactcgtgaaaagttggtgcttttgtttctcaataagagaaagaacaatgagttctgggatttggttaagaagaccaaggagaatggtgtggcgaagaggaaggagattgaagggaagtggctcgtggtggtggtggcaggggacgcccctaagtttaccagtatcattaaggttcaagaaccaaatgcttacaaagagataatgaaaaaggcaaaggagtttgaggtgtgtgattga

SEQ ID NO: 81863 - DNA, 447 bp, Glycine max
  Peptide Sequence Number=SeqID_173548
atgagcaagaaggatcttttctctgttttggatgggggggaagtaaaggaaaaagaaatcttcattcttgaggaggaaaactttagtccaaatgcccttcaattgtggcttttgaaaaagaaggataaattttgtcccaacttatatccagatgaaaacatgagccccacctcaaccaaagacaatcaaactctaaaaggagtccagggtcaaaaattgaaaagaaagtcattcagcgtccatatgaaattcgcacaggagcaagattataaggacagagtggaaaggggcattctgtcaaacaccaaaccaatagcagtcaaacaactatcacctaaatcagagcaaggaacccatgagtttataaatgacataggcacgatctctgcttttcaacaccctaatcttgttaaactttatggccgttgtgttgagggaaaacaatag

SEQ ID NO: 81864 - DNA, 285 bp, Glycine max
  Peptide Sequence Number=SeqID_173549
atgaggcatattcaaggaaaacttactgctgaaaaggcaaaaactagaaaagtaaagcaagttgaagactcaagccttattcagcaggtcattcaaggtattgattcatatgatgataaagaagaccaacaaattcttattgggtaccctactgagattgctcctaagaaaccattgtacattcagcctgagaagtttaataaagttacctcagctcctcaggaagtagttgtatactcaacaagtctgagaaggcttctaaaaaccattgtccattcaacctaa

SEQ ID NO: 81865 - DNA, 129 bp, Glycine max
  Peptide Sequence Number=SeqID_173550
atggtggcggtggtggttagcttggtggtggttgatttggtggtggtgaaggtgcaaattgagcaggatcagagtggacgggtggaggtggaataccttgtgtttatggatggggttgaggtcgagtaa

SEQ ID NO: 81866 - DNA, 1425 bp, Glycine max
  Peptide Sequence Number=SeqID_173551
atgaatcatctaatgataaagggtgagacaaaacatgaaaggaatcccgcaatcacgacagatataggcttgcttgtaggccacacgcatggaaaggaatcccttgctggattatccagtcctaaggctattccattctcacacacaaaatatggagcatgcatctctgagtgtttagaaggaagcccttatataactgcttctgattccaagtatgtcgaaactcttgacaagttcagttcttgttaccctgtgtctgctgatgcagcactcaagaaaccattcagtgttgagtataaatggaaaaagaaacgttctggggacttgctcatgctggctcaccctcttcatgctaagcttctgtcatatgatcatgatgttactatgctgaatgattttaagtatagaagcattgatggtgaccttgttggtgttgttggagattcatgggtgttggaaaccaatcctattccagtgacatggaattctaacaaaggtgtggagaaagagtcttatggcgagattgtcacgacgctttttaaggatgttcaagcgctgaattcttcagcaataggaacaaattcatcttatttctatgagaagcaggttggaagggctgcgaggacaacagacataaggttccagttcagacttgatgtagtcttcatcggaaccaatgtctgggtacaaaagaagcctatcgtcttcaaaaaacctgatagcggaagaagtgttttaaaacagtggagcaaagagtatgggaatattagtgttaagaggattcagaatattcagcataagctaaatgaagtggaagatttagcctctaatagaattctgtctgaggatgagcttaaggctaagaaatccttacaaagaaattacaatgctctccaaggaattctcattgatggtgtgtgggttcagcaacctaatgtagtgaagaacgaagctgttaatttcttcctcaagagattcactgaacaccatttttccagaaccatgaatacttgcaagaagtcccctttgaagccatggaagaaagggccaacaagggggaaaggcgggccccagaacgcctcctgcgagtaccgaggcgttcggcaccgaacttggggcaaatgggttgctgagataagagagccaaagaagagaaccaggctctggcttggttcttttgccacagctaaagaagctgccatggcttatgatgaggctgcaaggagactctatggtccagatgcataccttaatctcccccacctgcaacccaggtccacttcaactatcacgttaggaaagttaaaatggttcccttccaagaacttcatttcaatgtttccttcctgtggattactcaatgtaaatgctcaacctagtgttcatttaagaggctacaagagcttaagcgaaattcagttgtga

SEQ ID NO: 81867 - DNA, 363 bp, Glycine max
  Peptide Sequence Number=SeqID_173552
atggaggctggcagggactttcaattcagctttgttgggaaaatggcgttgggatttatttcacaagcagcaggagcactgggcaaaaatactaatatcaaaatatgggggctggaaggcattggaggaaggcacgacaggaagactacaatcaacttggtggaaggatctgatatcaattcagcagcaacaacagattcaattaatcaaaagggaaacaaaatggaaggtggggagtggggagaaattcagattttgggaagacccttggacacaaaatgctactccattaagggagaaataccccaggctgtatcagaactcatgccaacaaaaggaaaccatcatgaatatggagaataa

SEQ ID NO: 81868 - DNA, 1683 bp, Glycine max
  Peptide Sequence Number=SeqID_173553
atggatgggaaggttcaatctgaaactccctgccaggaaattccttctatagcatcaagtttaaattatactcatagtaatcaatctgggagtattgatcagtgttccagaccttcagaaggagtaatagagagtggatcatctgcttctgctgtctattccaatttaaagcttgatctttcaatgtcagatggagaaatatgcttggacaagctatcaatcagagaactgcatgaactatttaaggtaacatttggtcgggaaaccactgttaaagacaaacagtggctgaaaaggaggattgccatgagtttaactaattcgtgtgatgtttcagctacaactttcattattaaaaataacaaaatagttagaaaatttgaagaagaaagttctggaaatatgaatgctggatctttaatctcttcgggaaatatgactgaagaagaagatgtcaactttaaggattcatctgctgtaaatgcttgtggaattgaagataaccaagttgtttctgaaacaagaccaaaaattggattggaagatgagaattatcaaacaggacaaagagctgcaaagacaaattgcatgaacatagtggggggcatagaagcttatttagagggaggctttttatgttcaagttacatggattttcagcctttgaagttgatgtttcaagagttcaaagacaaattgattgaattgggaaatgagcaagtgaatctccacttcaacagaaaaaggatggggaagcaaggattgggtgcaggcattgaatttgacattgacacagttaaacatggactgctagcaggtcaagcagataaagcaccaagagaacccaatgttttactattgctacctaaggtgaaggaaggacctgagctggagatgaatgtcccccaacacttccttatcttatcttctcctcctccagctttgagattctcaaagaaacttctgaagatggctggcatagcattcggaaacttcaatgattctgttagttttgcctccatcaaggcctacattgctgagttcatctcaacccttctctttgtttttgccggtgttggttcagccatagcctatgctaagttgacatcagatgcagctcttgatccaactgggttggtagcagttgctatttgccatggttttgctctcttcgttgctgtttctgttggagccaacatttctggtggccatgtgaaccctgctgtgacctttgggttggctcttgggggccacatcaccatcctcactggtctcttctactggattgcacagcttctcggctccatagtggcatccttactcctcaagtttgtcactggctatgatactcctatccacagtgttgctgcgggaattggagctggtgaaggagtagttacagagatcataatcacatttggattagtgtacacagtgtatgccacaacagcagaccctaagaagggttcgttgggcacaattgcacccattgccattggtttcattgttggcgccaacatcttagcagcagggccattctctggcgggtccatgaaccctgcacgctcctttggccctgctgttgttagtggtgactttcatgacaactggatttattgggttggcactcttattggtggtggtttggctggtcttatctatacctatgccttcataatgtga

SEQ ID NO: 81869 - DNA, 444 bp, Glycine max
  Peptide Sequence Number=SeqID_173554
atgcgagcggggaattctggtatctatggattcctcgagccacagtccattaagaggtctgggcaatcacagtttgagtctgaaagttacataaagagttggatgcagagttcaaaacgcgatgtctatcttggagcctaccaaaatgggccagacaactactttaaggggattattaatagtgctttaaaaggtcttgatgatgctccacagcctaaatcaaaggctcctgctaggtggattgtcgtcaagtgtaatagacaaaaaagaagtactgagtgcggctactatgtgatgcattggatgtccaccatcattttaggaacttttaggaataattgggaagcgtattttaacgatcctagaccatgtgggtcagagagattaaaggcattgcggatccagtgggcacagttttatctccgagttatagatcaggcctag

SEQ ID NO: 81870 - DNA, 279 bp, Glycine max
  Peptide Sequence Number=SeqID_173555
atgtcttggttccttgtaattctgtttctcagcatcacacatggtagtgcttcagagactagccatgacaagaaacttccttctgctgttgtggttggcactgttttttgtgatacatgttctcaacaggaattcaccattggaagccatttcatttcaggtgcctcagtagctgtggaatgcaaagatggaaattcaattccaagattcaagaaagaagtaaagacagatgaatatggtgaattcaaactgcagctaccattcaaagtgaggaaacat

SEQ ID NO: 81871 - DNA, 192 bp, Glycine max
  Peptide Sequence Number=SeqID_173556
atggttaaccatggtggaattacatttcttgttgaacgggtgacttgggacttagctcacaacaaagtaagtcatcatccctcaatgagtgttatgtatgctaaaaatgagcattttacatatgatgtgacttcaaagttgaaaactaagtttttgggaaactctgttgatgtttaccctgttggaaggtga

SEQ ID NO: 81872 - DNA, 1649 bp, Glycine max
  Peptide Sequence Number=SeqID_173557
gaccttgtgatgaaaggtggtcagtggttctacacgggaaaacaattggtgttaatgttgaagatgatgatttatacattgatacttatgttagtcctctttccacacaaatgtcggctaacatcgtcggagaggaagaagctgacgaccaaatggccataccacccagctctcctcctcctcctgctggtgcagcatcacagtcaccgtctaccttgaagcggacaagaaaagccacacggctaagatcattggcgactagaccaggatcgtcactcgtgataagttcaatgtcacatacgagaattggaagcaagtcctggctgcttagaaggattggatatgggaggatattcagacaattcaagtcagatttgacgttgaaatgggcagttgcagccgacaaggaaattgtcgacgaaactgtatgcgaaaagtacgacattagcaaggagaagtgggcccaattttttcagacccgcagagacccttcgtgggaggatgtgcgaaaaaaggcacaggctgtgattgatcctccatctcccatcagacgacacgtgaagtggaagatgacctgcaccaagaaaactggtcagatgacgtctgaggcagcaaaggaaattgctgagaagattgcgtcacagggttcctttgtcctccatggacgtcaggatgtcctgactgctaccattgggcgaccagaacaccctggtcatgtgcgtgctgttggaaccagtgtgacaatcaaacaatactttggaccggctccaaggacctcccacatgtcttcctccatggctcccgaagacctggagcaactgacgcaacaaattaggggccagctggaggattcgatcacagaaaaatcacggatgcaatcacaggaactagcactgcctcctgagcctgaggttggtccttcagctgctcgtgtcggtacaaataagagttgtgttgattccttagggaatgatccagacatgggtgacttagacaaatgcgggttgtacatcgaagaaaatcctccccgcctggtagccctaagaagagtttatgagggatccacaactgttcacaacattcctttgttgcatgatcaagtgaaggttggtgttgaggaggttaaagatgcagatgcttccattcctgtacccattgaagatgttaagttagtgggacagacacttaacaccttccttgcttggccgacacatctggtcaagcgtttatcagaacaaggagctgtgggaccagcaaaacctgcagataggccggatcatgaggtcgatgatcccctatatctgatgacattgaccatcccacaactttttttgaagccattgcaggttatgtgggatgctaccgtgttcggggtgtttaatgaagacttccccttgtacataaaccatgaagatctgtctggaataacacacggtggtcaatgtcttagcatctctattatacagttgtggattctgcatatgaatgagacaagtatgcgagcggagaatgtcgatatgtatggattcctcgagccacagtccatccagagatctgggcaatcgcaatttgaattagaaagttacatcaagaactggatgcaaaattcaacatggaatgtgttcctaggagcctacctgaatgggtaa

SEQ ID NO: 81873 - DNA, 120 bp, Glycine max
  Peptide Sequence Number=SeqID_173558
atggctaaaactcaagctacaaggctccaaatgaggaacaaggttgaagatgaaatggtggaaggaaagaatcactctttccagcaagggcaacacacaaaggatgtgaaagacctttga

SEQ ID NO: 81874 - DNA, 165 bp, Glycine max
  Peptide Sequence Number=SeqID_173559
atgcaaagccttaaactaaataacaaaacaacagtagcatgttacgaggaaattatcatgaatccaattatttctgcggcttctgttgttgttgttgggttggtcgtagggcttgcttctattggacctgggttggtcaaggcactactgcagggcaagctgtag

SEQ ID NO: 81875 - DNA, 342 bp, Glycine max
  Peptide Sequence Number=SeqID_173560
atgactgcagcgtacgacgagccagtggtccttgcgccagatgttcaggatgaccctatggaggcaccagctgctgtagaggacattgtggcagacattcctgcggacacaggcacagaggctgctgaggatgagcatgagggattttcgggtggtccgagcgacccatccgtgttgacccagtatgcggatcacgttgcttgcagcgtatggacgggagaggagtgtcctgaactgaagatatcctttcatgggaggaaggtccatagtttaagcaggcatgtccctgccattgaaaaacttgttgctggtacaggactaagtcctctaatcgcgtgttcg

SEQ ID NO: 81876 - DNA, 378 bp, Glycine max
  Peptide Sequence Number=SeqID_173561
atgggtacgtggaatccaaaacaggaatttggtcatctaaggctggactggacttctcccaaatggttggactctacattagacttgttgcatttgttatctaagtatcctaacacctccatcaaactaatcacagtcctaacacctgcgatgacaccttcctcacaagcatactcttgcgaagacacctccttcaaacgctacggcagtgaccttatccttcacatagtgccacccccttcaccctcccatgttggcaacaaccttgtcattcattgcattaatccctacaccctcctcacgacgccgcaccaccaccttccccctctttcctttgttccatctatggatttggacgagtttcaagtttttggtgtg

SEQ ID NO: 81877 - DNA, 297 bp, Glycine max
  Peptide Sequence Number=SeqID_173562
atggtacaaggagtgttaatgattcagctccaccaattagcattccctctccatgtcatactcaaagtccatcacaataagggacaaaagctccttcacaaccacaaggacatgaaactccagcacaacaagggcaaggacaacaacctaaatcttaaatctgcacaagcagaggagaagttgaagcatgtgttgtctgcaaataaacaaatggtttcacttactacggatacttggatgtcaattcaaaatatgaattacatgtgcgtgatagctcattacattgatgaaaggtag

SEQ ID NO: 81878 - DNA, 708 bp, Glycine max
  Peptide Sequence Number=SeqID_173563
atgcatttcattctttctctctcatccaataactccctcaccaaacacaccttgcagctcaacaatggccaaacatggctcattcatacttcctcccctattagtttaaaccatagcctttttgagattgcttctactgaattttctggaataattaggataacggtgttgcctgattctgaccccaagtatgaggtaattctcaataggttctgctcttgttatcttgtgtctagagatgcagcattcacaaagccattatgtgtggagtataaatgggaaaagaaagggtggggggagttgctaatgctagcccaccttcttcaccttcagcttttgaatgatagtgattgtggtgtgactgtgttgcatgatttaaaatatagaagcattgatggtcttgttggagactcgtggctgttgaaaaccaatccggtttcggttacttggcattccacaggaggtatcagagaggaattccaagaggatattttttcaacgctttctgaagatgtggatggtttgaatcctttgggaataacaacaacatcctttgggtttggtgtttataataatcattacaatttggggtacttcctttatggaattgccatgcttgcaaagattggggaaggaagtacaagcctcaagcctattttattcacttgtagcagatctcatgaacttcaaaagaagatcgaactctaa

SEQ ID NO: 81879 - DNA, 273 bp, Glycine max
  Peptide Sequence Number=SeqID_173564
atgggtcttttttggaagtatttcttgcatgatgttgtttttgacgtaaaaagcatgcaaatcgcagaagccattggcgacttcgggctggctgtgacacatggcactggtcttgccagtgccactagcgatttcaggatgcatgggactcaccagtttgactggcgagttgccctaggggagttggagttgccagcagcactggcgagttgtccttggagtagccattaccaatggcgagttcatctgctttatatagggatgctcctttga

SEQ ID NO: 81880 - DNA, 183 bp, Glycine max
  Peptide Sequence Number=SeqID_173565
atggtgagtttggatttagatttggatgtggatataccaagtttcttaaacatgaaacagaaaaatgtcaaaaagaagaaacgatgccattccttggcttgggtggggaaaaagggaaagctgtcagacgaggcagttaaaaggcacatgttgcatcacatggagctgtgtatctatgaataa

SEQ ID NO: 81881 - DNA, 570 bp, Glycine max
  Peptide Sequence Number=SeqID_173566
atggattgtggtgatggaaagaggggttggttgagtcacagagagggtcaaaaaggggcttccccgaacaaggaaaaacctcaaattggaagaagggatatccaatgtaacactgagatcattgtgggaagagatggtgtggttcaaatgggaagggtgggatttttgagaggaagagatggttggtcaccgtttttgaggacaaagttttggaagaaggagtttgtggggagtggatttgagacaaggtttgaggagaagaaattggagggttcagggacaacagtggaatcaacatgggggaacagaaaaggagtgtgctttctgggtttggagccttttctcgagccacctgcgagagctgtgctaaccttgcgtctaattgttgaagggcttgacaaagacaacaatggttttattggattggggttttgcataggatgtggagaggcgaaggaagaaggaatagggtatgatggggcagcaaggtatgtgaatttgactatgtcaagaaagaaaacacaaaaaggaggtttttcaataggaaagtgcaaggaagggatggcgtaa

SEQ ID NO: 81882 - DNA, 915 bp, Glycine max
  Peptide Sequence Number=SeqID_173567
atgtggtggcatttgcttcatcctaagattgtcattgagttcagactaactaaattttactttagttctacaattttgcattcccaacatcctaatgagcaaggacagacctctgttttggcaaactgtctggaaaaccgactatttgttgaggctgcttcaaaggaggactatgtcaatcgacgagcaattatgcggcaaatggatacacaactcaagaagttgcatgccccaaaattcagccaagtaaatagctttattgcttgcacatcccaaatggtgccatcttcttggttattgcaagctaggtctaatggaagtgtatcgaaacctgcttttcaaaatatggtcagttctatcaccaatgcaactgattattgtgcagcgactatagataataaaaatggctttctaaatggagggttgtcttattcttctgttgttcccaaccagttttttcaccttataaccatccatcaatcgctacatgcactgatttggacatgcttcttaactcttttgtttttggtgggagaagcaatccaaaagctagttgcaaggatgacacttttggtgaagtatgaagattgttctaggactacaatgggaaaatccgtccaatttgaatcttcaaattcgatgactcctcaagataccttgaaggaattttcaaaattttccgatcttcctcctgtcccgagaagccttggagatattaggcaacatcaacaccaaaagcgagattttcagcagaattttaaaccttttgtgcagccatatgggcttcctggtaaaacttatatggcgcgacctaatgcattctccaatcaaggtgaacgttgcggtcaaatgttggggtcgaaaaaattgaaacaaccacaacttttcagaagaagtctcagtggggatcaatag

SEQ ID NO: 81883 - DNA, 444 bp, Glycine max
  Peptide Sequence Number=SeqID_173568
atggtgctcgatctttttggaaatactcaagttgtgctaccacctgcaaaaagaacaaaaatggatcctgcttttggtgtccctttaattaataatgcaaatttggattggctgactcagaaaatggttcaccctcgttcttctgaagccttttcagaattgttgcaacaagcacaatcttttcttttttatgaaagtatggagtgcaaagctgatcatatatctcctctttctttacattccaatatgcatcctatctgcaaagaatcaatgcctgcagatgtagaaggcatacatggaaaaaccgagtttaaccaagatgggataaatgttgccgttgagccaaaagctgatcaagagatggaaaggatgtcattaaatccaacagctaatactgcaaacatggaagacatgcaaggtagaaccaggttcaaccaagattag

SEQ ID NO: 81884 - DNA, 453 bp, Glycine max
  Peptide Sequence Number=SeqID_173569
atggaaattggaaatattaccaggaatatatggatgggagatctaaatgctacagtaccattttgcaaaggacattaccaatgcacacagagatacttcactgaagaaaaacacatgactgttgaagctagaagcctagtgcaatttaggcacccaagagtgtatagttgccacaagatgaaggaaataactactaaggaaggaacattcaatattgatctcccatcttgtgaagaaatgatagttgaaaaatgtctcaacatgacaaccttttgctatggatctgtaacaacagcaaggcttatacatatatataaaggttcatatgagtatgttgacataatgggagaccttaatatgaccatctatcatgctaatgagggtttgaaggttgcactacaaacatctgagacaatgacaagcattgagcatgatcaacacctgcttccttaa

SEQ ID NO: 81885 - DNA, 255 bp, Glycine max
  Peptide Sequence Number=SeqID_173570
atgaaggctatcactttgatggtggacgactatgaggtggatcctaattgttatcatatttttcaagctgtgaaggaacatagtggtcacccagtgaaagtggaatttaggcacgtgcttagagaatgcaatggtgttgcaaacgcaattgctaagttgggtttttccatgcaacaagaaatagttttttatattaagccttctgtggctattttgccttgtctggaagctgatgtttcaactcttggcatttaa

SEQ ID NO: 81886 - DNA, 531 bp, Glycine max
  Peptide Sequence Number=SeqID_173571
atgagtaaaatagaagctcagcctgtgccagccatggttgtggttgaggcggtggcttcggtggtggtggtggtggatgtggtggcggacggagcaaggccaagtcttgacagcgaaaagaatccaaaccaagcgtggaggaatctgatgcttgacggcatcgttgcggagcaagacggtgtcattgccgtaagggattttgcagcaatggtcgtggcggtaacgattgagcgggaagtggcggttggtcgtatgaaagcggggaagtggcagcggagccatgggaagaagggtagaggtgactgggtcgccacggcagtcttaggagaagggcatccattgaggattcgaggcggtgttgagcgacagcaaggttggccaaggcggcctcaaggcggtcgtcgacagccatggaagcttcgtttggcgagtggcagccatgggcggcaagtggaggtgatcgagaatcgagtccaccttgccggaaagttctgcatatttatcattgagggaagcttgactattggatag

SEQ ID NO: 81887 - DNA, 318 bp, Glycine max
  Peptide Sequence Number=SeqID_173572
atgtttgcacatcttcccggtgctgggtactttgaggcaaaggagatttacaatcttatcgatccactagcctccatatggaagccattgagagattttggactttcccttctagtcagggagaaactggatgacctgcagatgcatgttgtcatcatcaactcatacaacaaatttgcaatagttgcaggatggcttagtagtcagagcaatgtctcatcaacaaattttggtttccttgatttgtgcagcagggcaaggatttctctagagatcggcaaaaagttgcattcaactcaattggacaattgctactaa

SEQ ID NO: 81888 - DNA, 375 bp, Glycine max
  Peptide Sequence Number=SeqID_173573
atgtgggactttcaacacacccatctaccgacttgtaagacgaggattgctcctcacttatatggcttatctcgacactattttcattcgatgtgggacttcaacatgtcccattttttctcatggctacccgccatgtgggactttcaacacacccctctatctaggtgtgactacacctcccttcacgctcaaggctacctgcctagaggaaagtgggtttttcatgagcttaactcaaccctacaaaaccggcttgtaagcatgccctatttttcctcatggctacccaccatgtgggactttcaacacacccctctatctaagtgcgaccacatctctcctcacgctcaaggctacctacctagagtgtga

SEQ ID NO: 81889 - DNA, 120 bp, Glycine max
  Peptide Sequence Number=SeqID_173574
atgggaaattacacaacgacatattttaggaactttgcaaagggagaaaaaacctctattggtcttgaaatgtgtgacagagacacatccatagcaatggaccctaccatcatagactga

SEQ ID NO: 81890 - DNA, 273 bp, Glycine max
  Peptide Sequence Number=SeqID_173575
atgcagtgggttattcctccttgtccgtacccaactgctccatgggccaggcccaattatcaacaacctccgcaccaacagcccagtattcttgggtccagacctcagcaggcatacataaccacagctcctactctaacagacatcgaggctgcaatgcacaccctcggtattacttctccgtatccaaattggtatatggacaccggtgccacctctcatatgacgtccacctcaggattttcagacagggatgcctctaatgaggtgtga

SEQ ID NO: 81891 - DNA, 330 bp, Glycine max
  Peptide Sequence Number=SeqID_173576
atgctcctgcatatgagcatgggcatgggattgtcagggatggataatgaggaggggatgattaataaaattgcaaatttgaagaacaaagataaggagaatgcgcaacaagggaggggaaaaggaggctacaaatatggctggcgggttgttatgtgcatgaaagtcagaggagtttgcgatggaggatgtgttccatgggtgtgggttcttatgtgtgaaaggtccctgtatttgggcagctttgggattctcatcaagcgtggtgcacgtgtcatgggaaacttcaatgcgatgagacacatggaggaaaatagggatgattggtag

SEQ ID NO: 81892 - DNA, 984 bp, Glycine max
  Peptide Sequence Number=SeqID_173577
atggcaataactgtcttgcaatattacacttatagtttttgttttggtagtttggagtatgctattatccgttatgaaaggttgggcacaaagggttcattttcgattttggaagttcttggtgggtcaaaggtttctaaaggcttttgtggggaaatagtatctcgacttcgtgctagtgctatgcatgcagtggtggagtggcccatagatgtatcatacacagatgacttttccttcaagcgatggaagtactcaagctacaacttcacaatgactactttttggtcaccctatctagttagagctaaacaagtggattcaaatggtggtctctacaatgtttatcttgatgagtttgatgaaaaatggactactcaaattaaagagtttgactatgtcatcatcaatgtagggcaatggttcttaaggccaatggtgttctatgagaaacaaaaaattgttggatgtcaatactgttctttagaaaatgtcactcacttatcttggcactatggctataaaaaggcttttgggactacatttaaagccatcattaatttagaaaactttaagggagtaacatttcttagaacatttgcaccatctcattttgagaatggggtgtgggataaaggtgggaattgcgtcagaactaagccatttaagagtaatgaaacaaggttagagggcaacaatttggagttacataccatacaattggaacagttcaaaattgctgagaaagaagccagaaagaaaggtttgaaattcatgttacttgacaccacacaagcaatgttactaaggccagatggccaccctaataaatatgggcactggccacatgagaatgtgacattgtttaatgattgtgtgcattggtgcttgccaggacccattgacacatggagtgatttcctactagaaatgttgaaaatggaagatgtgagatctactagtaaagagaggtttcatttgtag

SEQ ID NO: 81893 - DNA, 1278 bp, Glycine max
  Peptide Sequence Number=SeqID_173578
atgaagttccaagatattgagcttctatttgggaagataaccccaaaacaaatgctcccaaaagtgactttacttgtactcttatccatacttatatttgttgtcaccccaatgtgttatcctttgtttagttactcttcactcttgaagatcaataaatataacaagcacccagaaagcttgccttcaacatctgtgaagaagtgtaacattttcagtggtgaatgggtgtcaaatccagaggcaccatattacacaaacaacacatgttgggcaattcatgagcaccaaaattgcatgaagtatgggagacctgacactgatttcatgaagtggagatggaagccaaatgagtgtgaactccccatattcaacccctttcagttcctagaaattatgaagggaaaatctatggcttttgttggagactcagtgggaagaaatcatatgcagtctttgatttgtcttctttcaagggtggaatggcctatagatgtttcacccacaacaaatgactatttcagacaatggaagtacccaagttataacttcaccgtagcagctttttggacaccctatttggtgaaatctaaaatggtagattcaattggaccaagtcacaatggcctgtttaacctttaccttgatcaagttgatgagacatgggcaacccaaattgaggagtttgactatatcatcatcaatgctggacattggttctttcgttcaatgatattttatgagaaacaaaatattgttggatgttgtgactgtctcttaaaaaatgtcactgacttaactacgtactatggctacagacaagtttttaggactgcatttaaagccatcaatagtttacaaaacttcaagggagtaacatttcttagaacatttgcaccatctcattttgagaatgggacatggaataaaggtggacattgtgtgagatctaagccatttaagaacaatgacatacgtttagaaagtactaatttggagttatatatgatccagttggaagagttagaaattgcaaagaaggaaggtagaaagaagggtttggaatttaggttgtttgacactacacaagcaatgttattaagaccagatggtcacccaagtagatatgggcattggccacatgaaaaagtcacactttataatgattgtgtgcactggtgcttgcctggacccatagacacgtggaatgattttctactagaaatgttaaagatggaggacatgaaattttctagtggtgaaagacttcatgtgtaa

SEQ ID NO: 81894 - DNA, 1065 bp, Glycine max
  Peptide Sequence Number=SeqID_173579
atggctgggttactggcatgggcggtaggaggtggcggaggaaaagaagcggaggacgacggcatcatcccaatcctgttttctgcagatcagcaaaagtacgtcaacgaactcgatcagaaggcgagctctctccggcgttggatccatgatctacggcaaagattgcctccccaggacatctcccagagcctcccacacctccacgcccactccctggcctccaacgccgccctcgccctccaattaaactcccactccaccacgcgccaacaggcccaacttagagaggtgacgttgaaggaagagaatgctgcgttcgaaaatgcaatatcagattgtgagaataaaataaaggagaaattgcaggaggctgatttactgagggaaaagttgaaggagatggatgaaactgagaagaaactgaaagctgaggtggagaatatgaagcagccaagttgggtatctgatggttgggaggaagagaagaaggcaaattctaaagctggattggaggcagaatcagctttactagatgaattggaaaagaagaagaaagatatgagttcaatggagaatgctgtacatgagttggagaagaaatgggcacaagttcaggaaaatgcacttaaacagccttcccctgggcaaagggagaagacattggataaacacctgcatggtctaattgagcaactagcagttaaacaggcacaagctgagggcttacttggtgaaattcatctgaaagaaatggagctcgaaagattgaatgggctatggcgacgaacggagagtagcaattcagaggcgaacactgctgctaggaatcgtttcagtaaaggctcctctgataagttacatagtttgtcagattacgaaggtcatcagaggcttccttatcattctgctggccgaactgaaagccagcagaggcttatgctactcaggtcggcgttcgtgctctatattttagctttacatatactgataagatcaatagactcaaggaaccctgtcggtgcccccattgcctcacctcccctatgtgccagtacaggttaa

SEQ ID NO: 81895 - DNA, 246 bp, Glycine max
  Peptide Sequence Number=SeqID_173580
atgactagaccaatttattttgactggaaagacatgtgtcatacttatttaggtgttgttccaccaaaagatgatgcaatagtaggctcgacaatcaaactaaaatggttgtgtgacaacaagccacctttaccacaacaattagaaactcattgcaaagcatacattcttggattgatttggggggtattgatgcctgataaaataggcatgcaggtagatatagttagggctccacttgtttag

SEQ ID NO: 81896 - DNA, 480 bp, Glycine max
  Peptide Sequence Number=SeqID_173581
atgaaggatttgaaatggctgagtactgagtatgacattaatagaagtttaaaaatgttggtaaattacgaaggtttacaaatcgcagatggtttgagaccacagtccaagcagttattggatgcttctgttggagagaaaatcaaattgaagacccctgaagaagctatggagcttatagaaaatatggctgctagtgatcatgctattttgcgtagtcggactcatattcctacaaagagaagcatgttagagctttcctcacaagatgcattattggcacagaacaagttgctagctaagcagcttgagacattgattgagacacttactacacaagaagtgaattatatggggaatcagcatagaccaggatttaatgcaggtggatttgcaaattttcagcaaggttccaattttaatcagaatcaagggaagtggaggtctcatcctggaaaccagttcaataaagaccaatga

SEQ ID NO: 81897 - DNA, 174 bp, Glycine max
  Peptide Sequence Number=SeqID_173582
atgatagatggagaggatgaatatgcacaaaacaacaaggggggacccctaagggcaaaaggtcactttggggcagttgcagctcgcccaggcgagctgaaagttaaccctgcagcagtgagctcgcctaggaaagctagagctcacccaggcgagctggtttcttcaccatga

SEQ ID NO: 81898 - DNA, 279 bp, Glycine max
  Peptide Sequence Number=SeqID_173583
atggtacttgttgttaatggaaaggtgaggagcaggcatgggtgcttggctttattgcatcggcgcggggcatggaagtggaatcagcatgggcgacagggtcagcttggatgtgtgtgcgggaggagaatgacatctagtttggcagccatggaggcttgggtggcgacaaagtgggaaatggcagcctcgagtcgatcaaggacagggttccaacggtcagattctgccattggaactctcaatgaaagcaccgaattgttatgtgctcataattga

SEQ ID NO: 81899 - DNA, 1251 bp, Glycine max
  Peptide Sequence Number=SeqID_173584
atgttcccttacagttccaacccctacccttccttcccttcatcatcttcttcttcataccctccttttccttttctcaaccttgagaatgcttctgcaagcaacacccttcttcatgatccactttctgtgccttacataccaactcatcatcataacccttcaagcatccaagaagcactgaacaatttgccagtcacagatcataactgtggcggtggtggtggttctgcaatgaccaaacctgactctaatggtggtggtgctcctcactatggcatttcttgtttcctcacaaagaagccacctaagaaagacaggcacagcaagatttacacctctcagggcttgagggaccgaagggtgaggttgtccattgcgattgctcgcaagttctttgatcttcaagacatgctagggtttgacaaagccagtaacacccttgagtggctcttcaacaagtccaagagagcaattaaggagcttgcaaggagcaagcacagcaacaacaacagtgatgaaggagccaagagcttctcttcttcatctgattgtgacgatgactgtgaagtggtttctgagatcaagcagaaacaacaacaactcatcacttgtgatgctgctactactcaacacaacctgcaacaagggttggattcaggtgataacaagtcaccaacaacattggtggctgcaagggagaggatgaagttgaagaggacacagaaggaacctgcaaagataaaggagtcaagggagaaagcaagagcaagagcaagggaaaggactagtaacaagattattatgtgcaatgttaacaccaacaacaacaacacaggaaggagggtgcaacaacaagacttgaagaaaaagtgccctgcaattgaaaacaaccattctcaaatcatgcatcaatcaagttcatcacctactcacaaccttgtgggaaatgaaacacctagagatgacttcaacgttatcgaggaatccattgtgatcaagagaaagttgaagccatctttgatgtcctcttctcatcatcatcatcatcatcaccaaagccttatgatccctaaggaaccaccaagcttcaacaactgtgagtaccaccccttctccaatttgtctccaaattgggatgctaatggatccactggccgctccaacttctgtgccgtagctagcatgaatctatccacagggcttcaaatctttggaaagtcttgggaggagtgcatcaatccacgttaa

SEQ ID NO: 81900 - DNA, 951 bp, Glycine max
  Peptide Sequence Number=SeqID_173585
atgaataccattgagcgcttgaaagatgatcacgagaatttttttgatgatgaaaaggatatagataatgtcatcacagaacgagatgttggggttgttctcaatgaagcttttatggaagatgaagtggtgatagccttaagccaaatgcatgtaatgaaaaccttagggcctgatgggaatccaacattgatttacaaacatttatgggatattgtgggtcgagccaggatgtggtggacaagagggtggaagaaactgaaagactggaaagaggaggcactatcaaagaggggaagggaagagattgaatcaatgacaatacgtttcttctggggtggtgatatagatgagcgtaaggtgcattggatgagttggaagaaacttagtaggcacaaaaaggagggaggagtgcgtttggaggattgggaatggatgaaagtcaacgttttgaaggatagatgggttccctctctcctgagatctcgtataacccagtatgaggacaaagccattaaagcaatccctctaaagctgtgttctagtgaagattggttgttttggaaattctccaacaatggaatatattcggtgaaatctgggtgtcaattagcaacaagaagattcaacctagtgagaggaaatttgatcacaaaacgcatgaatctggacccgacttgtcctcggtttggtgtggagattgaattgaaactactctccatgctcttgttacttgtcctcaagaaggaagcttcgtggatttccaagattcggctcttgaagtgtttgaaagatgtggaagaagaagtgaaggtgatgttttcgaaggaggctatgcccattgcatggaagcccccagtggagggagtttacaaagtcaactttgatgcatcaatcaagaagaatgtggtgactggaatggggttgattgtgagagattgggagggttag

SEQ ID NO: 81901 - DNA, 1260 bp, Glycine max
  Peptide Sequence Number=SeqID_173586
atggccaccctctccgatcatcgccgccgcatgctcccgccggagaacgttgacgcgcagccaataacttcggactccgtctctaacaaccaccgcaccactcatcggcgcgatgccggaaataacggcctccggcatcgcctcgttcggcaagaatctttgcgcagaaatatcgaacacgtcgccgcggaaacctacttggtttctcgtctcgccttcacgcttcttcgctatctcggggaggaaggaggagaaagaggtgttgcatattactatttcttcacaagcaaagtaaagcgaagcattgtttatggagatcagcctagaaacaggttggatctgtatctacctgccaatattggtgaacctaagccagttttgatatttgtaactgggggagcatggattattgggtataaagcatggggctcccttttaggactacagttggcagaaagaggcattatggtggcatgcattgattacagaaattttcctcaagggaccatcagcgacatggtaaatgatacttcgcggggaatttccttcatcatcaacaacatagctaattatggaggtgaccctaataggatttatctaatggggcaatctgctggtgctcatatttcttcttgtgctttactggagcaagcagccagagaatcggaaaaagaagatagtgtttcttggagcatttcccagttaaaagcttatcttggtttatctggaggatacaacttactggatttagtggatcacttccacaatcgtggcttggatcgttcgattttcttaagcataatggaaggtgaaaattctttgaaggaattttctcctgaaatcaaaattcaagatccatgcctcaaatcttccattcctcactttccccctgtatatctggtccatggaactgcagattattccataccatcagttgccagtgagcggtttgcggaagctcttaagaaggcaggggtaagagctgagttgattttatacgaggggaagactcatacagatttgtttctccaaagttcaactatgtgctatccttttgttttgcctattgaagttctaattctcaaccatgctgcacaggatccgctccgaggtggtaaagatgacctatttgatcttgcagttgccattatgcattccaatgatagtgatgctcttgcaaacgatgccattgcacccccaagaagacggtttgttcctgagattttattaaagttggctagaaagatcagtcctttctaa

SEQ ID NO: 81902 - DNA, 1809 bp, Glycine max
  Peptide Sequence Number=SeqID_173587
atggaaggtgacgagcacatgaacgaggttccatcagagaacagcaacttgggaagtgattctttggaaaaggagaacattttggaagatgaaaaggaggatttgcaagatgggttgaagttgaaggtggtcactgaggaagtgagtggaggattgctcgctgagaatggttgcatttctcttgaggatgggagtctcaaaagaagccttgagactccactggctgctactgggatggctgtgacggagtgtttcagttttgtggctgatttcatggccagaaaggatgctagcgaagtgttggaatccggtgaggagacattttttcctgctttgcatgttggacttgaaaagacttctgccgtgtcattctggatggagaaccaaacaagaaatgataagaacaaagatttcattcctttagctgataatactgtgcctctatatgatcgtggatatgctttgggattgacttcagctgatggctcaagtaatgtggatgggaagtttagttcagatgacattttgatatgtaagaaatccttacttggccaattgatgttgccatctgcagcagattgtgtagtggtgggaatgttgtgtatgtatggtttagggattattgatgctgctgctaggtgtttcaattgtggttcttacaaccactctttgagagagtgtccaaggccccgtgacaacattgctgtcaataatgctcgcgataaactcaagtcccgacggaatcagaattcttcttcccggcatccaactcgttattatcagaattctccagctggaaagtatgatggtttgaggccaggatctctggatgatgcaacacgtaaacttttgggcttgagggagcttgatccacctccgtggcttaacagaatgcgagaactaggatacccacctggatatcttgatgtggacaatgaggatcagccttctggcattacaatattcactgatagtgagattgctgaccaagaggatggggaaattatggaagctaatgcttccaaaccaaagcgtaaaaagactgtcaaatttcctggaataaatgctcctattccagaaaaagcggatgaaagattgtggggcactagggctggaccctcgagttcagatatatcaagaaacttgtcattgccacagcacaggtcgaattatagtactgattatggcagtcgaggatatcatcgcgaacatagattaggggatcttagggatgaaggtccaccaggggacccaggacatagttcatttatgttcagttttcatcctaggtttggtggccatgattctgcactaagaagtccttcaatggcaaggtctcaatctgacaggagtagaagtcctatgcatgatgaagaatcctcaatgcctttttctttccattctcttcattattcatcttcagagaggcatttttcgcccttggaccgagattctggttcgacgatcgtcactaccgcagttggaggtgaggatggcacaaacaggatcaatcatattggtagagttctagcgaagttagcagctttaaccatttttctggagagcacatcggtggatgtgcgtgacaacacaatgatggtgatgagaagttgtgtgtgtggagcctcgaaggttgagaggatgtttcgcacatgggctctgtgcgacagtgatgatgggggttgtggcagtgcggggcatggaggagatgggataaggttgtggtgtattgcggaggtggttgatggtgatgatggttgcatgattgtggtgaagggagggaggagttgtagttctagattttgctag

SEQ ID NO: 81903 - DNA, 1179 bp, Glycine max
  Peptide Sequence Number=SeqID_173588
atgcaagctgatgcttcttttaacagagtacaatggttgaagaatcaggaagtgatgtttacacatgccaattatgtgaaatgggaacactttcttttgcccccgtgccaatctattgcttttgttgtggcatccgcatcaagcgaaacacatgctattactatagaagagaagaagatgatacacaacattgcttttgcagtgtttgctttaggacttctcgagcatcaaatatgtgcactctacaacgataaaagagatttggactacagagctgagtatacatgtcctatatgccgcttaaaggaaattggaaatggaatgcatgtacccttaccgaagacagcggctatgtttagtgctaatgacttgccgagaaccatgcttagcgaccacatagagagcagactttttaagcgtctctggcaagagaatgaagattgggcaaaagcagggtataagaatcttgatgaggttattcttctgtttcagaagattgaaggagtggatgtatgccttttcgcaatgtatgttcaggagtttggctcagaatgtggctatcctaatcagcgttctgtgtacatttcatatctcgattctgtcaagtattttaggcctaaaagagtgactaaaagtggagaagctcttcgtaccatcgtttaccatgagatattgattggatatcttgatttttgcaagaaacgaggtttcgcaacttgctatatatgggcctgtccacctatgaagggagaagattatttactatattgtcatcctgacacccaaaaaactcccaagaaagataaactacggcactggtatcattcgatgctaagaaaggctgccgaagaaaatatcgttgttggttcaactaacttacatgatcatttctttgttactactggaagttgtgactccaaggtaacaactgctcgtttgccttactttgatgggggcttctggtctggtgctgctatggataaagccagggacattgaacaagagtgtggaggagattataaaatgatcttcgataaagtagtatccaaaagatgtttaaagtccatgggacatgtaaatcctccttctgaaggaactgccaaagacattctagtgatgcataaagtatgtctaccttgtctctcaccttcatctattttttatattggctcttcatag

SEQ ID NO: 81904 - DNA, 570 bp, Glycine max
  Peptide Sequence Number=SeqID_173589
atgcatgctttaaggatgcacagccccactgagaggcatatgatgatgcatggaggcaatggatcaggtgattcaggacttgttctatcaactgatgctaagcctagactaaaatggacaccagatcttcatgaaaggttcatagaagcagtcaatgaacttggcggagtagacaaagctacaccaaaaatagtattgaaactaatggggattcctagacttactctttaccacttaaagagtcatctacagactgtagtgctgttgctgccgccgccgtccatgctcgcgtccgtcgccgtccgtgctcgcgtgcgtggtgcgctggtgccacgtcgcgtgcggggtgccgagtttgccgtcgtcgccgtcgtggtgcaggtgctgatgcggggtgttgcgtctcgtttgcgtggtgccgttcctgctcgtgctgctcaccccttttgcatgcgaaaatcggctatggcggccgccatggcgccgccatccgcaacccgaaacgccaccgctatttggtggcggtttttcaaattcccgcaacgctattccgccatagccgctatttga

SEQ ID NO: 81905 - DNA, 1101 bp, Glycine max
  Peptide Sequence Number=SeqID_173590
atggaaaagaaaagattggatgactatgaacctggtcctgttccttcaccaagagcattagatagatttgggtttgtaaaacaggatgttaatacttctgaaggcttagtcaagaatagatcagcctacgagtatgagagcatgagtgagtataaaaaatgtggccattggttttacctgtatttccatttacctctcattagatatagggaggagagaagggttagaaaatggaggaagatgattggggttggtggcagtgactggaagcattatctaaggagaaaacctcatgttgtgaaaaggcgtataaggaaaggaattcccgattgtttaaggggccttgtttggcaattgatatctggaagtcgagacctattgctgatgaaccctggagtttatgagagacatggacctgggcagcggtccctctacaatgttctaaaagcttactctgtctttgacagagatgtaggctatgttcaggttttactcaggaccccatcaccttgctgtgcttgttacaaaggcatgggatttttagcggggcttttgcttctttatatgagtgaggaggatgcattttggttgttggtggcattgctaaaaggagccgttcatgctccaatggagggcttgtatctggcaggattgcctctggtacagcaatacctctttcaatttgaatgctcggtgagggagcatctaccaaagttgggagaacatttttcctatgaaatgataaatcctagcatgtatgctagccagtggttcataactgtattttcatattcctttccatttcatttggctcttcgaatttgggatgtcttcctctacgagggtgttaaaattgtctttaaagttggcttggccctattaaagtactgccatgatgacttgattaaactacctttcgaaaaactcatacatgccttgaaaaactttcccgagggtgcaatgaatccggatacattgttaccactggcttattctatcaagagtctgagcaaaaaaggtattactgagccaaactttgtttttatcttgaccagtgtccctgctcttttacctttgtcaaatagttggacttgggattaa

SEQ ID NO: 81906 - DNA, 147 bp, Glycine max
  Peptide Sequence Number=SeqID_173591
atgccaccatggaagatgtgcagctattcaaactgcaagaataaggaggaacccaggaagaacaatagaatgatgctcaacttgatcaaatatcatataattggttatacttctctggtgttgattgcgttgatgtttgctaattaa

SEQ ID NO: 81907 - DNA, 957 bp, Glycine max
  Peptide Sequence Number=SeqID_173592
atgatgggactgtatgtgcagcgtgaggatggtacactagggttggtctccatggggaaaataatggatggggattcaatcatacacaccgtggcttatgcagatgatgttgtaagggtaagtgtggaaacaattattgatcctgatgttgagatcccctatggcacctcagaaattcagtatgtcaagcaggccctcgatacatttgtagcttggcccacacaccttgttaaagttgtattagatgaggatgcagaaattattccgcacaaagtggatgcacatgtggcaaagccggctaatgtggacgcagatgatctgatgcgtggcctgataaagtacagttttgatatttacgacaagccagttgaattcgaatttgatgggagtaactttggaattgtagatgcacctacatcgatattcctaacatattatgatgttagtgaaataatagcaggagacaaaagtttgaacatatctgtacaacaattatggttgattcaaatcttgggtcaaggttccatgtatgcattccttgagccacagtccttggtggtttcaaaggatacacgtggcgaatgccaacaatatcttgaaagatggcttaaggaatctaaccgagaggtgtacgttggaccttacttccatcagaaacctgatatgcatatcaaagccgcaattaatagtgtaatgacaaaattaaagacgagttcgtctcctgaaagtaaggcagctgcacctaagtggattgaagttaagagtcaagttcaaaccggatgttatgaatgtggatattacatgatgcattggatgtggaacatcataaccagcgagatcaagagtgattggtccatgtggtttggtgatgagacaccgttggacaaggacaacatcacaacaattcgaaagaaatgggcaagatattttttaaagactgcgtgtaaaaatggctaa

SEQ ID NO: 81908 - DNA, 258 bp, Glycine max
  Peptide Sequence Number=SeqID_173593
atggagagtcgtagggaaaccgggacacgcggcatacaccaccacacccgaccacaatattcaatcaatagcgcaagacatgacccagttctacgtaccccctatgcccacactagatcgatgctctgtgagttcaaacggtgtttcttgaagaagaggatcatcggcgtgagggaagagtcgcgagttcgagaacgggatttcgaaaacttactttcaagtagaagagaagatgaaggttataaaggaaatacgtga

SEQ ID NO: 81909 - DNA, 135 bp, Glycine max
  Peptide Sequence Number=SeqID_173594
atgggtttgtcaggcttaaaggagcactcaaacccggtgacccccaaggcctacactccgaagagtccgtcagggcctctccctcctgattcaggtccaatccctaaaataattttagcacacagacactgctag

SEQ ID NO: 81910 - DNA, 1434 bp, Glycine max
  Peptide Sequence Number=SeqID_173595
atggctcaccctgctgatctttgtcaaaagctgaaagtcatagagcaatgtcaagtttctcctccaccaggttcggttcctccaacctctcttccactagccttccttgaccttccttgggtttactgtgacacagtgcaaagcattttcttctttgagtttcctcactcttgtaaccacttcttgcaaacagtgcttccaaatctcaaacactctctttccctcactctccaacaattcttccccttcgttggaaaccttgtgatccctcctaaacctaacttccctcacattctctacacctctgaaaactccatctccttcacgattgcagaatccactgccgactttccacatctcatagctgacaccgctagagatgttaaagactcgcacccttttgttcctatcttacctaccccaactaccaaagaagatggcacatggttgcttcctcttatggccattcaactcaccattttccccgagtatggcttcagcatttgcatcagttttagacacgttgttgctgacgcaagagcattcttacatttcatgaagttctggtcctatgtttgtaggacaaaacatgacgtggcagctactcaagatttgttaccactgctcaacagggacatcatcaaagaccccaaagggcttaaattcgttttctcggaggaactatggaattctcctatagaaagcataataaaaacacctccaaaagttgtcgacaaaaacgatgacaaagtccgtcacgcgtttgtgttgaggcgtgaccatgttgcgaagctaaagaaatgggtgtcgattgaatgtaaaagtacttatgggttagaattagagtcattgcacatatcaacctttgttgtgacaagtgctttgatgtgggtttgcaaggttcaatcagaagaagaggtcaatgctatcactattgcaaataataataataatgatgaaatctacagcttgaagtttctgggagattgccgtaaccgtcccgaattttcgattccttcaacgtactttggaaactgcattgtcattcgcattgtgtcactaaacaggagcaagctaatgggagaaaaaggaattgttgaggcagcgattagtattggaagggcagttagagattttcagtttgatgctatgaaagacgttgaaaattttatgtctctcggtagaagtggaagaaaagtgaaacattcgtctacaattgcagggtcgccaaagcttggaacatatgagactgattttgggtggggaaagcccaagaagtgtgaaatacttcacatagaatattcaagaactatctccctttcggattctagggatgaagaaggtggagtggaagttgggctagcacttggaagggctcaaatgagcaaattttctgctatattggaagaatatctcagaaatattgctatatag

SEQ ID NO: 81911 - DNA, 1095 bp, Glycine max
  Peptide Sequence Number=SeqID_173596
atggctccgaagaaactctccacgaagagtgccgcctcagagttcgatagtcatcgtttccggagtgtcgagcaccagcatcgcttcgaggccatcaggggatggtcgttccacaaggagaggcgtgtccagctcagggaggatgagtatacagactttcaggaggagatagctcgtagacgttggacaccgctggtgactcccatggccaagtttgatcctgagatagtcctggagttctatgctaatgcttggaccacggaggagggagttcgggacatgcgctcgtgggtgaggggtcagtggattccctttgatgaagatgccctcagccagttcctgggcgacccgctagttttggaggaacgccaacagtgtgagttcagccagaggaggaacagggccgacggtttcaatgaggaagcaatcgcccagctgttgtgcacaccggggcaggatttcgcccgaaccgctgcagggaggcgggtgcggatcatgcgcactagcatgaccaccttgacccagacatggatgacactgctgctcaacaatgtcttgcctagcgatcacaactccgatctccctctgcctaagtgccagttggtgtatgccatcctgacacgaatgagcgtccacgtggcccaggtgattgctgacgccatttatttgtttgcaggtatggtgcctactagacaccctctggaccaagataaatccaacagggccctggggtttccggcgctgatcaggggcctctgccagtcatacggagttcccgtcaccgccagtaaagccgcagacgcaccgccaccacctcgacaggccgatccagctgggtcactgggcgtggagcgttatctacaacatttggttcgccagcaggcaaccaaccactgtgggcaggggcagggttccaccccttttgtatgccctaccccggagcagtttggggctgagatcgcatggcctagagactggcccaatgcccagccaggggaggagcctgcaggatcccccggtgaggcagatgagtcccatatggatgaggatatgactgacctgctcgatttcttgggagggagcggagccacgtga

SEQ ID NO: 81912 - DNA, 87 bp, Glycine max
  Peptide Sequence Number=SeqID_173597
atggggaaagggaggttacggtggcgccttccggaagatccttttagggttcttccggaagaagagttggttattggtataaattaa

SEQ ID NO: 81913 - DNA, 600 bp, Glycine max
  Peptide Sequence Number=SeqID_173598
atggtgaaacatctgtgtccatcgcaaaaccctagagcaaagaatctgggcgaggtggatcatcgactgaaggcgtttctctccttctcagaagtgggttctctatcccttgatctctccatcacgaggctcctccaatcggtcccctcaaacggtgattccgatctcatcaattgtgccctaaaaatggcctctctcttcttcgacattgccagacactcctcccgcaaacgcgcttccaaccacaattccctctcctggcccctccctcccgacctcaccatcaagactaatgatgagcatatattaggatttggagatcttggttgccaatgcttgccaataaccattgatgttggcacaaacaatgagaatttgttgaatgatgagttttacattggacttaaacaaaaacggacaactgggcagcttctaaaagagttcatgcgcgcagttaagcagaactatggggagaaagttctcatacagggtacacaatctgtggtattagcaggattgcttgcatccctaaaattagttggggggaccttagctgaccatacgtttttattcctgggtgctaaagagatacgagtctga

SEQ ID NO: 81914 - DNA, 2037 bp, Glycine max
  Peptide Sequence Number=SeqID_173599
atggatccctcacgccgtgccccacgcgccgtgatcgaccctataccgaagatccgccaagtggggttctttgccccgcccgagcgctctcagtcgggtcctcccgacccgacccactcctctcccccgatctccagctccctctccccggtcatgatcccgcccccgcgccacctctccgacaacctccttctccacgccccccgccccgcctcctcccccctctccgccgccgctgccgccggaggaagcggaaactcctttgactacggcgcggtcttcttccccgccccgctctctcccgcgataccgtcgtcttcgtactccagcagaatcatcgccaccaccggcgagggagggttcttcaaggggaacggcgccggcggcggaaaggtggcggcgtcatcgttccctcgcggaggattcgacttgacggcgatgaagaaggcggcggcggcgagtgttgtggtgccggcgagcgagttgactacggtttccgtggtaaatgattcgctcgggattcctggtgaggtgaggttcgtatttgtggctaggtttgtgaatttgaagtgggtttggatgagaaatggtggaggatgtgatatagggtgtacttggcaagttaataggggagcacatacctatgaagcatggacactccagccccttggcgtgtccggtgtccgacaagcgtctgtgtcagtgtccgataccgatatgacacccgtattacaaaaagaaaaaggaaataaagcaggagggtcagcagtggaagtgaaagaccaacctaatagttcaaagcagcagaaacccaaactctcaaaagctgaaagacgtgcactccaagaatctcaacgggctgcaaaggctgctgcaaaaggaagtaaggcatctggaactgtggctacaatgaatgcaaaaccagctaaagctgtaaagcctgcacagaaagttgataatgcagcagttgcagcgtctgaaaagaagggaggtgagattccaccagaaaaggatagaaagaaagatgctcctcaaccacgcatgcagtatgacgacaagagtcgagtggagaaagctaaacgtcgtgcagtggtgaaacaaactgaagctaggaatagagttgagttgttcaggcatttgccacaatatgagcatgggagtcagcttccagatctcgaggcaaagtttttccatctttctccagtgcacccttctgtttataaggtgggtttgcaatatctaactggagatatagctggtggcaatgctcgttgtattgcaatgcttcaagcattccaagaggccatcaaagactacaaggttccacatgagaagactcttgtgagagacttgacagcaaaaattagtagttatgtatcatttcttattgaatgtcggcctctgtcaatcagcatgggaaatgcaattcggtttcttaaaagtcatatagccaagctacctttgaccttgtctgaatcagaagcaaaagcttctctccagtcagatattgagcgttttataagtgaaaagattatacttgccaacaaggtgatagtgaagcatgctgtcaccaaaataagagatggtgatgttcttctaacatatgggtcctcatcagctgttgaaatgatactattacatgcacatgagttggggaagcagtttcgtgttgtcgtagttgactctcgtccaaagcttagagggcaactcttacttcgcaggcttgtggagaaaggtcttagctgtacatatactcatataaatgctgtttcctacataatgcatgaagttactcgggtttttctgggtgcttcagcagttttgtctaatggaacagtatattcaagagtagggactgcatgtgttgcaatggttgctcatgcattccgtgtacctgtcatattgtataagatgaggattctatttacactccccggtagattcttgcattgtgtttctaagaaggttgatgtttctatgatgttcttacaggcaatccagatgtcatttcaaatgtactgggtagagaggatgtaa

SEQ ID NO: 81915 - DNA, 378 bp, Glycine max
  Peptide Sequence Number=SeqID_173600
atgggtgcactagattacctctccaacttttgcactgtaaccagcactaggaccaagcagaaagcaatgcagacaacagagataaaagtgagaatggactgcgatggttgcgaaagaagagtgagaaatgcagtgagttcaataaaaggagtgaaatctgtggaggttaacagaaaggagagcagggtggtagtgagaggatatgtggatccaaagaaggtgctgaagaggagtaacaagttcacagaactgaattacgcctttgactgcagagtaacaaggctggttaaattaattgggaatgaaatggactttgatgttcagcctaaggacatcgctaattcccaatcattggcatgtgtggcaaatgaactttga

SEQ ID NO: 81916 - DNA, 294 bp, Glycine max
  Peptide Sequence Number=SeqID_173601
atgactatgaaaatatcacctagggtgatgagaatcatgaaactggccaaatacaggctaaaggttcaagtggagaaggacgaagaaaacttttggcatttgataaaatttggtgagagtttctctccgggttccttgttgaaccaatatcagacttatcaaggtaatccttgtggcgtctaccttgacttatcttccttcaccggaagtggcgtctaccctgacttatcttccttcactggaagtggcgtcatccaaatattcgtagcctgtatcaagcgatccgccccgtaa

SEQ ID NO: 81917 - DNA, 150 bp, Glycine max
  Peptide Sequence Number=SeqID_173602
atgagacaaatacatagaataaagcgtggaaaagaggttgaaggtctggagattctcgctcaacaagccatgttcgcccaacgcgatacacttgctcagtgggcaacctcatattacaaaaagtcacatgaaaaacctgatattacgtga

SEQ ID NO: 81918 - DNA, 414 bp, Glycine max
  Peptide Sequence Number=SeqID_173603
atggtgactaatctcgaaggatgtgcgctgtgcaaagccaacttttatgctttcctatggattagccgggcaatctctacgtttggtctcctagtggaagctgaagcagtagctttccatgttgcaattgaattgggtgatcagtcttcaaatatgcatccagaaaaaagtgccctctccctcagaccctctacttcttcatctgaaacagaaacgagttcgcactgttgcgggggtgcatggacacgtacgatgcggcgtggtggaccttcgacaggctcatggcggtggatgcaccgtcgaataaaatcagcatcgttgtcttcatcgccgacgtgggtacgtcgttgtattcgccttccccaacacccacaaccatggcacccttgtcacaacttgaaatttgctcaataa

SEQ ID NO: 81919 - DNA, 452 bp, Glycine max
  Peptide Sequence Number=SeqID_173604
ctcgaagaaaagtaggaaaggaaagagtcccggaaagggtgggaatcgattttggaagtccattgtggttggccttaagactcctagggcgttcttcttctttctccttctgcatgagttcgtctttgtcgcaaactggcctgcgcttccgtgactgcaaccacattgtggagttcgtctctgccacttgtcgattgagctcgaagaaaagtaggaaaggaaagagtcccggaaagggtgggaatcgattttggaagtccattgtggttggctttaagactcccagggaagccatcgaagtggatgaccctgacttccttcacccaagaaaagaattcccaccacaaaggcaggactttaacacaagtgaagaacaaatgagaggcagactcaggttggctgtggcagaatgggcaaaggtcactgtcaatttggatttgtctcttagctag

SEQ ID NO: 81920 - DNA, 306 bp, Glycine max
  Peptide Sequence Number=SeqID_173605
atggtgatattggcatgcatagggaaccgccggtcaaattggcgagtttcactaggtaggggtttcagctttgtagggaatagtggtttcagctttgcagggatgttttcagcttttgcaggtatggcaggcgtgggacagggaaatcaccactcctatgggcgagttagcctaaactggagttgccaatggtattggcgagttaggcgtgggagtttttcaaaaactctcaactcaaaatttcctccttctcacgtttacatttattctgccataagctttccaaatttggtggttcgggtttaa

SEQ ID NO: 81921 - DNA, 162 bp, Glycine max
  Peptide Sequence Number=SeqID_173606
atggcgatactgccatgcatagggaaccgccagtttgactggcgagttccactaggtaggctcaggaggtttagctttgcaggagtcaggccatgcagaagaagctccatgacggactccacagttgcgttccttgcattgctttcttcttcttcttcataa

SEQ ID NO: 81922 - DNA, 192 bp, Glycine max
  Peptide Sequence Number=SeqID_173607
atgggttgctatagatgcagtggcgcaaccacttttggacaggctatgtcagcgtcgtgtgaccagctgaaaaagtattgtgccatgtcagttggagcaaccctttgctcaaattacctaagtacaacgtattgcatcattactaccggcgcaatacatgcctatataaaccctcgtttccctcccatctag

SEQ ID NO: 81923 - DNA, 135 bp, Glycine max
  Peptide Sequence Number=SeqID_173608
atgcctaacgccccaatgggccctccatggagtgtgtcgggaaacattcctaacattactgatttattaggggctgatgaaaggaggggcgataggagaaggaatccagatcgccaagctcggagatgggagtga

SEQ ID NO: 81924 - DNA, 357 bp, Glycine max
  Peptide Sequence Number=SeqID_173609
atgtacttgcccaagtcacaagcagataaaaagaaaagtctgttgggaagttcaccagattttagtgaggctcaagtgacatccaaggtggttgatgaatctgaagatgataatgattctaatgatgatggttctgtggagtgggcttcatattggaaaccaaatataacaataaacttggttgctgacttcactcacatactagcttttggcatgcttctatttttcttgttcaccatgttcaagtttttaaccatgtccttatttaatagggttgtatatgaggaattggggaaatatggagatgtggataaccaacttttgtgccgtgagcgagttgaggaactaggaaattaa

SEQ ID NO: 81925 - DNA, 165 bp, Glycine max
  Peptide Sequence Number=SeqID_173610
atgtatggactgaggcttaaagaatccatacagttgaccataacccaacctggtgaaaagatgaagaataagaaggttgcagcagctggtatctcgctaagcgaggcatatgcgcttagcgagcaacatccgctaagcgagacatcagctcacttagcgagttag

SEQ ID NO: 81926 - DNA, 159 bp, Glycine max
  Peptide Sequence Number=SeqID_173611
atggacgaagatcaatgggcgtataacaatacgatgtttgaagaagttgatatggattttgaagatgaacaacattgtggtgtgaatgaaggatatgttgattgtttagacgcttttaatacttctcaggtctttgcaacccgagacgacattttgtag

SEQ ID NO: 81927 - DNA, 1935 bp, Glycine max
  Peptide Sequence Number=SeqID_173612
atgcctgttcctaatggagaagagcagattctgttacctgaaactgaaaatgcaagtgaggtttcgaagtcaccctcattggatttgaacccagattcagttgatgggtccccacctgtttccaccgtttacactgatgtgggtgtcgtcccagaacaccaaaagaacgagcttgagcacttgatatccaatttagaaggtgaaattgaggagctgaggctcaagcagaagaaattggataaaaagcggagagaagaattaagcaagatattggacatcaaagggagcattcgagtattttgtagaattcgaccgaatctggttacagagaagagaaaattttctgaaccggtatcggctggaccagagaaaattcgggttaagttcggggggacgaggaaagattttgagtttgataagggtgcatgtgcccttgttggaacctctgcagagagtgtttttgtggaggttgagccaattctaagatctgcaatggacgggcacaatgtgtgtgtttttgcctatggtcaaacaggcacaggcaagacattcaccatggatggtacaaacgaggagccaggaattattccgcgtgcacttgaagagctctttcgtcaagcctctttggataattcatcttcttttacttttacaatgagcatgttggaagtttatatgggcaatctcagggatttgttatctccaagacagtctggcagaccacatgaacaatatatgacaaagtgcaatctcaatattcaaacagatccaaagggattgattgaaattgagggtctctcagaagtgcaaattagtgattatgctaaagccaaatggtggtacaacaagggcaaacggttcagatccacctcttggactaatgtgaatgaggcatcaagcaggtcacactgcttgacgaggataagcatatttcggcgtggggatgcattggaagccaaaagtgaagtaagtaaattgtggatgattgatcttggaggcagcgaaaggttgcttaaaactggagccaaaggactaacacttgatgagggcagagccattaatctttccctttcagctttagctgatgttgttgctgctttgaagagaaagaggtgtcatgtgccttacaggaatagcaagctgactcaaatactgaaagattctcttgggtatggctcaaaggtgttgatgttggtgcatataagcccttctgaagaggatgtttgcgaaacagtttgttccttaaattttgcaaagagagcgagagcaatagagtccaacaaagaagtgccagtggaagtgaagaagcaaaaagagaagaagattatggagctagaggaagacatcaaggaagccgaaaaacagagccagaatttaagggaacaaatacagcagattgagttgaagttaaatgagagtaaaaagctcttatttaccacatatagtcttgtggaaagtgatcacattgcaacctcaattagccccaaagatgatgtcaaagaggtcattgaaacccctaaagcatccaagaagtccattaaaagaaatttcaccaattcaatgcctcgattcatgacttcaactgttgcaagtcgccaaaggcaaagtgctgcagaacgagacattggtactgtgagattgaaaagttttagatcaattgcctctaaaagttccatcaatttttcatattcccaatcattgagttattcagatatccgcatcaaagcaatactgcgaagttcaaatggaaaatctcggtacgctgaagcagatagtgttccaattccaaagactgttctcacagaaaagcctaaatgcaacaatgatttggaaccaaaagtcacaactcctcgaagcaagatggttacatcatcagaccaaaactttagagtttcattgggtcgtcacagaagaaggatgtctgatttgatctaa

SEQ ID NO: 81928 - DNA, 1119 bp, Glycine max
  Peptide Sequence Number=SeqID_173613
atggaatccgatctaaacgacgccgttttccccgaagaagatctcgacgacgacgacgacgatgaaactccagaggacgaagaggactacgacgacgaaaccgaaccccctcccttcgtcctcgccgtcgtagcagtcgcgccgcccgcttccaccgcctccgaaacactcgacaccacgttgatcccgatctccgccgtcgccgattcctcactgaaaccactgcacccggagctaatcgaggagaaaaaagcgctggacgattcgcggcgactgttccagcgtctgtggacggacgaggacgagatcgggctcttgcaggggtttctggactacacggcgcagcgaggatcctctcaccacagcgataccgccttgttctacgaccaaatcaagtcgaagctccaactcggcttcaacaagaaccagctcgtcgagaagctccgaaggctgaagaagaagtaccgcaacgtcgtcaccaaaatcagctccggcaaggatgtctccttcaagagccctcacgacaaagccaccttcgaaatctcacgcaggatatggagcaacaccgctccaataagcggtcccgtcgaagacgacgacgaaatcaaccctaaccctaatttcggcaattccgcgaagacacctatctcgcggaagcggtcgcggcctcagaagcgcgagttgaacgacggttcaacattgaatagagataataattgtattggcaataataataataatagcaatagtaataataataataatgagaattgtaatggtaggcataacttacagggtttgattgaagagacggttaagagttgcgtgtcgccggtgttgaaggagttggtgtgtggtaccggtggcatggaattgggaagagggtttggagttggaggagggcttggagttggaggagggcttgcattgaattccttgcaaactcaaatgacaatgccaatgactttattgaatttgaggattggggaaacaacgatggatgagaagtggaggaagcaacagattttggagctggaagtgtattccaagcgtttggaattggtgcaggatgagatcaaggttgctctcgaggagttgcgatcagctggaggagtataa

SEQ ID NO: 81929 - DNA, 1158 bp, Glycine max
  Peptide Sequence Number=SeqID_173614
atgttgtcttcaggtcctcccaagcttcctaagtggattcctcaagagataatcccaaccattggaccagtaccaacttggaaggctcatcctgagtttgatgccactcaggcgaaacagctcctaccaaaaagagctaatgaaaacaaggtcattgataaaatcgagcgaaaggtcctcccatggcatatttgggatggcaagcgagttatgaatggattgtctgatggtagccatatcttcctatggaagaagatgagattgcggtccaccgtgaaaccttcatgtctggctgggagaaacaatgcgagacagggtgtctgccacaacgttactggcatcggatttgtattcgatcgtgtagttgtagccaagatgataaaggaatttccaagcaggccagtatgggagcctgggtcattatctcctttagacggtcaaaagcactttaagcctctaggttccactgaaagtgctctttgcggagcaatgttgcaaccatggcttgaatcttctctggattcgatgccacttccttttcaaaaacgatgtggccaaggttttgaagatgaatgtcttcatcagaaacccggatttggtggaacccctatcggagatcaagcttcagaaaccaacatgcccatcctagcggataagatcggtagtgagcatagaggccacctatttttccagttcagctttctgggaatagggataacgataagggcatacattgacgaggacaaaattggcaattgggttagcttcggtgatggtgagggattgtcggaagtaggggacatatttgggttgtattggaacacttgcgtgaatggtagtgggctaacccaagtggtgcatagaggtcgaccacgaaacgatggtcatgtatctccaccgagacctgtggacaagaggagtggtcgggaggccgaggaatttcgcaacgtgggaccgtataaaattgtgggtactcccaccatcgacgaggataagaacacagtggtggttgatggggaactcaaagaggtgtggttcagaactagggttgggtttttgtcaagaacatcattgtcttcatcagcgatgaacaattggagtggtagtagaggccatgatcgcggtgcaacaccagttccttcgaggatagttgcttaa

SEQ ID NO: 81930 - DNA, 1050 bp, Glycine max
  Peptide Sequence Number=SeqID_173615
atggccatcgaaatagggaacttccaatttaaagggtggacgaggggtgaaaggagtgccacgctatggggtgggggaggtgacactgatggtagaaaggcgatccaagatggattcaactttctgggaaaattcggagaggtggttggtgagggtgttgaggctatgggcgaggcagaggatggcgtccttaaggtggtcggtggtggtttttttggtattgtgttcagtcatggtgggcaggataccatgtctcaagctcttggcatctgtctcaggcttcttgaaaacactcgatcttctgatagtgtgcggaatactgcagcagctaccttcaggcaagcagtggccttgatttttgatcatgtagttttggctgagtctcttccaactggcaaatttggttttggaggtcagctctctcggacaaattcagttactggtgatgttaaccgtagcatcaatttgtctgaatcattagatcatgagtccgtttctggaagaccccctgtgatgagggagactttaactgaaactggaaaacttggactgcgcttgcttgaagacctgacatctcttgccgcaggtggatctgcaatttggttacgtgtcaatattcttcagaggacatttgcacttgatattcttgagttcattttgtccaattatgtggctgtcttcagaacattgttaccctatgaacaggctttacgacggcaaatttgttcacttcttatgacttcacttcgtaccaatgctgagcttgaaggagaaactggtgaacctagctttcgtcgtttggtcttgcgttcagttgctcatattataagactttacagttcttcccttataactgaatgtgaggtttttcttagtatgttactgaaggttacttttcttgatttgccattatggcatcgcattcttgttcttgagattttgagggggttttgtgttgaggcacggacattgcggattcttttccaaaattttgatatgaaccattggtatattggcatgccttataactattgtgctcttaccaactag

SEQ ID NO: 81931 - DNA, 1197 bp, Glycine max
  Peptide Sequence Number=SeqID_173616
atggggctcccttgctggtcaacacctccattctttttcccatggcaaggctcctccatgacggaggtggctcccaagaaggaaaacaagagagaaatgtctattgatgttaatcaggctatttttttactaaccctcaaattttccttgatgttaattagaattgatcttcaaagtattgaatggagtctagataatgatgcatctaatgctgcagttttggttgccagtgaagcacatgccataactttggcagttgaaggcctattaggggttgtcttcactgttgcaactttaacagatgcagccatagatgttggagagcttgagtcccctagatgtgataatgacccacctgtgaaatggactggtaaaactgcagttctctgcatctcaatggttgactcactgtggttgacgatacttgatgcattatcccttattctatcaaggtcacaaggagaggccattgtgttggaaatattaaagggataccaggcatttactcaggcgtgtgggattctccgagccgtagaacctttaaactccttccttgcatccctttgtaaatttaccatcaattttcctgttgaaacagaaaaaaggagtgctttgccgtctcctgtatcgaaacggtcagaactatcagttgaccagagggatagcattgtgctcactcccaagaatgtgcaggcattgagaacccttttcaacatcgctcatcgattgcataatgttctgggcccatcctgggttctggtgttggaaactctggcagctttagatcgagcaattcattctccacatgccactactcagagcagccattgttgcgcactcttcttctcgcttttctctcttcggtgtcgtattatcttcggttccttggcaacggttaggttcggtgaaggtagcggtgttcagtgttgcggtggttggcggcggcatacgaggaatgccaccaccacgccgccaaacgccagtcgaggagaatgcacgaggaagaagcaaaatgagttgaccaaatcgccttcaggaatttgtcaggggattcccccttcaatttcgagcgttttgacatattatgggcctcaaacagacatttctatcaaaagttacaaccgtttgagcttattgatcaacttgatccgtgaaacacttcttaaaaatcaactcgcggatcaacttgatccgtaa

SEQ ID NO: 81932 - DNA, 675 bp, Glycine max
  Peptide Sequence Number=SeqID_173617
atggctatactcgtggatgataaagacttccgctcgagggggaaactatcatgtggaagagactcacacttgagggggagatgtgttgggttacaatgtggtgtcaggtctccttatgtggtgactcgtggttcacaggatggtttgatagaggctaatccagatggtccgaatgaggtaacacctgccggatgctcaaacagtgcctttctagcttgctctaacacaaaaacttctgatgatacaccattaactaatcaggcgatggacattgtatcgtcacccagtggaactgctattcaacttcccatcaatggtgtggatactgtatctgcaaaaactgctagtgaacttcccattgaacctgccaatcaacttttaatcaaggctgccagtgaaactcccatcagggcagaaaaagaatcaggttatcaaggcagaaaaagaatcgaggctgccagtgaaactcccattgaggcagaaaaagaatcaggttactgtcttgcagagtttcagccagattgggctttggccgaaaatcatgtatcgaattccccacaacttgggacgggacttagtgacaaaaggtataaacctagctatggctggatatctaatgatgacgaggaggaagaagagctaatagagctacctctagctccgtggttaagtgag

SEQ ID NO: 81933 - DNA, 567 bp, Glycine max
  Peptide Sequence Number=SeqID_173618
atgacggggatcaagggaatcccataccgggcacgtatagaagccctgactgtcacggacgtgtgttggatgccctatgcagagcaccgagtagttaggggcttcgacctgatctcaacctacacgggccagctcagatggggtcagatagtcgtctacgttcgaccagagcgggtgcttcgacagttcgggtacattcagaccgtccctccgttgcctgtttgtgattcgtttacgggtcctgatatagacgaccgatggctgcacttttcagaccatctagtgcccgcgggggagatctgtgtagttcctggccaggtagcgccagactatatggattggtttttccggatttcgcacccgttcgtcacgccgaccgaggacggtgtcgtggttgactgccaaggatgtcaagtgattgctgaggatttagagcggatcttcaaccttaggatggtcactgaaggcactgagttatatgacatcatgactcgttgcctcaggatcgctagaggtgacaccacagatggaagccttaggccgcgacaaagacgacgcatagaatag

SEQ ID NO: 81934 - DNA, 507 bp, Glycine max
  Peptide Sequence Number=SeqID_173619
atggtcattgaccaatccctattctatgacttgacccaattatctagtgaaggtgtaccatttgaaggttcactgaatgatgattggaagtttgatttctctgtgcatgatgcccaccggtttgtttgcaccaaccaagcagatatgaccagaaggcttcttgccggttcattggcttttgaaagccgcatccttcattatctcattgtgcgtattttgcttccaagatcttcaaaccttgcacaggtttctgaggaagatcttattgtcatgtgggcttttcataaaggccgacaaattgattgggcatacttagttcgatatcgcatgcataatgtattgcgattaaatgctccattgccatatccacacctagtcactctcttccttcaacacttgagcatccctcttgattctgaaccttatgttccaatcaagagatccttcttaatcggtgccgctgtgattgcatcctttggttaccgtaaagagcatgatggctcttgg

SEQ ID NO: 81935 - DNA, 228 bp, Glycine max
  Peptide Sequence Number=SeqID_173620
atggcctctgacaggaagttaagatggtctcgggtaatcgattaccaagggtgtgtgtcgcaacgtgcccttcgcgggcgagcgagggcgaggctcacgggtgcgcttcccaaaggaggaaagatgcgcggagtcgccaccaacgtttatttgtggaaaacgtcgggaaaaccgaaggaaactggtcaaaatgaaaattccaagtccgggagttgtatttacgcttga

SEQ ID NO: 81936 - DNA, 53 bp, Glycine max
  Peptide Sequence Number=SeqID_173621
gggagtatgctgatgaaattctgataaccacaaatgagattttggatgtttag

SEQ ID NO: 81937 - DNA, 234 bp, Glycine max
  Peptide Sequence Number=SeqID_173622
atgttcctttcagtgttgtggttcagtggaaagcaacggcagctcgtggtggccatcagtggaggaggaggaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 81938 - DNA, 384 bp, Glycine max
  Peptide Sequence Number=SeqID_173623
atgtttaacacccatcgttgtgtaacccgtaaagtctcacaacattctggaagtcaaaaagagtattgttgcgtaatccgtaaagttccgcaacattccagaagtcaagaagagcattgttgcgtaatccttaaagtcccgcaatattccgaagggcaaaaagagtatcattgcataattcgtaaagtttcaggatgtttcggagagaaaccagccaagaacatgaaattgggagtactattacaccataatttcatccggggaccgttgttgatcgcttcagaaggcttaacacccatcgccatggaatccgtaaagttccgtgaggttttcgaaggaaaacagccaaaacacaaaaaccggggggtgaacttatcaagatag

SEQ ID NO: 81939 - DNA, 501 bp, Glycine max
  Peptide Sequence Number=SeqID_173624
atggaggaaccatcaaagaagcgaaagggttcttcgagtcgaagccaacgacattccgagactcaggaaacacagattccttcctcaatttcctcttcctcattgttctcatccgaagaacaacgtatacgatacacaaatattttctcttctcgttccattattgatccaaaattcattgacatggatttcttttccaatgagagttttgaatgcattcaggcatttgaaaattccaatctcattcctttcatgtctttaaaattgcatgtttacactgaattggttaaggccttctattctaacctagaaattcaagaaggcactttgatttctaaagtttatgggattgaaatggtcattgaccaatccctattctatgacttgacccaattatccagtaaaggtgtaccatttgaaggtacactaaatgatgattggaaatttgatttctctgtgcatgatgcccgtcgattggttgcaccaaccaagcggatatga

SEQ ID NO: 81940 - DNA, 231 bp, Glycine max
  Peptide Sequence Number=SeqID_173625
atgtccaaaaggtcatcttcggatgtattgccaaaggatgggggcatattctacggaccaaaagttgttaatgcacttctttcaagacagcttagccggagcagcagtggcgtggtacaccaatctggaagcttctcagatccggtcatggaaagactgggcaattacttcattaggcagtaccagtacaacacggacatggctcctgatcggaacaacttcagggcatga

SEQ ID NO: 81941 - DNA, 188 bp, Glycine max
  Peptide Sequence Number=SeqID_173626
ggctccatagagtagggagggtaccctttatggaagcttgcttgtggagcttcaatggaggttggatctttgagcttcaatgggtcccttcaatggtgattttccaccatggagatgcaatgaaaggcaaaggagaaaaggagaggggaggcaccatctgttggatcaagtggcctcgaaataattaa

SEQ ID NO: 81942 - DNA, 207 bp, Glycine max
  Peptide Sequence Number=SeqID_173627
atgtttgttgactatgtcaatcaaacatggataatcccccacaaagaaaaatttgttaaagccgggatgaatgagattatgcacttagggaacacaacaacaaacagggttgaatctactcattgggctttaaaaagactactacaaaatagtcatagaaacctatgtagtgtttgggaagccatgaacaacatgatcacggtgtaa

SEQ ID NO: 81943 - DNA, 534 bp, Glycine max
  Peptide Sequence Number=SeqID_173628
atggccccgaggaagctttcctcaaagagatctaggaaagacgctgcggcatcagggactagtgccgctcccgagttcgatagccatcgtttcaggagcgctgagcaccagcagcgtttcgaagccatcaagggatggtccttccaccgagagagacgcgtccagctcagggacgacaagtacacagatttccaggaggagatagctcgccgacgttggacgtcgctggtcactcccatggccaagttcgatccagatatagttctcgagttttacgccaatgcttggcctacagaggagggcgtacgggacctacaatcatcggtgaggggccagtggattccttttgatgcagatgccctcagtcagttcctaggatatccgctagtattggtggagggccaggagtgcgaatatggattttgcccggaccgctgtcgggagacaggtgcggatcatgcccaccaacatgactaccttgacccagacttggatgacgttgctgctcagcaacatcctgcccagcgatcataa

SEQ ID NO: 81944 - DNA, 648 bp, Glycine max
  Peptide Sequence Number=SeqID_173629
atgttggtgcgcatgatccgcactcgtttctttgcagcggcacgggtgaaatcttgccccagtatgcatagtagcagtgtgatagcctccctctctagttgtgctcgcacagttggccctcctccaatatcagggggtggcccaggaaccgtgtggatatggagcccactgaaagtgaggacgcgtagtcctctaaaggcgagggcgtgtagccctctgaagttcaggacgtgtcgcctttcgaaggcgagggagtgtagtcctatgatggcaaggacgtgcaatcctctgaaggtgagggcgtgtagccctacaaaggtgaaggcacatgaccctttgacggcgaggacgtgtagtcctctgaagttgaaggtacatgaccctttgaaggcgaggacgtgtagtcctctgaaggtgaaggcgaggacttatagtcctctggaggtgagggcgtgcagccctctggtggtgaggacgtgtagtcctctcaaggcgaggacgtgtagtcctctgacggtgagggtaagggcgtgcagccctctgatggtgaggacgtgtagtcctctcaaggcgaggacgtgtagtcctctgacggtgagggtgagggcgtgcagccctctgatagtgaggacgtgtagtcctctgaag

SEQ ID NO: 81945 - DNA, 291 bp, Glycine max
  Peptide Sequence Number=SeqID_173630
atggtgctgttttgtacgtggtttgcatggattttgcatgcaaaacgcaaccttcattggcgacatcgtgggcaatggacacgtggatggcaacccgctgctgctgctggcgatttcagctttgactggcgatttccaaggctacgagttgtagggtgcagaggcacagaagccatagaagccatttccgaggctctgaacggagctgcagctgcagggagtcgccaacaggacctgcgacttggtgagttcccgaaaccgccaacaggaactgcggtttgctttgcttaa

SEQ ID NO: 81946 - DNA, 774 bp, Glycine max
  Peptide Sequence Number=SeqID_173631
atggtagaagtctccacagaggctattgcctccctcgcccagtattatgatcagccgttgaggtgcttcacctttggggacttccagctattgcccatggtagaagaatttgaagagatcttaggatgccctctagggggaaggaaaccatacctcttctcagggttttatccctcattagctagaatttctaagatagtccaaatctcggtgcaggaattagaccatagaaagcaattcgaaaatggggtggttggaataccgagaagatatttggagggaaaagcaagaattttggcaggtaaaggcgaatgggccctgttcatagacattctcgcactgttgatcttcggaggagtcctctttccgaatgtggatgggttggtggacctagcagcgatcgacgcttttctcgcctatcataaccatagggaaagcccggttgttgctatgctagccgacctatatgacacttcgaccgaagatgtaaggcatgcttgcccgttagaaagtcaccgctcatgcatagagaaaggaggcgcaaattgggaccaactcttagcaaacaaaggaagattcggagttacctcgatgaaaagaagggagagtcggagttcttatttcatgcggaggatttccgaatgttcccttgatggggacgaggggttgcatcagttacaatcccgttcttgctataagacaacttggctaccctatgagaggggcaccactagaggaagagctcgcgcctgtcatttcacgaggtttcaatga

SEQ ID NO: 81947 - DNA, 267 bp, Glycine max
  Peptide Sequence Number=SeqID_173632
ttgattatagtatcaggaaagaaagatatacttgtaagttgttcatttcctacgccttatgttgaggctgtagaggagtcgttggaaacatccttccaggcgctggaagttatgagcaatgcttatgtggagtcttctctggtgcagccacgcttatctggtgttgctttgatggtggctcgggccatgttggggcacaaatatgagcccggaatgggtttaggccgaaacggggatggcacggccagcttggtggagttcacttag

SEQ ID NO: 81948 - DNA, 741 bp, Glycine max
  Peptide Sequence Number=SeqID_173633
atgggatcaaatcaaacacctttgattaagaaaaggttctatcaagtcaaaatcaaaagcttagaggtcgccagtttgcaagaattggggcaattgatgggtcagctccaatgtcaagccatccgcaagacctataagaagatttgggacctagctatggtagaagtctctgtggaagcaattgcatcccttactcagtattatgatcagccccaaaggcgcttcaagtttggggacttccagctagtaccgactgtggaagaatttgaagagatcctgggatgtctgctgggaggaagaaagccatatctcttttcagggttctacccttccatggcaagagtatccaaggtagttaaaatctcggtacaagagttggaccatgtgaagcaaaataggaacggggtagtcagaaaaccaaggaagcatttggaggaaaaggcgaaggcgttggcaaatcaaggggaatggacttcgtttattgacatcttggcactgttgatatttggtgtcatcctctttccaaatgtggaggaattagtggacctagaagcaattgatgccttccttgcttatcactatagcaaggaaagctcgatcattgctattttggccgatgtttatgacacgttcgaccaaagatgcaaaaaaagcggtgcaagaattgtttgttgtacaccagttctctatgtgtggcttatcttgcacctttttcgtcaagaaagtaggggcatccattaa

SEQ ID NO: 81949 - DNA, 279 bp, Glycine max
  Peptide Sequence Number=SeqID_173634
atggaagcttgcttgtggggcttctatggaggctggatctttgagcttcaatggggtcctttaatggtgattttccaccatggagatgcagcggaagacaaaggaaaagaggcccaaaagaaggaaaaaccaattctaacatttacaaagaagaatggatccaaccttgacccatgggctcaaaaatctaccctaaggttcatgagaaccctaggaccttctttagtagctctagcccaagcctcttggagtcttctatccaatgcccttggggggtag

SEQ ID NO: 81950 - DNA, 571 bp, Glycine max
  Peptide Sequence Number=SeqID_173635
gcaattcttggtggtgaagctccttcttccttggcttattccctagtggatggtgcctcccctatcctcttctcctttgccttccgctgcatctccatggacgaggaacttaggggaagtagcaatgggcccatcgacggttaccgtaggtggttgaaagcctacacacaaggtctggattggcttccaaatttgagaactactaaagcggtggagggtgaagctccagaagaagacgaagaggtacaagcccttaaaacagagcttgagagagcccaaacaaccaaagaaaaattcaagttagcagctgttaggatccgaaaagagaacgccgaactgagagacatcaacatagccaccatcaaagagggcccacaaggaagaacatggccggaacaagttccgaggggctatgtggggcaaggagtttgtctcagcggttatgcgagaccgaaacaaattgccatcatcagcaagtacaaggaagaattaaatttggccaccgcccatgagcacgaagtggcggacgaatacacccgagtgtacgcagaaaaggaggctagagggaagg

SEQ ID NO: 81951 - DNA, 668 bp, Glycine max
  Peptide Sequence Number=SeqID_173636
ccgacaaggacgatgtggaagacaatgtctatgaaaaatacggcattagcaaggacaaatgggcccagttttatcagacatgccgagatccctcatgggaggatgtgcagaaaaaaacacaggccatccagaagcaaaacactgccccccacatgttgtctcgtgagggttatgattatttagaacagaagttgatggctgagaagacaaagaaaaaactagaggaaactactcagtctggaggcaccgagggcgtcattaatcctccatctcccatcaaacgacacgtgaagtggaagatggccagcacgaagaaaactgggcagatgacgtctgaggccgcaaaggaaatcgctgagaagattgcgtcacaaggttcgtttgtcccccatggacatgaagatgtcctgactgctaccgttgggcgactagaacaccctggccgtgtgcatactggtggagtcggtgtcaccatcaagcaatacttcggatcggctccacgaagctcccgcagttcctcctccatccctcccgaagatctcgagcagctgactcaacaaatcagggaccagttggaggagtcgatcacagaaaaagtgactcggcaactgatggcatcctttagccagatgcagttccagctacagtcacagatgcaatcacagtga

SEQ ID NO: 81952 - DNA, 258 bp, Glycine max
  Peptide Sequence Number=SeqID_173637
atgacagccaccgttttaggagcgctgagcaccaacagcgcttcgaggccatcaagggatggtcatttctccgggagcgacgtgtctagctcagggacgacgagagggcgtgcgagatatacgatcctgggtgaggggtcagtggatcccgttcgatgcggatgctctcagccaattcctgggataccttttagtgctggaggagggctaggaatgcgagtatggccagaggaagaaccggtccgatgggttcgatga

SEQ ID NO: 81953 - DNA, 879 bp, Glycine max
  Peptide Sequence Number=SeqID_173638
atggaggccgaggcagagaacaacgacttgaagaaggaagaaaacaacaatgataacaacaacaataacaatgaaagtaacagaaaaatcgggaattcaagtgagtgtctaagcaagcccaagcatcaaatgaagatgccgtttcagcttgaaacgctcgagaaagcttatgctaaattacccatcggagactatgagggtggagttgtcagagaagttagggttgtcggatcggtagttacagatgtggttttgtcactggcggttgaaagacaagaaggagttatcggcaaagaagccgcgaaaggcagcggcgttgccggattctccggtggaggagcccaagttggagtggaggaggtgactgcagatagcaaggcaagcaaagtggtagtgaaaggaaaggcagcagaccccatgaaggtgtgtgagagactacaaaagaaaagtggcaagaaagtagagctcatttcacctttgcctaaacctccagaggagaacaaagaagaagagataaccacaacaagaggagaaaaagggggaggcttatgggacatcatcaatcttcatatgcgaagatcagattctgcagctaacttgatcttctctttgctggaaatccttccaatggagactagaaacatatttgctatcactcttttgtgcatttggaaaatgcgaaatgagagagtttgggaatggatgagcacgcctccagcaatatccattgtgcaatgtctgcaatatcttcatgaatgcaattttaaagaaggaatctttggtgctggaatggttctccgtgacggaaaaggatactttatgaaggctaaaaaagtgactgcacaaagaaatccagacacaaaggaggctaaggcgtga

SEQ ID NO: 81954 - DNA, 1161 bp, Glycine max
  Peptide Sequence Number=SeqID_173639
atgaattatctacaacaccaacaattaggggtggccacagatctggatcaatctaataacccagtgaatccaaagtccaaactgatccaaaccggaaaatctgcaaatctgatgagttcggatctgatctcggattttacttttgaaaatccaatccgatccaatccaccggattacttggcagaggaagtacaaagattacgcaaaagaagaaaggctgaaaagcgcttactggatatgcaaagaaggcaaaaagaacgtattgaagaagtgagagagacacagaagaaggatgaagaagttatgaacctgaaggagcaattgcgggttgaaatacagaaggggcttaatcaattggagatgcgatgccatgatatgccctcactgcttcgtggcttaggaatacaagtgggaggaagctttatccctttgccaaatgaggcaatccagtcaatgcctgctggccatctttctttaaatagaaagaaaccatctctgagagaaagaagggcctataaacgtgcgttgcttaagtttcatccagaccgtgcatcaaaaactgacgttcgtgctcaggttgaggctgaggagaagttcaagctcatctctcgtttgaaggaaaagtttgggatgacttcattggttacccttttgttaaaatggtttggcttcaatgttgacggccatgaccgtgacgtctgtaacacttgtgccgacaaaactcagcctgtgccagccatggtggtgatggaggtggtggcttcggtggtggtggtggatgtggtggcgggtgtggcggcagacgtcgtcgtcgatgatggacaaagcaagaggttgagggtcgatgacgcgaaccacgacgagaacggagcaagagggagagagactaagagaagagagatgggtttgttggcgatggagggagatggagctgatgcgcttcttgatgtccacggtggtgatgaaagcggagcgaagactcgggagggagtgggtgtgagagcggatagccagtcaaggatgacgtcaaccttggcggtcatctctagagtcttggtggtcatctccaaagtttgggtagtcatggtggataggttctgggtagaggcagccatggacgacaggttagaccaaattgttacgaacagaggacaaagctag

SEQ ID NO: 81955 - DNA, 471 bp, Glycine max
  Peptide Sequence Number=SeqID_173640
atggaaagaaatttgggatcttggagtacctccgaaggtacgtgcgcttttagcatgttgaaacttgaaaatcgttggaacccatgttttggttgtgatggagtcaatgagataaatggtctcatatgggaagcaaaagctttccattcgaacagccctgcccaatggtctcctcctccaacaggagttttgaagtgcaatatagatgttttcaaaacaagcgtattgaaatctgggaacattatgacaaattgcacaacactctttggagcttttccaaactgtcacattgactatgtttgtaggttaatccgtcttatagttcaaccatcgattggtgctgattctgaaaatttgaaacacccacttcccattcgggttcaatatgagaatcgttctgatttccaaattcatcattggcttctggagcctatctcacctctaaaggatgaggttgaaccactttcctga

SEQ ID NO: 81956 - DNA, 1068 bp, Glycine max
  Peptide Sequence Number=SeqID_173641
atgtccatagcaggccttatagacccagaaatgaatcacaacaagtccttccaccggcgaaataactccggcgagctcgatgtgtttgaggcagcaaggtacttctcaggatacagtgaagttcttggctccaccaccaccacctacactcagaagatcaatatgagagaagaaaggcaccatcatcatcatcatcatggacatagagctgccagaatcagcttagacatgccaatgagaagcttgctcccacagcaattccatggcatggagaagcaaatcatcatgaaggagaagaagcacaagcagcctagctctcctggtggaaggcttgcaagcttcttgaactctctcttcagccaatcagcatcaaagaagaagaagtcaaataagtcaagctcacagtccatgaaagatgaagatgagagccctggtggaaggaggagaagaaggagcagcattagccatttcagaagctcaagcactgcagattcaaagtccttgtactcctccttgagttcagggtttagaactcctccttatgtacaaacaccaacaaagagctgcaaggaattcagaaccttctcttcagaaaacaagcatgcactgtccttttcagcaaagtacaacaataacaagaacaacaatggacaacatgtaagatcatcaacagcaaccaccactttgcaaaatgagtttttgtgggatgagaagaaaaagagggaaccaacaacaacaacaaccttgttggatgataatagcaaccacaaacacttatcagagaaacaaaagaacaacaacaacaagggaagtcatgagttattacttgagaaagataggatgttagtggacaacaagtactcatcagaagagaaggaaaccaccactcaattcaagaacttcaatgaggttgttgttgatgatggtgcagaaagtgattcaagttctgatctgtttgaattgcaaaactatgacttgagatactattcaagtggcctacctgtctatgaaactaccaacatggatagcatcaagagaggagcaccaatttccaatggccctctgtga

SEQ ID NO: 81957 - DNA, 963 bp, Glycine max
  Peptide Sequence Number=SeqID_173642
atgcaatttttcgtttctcaagttgaatttgatatccctgaagcatctgatctgaggacaaaaaagaaaatacttcagaatgtggaggagtggtggagacagtttaagtctgatttgacgtcaaaatgggcacttgcagccgacaaggatagtgttgatgacattgtatgcgaaaagtatgacattagcaaggagaagtgggcccaattttgtcaaagccacagagacccttcgtgggaggcacgggccatccagaaacaaaatagtgcccctcacgtgttgtctcgtgggggttatgaatttctagaaaacaagttgatggaggagaagaaaaagaaacaactagaggaagaaactaaatttggaagcacaaatactatcattgatcctccatcttccatcagacaacacgtgaagtggaaaatacgtcaggatgtgctgattgttgccgcctttgggcaaccaaaacaccctggtcatgtgcatgctgctggagccagtgtcatgatcaaacaatactttggactggctccaaggacctcccgcacgtcttcgtccatgacaactaatggactcgcactgcctcctgagcctaaggttgctccttcaactgctcgtgtcagcacaaaggagaattgtgttgatccctcaggaaaagatccagacaaagacaagggtaacttagataaatatgggttgtacatcaaagaatatcctccccgcctagttgccctacgaatactttatgaggggtccacaaccgttcacaacatccctttgtgccatgataaagtcaaggttggtgttgaggaagttagagatgcagatgctctcattcctatacccactaaagagggagctatgggactgaagaaacctgtagataggctagatcatgatgtcgatgatcccctatatctaatgacattgatcatcccacaaccttttctaatgctgttgtag

SEQ ID NO: 81958 - DNA, 340 bp, Glycine max
  Peptide Sequence Number=SeqID_173643
atggtcttcaccgacgaaaggatcgatgtgggtctaaaaagaggcaaatttagtcatcctgcttggacgaatgagaaaactggggcaaatgaagagggtgaggatgaaggaaaaacctatgctgtgactgccattcttatacgaccagccccggggcgttgcattgagcattgtagggctctgaagcgtaaggtgcaaggtctaattgatgcaggctggctgaaatttgaggagaatcacgtgattttcaactttcaccggaagtgggtgcaagccattggtcagtttgctcaagcgacctatgctcctgagcttgggacttccaagaccgttggtgggg

SEQ ID NO: 81959 - DNA, 441 bp, Glycine max
  Peptide Sequence Number=SeqID_173644
atgtggcaatggcgtgtagattgcatcaataagaaagcagtatgtgccggcaagttgtcccaaggtagcaaaggcgttgaggaatactataaagaaagggaggcgctcatgattcaagccaagatagaagaggatgaagaggaatttgttgaaatagaagatttgcttcacaaaacaattcgagtagagcaacaattgaagaggaaaggtgtggccaagaggagttccactaattatggcttaggacattatgcatatgagtgccctaacaagaaagccataattcttagagatggagagtacattagtgagtctgaagttgaaaagggagaagagagtgaggatgatgaggaggaagtggagaaaacactggagggagaattgttgatgatttggcggttacttggccatcaattgaagtctatggaggaaagtcaatga

SEQ ID NO: 81960 - DNA, 231 bp, Glycine max
  Peptide Sequence Number=SeqID_173645
atgatggaggaaaatacatctccaactaacaaaggacaatggcagcctcattctacaaatcatccaattgtcgaagagtatccttgtgggacctttgcactccgcagacatcgacaaaaacttctcttctctattgttgacatcgtgtggcatgttgggggaagatacgttcaccgatcttatgatatcggatgcaactgctctcgtattcccatgtcaaccaggtcttga

SEQ ID NO: 81961 - DNA, 237 bp, Glycine max
  Peptide Sequence Number=SeqID_173646
atgcttgagggagacagtagccgtgagactgtgcgagaattcgctaagtgcaaccttcagtggctaagcgcgaggaagaatccagaagaagatgagctgtcaagttcgctaagcgcaccactccaggtcatcaagcacaccgcttcagctcatccgctaagcgaaacaagtgcgctaagccaaaatccacttatgcgcgctaagcgatccggatctgcgctaagcgcacgagcatga

SEQ ID NO: 81962 - DNA, 168 bp, Glycine max
  Peptide Sequence Number=SeqID_173647
atggctaccaaaggttggagctttgttggagcttcaatggtggaggaagaagaagagaatggcaacttcctcgcgtttctctgcgcccgtaggggccagttttcgaaagtaggcaatatatatatcaaaacactcaggataaaaccccgagtgtggttcagaggttga

SEQ ID NO: 81963 - DNA, 297 bp, Glycine max
  Peptide Sequence Number=SeqID_173648
atggtcgtcattgtcaatgtggaagcttgtggttatgtgagcatgaactactaccaatatatagatgttgtttatacaaacgagcacatcttaaaagcttactccgcacaatggtggcctcttgggaatgaagcagctattcctccttctgatgacgcatggacacttatccctgacccaactacaattcgtgcgaaaggtcggccaaaatcaacaaggataagaaatgagatggattgggtcgaaccatctgagcaccgaacaaaatgcagtagatgtggagccgaatgggcataa

SEQ ID NO: 81964 - DNA, 288 bp, Glycine max
  Peptide Sequence Number=SeqID_173649
atgcagaaattgattaaggaaaggatgacaaataaggtggttaattttgtgggtcttaataaggtggttcttggcataaaatggaataatgagatgagaaaacgtaggttaagtgatggctggacagaatatagaaatggcaaaaactcaagctacagggctccaaatgaggtgattccaaaacgaggtgaaaggttgaagatgaaaggaaggaaagaatcactctttccggcaagggcaacacacaaaggttgtgaaagtcctttgatacagccagggtgttcttga

SEQ ID NO: 81965 - DNA, 170 bp, Glycine max
  Peptide Sequence Number=SeqID_173650
ggacccaaaaatctagggctagaagatctgaggccccatctccttcagctgcccctactccccctacttcttctctcccttcagcactagcagccccagttcttctaggtccctctgctcagagctcagagcctttcatgtctatgcttaagagcctgcaccaaggctag

SEQ ID NO: 81966 - DNA, 189 bp, Glycine max
  Peptide Sequence Number=SeqID_173651
atgggcgagaaaaaaccaggggaaaacaaaatggaggagaaaaaagcagaggaagaagaaaagaaagaagaagagaaaaaaccaggggaatcaaaagatgacaaggaatccaaggaggaatttgcgccgccagcaatcgtgcaaggcacaaccttcgcaatgcatgaacactttaagcacgatttctga

SEQ ID NO: 81967 - DNA, 291 bp, Glycine max
  Peptide Sequence Number=SeqID_173652
atgttggggaagcttgggaggattaatggagacccggggttgagaaaaacgaggatatgggctacgtgggagtacgtgagctcagttggaggtgggcaacaggggatggtgggtttatgcgcgatttgtggatgtggaaaacttgttgtgcaccatcgcccaaccgccacccagtaccacatagtggtacctggagatatgtcgcgggggtcaggagaccttggggacgttaggtggggtgctattgccccaaaaccaagcttgaccaatcccgacccaacccgggcatag

SEQ ID NO: 81968 - DNA, 540 bp, Glycine max
  Peptide Sequence Number=SeqID_173653
atgttggaagagaagtctgttaccattattgatgctaatagcaatgaagagaaagctcattataaagcttgggaaagatctaatagtctcaatctaatgttgatgagaatgactattgcagatagtattaagacaactctccctaaaatcgaaaatgctaaaaagtttatggggttagtgggagagcactcccaaacagctgataaatctgttgttgaaacattaatgagtacattgatcaccatgaagtttgatgttaaggaagaaatgaggcttaagaatcaaggaagtcacttagttcataatgtaaaccaccaagggaatcaaggagctggaaagaaatttatgaagaagcatgataaaggcaaagggtcattaaagatcaatgatgactctttgcaaatccagaagaaggtatcaaatgacaataattgtcaattttttaggaaatctgaacatttccagaaggatttcctaaagtgtaagccttggttcgaaaagaaagggattccttacaatccaaaccataagcccaaatga

SEQ ID NO: 81969 - DNA, 234 bp, Glycine max
  Peptide Sequence Number=SeqID_173654
atggaaattgcgatgaacgtgctgagtgcgcctgttacgcttaacctattcatcgcaactgttaaaattttggattcccagatgaatgcgctaagcggaccatgtcgcgctaagcgcgctaagcgcccctttgcttctgctaagtgcaccctgtgcgctaagcctgagtgttattctattaaggttgagctaagcgcgccctgctgtgctaagctcagactctcttctatttaa

SEQ ID NO: 81970 - DNA, 258 bp, Glycine max
  Peptide Sequence Number=SeqID_173655
atggccggtagcgggcaacagacacaccaccgccacctccagagcccctcagctcatctacaaaggatggagtgttgcctacgactcatggccgaccagcaggcgaccaagtccaaagccaaagaagtgctactaggaggcaacctagaattggctacgaagaagctccccgcgaagtggtccaggaagggcaccattgaagaggattccagtgtggccccacaagctgacacaagctttgacaaacaccgattctag

SEQ ID NO: 81971 - DNA, 531 bp, Glycine max
  Peptide Sequence Number=SeqID_173656
atggtgggttacacaccttcaagctttgcggatttggtcttcgctggcgaaataatcgaagtggagggtgagaatgagggagaaacccatgttgtgactgctattcctatacaaccaagtttcccaccaacccaacaatgtcattactcagccaataacaaaccttctccttacccaccacccagttatccacaaaggtcatctctaaatcaaccacaaagcctgtctacctcacttccaatgacaaacaccacctttagcacaaaccaaaacaccaaccaagaaataaattttgcagcgaaaaagcctgtagaattcaccccaattctggtgtcctatgctgacttgctcccatatctacttgataattcaatggtagccataaccccagccaaggttcatcaacctccatttctccgagaatacgactcaaacgcaatgtgtgcttgtcatggagaagccccggggcgttcaattgagcattttagggccctgaagcgtaaggtgcaaggtctaattgatgcgagctag

SEQ ID NO: 81972 - DNA, 549 bp, Glycine max
  Peptide Sequence Number=SeqID_173657
atggctccgaagaagctctccacaaagaggtccaggagggacgcccatggggaaagctccaacgccccgatggagttcgatagtcaccggttccggagtgccgagcaccaacagcattttgaggccatcaagggatggtcgttccacatgaagcgacgcgtccagctcagagaggatcagtactcggacttccaggaggagatagcacgcaggcattggaaacctctagtgactcccatggccaagttcgaccctgagatagtcctagagttctatgctaatgcctggcccacggaggagggagttcgggatatgcgctcgtgggtaaggggggtgacgcccactaggcaccctttggacccggagaggtccaatagggccttgagattttcggccttgatcacgggcctctgccagttctatggggtacctgtcatccctagcaaggtaatcctgccgccgatcacccgaactttcatcgagaaatattgcaaccctaggcaggcccagggggatgcacaacaggctgcagatgcaccaccaccttag

SEQ ID NO: 81973 - DNA, 228 bp, Glycine max
  Peptide Sequence Number=SeqID_173658
atgtctcaaggaaatttcaataggggttcaccggaaagcgcaccagatcgtcaacctaaattactaaaccctcgatccctcgtcaggctgaatatccaagcttcgtccgtagatccctcatatccctcatgtaagaatagactcaactcaagtagcttacgaaagtgtagcctaatttaccctaagctttgtccacaaatccctcatgtaagactaggcctaaactaa

SEQ ID NO: 81974 - DNA, 192 bp, Glycine max
  Peptide Sequence Number=SeqID_173659
atggatttttacaaggttgaaagaaatcttaaggaccgcaagtcgcttggggactggatgttggcacaggttgttgccgaaccaatcaccatacagatctttgtccttctgtgcagtaatctggagtcaatgagcaacctgaagcttatgctgcaaacatttacagtagacctcctcagggggatcctctag

SEQ ID NO: 81975 - DNA, 381 bp, Glycine max
  Peptide Sequence Number=SeqID_173660
gtgatccggtcgccgatctcccgagccttcattaagaagtattgcacgcctaggcaggcgcagggtgatgcgccacaggctgcagacgcaccgccgccacctcatcaggctgattcggctgggtcattaggcacggagcgttatttacggcacttggttcaccagcaggcggccaaccaccgggggcagggccagggttttgctccttttgcatgccctactccagatcagtttagggctgagatcgcatggcccggagattggctcgaggaccagacggaggaggcgcctgcaggagctcctgacgatgcagaggacgctcgcatggatgaggagatgatagacttgctcggcttcttgggaggaagcggagccacgtga

SEQ ID NO: 81976 - DNA, 255 bp, Glycine max
  Peptide Sequence Number=SeqID_173661
ccctttgtcaaagtcaagagatccttctctataggtgcaaatgtagtttcctccttcggttacctcaaagagagggatggttcttgggtaaagaaggatgctccagtacaagccacagaagatcgctctccatcaccacattctcagagagatgactcttcatctcttatgcacagtattcttgaaagctttgatggacttcaaacctatgtaagtgagaggtttgatgctttggaacgacaagtggacacgtga

SEQ ID NO: 81977 - DNA, 123 bp, Glycine max
  Peptide Sequence Number=SeqID_173662
tgttgtggtgaccgtcgtatcgttccactggcgtcgtcgacctccaaggctcgaaccaccgtccttccacttagatgcgtagttgcactcgtcggctcaagctacgaccgcagcacgccttag

SEQ ID NO: 81978 - DNA, 489 bp, Glycine max
  Peptide Sequence Number=SeqID_173663
gttcagagtaagcattcttttccaccatatggtttgcctcccaattatacatcgcccaatgttgtgtatgctcctggcgagaatgtcaataattctacacctatactaaatgagaatcaacaaccacaacctaatcatgcccttgtttctcaacctctgggggaaacacatgaagctccccaagaccacactttggccgattttgggtcacaccccgaatataccattaaagggcatgcatttcctggtgcccccgtgccaaacgctccggggggggggcctcggtatcaatcaccaccccgacccttgcattttgcgataagagaaagcccttccacagtacttgagaaggaagggattaagaatatggaggagaggttgagggccattgaaggaggaggaaattatgcctttgctgacacggcagatttgtgcttggtacccgatgtggttattcctccaaagttcaaggtgccaaatttcaattag

SEQ ID NO: 81979 - DNA, 639 bp, Glycine max
  Peptide Sequence Number=SeqID_173664
atggttaacgaattggggatgagaactttactgaggcttggaggggttgacggggacccggtgctgagaggaacgaggagaagggctacgcgagctcctggcagtcaaccaataaaggaacaaaagtccacgaagaagggaggcttgtgtggtggatggccagctatctatcttatgttgttatttgaaaaattccttctgatcgcgatggcagcacagttgattcatgatcgtgtcgtgatggagtgcctagagggtgtttgggagaccctcgaaggcaatgagaggtgccgattccgtggcatagttcaactcactactacttcgctagtacatcctgagaaacccgcacgcacacttcagcagcctgtggagtggatactacctacgcctactccatatcgactagttgagcctgttcaattgatagaggtgtcaccctctgaagaggatcttgaagaggacccagaggagttacctcctgaaccagctatggatgcccctgacttaccagaggatgatgaggactcactccctgatgttgattctccagaggatattacgtcagcatctgaggcagactctacagaggagagtggccctggagggacagcgaatagtgacgacccttcatcatag

SEQ ID NO: 81980 - DNA, 858 bp, Glycine max
  Peptide Sequence Number=SeqID_173665
gcacggtcaaagttgaaggttgtcagccatggtgcccaggtcctaccactcccaactgcaccaacaatgagggcttacatgctacaattggtggttagtaggcctaatcacggtgtgagagatgaaatgaccatcactctagatgatgtgtcttgtctcttgcatctgcctgtgacaggaaaacacattgatcatgttccctccatctttgatagagatgcagtgaagattctactaatgactcaccttggcatattgacagaggaagaggctatgacggtgacaaacgcagctgctagggctcgtgtgttggctaccacagtttatcttttgcacttggttgacaatacaatatttgccaacaagtccttgactcacatccatgtcacttaccttttctacctcagcaacctggatgtttgccatgagtacacatggggagtcactacattagcgtacctatacgatcatctctcttatgcaagccagtacaccaacaatcaagttggaaggtatatgacattactcattgaaatcatgggttatgtgcatctgcctagtgttggctattcagaacatgggaccggtgctctagatgatccaatagccaatagatggaagccaaccaaaggtttcagcttcatcaaatgcgggactaatgtgtggccttatcttctagagaaggttgtagagcatgtcattccactaggaaatgttgtgccacctaggaatcattgggcttgcacccctaactatctaccttggttttacaaggagggcttcgaagctatgtgcaacttagagaggcaaaggaagagccttgtaaagggtggcaagaagggtgacagaggtggatga

SEQ ID NO: 81981 - DNA, 228 bp, Glycine max
  Peptide Sequence Number=SeqID_173666
atgattgcaaccctgcacgaaccagacgatttcaacaaagcaaaggagatgtttctattacaagggatgaatgcgatcaaagcgcgttatcttggagaaaacaaggttctcatcagtccagagaacgggagcaatcttgaggaatggtttgtaaacaaggaggagtggctaggaggcttttgcgaatctgttgaagcatggtctccaaggaatgtcacaggaaattga

SEQ ID NO: 81982 - DNA, 1086 bp, Glycine max
  Peptide Sequence Number=SeqID_173667
atggcttctagaaaaagaaagagtattggtacaaagccaatagcacagtatgatacaaggagatttcactcctttgaggcctggaatcaatacatggataacgttttaggaagacacatcttacctgagaggaaggtggaaatataccacactgagctggacgagtttaaggctgaattggagaggcgtaacttccataaatgcctcaccaatttagttgacagtagcatagacttagctttggtgaaggagttttatgccaacctttacagctctaaagacccttcaccaaagcaagtcagggtcagaggccacctggagaagattgatgcagacagcctcaacacattcttggagatgcctgtgatattagctgaggggtttgttttgaattctgagggccatcctgggaagattctcaggaaagatttgacgactcttgctcagatggacatgaatgtgggagcccttatctctggccagatcacatctatagcccagtctaactcttctagacttgggttccctactctgatcaccgccctgtgtaaggccagaggggttaattctgatagcttggttttcgagcgcttgagcccggtcatcaacttggcctatattaggaaaaattgttggaatccttatgatctaacaatttctatcagaggggccaggcgggcaaggacgaggccagctgagcctccttccacatctacagctcctattccagcatgtacctcagcagctccttctgtcccagcttctgcagattttcaacgatctattccttcagtggagcagttcactgagttggtagcctggcccgggactcagtcttctcttcgtagggaagatgaaggtcccacagcccaggtatcacagcatgtggaggatgattcatccgaggccaccattccagagccttttgtcagggggatggaggcagaggagacacaggaagctgcggccacacttgagagatctcttgaggtagcttctgagtccccagcacaaggggaggacataccctcacctcagcctgcaacagacccttccactcttgtcttggacttatcagaggattaa

SEQ ID NO: 81983 - DNA, 876 bp, Glycine max
  Peptide Sequence Number=SeqID_173668
atggcatcagcggcacaagatgccacaaacatgccaaatgttgagaactacacttttcgcagcacatgtgcctttaccacctccgtttatttttgggagctaatgggaaggcccttggttgaaagcttgtgtgtccctgaaattccttctctggaaggatgctccacaacccaattcatggatttcctgattgcacaaagtaatttcctcaaattcaatgatggcaacatctacaacacaatcagggaaatcgaaggtgcttacattgacttcatggatcgcatcagtggtgacgaaaacttgggcactgggccctttgtcgtgttcggtgtccgacacgcgtccgtgtcagtgtccgacacgcgtccgtgtcagcgtccgacaccgacacaacacccgtattacgttctatattttggacattacaggtgtccacgtgtccgtatccgtgtcgtgtccggtgtccgtgtcggtgtgctgagagatgctgataaaggagacatcttcgatggaaatgaagcaaaatggcatgagcttccaaatgggtttgaggaaagaatagaattcttgcttagagagcataaccacgggggtgcaacagcagcatggcctatgcactctgaccagccaagaaaatcagttttgatcacagaggtcctcaaggttggttcgcttgtgaaggattgggcacaaaggaatgcattagttagtgcttcagtaggtgagaatgcagtgagaaggttgatggaaacaaaggaaagttatgaaatgcgagagagagcagtgaggcttaaaattgccatccataggtccatggatgaaggtggggtttcttgcatggaaattgattgtttcatggctcatatcactaaatag

SEQ ID NO: 81984 - DNA, 330 bp, Glycine max
  Peptide Sequence Number=SeqID_173669
atggaactccaacgtctcaaccaaaatgaggaaactgacaaaaggaaaagaagcatagcactcaaagccttctcctcaatgcaagaagaagaagaagatgatgaagaggacttctcactcttttgtaatcaacccggtcacataaaggcaaactgcccctcaaatgagtcatggcccgagaagaatgagaagaaaagctataaagaaagaagatccaagaaggcatatattccttgggatgacaatgactcattcgatggttctaagaaggagatcaaccttctatccaaggactatgaaagtgatgagaacatctctgaagaagtttaa

SEQ ID NO: 81985 - DNA, 141 bp, Glycine max
  Peptide Sequence Number=SeqID_173670
atgtgcatacttacctatgtcatgacggcacagaccaaccgatacatctgcagggggagattggcattgtggtcgtcgggcagaatgttactaaatagcaacgataaattttttatcgcgcgtatgagaacggtactatag

SEQ ID NO: 81986 - DNA, 4155 bp, Glycine max
  Peptide Sequence Number=SeqID_173671
atggcttctttagtgtcttctccatttaccttacccaattctaaggttgatcaactctcttctcttgcccagagacacctttttcttcattctttccttcccaagaaggccaatggctatgctagcagctcaaaagcttccctgagagtgaaatgtgctgctatgggcaatggtcttttcactcaaaccacgccggaagtgcgtcggatagttcccgagaagaaccaaggcctgccaactgttaaaattgtgtatgttgtgcttgaggctcagtaccaatcatctctctctgctgctgttagagttctcaacagcaacaagaaagatgcttcctttgaggttgtgggctacttggtcgaggagcttcgcgatgagtccacctacaagaccttctgcaaggacttggaagatgccaacattttcatagggtcactaatttttgtggaggagcttgccctcaaggtcaaggctgttgtggagaaggaaagggacaggcttgatgcagttttggtgttcccatcaatgcctgaggtgatgaggctcaacaagttggggtctttcagcatgtcacagcttggacaatccaagagcccctttttccagctcttcaagaagaagaagcagtcctctgccgggttcgccgacagcatgttgaagctggtgaggactttgccaaaggtgttgaagtacttgccaagtgacaaggctcaggatgccaggctgtacattctgagtctgcagttttggcttggcggatcacctgataacttgcaaaacttcctcaagatgatttccgggtcttatgttccggcgttgaaagggacaaagatggagtactcggagccggttttgtacttggacagtggaatttggcaccctctagctccttgtatgtatgatgatgtgaaggagtatttgaattggtatggaaccagaagggatgctaatgagaagctgaagagtccgaatgcaccagtgattggtttgattttgcaaaggagtcacattgtgactggggatgatggccactatgtggctgtgatcatggagcttgaggctagaggtgctaaggttatcccgatttttgccggtggcctcgacttttcggggccagtggagaggtacttgattgatccaatcactaagaaaccgtttgtgaattctgtggtgtcactgaccggctttgcgcttgttggaggccccgcaaggcaggaccatccaagggcagttgaggctttgatgaagctagatgttccttacattgttgcattgccattggtgttccagacaacagaagagtggctgaacagtactttgggtttgcatccaattcaggttgctctacaagttgcactgccagagctagatgggggcatggagcctatagtttttgctggtcgagatcccaaaacaggaaaatctcatgctcttcacaagagagtggagcagctctgcactagggcaataaaatgggctgaattgaaaaggaaaacaaaggaagagaagaaactagcaatcactgtcttcagtttcccaccagacaaaggcaatgtaggaactgcagcctacctgaatgtcttctcctccattttctctgttctaaaagatcttcaaagagatggttacaatgttgagggacttccagaaacttcagaagctttgattgaagaagtaatacatgacaaagaagctcaatttagcagcccaaatctgaacgttgcttacaaaatgaatgtccgagaataccaaagtctaactccctatgccacagcattagaagaaaactggggaaaacctcctgggaatctgaattcagatggagagaatctattggtatatgggaaacaatatggtaatgtattcataggtgttcaacccacatttggctatgaaggcgatcctatgcggttgcttttctccaaatctgcaagtcctcatcatggatttgcagcatattactcttttgttgagaaaattttcaaagctgatgctgttcttcattttgggacacatggttcccttgaattcatgcctggaaagcaggtggggatgagtgatgtatgttatccagacagtctgattgggaacattcctaatatctattactatgctgcaaacaacccttctgaggctaccatcgccaaacgaaggagctatgcgaataccatcagctatctgactcctccagcagaaaatgcaggactgtacaaaggtcttaagcagttaagtgagctcatctcctcataccagtccctcaaggacactggccgcgggccacaaattgtgagctcaattatcagcacagctagacaatgtaatcttgacaaggatgtggaactgccagaagagggtgaagagatcccagcaaaagatcgcgaccttgtggttggaaaggtgtatgccaagatcatggagattgagtctcgcctgcttccttgtgggctccatgtcattggtgagccaccctcagccttggaagcagttgcaacactagtgaacatagctgcacttgatcgtcccgaagatggtatttcctctctcccatcaatactagctgagactgttggaagaagcattgaggaagtttatagagggagtgacaaaggaatactaaaggatgtagagcttcttcggcagataactgaagcttcgcgtggagcaattacttcctttgtgcagaggactactaataagaagggtcaagttgttgacgtagctgataaacttacctcaatccttggatttggcataaatgaaccatgggtcgagtacttgtcaaacaccaaattttaccgagctgatagggaaaaactcagaaccttgttcgatttcttgggagaatgtttgaagttggttgtagccgataatgaattgggaagtttgaaacaagccttggagggtaagtatgtggagccaggacctggtggcgatccaattagaaatcctaaagttttaccgacagggaagaatattcacgccctggacccacaagctattcctactacagcagcaatgcaaagtgccaaaatagtggtggatagattgattgagaggcagaaagctgaaaatgggggaaagtatcctgagactgttgcacttgtattgtggggaacagataatattaagacatatggtgagtccctggctcaggtcttgtggatgattggtgtgaatccagtagctgatacctttggaagggtcaaccgggtggaacctgtaagtcttgaagagcttggaaggccaaggattgatgttgttgttaattgttcaggagtattcagggaccttttcatcaatcagatgaatcttctggatagagcagtgaagatggttgctgaattggatgaaccagcagagcaaaactttgtgaggaagcatgcactagaacaagctcaagcccttgggattgacgttagagaagcagcaacaagggtcttctccaatgcctcagggtcctactcctcaaacataaacctggcagtggagaattcttcatggaatgatgagaagcagctccaggacatgtaccttagccgaaagtctttcgcttttgactgcgatgcgcctggtgcaggcatgacagaaaaaagaaaggtctttgagatggctctgagcacagcagatgccacattccaaaaccttgattcatcagaaatctccctcactgatgtcagtcattactttgactcagatccaacaaacctggttcaaagtctaagaaaagatgggaagaagccaagtgcatacgttgctgacacaaccactgctaatgctcaggtgcgtacccttgctgagacggttcgacttgatgcaagaaccaagctattgaaccccaagtggtatgaaggcatgctgtctactggatacgagggtgttcgcgagatagagaagaggctcactaacacagttggatggagtgcaacctcaggccaagtcgacaactgggtgtatgaagaagccaacacaactttcattcaagatgaggaaatgttgaagaagctaatgaacacaaatccaaactcctttaggaagctggtgcagacattcttggaagccaatggacgcggttactgggagacttcagaagacaacattgacaagctcaggcagttgtactcagaagtggaagacaaaatagaaggcattgatcgctga

SEQ ID NO: 81987 - DNA, 216 bp, Glycine max
  Peptide Sequence Number=SeqID_173672
atggaggttaaacttgggaggattgatggggacccggtgttgagagaaacgaggatatgggctacatgggagtacatgagctcagttggaggtgggctacaggggatgagtggtacctggagatatgtcgcgggggtcaggagaccttggggacgtcaggtggggtgccattgcccaaaaccaagcttgaccaatcccgacccaacctgggcatag

SEQ ID NO: 81988 - DNA, 309 bp, Glycine max
  Peptide Sequence Number=SeqID_173673
atgggtggactaggagtaaagaatttgaaagattttaatgaggtcttattagggaaatggaggtggtctctttttcttgaagagggtagtttgtggagtgaggatttgaagaaaatttgtggtggtaatgggagagcaagatggttcgatgaaggaattgagtggaaagtagataaagattcccaacaaagtcgtgttcatactgtggagatccctgagggattgtttggcaacaaaagaaaatctattacgcaggaatatcatcatcaatcatcaggattctctttgttgtttatgcgaacttcatag

SEQ ID NO: 81989 - DNA, 207 bp, Glycine max
  Peptide Sequence Number=SeqID_173674
atgacaccatgctcattgcaacctcctacttcgacatcagcgttgacaatgttccagggaacccgggttgctaggttcaacaacttcaatggtggtggtagtggtgggggaatgtcagagttaggaggaggtagcaaggtgggaggcattaggggtagggtggagggtgttagaaagggggaagaggagagggttttggaagattag

SEQ ID NO: 81990 - DNA, 540 bp, Glycine max
  Peptide Sequence Number=SeqID_173675
atgaaaggggtcttcctccagcaccaccactgttggccaccgccaccatggaacctccgaagacccactagcaccagttcctccctctctttcatctccctggtccttcaaactggtcgtcagatcaactgggcccatctagttcggtactggatgcataaggcattatgggccaatgcacctctcccatatccccaccttgttactctttttcttcatcatttcaatgttcctttggatgatgaaccatatgtcaaggttaaaaggtctttctccattggtgtcggtgttgttacctcctttggttaccggaaggatgttgatggtcagtgggttcgcaaacaagacttgccaccacttattcctgacgaacgtaccccatctcctccaccagaaagggatgcttcttcttctctgctgattgaagtcctcacagagctccgcgcgatcttcaagcattggtgggtgagcattttgatgcgatggatactcgctttgatgggatggatactcgtatcactaggcttgaagatgatatga

SEQ ID NO: 81991 - DNA, 234 bp, Glycine max
  Peptide Sequence Number=SeqID_173676
atgtctgcttcaggcactgcagtttcagattcccttgtttctggaaaactggaagacgactcagaagatcagggttcttcaagaattggtaacgttgtcctgtcctgtagaaattttcttctctgctctatgttgttccgtctaagagttgcttcaatttccaaatctaatggaaccaaatcacctgtagaggactttccacacatacaaagcactagcaagaacaacaattaa

SEQ ID NO: 81992 - DNA, 561 bp, Glycine max
  Peptide Sequence Number=SeqID_173677
atggcctcttcaaattcattgtttcctgaaggaaattccatccataggccacctatctttaatggtgagagttaccactattggaaaacccatatggagattttcattgaagccatagatttaaacatttgggaagcaatagaaataggaccttacatacccaccatagtagatgtaagtactagcaccacaacacaaaaacctagagaagaagaatcagaagatgcagaagacttctcactctttgtgaagaagtttaaaaaatttgtcaagaagagaagaatcgagaggcgtcaaaacttcaacaatggaagaagatctcaagaagactctcaaattcttagatgctacaaatgcaaccaacttggtcacattaaagcaaattgtcccttaaatgaggaatggcctgagaagagtaataagaaaaggtatgaagaacgaaggactaagaaggcttacattgcatgggatgacaatgactcatccgatggtttagaaaaggagatcaaccttctaaccaaagactatgagagcgatgagagtatctctaaaaaagattaa

SEQ ID NO: 81993 - DNA, 216 bp, Glycine max
  Peptide Sequence Number=SeqID_173678
atgtcagcttcacgggaatgtcgtgcagaggagtataagacccatgaccaccctcgagacacaaacggcactgtcgcaacctacccttcgacgggagggcgacgcgtgactcacgggaggcgtgttccaagaatggaatacgcgcggagtcgccaccaatgtttatttgaggaaaacgtcggaaaaaccggaaaagacgtgatctacgaattctaa

SEQ ID NO: 81994 - DNA, 422 bp, Glycine max
  Peptide Sequence Number=SeqID_173679
atgacatgcgaggaaccatttggtcccgcaatttttcaccttttgtcatcagaggcggcggaggcggcgggctcgatgacatgcggagacaaattttggtcattccgcacaccttttcgccattcagacacagtcgtgtccgatggcactcagagactaacttcgtcttctgcgccttttgtcatccagagtcgtgtccgatggcacgcagagactaacatcgtcttctgcgccttttgtcatccagaggcggcgggcccgatgacatgcggggaaccatttggtcccgcactttttcaccttttgtcatccagaggcggcgagcccgatgacatgcggggaaccatttggagtagcgagtcgagtgataaacacgcggagacaaattatggtcattctgcaccttttgtcattcagggaca

SEQ ID NO: 81995 - DNA, 204 bp, Glycine max
  Peptide Sequence Number=SeqID_173680
atgcatgctttgttagggtcattgaacagtggaaactggtctgactctaaagtccttgatagtgcagggctgagttgtcgggctttcacgaggaatcagggtgtgataatcctggttgagtttagtcttacaagaggaatctgcaaacgatgcttgatcaggattaggctaaactatcatgaggaatcgaagtttggtatctga

SEQ ID NO: 81996 - DNA, 534 bp, Glycine max
  Peptide Sequence Number=SeqID_173681
atgtcttgcctagtgatcatagctccgatctccctctgccgaagtgtcagctggtgtatgccacccaccaggcaccctctagacccggataagtctaacagggccctggggtttccagcattgatcacgggcttctgccagtcattcggggttcccgtcacccctagtaagggggatgcacctcaggacgcagatgcaccatcgccacctcatcaggctgatcccgctgggtcactaggcatggagcgttatctacagcacttggttcgccagcaggcggccaaccaccgggggcaggtacagatacatgagtgtctctaccgcttcagccttagtcagcaggggcagggtttcgctccttttgcgtgccctactccagagcagtttagggctgaggttgtgtggcccggagattggcccgaggcccaggcaggggaggcgcctgtaggatcccctggcgatgcagagaaggcccgcatggatgaggagatgacggatttgctcggtttcttgggagggagcgaagccacatga

SEQ ID NO: 81997 - DNA, 244 bp, Glycine max
  Peptide Sequence Number=SeqID_173682
ctccagcaagggcatcaggccccctactaatcgagctttcatcaagaagtactgcgtctccaggcaggcgcagggcgaaacaccacagcagcctggggatggccggcagcgggcaacagacgcaccgccatcacctctagagttcacctctgctcatccacaaaaaggtttgagtattgtctacaccatatggccgaccaataggcgaccaagtccaaagccaaaggtagtgaaaataccttag

SEQ ID NO: 81998 - DNA, 195 bp, Glycine max
  Peptide Sequence Number=SeqID_173683
atggccttcatcattctcagattcatgcattcattccataaattagagattcatgcaaaagtcattacccaatgtcagtcgtttctttcacaattaagatcacactctcaccggatggctgtggatcatcaagaactggagctagagatgactgaggaacaggctctggtgatgctacctcctcctgagcactag

SEQ ID NO: 81999 - DNA, 114 bp, Glycine max
  Peptide Sequence Number=SeqID_173684
atggcatttttccaaagctacttggactgcaaggctcaaaacgcacaagtgactaatgctctcagaaatggaaacgtcgcgcacactccagaggtcttctcaaatatcccaatg

SEQ ID NO: 82000 - DNA, 462 bp, Glycine max
  Peptide Sequence Number=SeqID_173685
atgggcccgaaatctaccctaaggctcatgagaaccctaaggctttctcgtgcatctctggcacaatcttcttggagtcttctatccaatgcccttgcgggcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 82001 - DNA, 669 bp, Glycine max
  Peptide Sequence Number=SeqID_173686
atgtacaccggggcaggattttgcccggactgctgcagggaggcgagtgcgaatgacatgaccaccctgacccagatatggatgacgttgctcctcagcaacatcctgcccatcgatcataattccgacctccccatgccgaagtgtcagctggtgtacgccatcctaacatggatgagcatccatgtggctcagttgatcgctgatgccatctatatttttgcaggtatggcgcctactaggcaccctttggacccagataagtccaacagggccctaggatttccctcgctgatcacaggactctgccagtcattcggagtccccgttgcacctaccaaggtaattcggccgcccatcacccgggcttttattgagaagtactgtacccagagacaggctcagggtgatgctccacaggccgcaggcgcgccaccaccacctcatccggctggccaggctggggcatttgacatggagcagtatttacggcatttggttcgccagcaggcggccaaccaccgagcacatgtcgcatggcccggggattggcccgaggcccaagcaggagaggcacccctagaagctcccggcgatggagaagaggcccacgaggacgaggagatggctgatttgcttgacttcttgggagggagtggagatacatga

SEQ ID NO: 82002 - DNA, 198 bp, Glycine max
  Peptide Sequence Number=SeqID_173687
atgttgccaaagggggagagaacttgggagagcacatatgggtattgtcatcatcaaaaagggggagattgtagacaaaggatcaagctgaatgttttgatgatgccaaaggattacatgaatcatatgcttctcaaagatttactcaagacaaagcaattaaagatattcaagatggatgatcaagacaatctatag

SEQ ID NO: 82003 - DNA, 270 bp, Glycine max
  Peptide Sequence Number=SeqID_173688
gctaacggtggtgttgaaggttacggcgctttggccatgcaaggggttgcaacaataggacttgtacaggtttgtaggcacaaaagcttaatttttttgtggtgttctgcctttattttgttttctgacttctcccaatacaaaaagaaggtggaaaaacacattaaagttgcgatttttatctcaaaacttcatgggttcaggtttgtagagaaggtggaaaaacacattaaagttgcgatttttatctcaaaaacttcatgggttcag

SEQ ID NO: 82004 - DNA, 774 bp, Glycine max
  Peptide Sequence Number=SeqID_173689
aggatccccgtcctcgtcttcagaggactgcacgtcctcgccttaagagggttgcacatccttgccttcaaagggctgcacaccctcgcctttagagggctacatgtcctcaccttcagaggactgcacgtcctcgccttcagagggcttcatgtcctcacctttagaggactgcacgtcctcgccttcagagggtttcacatcctcgccttcaaaggactacatgtcctcgcctttagaggattgcacgccctcgccttcagaggattgcacgccctcgccttcagagggctacatgccctcacctttagaggactgcacgtcctcgccttcaaagggcttcacgtcctcaccttcaaaggactgcatgtcctcaccttcagagggcttcacgtcctcgcctttagaggactacatgtcctcgcctttagaggactacacatcctcgccttcagaggactacctgtcctcgcctttagaggactgcacatcctcacctttagaggattgcacatcctcgcctttagaggactgcacgtcctcgcctttagaggattgcacgccctcaccttcaaagggtttcacgtccttgccgtcagagggctacacgtccttgccttcagaggactgcatgtcctcgccttcagagggcttcaagtcctcgccttcaaagggctacacgtcctcaccttcagagggctccacatccgcgcctttagagtactcaaggtcctcttgttcatatctggcaagtgcactggatcgcgcaaatag

SEQ ID NO: 82005 - DNA, 348 bp, Glycine max
  Peptide Sequence Number=SeqID_173690
atggtcattattgtcaatgcggaagcttgtggttacgtgagcctgaactactaccaatatatagatgttgtttatacaaatgagcacatcttaaaagcttactccccacaatggtggcctcttgggaatgaagcggctattcctccttctaatgacgcatggacacttatccctgacccaactacaattcgtgcgaaaggtcggccaaaatcaacaaggataaggaatgagatggattgggtcgaaccatctgaccaccgacaaaaatgcagtagatgtggagccaaagggcataacaggcgtcgctgtccaatgcaatctgagcgtgcgagttgttcaaatcattga

SEQ ID NO: 82006 - DNA, 300 bp, Glycine max
  Peptide Sequence Number=SeqID_173691
agcttcaaccttagaggagacggaccattccaagtgttggacaagatcaacgacaatgcctacaagattgacttgcctaatggaggagccttggatttgaggacaaatcattttcaagaaggagggagtgatgaggacataactaagggcaaggaccatgaagcacttgaagggcccatgaccagaggcaaacttaaacaggcccaacatagtgatgaggacacaacaaagggcaaggaccatgaagcacttgaagggcccatgccagaggtagacttaagcaggcctaacacgtcatag

SEQ ID NO: 82007 - DNA, 370 bp, Glycine max
  Peptide Sequence Number=SeqID_173692
ttgttgcttctatatctatatctgctaatctgaattcggttccagttcttaatggtgcaaattttaaggactggaaagagaacatgcaaattggtcttgtctgcatggatctaaaccttgcattaaggattgagaaatcactttctcctacggattcaaaggaaaggttgaagcaagaaaggactaaaagtgctcatgttgtgagtacctctaaagacaatggcgaaagaaaaaggactgaggaccccaagaatgaagctgctaagggtccagcacaaaagaaacaaaatcaaggtgacaattgtttcttttgcagtaagcctgggcatataaagaagaaatgtaccaaatgcttggcacgcaaagaagg

SEQ ID NO: 82008 - DNA, 216 bp, Glycine max
  Peptide Sequence Number=SeqID_173693
atgaccaaagttaagcttggagagattgatggggacccggtgttgagaggaatgaggataagggctacgtgggagtacgtgagctcagttgaaggtgggcaactggggatggtgggtttatgcgtgatttgtggatgtggagagttgttttgcaccatcgcccgatcgccacctagtaccacatgtgacgggtaccccataatgctacaagcttga

SEQ ID NO: 82009 - DNA, 423 bp, Glycine max
  Peptide Sequence Number=SeqID_173694
atggcatctaggaagagaaagagcattgcttctatacctacaactcagtatgattccagatacacggacaacattctcggccgaaatatccttccagagagaaatgttaagatttatcatactgagttcgatgagttcaaagtggagttagagaggcgtaatctacacaaacgcctcaccaacctccaagatggaagcatagacgtggttgtggttaaggaattatatgctaacttatacaccctagaggaccaagctccaaagcaagccagagtaagaggacacctgatcaaaatagatgcagacagcctgaatgagtttcttcaaactccagtggtattagaggagggggaatctttacccacctactctagactttgcaggttgaggtctaatcctcaagagattgaagctaggctctga

SEQ ID NO: 82010 - DNA, 315 bp, Glycine max
  Peptide Sequence Number=SeqID_173695
atgccgcgcgcgctcgaaaaccttgccctgcctcttctctttgtcaccgtgaaatcactcttctctttctcgtcccgcctgaaaactgccggaaaccgctccctcgacacccacattgtccttgctcaaacccacagaaccccctacactgccggaaaacccacattctcctcgcttgaacccacagaaccccctacactgttcttggaagtctggctcaaagaaaacccaacatacactgttgctactagggtgctgaaacagtcgtgggtgctcaaagctcaaagctttctctgcgagttgcagtattgctga

SEQ ID NO: 82011 - DNA, 195 bp, Glycine max
  Peptide Sequence Number=SeqID_173696
atgatttggaatgtccttccagactatatgaagttcatggaatttctagctaaaagtcctttcggtaagcgcaagcctcacgctaagcgcatcattgttcatgcactaagccgtgagtctcaagcgcttagcgcccaacccttgcatctgaggctgatttggtctgctaagctggccaaggttgagctaagctaa

SEQ ID NO: 82012 - DNA, 923 bp, Glycine max
  Peptide Sequence Number=SeqID_173697
atgtaccacactgagctagatgcttggaatcggttcctttatttgcctgagagaaaggtggagctctaccacattgagctagatgattttaagactgaattggagaggcataattttcataaacgcctcaccaatttggttgatgggagcatagacttggctttggtgaaagagttctatgcaaacttatacagctatgagggcccttcaccaaagaaagccagagtcagaggccatttagtgaagattgatgctgacagtctcaacatatttttagagatacctatggtgttggcagagggtgagactttgcccacacactctagatactgcaggttgcccatagagtacagagagattgaggctgccttatgcataccaggccgaggccttacttttgagcgcttgagctcggtgattaacttggcctacatcaggaagaagtgttggaatcctgaggatcaaacagtttctatccgaggggctaggagggtggtggcgcctccaggatccattcctttagttgagcagttttgggagatggtagcctggcatgaggcccaaccttctcttcatagggaagatgaaggtcccatagcccaggtaccacaggatgtggaggatgagtcatctgaggccactgttccagagccattcattgtaggagaggaggctggtgagacacaagtgagacaggtagctgcagccactcctgagagatctcttaaggccacttcaaagactcctgcaccaacggtggatctatcctcgcctcagcatgcagcaaaccccttcacttctatcctagagatacacgaggacctgactacaccagtcctgactctggacacttctcctccagctactctagtacttcatctgatagatgaggaggatgttcagacattggatactcaggacca

SEQ ID NO: 82013 - DNA, 313 bp, Glycine max
  Peptide Sequence Number=SeqID_173698
atgactagaggaaatccatctgacttacaaccctttgatcctgagatagatagggcatttcatagattagttagacatcatttagtaccttttgagcatcttgagcattctgatattggtgattttgagcattataattttgtacattctgagaatatggcacaacctccaccccgtgagaggactctaagggaaatggttgcacctgatttcacctacgaaagcttgtgcatccaataccctgatgaggatgtccaatatgttcttaaaactggaaagatccatttgcttccaaagtttcatggccttgcag

SEQ ID NO: 82014 - DNA, 303 bp, Glycine max
  Peptide Sequence Number=SeqID_173699
atggcaagtccgatgacatgcggcggttccgtatggttatccgcacctttcgtcaaccaaggcgaacaagttcgatggtatcgggatgatgttggacttcctcccatttcctgggcatcttcccatgagggaacatggttcctcaccaacaaaatgagtggtgctacaagtataggaaaatatgggacaaaccttttgcaaaagtttgttaagtcatggaagccccaaattttccttatagttggtggagtgggccactcaggaatgaacttttttctcttagggttcgtgggaaccccttga

SEQ ID NO: 82015 - DNA, 237 bp, Glycine max
  Peptide Sequence Number=SeqID_173700
atggataaccgtaaggtgtctccgcatgctaccggattttgggtcatgatagcaaaaggtggggtggtcgacaaaagcgaggcttttgctcctacgtatcctcaatttgtgatgaggaactcagatctacgtgcggataaccgtaaggtgtctccgcatgctaccggattttgggtcatgatagcaaaaggtggggtggtcgacaaaagtgaggcttttgctcctacgtatccttaa

SEQ ID NO: 82016 - DNA, 405 bp, Glycine max
  Peptide Sequence Number=SeqID_173701
atgatcatctacaatagcctaactaatgagattaccatcacccatcttggcactaaatttttgttgcatcctcaaacaccttcgcaagtagcgaaggatcaagtacaaataaaactcaaatgggatgaggaaaagaatataaaaagaaaaaaagaacaacctttaatggttaaggaggagtgtaaggaggtaagtgtcgcctccaagaggttagctaagaaggaaagtcattttgcaataaagacaaacattaaagaaatttccgttcttagacaacctccacatcttctcctttgtaaaagaacccttgttagaactatcatatctcttgagcttgaggttattcctcaagctacggagatttggatgacgccacttccagtgaaggaagataagtcagggtag

SEQ ID NO: 82017 - DNA, 276 bp, Glycine max
  Peptide Sequence Number=SeqID_173702
atgtccacaacgcatttggtagtaagcatgaatgaatggcctaggatcatggaaatatttgagtcctcctctatgtccacgatcacaaagtccacagaaaagaattctctgaatcacagcactagaattcctttctacgataatgctctcattgttgatgtgcttttctttcttcgtgaggaggttcttcaaaatttagtgtacatcagcatttgttgtaggacttctccaaaaggaatggtgatctccagcttcttaaaaatgtcaagaaaatga

SEQ ID NO: 82018 - DNA, 876 bp, Glycine max
  Peptide Sequence Number=SeqID_173703
atggcatgcaaaccgaggcaggattttagcgttgcaaagcttgggaggattgatagggacccggtgttgagagaaacaaggataagggctacgtgggagtacgtgagcccagttgaaggtgggcaacaggggatggtgggtttatatgtgatttgtggatgtggagaattgttttgcaccatcgcccgaccgccacctagtaccacatgtgatggagtggtacctggagatatgtcgcgggggtcaggagaccttggggacgtcaggcgagctcctggcagtcaacagataaaaggaactaagaccacaaagcaaggaggcttgcttaaaagtgaagacaggaagctaagatggcctctggtaatcgattaccaaggggtgcttagaaatgaaggcagcatgttgtggaggcctctggtaatcgattaccaggctgtgcaatcgattacaccggggaacatgccactggtaatcgattaccagatcgtgatggcagcgcagctaatccatgatcgagtgaagatggagtgcctagagggagcttgggagaccctcaaaggcaacacgaggtgcagatttcggggcacgattcgatttacggctacttcattgtggatactacccacgcctacaccataccgtctagtggagccagtccaagtgattaaggtaacgtcatccgaggaagaccctgaggaggatctcgaggagctacctcctgagcctgctgtggatgctcttgactttccagagggtgatgaggacccactccctaaggtggattctcccgaggacgtcatgtcggcatccgaggcagactctacggaggatagtggccctggagagatggcgattagtgaaggctcttcatcatag

SEQ ID NO: 82019 - DNA, 624 bp, Glycine max
  Peptide Sequence Number=SeqID_173704
atgaacttggtgtacattatctcaactcagatttctatgatagcccagcacgacttctcgaggcttggtttcccagcccttattaccgccttgtgcaaggcctggggagtcacatcagattcactgttcttcgagagtctcagcccatccattaacttggcatacgtgaagaaaaattgttggaaccttgatgacccctcgggcaagaggtttgaggctccttcatcttctcctctccctacctatgctccttttacatttgcacccgcttcatcgactcccgcacaagcttcagctcccactccttcaggaccttccacagttagctccaatactttacctgccatgttgcagatccttcataaaggccaggcctccgcagcccaagagcctgtgcccgaggatgaggacgagtctctcccccctgagcctttcatttatgagccagacacaaagattgctcaggaggaggcaccatcaccagagcttattcctcagtcatcaccatcaccagctttagtccttgaagacccagagccatctgcaccagcaccgatacctgatcagcctcttgctcaggaccctctagctgcactaatgttggacttgaatgagcatgcatag

SEQ ID NO: 82020 - DNA, 737 bp, Glycine max
  Peptide Sequence Number=SeqID_173705
atgactgcaaaagaaactaataagaaagcagctgaagaggctaccacatttgttgtggatggagagccagtgccagaggaagtcattattgatgaagatgatgtcaaacgcttagaggctatttatgaaccattaacttatgacaacatttccaatgtccaagaaggtctagaacataggaaagtgatacaagtcactgcagaacccatcagattgtcccctatctttgccactcttgataggcatctgacaagaatgttgtcctttggaatggaaaacatgaaacaaggtttagagaagcgaattggatattgggactcaggattccccgggattgatccttccttttatccaattttggacaacctacctgaagaggagcaacctgctcttagtgtctatgatgtagatggaccagccattcatatgcttcctcctcgacagactgctactcctaatcccaacaacattatctacatctacgaaccaagcacaatgagcttaccaaaaccctcttttgcacaagcttttaagggtcatgcctttgctaagaatgaatctcacaaatggtctctgattggtgatttcttctacaagaaaccatctagatggaagcctcatcgctttcatatgactcctggtagcccacttaccatctcttctaacttcaaagactctggtgatgagttcttgaggaagtttgatgaagaagctgccaaacaaaagggaagaaaaat

SEQ ID NO: 82021 - DNA, 1422 bp, Glycine max
  Peptide Sequence Number=SeqID_173706
gttgataaagatgcactagtagaagttgacactcgttctggctgtcattctggtactaaggatattattgaatgtaatgatgaacatgttggaaagtcagtatcaaatgacctggtagatgatagtcaaaaaacctccgcccttgaagatttttgtaagaaaagtgaactaaccgaacctcaaacaagaacttccaatgaggaggaccaaagtcattttgctttgagtaagagactaagagctaacaactggtttgaggcctcactttgtggtcatgaacttaaagcaagtatgggtttggttgctgttgccaaggtttttgaagcacatcggatatttgcagaagaatttggaagttctgcattatccataattaagaatgaaaatcttgttctgaagttcagagagaggtatctgctatgggaaaaggttgctcttcttgtacttggaatgactgtatttggtttagacttacctattgagaccaaagatacaattccagtgggactggatgatacaattgatcacactgatagtgtatcaagtgaggaggtatttgtagattctgagtctgattgccaaacttctgttgttgagccatctccaacatgtgttatgcccatttccaaattcattactatttcacaggtaaccactaccattggattcgcttctccaaacaaggttaattcctatagtgttcatgggagtgcattaggtgctaaagaagttgatgctacaaggaagaatcttggaaggccatacgagcttttccatgtgctagaagatgtcaagaagcattggagtcgccatacccctgagggtgctaagtggaatgaaactttctttatttttcatgatcttgaagctaagtggaatgccaagtttgtggaatatgagaagaaatacagtgaggaagctgcagagcttaaggctattattactggcgaattaccagctagttgggagaaagcactttcgccaatagagcatttggcaagcttcagggcaatgccaaacactttgatgcttcgtccaactgatggtaatgaaactgttggatcatacaaagttgttgtggttaacaggaagagaccctcaattgttgcactttgtaggcaaaagttgacccaacttccaggaacatctattgagggagttgaaaagggtggctacaccatttcagacaattcatcaggaaggaaaggaaaagctgttacaattgcttcttttgttagttgggaactttttgatgagcagtcagatgaatacaacgagagtcttctacctgcttcagtaacagctagagttagcattgagacaggatcaacatttggttgccacaacattgttggaagcaaaggaaaggagtttggtatcaccaaggaagctgttattgctgctgccaaagaacttccgtag

SEQ ID NO: 82022 - DNA, 427 bp, Glycine max
  Peptide Sequence Number=SeqID_173707
atggagaacatttctcttaagagcttgagttttggtcctccttgtgcgaaaggaggctcttttctactctccttgttgttctttgggttgttactagtgtggaaaactcctcccttggagccaaagttcgtctttttctcctccatcttcacaaagctctctttttcttctatagagagcggccgccaccgcggtggagctccaattcgccctatagtgagtcgtattacaattcactggccgtcgttttacaacgtcgtgactggggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgg

SEQ ID NO: 82023 - DNA, 1170 bp, Glycine max
  Peptide Sequence Number=SeqID_173708
atgcatgctttgttagggtcattcaatagtggaaactggtctaactctaaagtccttgataatgcaaggctgagttgtcgtgctttcacgaggaattgggaggaggggggagagctacctttatactccagattctgtcgtctgaggccagatccacaggaattggcagcccgattatgcatccctgggaggggatttgagctgaatgcagatgggctgcccttgaagatcctgaggaagaacctgaccactctcgctcagacatggagtgttctttcattctcgaacctagcccctacttctcacacttctgacatcacactggatagggccaggttgatctacggcatcatccagaagatggacatgaacttggggtatattatctcaagtcagatttctatgattgcacaacatgactcctcgaggctggatttccctacactcatcactgctttatgcaaggccaggggagtcacttcagattcactatcttttgagagtctcaacccagccattaacttggcatacgtgaagaaaaactgctggaaccttgatgacccctcagtcacttttagagggccttgcaaggccatggggaataggtcagagactctcctatcttctaagattcccccattagcagctccttctactatagttccagcttcttttgccccatctgcatctgcacccttaccagctcctattataactcctcctacaggaccatcttcctttacttcagagacattatatgctatgttgcagagcctgcacaaaggacaggtgatcatcatgaagcacttacagagctcaggcctgcagcctatgatgagcgtaaaggagttccttagccaggtggcttggcctggagtccagccttctccttcgggaggggataaggcctccgcagcccaagagcctgtgctagaggatgacgagcccgtccctcctgagccatttgtttatgagactgatccaactagtgctcaggaagaggtagcatcaccagagcccgttcctcacccatcaccagcaccagtccttgatgattcccagccatttgccccagcaccagtgcctgatcagcctcttgctcaggaccctccagctgcaccagtgttggaccttaacgagcatgcagaggatcatttgcagaatgattga

SEQ ID NO: 82024 - DNA, 1026 bp, Glycine max
  Peptide Sequence Number=SeqID_173709
atgtggttccctggcagttttcccttcaccagttatcccaaattcgtgaatattaatcagtgcacgcttcgtgttcgattaattgcctctgagcctaacttgcgttcatgcttaatggacgaagggctaactgctccagcacaacctcctcctgccaacaatgccaatcttggcatgaattccaacatggaaagaaaccctctagtaaagaagcttctggagttcaccctaatcccaatgtcatatggggacctattaccaacgctgatcgccaaccaattggcagtggtgacccttggaaggatttaccagtctcccttcccaaaatggtacaaccctaacgcaggatggttgactttccaagaagatgggccgaatgtgaagacgaatctgttcgccaaccatgagggatcagctatgaatgcaattgaggcgtgcagtttgcaaaggcctaagcatttaaaggacatcacaacctctaggaggtttatttttgaagccctacaagatgtaggcatgattcctctcggtgggcataagggggatccttgcttgatgcatccggtagacaagaaaagtcccaagaagcccaagcctttggtgatccatttcaccagagatgcggctccccaaaatcatcgaggcccttcaacgttgtcaggtagtaaacctgtccccttcccttataaaaacagcaaggtagtcccatggaggtacgctcctcagaagccgagcgagaagaaggaagaggccactgatattgactcattttctgccaaagtaaccaatatcactagactaagcggcatgacctgcagcggctgcatctttgcagtgcctaacctgccggtacgacctgcgaatgtcaaaggaaaagcaaaaatggtcgtggaagaggccaatgaagcaaactccaccctagatgaggatgttccaactgggaggtttgctaaaagaggggaaggtctcgatagaaaagaggtatccttggaggaggccaacgagttcctctatctaatccaatag

SEQ ID NO: 82025 - DNA, 471 bp, Glycine max
  Peptide Sequence Number=SeqID_173710
gttgcaggttttgtcatatgcgatggagcacatgagtctggctgctgtattccccaagaagaaacaacacatgaagtgaactatatggggaaccagccaagacacaatttcaatggacatgggagaaatcaccctggaaatcctttcaacaaagttcaaggtggaccatccacaaggccacgggaacaagggccaagtctctatgatcgaacatcaaagctggaagagactcttgatcagttcatgcaagtctctatgtcaaatcaaaagagcacaaagtctaccataaaaaatctggaagtccaagtgggacagctggctaagcaattggcagatcgaccattaagcatctttggagctaacaccgagaagaatccaaaagacgagtgcaaggctgttatgaccaggagcagattggcaaacaatgtggatgaggaaaaaactgagaagaagattgtggaagagaaataa

SEQ ID NO: 82026 - DNA, 201 bp, Glycine max
  Peptide Sequence Number=SeqID_173711
atgcccttctttttggagaccttgtttgggtttgccctttttgaggatacagacttagttttcttagaaaaggtagtgtggaagcaaagctacaatgatgattcaccaggatgttttgatgatgccaaagctcaaagagttgtttcaagaataaagaatcaagcattcaagattcctttcaaatattcaagaatcaaatga

SEQ ID NO: 82027 - DNA, 193 bp, Glycine max
  Peptide Sequence Number=SeqID_173712
atgagagcaaatgccttgttggccaagaaatctaagtgctactttggggttactcgagtagaatacttaggacattttatcactagagaggaagtctctactgaccctgctaaggctattatagaagccaagcttgcatttcagtgtcttaaggatcagttaaggcagacacctatattggcctttgatcaag

SEQ ID NO: 82028 - DNA, 549 bp, Glycine max
  Peptide Sequence Number=SeqID_173713
atggtggagtccatggtcgaggccatctccagcatcgagacaacttgcctccaacatttaaaattgagggattgttcgtcagctatatcttttccaggtggtcgtctacctgcatctctgaagactctggttatcagcaatcttaaaaatctggaattccctacccaacacaagcaccagttactagaatcactgtttctatataatagttgcgattctctcaagtctcttccattggttacctttccaaatctcaaaagtctcccaatcgaaaactgtgaacacatggaatctcttttggtttcaggggcagagtcatttaagagtctgtgttctttgagaatttcccaatgccccaactttgtatcattctggagagaaggattgcctgcgcccaatttgactgattttgaagttttgcattgcgacaagttgaagtcattacctgacaaaatgagtactcttctcccaaagttagaatatcttgacatatccaactgtccagaaattgagtcgtttccagaaggggggaattggagtttcacctag

SEQ ID NO: 82029 - DNA, 147 bp, Glycine max
  Peptide Sequence Number=SeqID_173714
atggtcaaataccgcgccaaatccgagacagagatgagtcgaggtacttggggaggggcacgaatggacgctaggcccatgatcaacagttcgttgtcccgcgtccagctccggacaatcgagaagcgctaccgggaggtagcctaa

SEQ ID NO: 82030 - DNA, 123 bp, Glycine max
  Peptide Sequence Number=SeqID_173715
atggtgggttacacaccttcaagctttgctgatttagttttcaccgacgaaaggatcaaaacaaggacaacccttcccttgtgttcaagaatcccctacaacaagagacccacggtatcttaa

SEQ ID NO: 82031 - DNA, 249 bp, Glycine max
  Peptide Sequence Number=SeqID_173716
atgttgctggttgaggtccttgacactgttttcccgacctcaatgactcgaccatctaaggttgagatgattcctccacccgggattgtacctgttgctggagagcataagcttcaggctattcaattgcttcagattgctgcacataagggcaaaggtctgtgtggtggtcggcagaggagcataaaccacagagtctggcgacaggtgcagattttttattcatggccagttgggttaccaggttaa

SEQ ID NO: 82032 - DNA, 207 bp, Glycine max
  Peptide Sequence Number=SeqID_173717
atgggacgagaaagagaacatgcaaattgttctggctacatggatctagaccttgcattaaggattgagaaacccccttctcctacggattccagtacctctgaacagaggaaacttcatgagaaatgggatcactcaaatcgcatgaatcttatgatcattaagcgtggcattcctgaggtttttaggggcactgttttcaaatga

SEQ ID NO: 82033 - DNA, 300 bp, Glycine max
  Peptide Sequence Number=SeqID_173718
atggccaaccttaccagcagcagaataaatggagaactcaccctggtgtcattgactaatcataagagcacagagtcagccataaaaaatctagaggtccaggtagggcagctagccaaacagcttgcagaaaaatcttctagtacttttggagctaacactgagcagaatccaaaagaagaatgcaaggctgtgatgacccaaggaaggaagctaaccatggaggagaagaagaaggagaaaatggtggaggatgacaaacaacagctagtaattgaaccaacacctaaaccagtgtaa

SEQ ID NO: 82034 - DNA, 226 bp, Glycine max
  Peptide Sequence Number=SeqID_173719
cccgcatcaattagaccttgcaccttacgctttaggcccctacaatgctcaatggaatgccccaaggcttctccgtgacaagcgcacgttgtgttcgagtcgtattctaggagaaatggaggttgatgaaccttggttggggctttctcgctgcaaaattcatttcttggttggtgttttggtttatgctaaaggtggtgtttgtcattggaagtgcggtaggtag

SEQ ID NO: 82035 - DNA, 246 bp, Glycine max
  Peptide Sequence Number=SeqID_173720
atggatgaacactttagagtatcaaattgcaatagtgcaaaagatatgtgggataccttacaagtaacccatgaaggaacaagaaatgaacacgaaatggaactgtcgcaacctacccttcggcgggaaggcgacacgagggctcacggtgcatcttccaagggaggaaggcgcgcggagtcaccaccaacgattattcgaggaaaacgtcggaaaaaccggaaaggtgtggtctacgaactttaa

SEQ ID NO: 82036 - DNA, 219 bp, Glycine max
  Peptide Sequence Number=SeqID_173721
atgactgtcaaggcagatcaaaagcacgcacaacagtgctacgcggaaagcttgaaagtggcactctatcctcccaccagggagcctgccaagctttaccccacagcagatgaggcccaaagcctactgaagaactcgtcaagctacaactcggacccaaactcgggtagtgcatgtagctcaacagggacctcaccagccatgagcacagacgcatag

SEQ ID NO: 82037 - DNA, 216 bp, Glycine max
  Peptide Sequence Number=SeqID_173722
atggacaaatctgataaaagaaatttcaaagaaaagaaagcatacatcacttgggaagataatggcatggattcttcaagtgattcaaaaaatgaaatcataaatttgggtctcatggccaaagactatgaaagcgaagaagaggcaatgtcatctaactatgacttatctatttcttttgatgaactccaagatgcattcaatgattttgcataa

SEQ ID NO: 82038 - DNA, 347 bp, Glycine max
  Peptide Sequence Number=SeqID_173723
caacttcatgtcgacgatgctgtcgatatgttggtggaattactcgaggtcagcgttgcagaggcaagagctgagacgattcaatgtcatggatcttatgttcgactattatggttgcgagatgtgtatcagacgaaaattgaggcatgtcactggatcggcattgctgctcttgtgcatatgtatgataatttaaatgaagcgccaaagagcacagagaggaaacttgtaggatatatcactctgttacaacgttggatctatgagcatttcccgtttgttggttccgccctagctgtcgaggattatgtcgagcggagaccacgtgcatgcctgagggacctctg

SEQ ID NO: 82039 - DNA, 282 bp, Glycine max
  Peptide Sequence Number=SeqID_173724
atggggactaaaacccctcaaacaatttcacagcatcatatcaaaatcaaaggaatcaaaatcatagggttttcaagcattagagagaaggagaagggattggagcctcaatttcactatctccatacgaggagcatttctctcttgacagacgatacgtcacaaatcccaatggtgggattgtatgacattaagtttcaaaggtttggctatatacggaaaaagatagggttttgggagaggaagaagggagaacgaacttgggagaaaaagagagtgtag

SEQ ID NO: 82040 - DNA, 540 bp, Glycine max
  Peptide Sequence Number=SeqID_173725
atggcgccgaccaggcaccctatggacccagataagtccaaccgggccctgggatttcccgcactgatcacaggactctgccagtcgttcggagtccccgtggcacctaccaaggtgattcggccgcccatcacccgggcttttattgagaagtactgcacccagagacaggctcagggtgatgctccacaggccgcaggcgcaccaccaccacctcatcgggctggcccggctgggtcatttgatatggaacagtatttacggcatttagttcgccagcaggcggccaaccaccgggcacatgtacagacccatgattgtctgtaccagctgagcctcagcatgcagagccagggcttcgcttctttttcatgccctactccagaccagttcagggcaggggtcgcatggcccggggattggcccgaggcccaagcaggagaggcacccccagaggttcccgacgatggagaagaggcccacgaggacgaggagatggccgatttgcttgacttcttgggagggagtggagctacatga

SEQ ID NO: 82041 - DNA, 491 bp, Glycine max
  Peptide Sequence Number=SeqID_173726
gaggaaaaataaagttgaaaacccctaaagaggcaactgaattgattgagaatatgtctgctagtgattatgccattttacgagataaagttgtaccatttgtggtgaggctcatgaatcaggtcattgcattcccattgaagaacacactaaggaagttcattacatgggaaatcgacagaggcaaggatacaaccaaggaggattttcagggtggaccttccaacatgccaccccaacaaaggccaaatatttttcagaggaccgccaaactggaggagacactagctcagtttatgcaagtgaccatgtccaaccataagagtactgagtcagccctgaaaaaccttaagatccaggtgggtcaactggctaagcagtttgctgagaagtcatccatcagctttggagaaaataccgagaaaaatcccaaagaagaatgcaaagttgttataacaagaagcaagaagcttgtggcggctgaggattag

SEQ ID NO: 82042 - DNA, 225 bp, Glycine max
  Peptide Sequence Number=SeqID_173727
atggaacgagaagagaaaagggaattgtaccggatacgttgttcttataaggaaaacaacgtaggagatgatatggagggaggaatttggcttgtctgtgctttggatgctccttggcttcgagttccggtgactgcggatgaagtcgaaacgccttttcgctttttcgatgggagaagtgctgtaatcgattacatagatcctataattgattaccagaactaa

SEQ ID NO: 82043 - DNA, 901 bp, Glycine max
  Peptide Sequence Number=SeqID_173728
gatccccgtggtcggaataccgaggaagcacttggaggagaaagcgaaggctttggcggatcaaggtgaatgggctttgttcattgatgtcttggcgctattggtatttggagccgtcgtctttccaactgtggatgggctagtggatctagcgacgattgacaccttccatacttatcaccatagcaaggaaagtttggtcatggctgttttggccaatgcctacgacacatttaaccggagatgcgagaagagcggcgcaaggattgtctgttgcacacccactctttatgtatggatggtctctcacctctttcatcatgaaagtagacctgtctatcccctacaaggtcaccacatttgccccgagaaagggaaggcgaattgggagcacctcttggccaatatggtagaggcatccgttaattggttcccccgatggaaggaaggaagagtcggggttttgtcctcatgtgaggggttctcaaacatccccttgatgggaatgaggggttgtatcaattacaatctcatccttgccataagacaacttggttatcccatgagaagagcatccgcaatgcaaaggaaggatagggagcttacgggaagcagcaatgggatcatcggcaactatcacaagtggctgaaaactaaaacacaagagttagattggctctcgaagctaaaggcttcaattgaggaagaggctaaaacccctaaggagagtgaggaggtgcaagccttaaaggtggaacttgaaagggcacaagaggtcaaggaaaagttcaagacaacggccatcaaggttcagaaagaatgcaacaaactgagaggcgtcaatgtggccaccgtcgaagcattggaacgggaaacaaagagggcccgaaaggaagaatag

SEQ ID NO: 82044 - DNA, 313 bp, Glycine max
  Peptide Sequence Number=SeqID_173729
gggatggtggttttatacgtgatttgtggatgtggagaattgttgtgcaccatcgcccgatcgccacctagtaccacatgtgatggagtggtacctggagatatgtcgcgggggtcaggagaccttggggacgtcaggcgagctcctggcagtcaacagataaaggaacaaagaccacaaagcaaggaagcttgtgtggtggctagccagctgcttagaaatgggactggaagattggaggcctatggtaatcgattaccagtctgtgtaatcgattacacagaggaatgggtcactggtaatcgattaccag

SEQ ID NO: 82045 - DNA, 357 bp, Glycine max
  Peptide Sequence Number=SeqID_173730
atgactgagacaagtatgcgagtagggaattatgatgtatatggattcctcgagccacagtccatccagagatctgggcaatcacaatttgaatcagaaagttacatgaagaactggatgcagaatttgaaacgggatgtctacctagaagcctacttgaatgggccagcatccatgtttgtattcaacaactctttaaaaggacttgacgatactccacaacctaaatccaaggctggagctaggtggattgttgttaaatattttaatgatgttagaccattgaaatcagagagattgaaggcacttcgcatccagtgggtaaagtattatctcaaagttagaagtgaaacttag

SEQ ID NO: 82046 - DNA, 201 bp, Glycine max
  Peptide Sequence Number=SeqID_173731
atggtggtagctttcatggatgagattgatggggttcagattcacctttctagcttggattacctcacttggagggctgatcctactgggtcttattccacaaagtcagcatacaacctcttgatggatgatggcagttctgataatgaagacaaaaacagcaagtgttggtcacgtcatgttctcttgcacaagaaatag

SEQ ID NO: 82047 - DNA, 417 bp, Glycine max
  Peptide Sequence Number=SeqID_173732
atgaagaatcatccctctgaggaggtggtgatggagagcggtcttctgcgacctacactggagcgtctctcttcacccaagacccatccctctctttgtggcatcagaaacagaaaaattgaacttccactcatcatcaagtgtaccctcaaatggtacaccatcactggaaaattgcaatcaaacactttatcatcaaagaaggataagtccacaaagttagggtcaataatggaacgagaagagaaaagggaattgtaccggatacgttgttcttataaggaaaacaacgtaggagatgatatggagggaggaatttggcttgtctgtgctttggatgctccttggcttcgagttccggtgactgcggatgaagtcgaaacgccttttcgctttttcaatggttctgccatttga

SEQ ID NO: 82048 - DNA, 1419 bp, Glycine max
  Peptide Sequence Number=SeqID_173733
atgggcctagttctgccagactcgcagagacccttcttgggagctgaaaagacgaagaagaagctggaggaagctgcacagtcaggaagcattgatggcgtcatcgacccttcatcccccgtcagacgccacgtgaagtggaagatggcccataccaagaaaacaggggagatgacgactgaggccgcaaaggaaatcgctgagaagatcgggacacagggatccttcatcccccatggacgtcaggatgttctcactgctgctattggacgtccagagcaccttggacgtgtctgtgctgctggagccggggtcaccatcaagcaatacttcggatcggctccacggacgtcccgcagctcatccttcttgcctcctgaagaattgcagcagttgacccagcaaatcagggaccaactagaggagtcgatcacagaaaaagtgactcggcagctcatggcattgttcagccagatgcagtcccagatgcaatctcagggacttgcactgcctcctgagcctttggttggtccctcaggtcctcgagtgagcacaaaggggagttgtattgatctctcaggaaatgatcctaagacaggtgactcagataggtgcggcttgtacatcgaagcaaatcctgtccgcttggttgccctggggagtgtttatgagggatccattgttgttcataacactcctttgttgcctggccaagtaaaggtgggtatggaggaggttaaagatgcagatgctccagttcctgtacccattgttgaggccgacacatctggtcaagtctttatcacagcagctgtgtctccggaaaaaccacctcaaaagcttgatccggtggtagatgatccgctttatctaatgacattgaccatcccagagtttttcttgaggccttaccaggttacatgggatgccaccgtgttcggggtctttaatccagacttcccgctctacataaagcacgaagacctctctgaaattgcacacggtgggaatttggatatctatggattccttgagccacaatccattaagagcgaacactggcagatggtggccattgtgcccaaggaacaccgagttgtttggtttagttcattgcatattaggctagacagctaccttaaggaaataattaacagtgctttaaaaggtcttgatgatgctccacagcctaaatcaaaggttcctgctaggtggattatcgtcaagtgtaatagacaaaaaggaagtactgagtgcggctattgtgtcatgcaatggatgtccaccattattttaggaagtttcaggaataactgggaagcgtattttaacgatgctagaccattggagccagagagattaaaggcgttgcggatccaatgggtacagtattatcttcgagttaaagatcagagctag

SEQ ID NO: 82049 - DNA, 528 bp, Glycine max
  Peptide Sequence Number=SeqID_173734
atgaaatgtgctgccattggcaatggcctattcactcaaaccaccccagaagtttgtagaatttttttagagaatgaccacaacttgccagcagttaaaattgtgtatgaggaccttcaggctcagtaccaatcatccctcactgctgcagtgatagctctcaacagcaaaaggaagcatgcttcctatgaggttcttggttacttggttgaggagcttcgggacgtggtgacgtacaagaccttctacaaggacatagaggatgccaacatcttcatcgggtccttgatttttgtggaggagcttgccctcaagataaaggttgcagtggagaaagaaagggaaaggcttgatgcagttttggtgtttccatcaatggctgaagtaatgagactcaacaagttgggttccttcagcatgtcacagcttcgacagtcaaacaacccctttttccagctcatcatccatttctatgtgaagcagcagtattctatgtggtctttcatatcttcattgtatgcccactaa

SEQ ID NO: 82050 - DNA, 907 bp, Glycine max
  Peptide Sequence Number=SeqID_173735
gacacacgtcctcgccaacagaggactacacgtcctcgccaaaagagggttgcacgccctcaccttcagaggactacacgtcctcgcctccagaggactacacgtcctcgccatcaaagggctacacgccctcgccatcagaggactacacgtcctcgccaaaagagtgttgcacgccctcaccttcagagggctacacgccctcgcctttagagggctacacgccctctcctttagagggctgcatgtcctcgccatcagaggactacacgtcctcgccttcaaaggactgcatgtcctcccatttataggactacacgtcctcgccatcagaggactacacatcctcgccaaaagagggctgcacgccctcaccttcagagggttacacgccttcgccttcagtgggctgcacgtcctcaccatcagaggactacacgtcctcaccttcaaaggactgcacgtcctcccatttaaaggactacacgtcctcgccaaaagagggctacatgccctcaccttcagagggctacatgccctcacctttagagggctgcatgccctcgccttcagaggacaacacatcctcaccatcagagggctacacgtcctcaccttcaaaggactacatgtcctcaccttcagagggctgcatgccctcgcctttagagggctacgtgtcctcactttcagggccagtagtttccttttatcagttccttttcctgggccactcgctgatctcagaggagggccaaatgtgcgagcacaaccagagggaggctatcacgcagctactgtgcataccggggcaagatttgacccgtgccactgcaaagagacgagtgtgaatcatgcgcaccaacatgaccactcttacacagatatggatgacgttgctacttag

SEQ ID NO: 82051 - DNA, 474 bp, Glycine max
  Peptide Sequence Number=SeqID_173736
atgtccgacatcgtggatcctgcacactctgttaaagatataacagatttatgtgtccagtattttcgagccggatgtcaggacatcgtatccgacatcgtggatcctgcagcttcaattcttcatttgacattttatcttgccttgtgcattgtacgagcagttatgcaagtgggatcagcaactttcattatcagagtaatcaagcacagcggaattggtaatggcgacagcaaaattctgcaagttgcaagtcgtttccaggatgtcaagacatctcacgtgacatcagctttctgctccccctgtctccatgctctagctgcagcatcttctatcagctactcgtcttttccaggatgtcaagacatctcacgtgacatccgctttctgctccccctgtctccatgctctagctgcagcatcttctatcagctactcgtagttacagtagcttacatcagtcatcattag

SEQ ID NO: 82052 - DNA, 195 bp, Glycine max
  Peptide Sequence Number=SeqID_173737
atgttgtttgccatgcttgacataatcacttccaatttgggagatcctatatgggccattagttctgacacattgaactctcttgtgggtctttctctcaatttctttttaatattgcctttcatcaactttgggtttatagggttcatgtatggggttgtgggtgtggtttgtcctgttgagccaggtgcttga

SEQ ID NO: 82053 - DNA, 366 bp, Glycine max
  Peptide Sequence Number=SeqID_173738
atgtaccctcccttgttctctttgaacaacctagtggatgtaacctccactagaactgatccacaagagatgtaccctctcttgttctcagtcacaataacccaagtagatgtaccctctacttgtaccacaaaggatggtacatcctttttggtacaagtagagggtacatctacttgggttgctgtgactgagaacaagagagggtacatctcgtgtggattagttctagtggagggtacatccactaggttgatcaaagagaacaagggagggtacatccctagtggatctttgcttgtaaaggaatttacaaggttgaaaagaaatctcaacgactgtaggtcgcttggggactggatgtag

SEQ ID NO: 82054 - DNA, 120 bp, Glycine max
  Peptide Sequence Number=SeqID_173739
atggctatcgacggcactaacaagtcagaggacttatcgttagcggcatgtgtgacgagggtggatagctccactatttgttgccctaactccgtaggcattgctttctttcttggttag

SEQ ID NO: 82055 - DNA, 387 bp, Glycine max
  Peptide Sequence Number=SeqID_173740
atgccttccaagattattttgatgatgccaaagaatcaagagtcaagcaagttccaaagaattaagattcaagcaagtttcaagaatcaagatcaagattcaagactcaagattcaagaatcaagagaagactcaatcaagataatgtacatcctttgtggtacaagtagagtgtacatctacttgggttgttatactaagaacaagagagggtacatctcttgtggatcagttcaagtggagtgtacatccacttggttgttcaaagagaacaagggagggcacatcccttgtggatctttgcttgtaaaggattttacaaggttattggaaattcaaaaaccggtggttgcttggggactggatgtaggcacgggtggtggttga

SEQ ID NO: 82056 - DNA, 708 bp, Glycine max
  Peptide Sequence Number=SeqID_173741
atgatttatggaataattctgaggatggacatgaatgtgggctacttaatttctgatcaaatctctatgatcgcccagcacgactcctctaggcttgggtttccaaccttaatcactgctttatgtaaagctagacgagaaacttttgattctaggacgcaggagagtttccgccccgccattaatttggcatatgtgaagaagaactgttggaatcttgatgatctaacagtgactttcagagggcctaggaaggccaaggggaagaaatctgagactctcccatcttctcaggttccccctaccacatcagctccttccacatcaacaccaacttcttctaccccagctacttctgctccatcaccagctcagctaccatttttagctccttcttctggaccatcagatttttgttttacaccaaagatgctacatgccatgatgctgagcctacaccgagggcaggtggcttggccaggagtccagccttctccttctggagggggtgggacctccgcagcccaagagcctgagcccacagatgagcatacaccagcagcagaggatgagctcgcttctcctgagcccttttcttttgcttctgattacgttgtggctcaggaggaagtaccttcaccagagcctattccagagccatcccctgcacctatctctgaggataccctaccatctgtgaatgcatga

SEQ ID NO: 82057 - DNA, 577 bp, Glycine max
  Peptide Sequence Number=SeqID_173742
gtcgcagaagacgacgttagtctctgcgtgctatcaggcttttcatcttacagacagcaaaatgtttatacggataaccactcgggtatttccgcctgtcagcgtggcacagaagacgacgttagtctctacgtgctatcaggcttttcgtcttacagacagcaaaaagtttatacggattaccactcgagtattttcgcccgtcagcgtgactcaaaagtcaaagacgacgttagtctctgcgtgctagcaggctttttggcttacagaaagctaaacgtttatacgaataaccactcaggtatttccgcccatcagcgtgtctcaaaagtcagtatgacagatcttgtgagcgcggaagataacggcacagaagacgacgttagtctctgcgtgttatcaggcttttcgtcttacagaatgcaaaaagtttatacggataaccactcgggtatttccggccgtcagcgtgactcaaaagtcagtatgacagatcttgtgagcacggaagatgacgtaaatctccacgtgtcaacgggcttgtcagccgcgattgacgaagggcgcagaacacgac

SEQ ID NO: 82058 - DNA, 147 bp, Glycine max
  Peptide Sequence Number=SeqID_173743
atggatacaagtaacaggccactggtaatcaattaccagtcatgtgtaatcgattacacagtgtatggtgcaggtttccatgttctgaagctgtgtaactcgagtttggcctcagtggttatgggacgcattgtgttgctaccgtag

SEQ ID NO: 82059 - DNA, 298 bp, Glycine max
  Peptide Sequence Number=SeqID_173744
atggaggctagcctgttcattcctagaaaaggctttgttctaaatgctgagggccaaccatggaagctcctcaggaaggatcttactaccttggcccagacatggagtatcttctgttactccaacctagctcctacctcccaaacctcagacttgaatatggacagagctaggttggtttatggcttagtcacagggatggacatgaacattggcgacttgatctctgggcagataaccattatggctcagtccaactcttctcgcttaggcttcccagctttaatcacaaccttgt

SEQ ID NO: 82060 - DNA, 585 bp, Glycine max
  Peptide Sequence Number=SeqID_173745
atgggaggatattcagctgacaaggacagtgtggatgacattgtttgtgaaagatacgacattagcaaggagaaatgggcccagttttgtcagacctgcagagacccctcctgggatgatgtgcggaaaaaggcacaggccatccagaagcaaaacaccgccctccacgtgttgtctcgtgggggttatgaatatttagaacagaagctgatggctgagaagacaaaaaaaaaactggaggaagctgctcaatctggaagcactaagggcgtgattgaccctccatctcccatcaaacgacacatgaagtggaagatggcctgcaccaagaaaactgggcagatgacgtctgaggtagcgaaggaaattgctgaaaagattgattctttggaggagcaggcgtcacggggttcgtttgtcccccatggacgtcaggatctcctggctgctgccattgggcgaccagaacaccctggccatgtgcgtgctgttggagctgatgtggccataaagaaatactttggatcggcttcacgaacctcccgagttcttcctccatggctcctgaagaactcgagcagctga

SEQ ID NO: 82061 - DNA, 543 bp, Glycine max
  Peptide Sequence Number=SeqID_173746
atgaccaccctagctcagacatgcagtgttctttccttctctaacctgattcccacctcccacacttctgatgtcactctttatagggccagagtcatctatggcattattatgaagatggatatgaatgtgcggtacctcatttcctaccagatctccctcactgctcagcatgacacatccagacttggattcctggctaagggagttcagtatgattcgagatccttggagagcctgaatcctgccattaatttggcatatattaagaagaacttttggaatcttgatgatccaacagtaactttcagaggacttaggaaggccaagggtaagagatctgaggccccttccacagcaccatcagaggcaccgacaccttcttcttctacacttcctccctcttcctccacagagatcccagtgattcctccagcaccttcacagattccacttccagctctagtctctacaggtccaacagattttattttcactcctcagatgcttcactccatgctccagagcattcatagggggtag

SEQ ID NO: 82062 - DNA, 438 bp, Glycine max
  Peptide Sequence Number=SeqID_173747
atgtcaagattcatggcctcctcaaattctctgtttcctgaaggaaactccatccatacgccacctatctttaatggaatagatgaatattttagagtgccaaactgttcaaatgcaaaggagatgtgggatactctccaacttacacatgaaggcaccactgatgaacatgaaatggaacttcaacgtctcaaccaaaatgaagagaccgacaaaaggaaaagaagcataccactcaaagtctcctcctcaatgcaagaagaagaaaaagaagaagaatctgatgatgaagaggacttctcactctttgtgaagaagtttcataaattcgtcaaaaatagaagaatggagaaaagccataacttcaacaataggaagagatctcaagaattttccccaacacttaaatgctataagtgtaatcaaacggtcacataa

SEQ ID NO: 82063 - DNA, 666 bp, Glycine max
  Peptide Sequence Number=SeqID_173748
atggagacacttcagaaggttcgcaaagcatgggaggtggtgcaaaagaaggacaaagaactaaggggcagtaacaatgggcccataggtggctaccaaaggtggttgaaagcccacgtgcaaggtttggattggctctcgagtttaagaaccgctaaaagggagaaagttgaggcaccggaggaagacaaagaggtgcaggcccttagggcagaacttgagcaagcccaaacagtcaaagaaaggttcaaatcagcagctctgaaaatccgaaaggagaatgccgaactgaaagatatagcaaccaccaaagccttcgaacaagaggccaagagggctcgtagggaagagcacggccggaacaagtccaaaagaaacttgtctcagcggttatgcgagacagagaccaacatgttagctatcgtcagcaagtaccaagaagaactaaatctagccacgacccatgagcatagagtggaagacgagtatgcccaagtgtacgtggaaaaggaggctagaggaagggtgatcgactcgctacatcaagaggcaacgatgtggatggaccgatttgctcttaccttgaacgggagtcaagaacttcctcgattgctagccagggccaaagcgatggtggacaccttctcagctattgtcagcatatga

SEQ ID NO: 82064 - DNA, 130 bp, Glycine max
  Peptide Sequence Number=SeqID_173749
atgggactccttgaagcaaagttgataattgatagcggttgctccaaacacatggcaggagatgcatcaaagtttattcatatttctcccaaaaatagtggacatgagacctatggagacaacaacaaag

SEQ ID NO: 82065 - DNA, 222 bp, Glycine max
  Peptide Sequence Number=SeqID_173750
atggattcctttgctttttggaagatgaatggcagcagaatggagaaggaagagagagagaggaagaaagagatgaatgaagggagtggaagagaagagcacgaaattttatgctctaaaagagctctgaaatctgaaatatggttcatcccactaatccaagatcaagtccaagattctccactaagtgtgcttaggtgtcatgaggaatgtaaagcatga

SEQ ID NO: 82066 - DNA, 436 bp, Glycine max
  Peptide Sequence Number=SeqID_173751
atgaccgatcttcattctaatatgcatgcttgtcactcttcatgcattgaatctgaatttgtacttgatcatatgtctgaattagatgctgagagtgaatctaaatttgatattgattacatgtctggtgatgttttacctcttgagattgattttataaagtcagatggaactaaccatgtttcaggaagtacacatacttctgactttctttatgaggtacaggctgagaagccatctctttctaccactatccagccggccacaccaaaattgaagcctctaccatcaaatttaaaatatgcttacttggatgataacaaaagttttccagtaattatatttgcctcccttgctaatgagcaagaggagaagttgttatcagttctcaagaagcataagaaggctataaactggaccctggcggacattcctg

SEQ ID NO: 82067 - DNA, 871 bp, Glycine max
  Peptide Sequence Number=SeqID_173752
acatgctggagttggtagtatagtcgaagaggtgggacgcattagtagctattgccatgacacggaggcctgccaatctcatcagagtagtaagacagctgaggtagaaacaagcttgaggtggaatagcttgaggtccgagggatggcaggctatctatgaacaagcaatggaacggaacgagtatgatgatatagtagaagagaggctgggtgtggttgttgaaagcaagggagatgggcgggtgcagcagcacaaagaaggatatgagggcagaagcatgacacacacaaccacctcccattcttcacagcatagcttagctgctgctctgtcctacacttccccttcttcgataagcaacactctctcgcagcaatttcagtcaagcaacaagaaagggcagagagaagcaacactacttacttcgttcgtctatttcctattcattctagaagtgagagtaggccccatagccctcgtatctcgttatgcaaaacctggcaagctattcgtcgttcagtcgcagcagcagagaggcggcacaccttcgttcgagttcatgtactactctgatcagactactggcaacaactggcataacggacatcccgtagtgggaaagaccgaatcaacaaaagagaaccgtagtgcccgtggtactgagaacacggttggagccctacttactctctgtccgcatctcgaactcccccatactatggactactatacgataaggatgctcggacttataccacaagcagagaagagagctactagtggtgcacaactccaaccactcatcatactctatatatgcgcttccactactttggagagacgtcctacagcctcgggaactaagtga

SEQ ID NO: 82068 - DNA, 327 bp, Glycine max
  Peptide Sequence Number=SeqID_173753
ctctagcttctcttctcaaggaggtgagcatagttattagaggggtgtgtgtagctaagcttgagcttctcaaggaagcttctcaaggagtatcctcttcaagcttcttatccaaggcaattgttggtggtgaagctccttcttccttggctgattccctagtggatggtgccacccctctcctcttctccttttccttccgctgcatctccatgagcacaagagcttcttgtgtcgagggaaggagcccagagtatgaagaacctcgggatttgaggtcaaatcctttgcaagatggagaggatgatgcaatcctaccccccaagg

SEQ ID NO: 82069 - DNA, 223 bp, Glycine max
  Peptide Sequence Number=SeqID_173754
tgtgaaaggttcaggagttgtatttttgcacggggaaggtattagcaccccactcgtctgtcacaagggacgacaacctttaatcaatcgacaaggtgtttcccttgctcctacgtattcctctattgtgataaggaaatcagacctacgtagttctttgagaactaaacgttggaaagctggagttgctgcacatgatgtccaacgttatgtcaaggaatga

SEQ ID NO: 82070 - DNA, 171 bp, Glycine max
  Peptide Sequence Number=SeqID_173755
atgtcattgtcacttgaagacaagttaattaggcaagctttggaaaatgctatttttcatctcctcgctaagccaatctgctggcttagcgagcctccgctaagtgcgaggaagactctggaagaagatgagctatacaggttcgctaagcacaccgcttcatctcactaa

SEQ ID NO: 82071 - DNA, 510 bp, Glycine max
  Peptide Sequence Number=SeqID_173756
atcctagaggtaaaggagacatcctcaccacttgtatttttgcaatctttcatcttgttcttctctttgttgttaagaaggcttcttggtatggaaagctaaatcctctgttggatcttccctggtcattcaatagtgaaaactggtctgactctaaagtccttgatagtgcagggctgagttgtggtgctttcacgaggaatcgggccgaacaagttcttggcgccgttgccggggaacttctttttatttgggaagttagctcgtttttaggcaatttagttcctctagacttagaaattgaagctacattgcgaaggaacagggccgagaggagaagcaaacttctgcaagacagaacagttgcatcctttcttgaggaggagactcatttctctaacttattatcacctgattcaccatcatcaagggaatctgccactcaattacctgaagccattaccatggcagaagagcatgaccagaggattacccttgaggattattcaa

SEQ ID NO: 82072 - DNA, 442 bp, Glycine max
  Peptide Sequence Number=SeqID_173757
atggccggcctgcacccgcttcagcgccggcagaatagcgtcacggcgactgccgcgcgtcagacgcataaagcgctcaacgctgattggcagcgtcggatcgatgtgcagcttttgcggcacatagccaatacgcagccccggcgcgcggcggacgctgccgctgtctggcgtgagcaggccgagtaccgtgcgcaccagcgtggacttgccggctccgttgggacccagcagggtgagaattttgcccggctgcagcgacaggctgatgcctgccagcaccgcacgctggccaaacttcaccgaaatgttttcgagtgtaacaatctcgccaccacgttttccgcgcagtctgcggtggtggcttcaatcaagcctctcggatttatcgcagccgccattgccgatggcattacgccggttgaagtattgctgccggacg

SEQ ID NO: 82073 - DNA, 708 bp, Glycine max
  Peptide Sequence Number=SeqID_173758
atgctcaccaaccttgaaccgcacgacgtcttgctgatcgatgaaattcatcgcctgtcgccggtagtggaagaggtgctgtatccggcgatggaagattatcagctggatatcatgatcggcgacggacccgcagcgcgctcgatcaaactggatttgccgccgtttaccctgattggtgccaccacccgcgcaggctcgctcacctcaccgctgcgcgatcgctttgggattgtgcagcgcctggagttctacaatgtgccggatctgcagcacatcgtcggacgcagtgccgcctgcctggggctaacgctgagcgaagagggcgcgctggaagtggcgcgccgtgcgcgcggtacgccgcgtatcgccaaccgcctgctgcgccgtgtacgtgacttcgccgaagtgcgcgccagtggcaacatgagtggcgaagtggccgccagcgcgctggatatgctcaatgtggacaatcagggcttcgactatatggaccgcaagctgctgctggcgatcatcgacaagttcatgggcggtccggtggggctggataatctggcggcggcgattggtgaggagcgtgaaaccatcgaggacgttatcgaacccttcctgatccagcagggctttattcagcgcacgccgcgcggccggatggccacgcagcacgcctataagcatttcggcatcagccgcgaagagtaa

SEQ ID NO: 82074 - DNA, 990 bp, Glycine max
  Peptide Sequence Number=SeqID_173759
atggccaccggtgacatcgaagtgttcgcccatgagctgaacatcatcaaccgcgcagaaccgctgccgctggactctaaccagaccaacagcgaagaagcgcgtcttacctatcgctacctcgacctgcgtcgtccggaaatggcgcagcgtctgaaaacccgtgccagaattaccagcttcgtgcgccgctttatggacggtgaaggcttcctcgacatcgaaaccccgatgctgaccaaagccacgccggaaggcgcgcgtgactacctggtgccgagccgggtgcacaaaggtaaattctacgcgctgccgcagtcaccgcagctgttcaaacagctgctgatgatgtctggttttgaccgctactatcagatcgtcaaatgcttccgtgatgaagacctgcgcgcagaccgtcagccggagtttacccagatcgacgtggaaacctcgttcatgagcgcggagcaggtgcgcagcgtgatggagcggatgatccgtgaactgtggctggacatcaaaggcgtcgacctcggtgacttcccgcagatgaccttcgccgaagcgatgaaccgctatggttcggataagccagacctgcgtaacccgatggagctggtagacgttgctgacctgctgaaaaacgtcgaattccaggtgttcgccggcccggcaaacgacccgaaaggtcgcgtcgcggcgctgcgcgtgccgggcggtgccgcgctgacgcgtaagcaaatcgacgaatacggcagctttgttggcatttacggtgccaaaggtctggcgtggatgaagatcaatgcgcgcgccagcggtttcgacggcgtgcagagcccggtggccaaattcctgacgccggagatcgttgaagctattctgcagcgtaccgacgcgcaggacggcgacctgatcttcttcggcgccgaccgtgccaaagtggtggcggatgccgctgggtgcactgcgcctgaaagtgggccgtga

SEQ ID NO: 82075 - DNA, 336 bp, Glycine max
  Peptide Sequence Number=SeqID_173760
atgtataccagggcaggattttgcccggactgctgcccgggagacgggtgcggatcatgcgcacccaacatgaccaccctgactcagatatggatgactttgctgctcagcaacatccagcccagcgaccataattctgacctccccctgctgaagtgtatggcgcctaccaagcaccctttggacccggataagtccaacagggccctgggatttcccgccttgatcacaggactctgccattcgtttggagtccccatcgcacctagcaaggtgattcggcctcccatcactcgagcttttattgagaagtattgcacacagagacaggcctag

SEQ ID NO: 82076 - DNA, 192 bp, Glycine max
  Peptide Sequence Number=SeqID_173761
atggaaaagggatatgttgctgctgttgcggaggagcctcaactgtttgttgtttctggggctgttgcggttgctgcttttgttgttgctgctggatgggtggaggaacatatggtctgcttgggccagcaacattctaaaaataaggctgttgttgttgctgctgctgttgtgaaggactcgaccatctaa

SEQ ID NO: 82077 - DNA, 1083 bp, Glycine max
  Peptide Sequence Number=SeqID_173762
atgtcgttgcaacaagtaagtagcagcgaggggagttccaagatggtgagagacggtgactcggtgaggtttcatgatgacgacaataacaattttgatgagaaagggattaagagcaaccccgatactattgcttcaaaagagcgtgatgggaagaaaaggcttgaagctatgtctgcatatgctcatcaaatggagcagcagtactctgcacctagtctctcagatgattctgagacaggaagccattatgaattagaatcaggattcttcatgaaatcgtttaccgcaacaatattcgttgcttcacttgtcactcttggagttcttctaattactttggtgatttccttggtgattatgctgcaatcctgtcaaagtaaaagtgctggagttatcgagcttctgaatataaatgattattacagttattgcagggtgtattctctgcatgctgagctcaataacttagaaggttataatcttcctggaatctgcagacacctggctgtacactatatcaaagtaggtcaatatgctagagacttggatttgactatgtctgtgattgatgattacttcaagagtgttagaccttctgaggatggtttggatgtggttttgatggacatagatgacatttttcctcggaactctgactcttccaatttgtttcacaggttttataatgacagcactagcaactgtattaaagaggcaaagaatgtaaagctcatgtttgttactagactatacatgtaccttcaaactggtggatggtctataattttgttatcgagagagcctagaacacaccgaaatgtcaccattaatcatcttgactcagcgggacttagaagttggtctgccttgatgatgagagcagaagattcagatcctaccaaagggtacgagtacttttctaggcaaaggaatttgataaggaagaagagcttccgaataaaaagtatcataagcagccatatggatgccgtgacagttccggagaccggagtgcggaattttttgcttccagaccctctatgttacaagtgtgagaagcagatagagcatagatactga

SEQ ID NO: 82078 - DNA, 183 bp, Glycine max
  Peptide Sequence Number=SeqID_173763
atgagttggagtcattatagtgattgttgggtgtgcgtcggtgttttagaaggagattgtgacatgctagttagtgttgatggtgttagtgttttgggaggagatggtgacatgctagttgatggtgttgatgcctggcttggttgtggtggttggttgcgcgatggttatgggtggtggtag

SEQ ID NO: 82079 - DNA, 1377 bp, Glycine max
  Peptide Sequence Number=SeqID_173764
atgaggaaaggaaacatggaactcgagacaaacaaggtctatgactacgaggatgcacgcgggaacgacgctgaagtcccagataccgctcatcagattagcaccgattcatggtttcaagtggcttttatcctcactaccggaatcaacagtgcctttgttcttggatatcccgggaccgtgatggttcccctgggttggttcgggggtgtgattggtctaattcttgctaccgctgtatcactttatgcaaatgctctagttgcttatctccatgaattaggaggacaaaggcacattaggtatagagatcttgctggatttatatacggtaagaaagcctataatctcacatgggttctgcagtatatcaatcttttcatgataaatactggctacatcattttggccggttcagccttgaaagctacttatgttctattcaaggatgatggtctgctgaaacttccatattgtattgccatagctggacttgtgtgtgcaatgtttgccgtctgcattcctcatctttcagctcttcgaatttggctaggattttcaacagtcttcagcctagcatatattgttatatcatttgtgttgtcgcttaaagatgacatcccgtgttactgtgcactaaccaatagaacgttatcaggattacgatcaccaccccgagattacgagattccaggagaaggtgtaagcaaaatatttacaataattggggcatctgctaacctcgtgtttgcatttaatactggcatgcttcctgagatacaagcaacgattaaacaaccagttgtcaagaacatgatgaaagccttgtactttcagtttaccgttggagttctaccattgtaccttgttgcctttacaggatactgggcttatgggtcttccacagaagtgtatttgctgaatagtgtgaatggtgcagtttgggtgaaggctttggctaatatcacagcatttcttcaatctgtcattgcattacatatttttgcaagtccaatgtacgagtttttggatactaaatatgggatcaaaggaagtgcaatgaatgttaaaaacatgtcatttcgaatggtggtaagaggaggctacctggcctttaacacatttgtggcggctttcctgccattccttggagatttcatgagcctcacgggagctataagcacatttccccttacatttattcttgcaaaccacatgtaccttaaggcaaagaaggacaaactaaacagctcacaaaagctctggcactggctcaacattggtttcttttccattatgtctcttgcagcaacaatttcggccatacggctcattgccatagactccaaaacattccatgtttttgcagatttgtga

SEQ ID NO: 82080 - DNA, 243 bp, Glycine max
  Peptide Sequence Number=SeqID_173765
atgggatgtccagttgaaggtggattcattgttgcatttgatccccttgatggcttcagcattgtggacacaaatttcacagtaggcaccatctttgctcctttgaggttcttgattgaaaaagctgaaggttacaacagtgatgttcatcagtctgtgctagataaagtcatcactaacattgatgagataactcaagttgcttatggatccaagaatgagatcatccggttaagaaaccct

SEQ ID NO: 82081 - DNA, 1116 bp, Glycine max
  Peptide Sequence Number=SeqID_173766
atgtcggacgctttgatcaatggattggccggagctggaggagggatcattgctcagctcatcacttacccacttcaaactgtaaatactcgtcaacaaaccgagcgtgatccgaagaaagacacgaggagtcaagggacccttgaacgaatgtgccaggttgtaaaagaagaggggtgggaacggttgtatggaggcttgatgccatcggtagtgggtacagctgcgtctcaggaaactgtcattgaccgtgattttggccacgacatcaagatttttgggcactctacgatcacaactgtggccatatcagccacatttgccgcaattcccggtgtttactattatctctatcaaatattcaggaacaaagctgaagcagctgcactacaacaaaagaaaatgggcgtcggcgatggatcagttgggatgctctcctcacttgttgttgctgttttatctgggtctgttaccgtgctgttgacaaatcccatatgggtagttgctacgcgtatgcagacacatagaaaagagttgaacagaactccagctgatcagggtttgttagtttccactgagcagccaattctttctgcagttgagcatcttccttatggaactagtcaggtgattcaagatatctacagtgaagctggaattttgggtttctggaaaggtgtattaccaacattaatcatggtaagcaatccttccatacagttcatgctgtatgaagccatgttggtgaagttaagaaaaagacgtgcttggagtaagaagggtagcaatggggtaactgctttagagatatttcttattggagctttagctaagcttggagctactgttgtaacctatccgatcctagttgtgaaggcaaggctccaagctagacaggacaaaactggagacaagaggcaccattacaaaggtacatgggatgctattataaaaatgatccgttatgaagggtttaatgggttttacaatggtatgggcacaaaaattgtacaaagtgtgctggctgctgctgttttgttcatgatgaaggaagaactagttaggggggttcgtttcttgcttgccaatgatgctgtaaagccaaagcatccgtga

SEQ ID NO: 82082 - DNA, 66 bp, Glycine max
  Peptide Sequence Number=SeqID_173767
atgacacaaaaaattatccatgagaaagaatttggtaatacgagtatagagaagtgcatgcacaaa

SEQ ID NO: 82083 - DNA, 521 bp, Glycine max
  Peptide Sequence Number=SeqID_173768
ggcgaattggagctccaccgcggtggcggccgctctagaactagtggatcccccgggctgcaggaattcgatccaaaaattccgagtagaaatttccaggatgtcacagaagctaccaaggctatagaggtggctcaagttcaaatcagccttatgcatggagaccacatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 82084 - DNA, 444 bp, Glycine max
  Peptide Sequence Number=SeqID_173769
gcaacctcacttatctataattttccttatgcattaagtttggctgtttcaacaaaggtagggaatgaacttggagctaataggtctgacaaggcaaaggcatcatcattctatgcattactatgtgctttcatcacgaccattgtagctacaatattgacagtaagtatgacttatgcctatggacaaatgtctattgaatatgaaccccttctttctctcactgcaacaacattgcccattgtgggtcgggagttgctaggtgcacccagcaattatgtgaatggacaaaactgtccttgtttaaaaaacgtgattttcaactgcggaagaaccttcttccgtgccatctcgcggaagaacttctttcgtaggaagccacggaagaaggttcttccgcagttgaaaataacaacagcagaagaaccttcttcggtgagttaa

SEQ ID NO: 82085 - DNA, 417 bp, Glycine max
  Peptide Sequence Number=SeqID_173770
atgaccatgattacgccaagctcgaaattaaccctcactaaagggaacaaaagctggtaccgggccccccctcgaggtcgacgatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcgggcgggtgtggtggttacgcgcagcgtgaccgctacacttgccagcgctga

SEQ ID NO: 82086 - DNA, 243 bp, Glycine max
  Peptide Sequence Number=SeqID_173771
atggggttgtcttggttgacggagttgatgcccttgaagtccctatccgtaaaggttcctgttctagtggaagttgtcgctcgtgccactatgactgttgtctttgtctgccttggtctttcgctcttcttctgtctgcttcctagttcctatgttgctcctcttgatgtcctccaggtcttggtcctgcttggtgattgtctggtctcttatcaaattgggctaagtacccagcctgtataa

SEQ ID NO: 82087 - DNA, 541 bp, Glycine max
  Peptide Sequence Number=SeqID_173772
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccatcattagatcagcagcacaatgacacgctgagcgggagatttacggaggaagagataagggaggcagtatggggctgtgggggagagaagagtccgggcccagatggaataaatttcaaattcatcaaggcattgggtaccgagctcgaacttcgtaatcatggtcatagctgtttccttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcg

SEQ ID NO: 82088 - DNA, 84 bp, Glycine max
  Peptide Sequence Number=SeqID_173773
aaaaccatagaggataaagccatggacaaccgcctccagtacagtttagggaaagcggaacccgggtggtgcagcccgccttga

SEQ ID NO: 82089 - DNA, 462 bp, Glycine max
  Peptide Sequence Number=SeqID_173774
atgcactttcatctcggaacgcaatgcccacgtgacactcatcaagagtcgggatcaaacacggtctcaacaactacaaaaacgtcgggttacggcatggttcaagctagtggtctcgcgttcggcggcctgacaggcaacaaggtcgtttcaacaagtcgagcacgtatggtcggaactggaacaacaactagtacaaccgggacaagtagcgcgctagaaggcccccttccccccggacatgcagctactagatggactgaacaactcacgacacagtcggacactcgtggtacggacggaagactacgacgaggagcagagaacaaccccactttcgataatatcgtaaagaagccagagaagcacctacaaccttccttcaaatatgtactcgttcacgctagagcaaagaagagatcgaacagcagagtagtgtgtctgtttgtccgaaccccctaa

SEQ ID NO: 82090 - DNA, 615 bp, Glycine max
  Peptide Sequence Number=SeqID_173775
tcatgttttgcggcgaccagcgcccgtttcgataacgttgacaacatctactcgaacaaacgaaagcttgatgccaacaaggagaccacttataccttcgcgcaaaccggcgtactggccttaggctgcagccatccgcaaaaacagcaaaacggcgaatttatccggttagaggtgagcggcggtggcgacagcaacctgcacattctcggtcagaatacgcaaggcgactgggagcaacagaaggccggcgccggcatcctgggcggcgccgtgttgtatgacggtaaatccaatcacttcgtaccgaagaaaatcaccgacaaaacgcaggagatcatcaataaatcgctgggggaaagcctcagcatcgccgcgctgtatgaagcggtgaacggcatggacggcacccacgagatgttcacggcatcacagggttccctgttcctcaactacagcaaatgctgcagcgccgaataccgcgagggcgcggtcaacgtcggtttcttcgccgacaagaccacccgcgccaacgccgcccactggggactctggcacgaactggggcatgagaacgaaccgcagtgggaatacaacgtattccccgaagtgcag

SEQ ID NO: 82091 - DNA, 417 bp, Glycine max
  Peptide Sequence Number=SeqID_173776
atgaccatgattacgccaagctcgaaattaaccctcactaaagggaacaaaagctgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgggaccgctacacttgccagcgctgatgtccggcggtgcttttgccgttacgcaccaccccgtcagtag

SEQ ID NO: 82092 - DNA, 230 bp, Glycine max
  Peptide Sequence Number=SeqID_173777
ttgagccggttcaagtgatagaggtatcatcctctgaagaggatcttgaagaagacccagaggagttaccccctgaacctgctatggatgccctttacttacttgaggatgatgaggacccactccttgatgttgattctccagaggatgttgtgtctgcatctgaggcagactctacagaggagagcggccctgtagggacagcgaatagtgatgactcttcatcatag

SEQ ID NO: 82093 - DNA, 435 bp, Glycine max
  Peptide Sequence Number=SeqID_173778
atcgactgggaccatttagttcaataccggatgcataaggcattacgggccaatgcacctctgccttatcctcaccttgttactctttttcttcatcatttcaatgttcctttagatgatgaaccatttgtcaaggtcaaaaggtctttctcttttggtgctggtgcggttacctcctttggttaccgaaaggatgttaatggtcagtgggttcacaaacaagacttgccaccgcctattcccgacgaacttaccctatctcctccaccacaaagggttgattccacttctcttctgactgaagtacttacagagctccgcgaccttcgagcttttataggtgagcacttcgatgtcatgaacacttggattactaggcttgaagatgatatgagcttcatcaggcattgcttcaatccctcggccgactcttag

SEQ ID NO: 82094 - DNA, 627 bp, Glycine max
  Peptide Sequence Number=SeqID_173779
atgaagatcctaggcctacaagctccaatggagcttacatcagttatagtatccagggttttgggaaccaaggtggtgctctcaagcaactcgattgccaagtcaattaggtgccttcataaagaaagcacctatcaagaaggatgggagaaaatctatgactcccatgttgcaagggcgttgtacaaggagaatgtgaacaaagcaagtgacaagaaaactatagtttacaacctaatatgtgagagggcaaggatttgggccaacattctgaataagagtgttctccataaagcaagattaaagacaacacaatcagatctccataagtttgtgctctttcacttgatggagaatctttcctttgacctgcctcacactatttacatcaacattctaagaaatctacatagcctaggtggtttggatgacatctattatgtttccttaatcaacaagacaaggaagcaatcacatagggaggaagaagaagaggagttgattgcaagggagcacgggacaaggaaaaaacatgaacagtccagtgtgtccattcctgagtgtccagccaaagaaaagtcaataccccaaaggttcaaagacctaagtgaaactaatgaagattga

SEQ ID NO: 82095 - DNA, 552 bp, Glycine max
  Peptide Sequence Number=SeqID_173780
atggttctgaaagaggagttaattgcttgtttgaggtccaaaagaagcttgtctcagcgtttatgcgagacggagaccaacatgctagctatcatcgctaagtaccaagaagagttgggtctagccacggcccacgagcatagaatcgcggacgagtatgctcaagtgtacacggaaaaagaggctagaggaagggtgatcgactctttacaccaagaggcaaccatgtggatggaccggtttgctcttaccttgaacgggagtcaagaacttccccgcttgttagccaaggccaaggcgatggcagacacctactccacccccgaagagattcatgggcttctcggctattggaaaaacaccataactaaacgcgccgcaagggatccctatcgcaccagatccaaatctagaacgatgggtgatcaagaggagacgcaggaacagatgaaagccgacatgtcggctctgaaagaacaaatggcctccatgatggaggccatgttaagtatgaagcagctcatagagaagaacgcggccaccgccgccgct

SEQ ID NO: 82096 - DNA, 194 bp, Glycine max
  Peptide Sequence Number=SeqID_173781
ttggcccagggcttcccggtatcaacagggacaccaggatttatttattctgcgaagtgatcttcccgtcaccagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 82097 - DNA, 489 bp, Glycine max
  Peptide Sequence Number=SeqID_173782
ccagtatacactccgctagcgcccaatacgcaaaccgcctctcccccgcgcgttggccgattcattaatgcagctggcacgacaggtttcccgactggaaagcgggcagtgagcgcaacgcaattaatcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 82098 - DNA, 204 bp, Glycine max
  Peptide Sequence Number=SeqID_173783
atggagaagatcaactcaaagcttgtggtctatgttgaaaagcatggccatggaaactggtgttcagttccagagaaagcggaccagtcaaaggatgctgtcaatatgaagcacatagggcaacaagaaagtgctagatttgaagctaaagctagaaaatccatgcaagttggatccaactctttcattcccccggttcattag

SEQ ID NO: 82099 - DNA, 318 bp, Glycine max
  Peptide Sequence Number=SeqID_173784
atggaggtaacaacgttcacagtgacaatgcacagggtggatgtggtgatgttcgagaacaaaaagtttggaaccatgggtaaaggtggtgacattcacaacgacaacatttgcaatgatgatgtttgtgacaacagcgaggcagaattggaggaagtggaaggaagtgaaaatgtgttaagggatctagaggaagggtgcaacattaggattgagaagttaaggcaaatgatggatgtcatggttgtggaaaagcatgttggtggctttgttctacccacatctgttcaattacttgtccctgatccctcaggatga

SEQ ID NO: 82100 - DNA, 1731 bp, Glycine max
  Peptide Sequence Number=SeqID_173785
atggtttccccggaaaacagcaattggctgttcgattacccgctgatcgacgacgttattcccgtcggcgacgcctccttttccgtctccgcctccgccttctcctggcccccacctcccgccaatgtcagtgttgaaattgatgcttcgcttggggattctgatggccccaaagatactgctttgaagaaaagatgcttgttcttggatgaagttataccatatctcttgtttattcctgttgcagggctagatgtgattcaagtactgcttctagctctaaagcgtgtcgggagaagttgcggagggataggcttaatgacaagtaaacttctgaatcatccccatcttccctctgttcataactgctctccttgtgggcctcccaaaacagacaaggctgccattctgattgatgctgcccgaatggtaacacagctgcgggatgaagccctgaagttgaaagactcaaatacgagtcttcaagagaagattaaagagttaaaggctgagaagaatgaacttcgtgacgagaaacagaggcttaaggcagagaaagagaagttggagatgcaggtaaaatcaatgaatgctcaacctgctttcttgccaccccctcctgcaatccctgctgcatttgctccacaaggccaagcccccggcaacaagttgatgcctttcatcaggtacccgggagttgccatgtggcaatttatgcctccggccaccatggatacctcccaggatcatgttctccgtccaccactaacatcatgtctacctccacactcaaatgctcagatcacatcaattccatttcctactactcattatctgtacaaccactgcaacagcttcatcatccctttaagtttcactgttcccctcaaagcattatccacttccatccattcctcactttcttcccctaagccacctatcacaaaggaggatgccatacttcaggccaaaacatccctttcagcaaccttagagaagcccctaaacaataccaaactaataggcaaattcaagaaactaaggcaacccaagttccgggttgaaattccagtcattgatgactcaccggattcactgtctcaacttgcccttgatttttttggggacatgcccatcaaaagaaaaggttctcccatcaagatcttaatcctgtggcctgatgctagcttgaaagaatctgccactattggctttcagtctcattcaacttttgaacacattgacattccttcagtgaccaaaacagaccccagaatcttgaattctgcggatgtggcgatatttttggcgccagagagttcccaattggcactgataagaagagtgagtgatgccttttatccaaagccattggttttgttcaacccaaaatgggcatttgaggaagagagcaactttggtgatctgagtggctttgtggattcttttgaagtggtttattcttttatgggattggaggtgagagggatcttgagcaaaagaaaaggggtgatttttaagtgtgtgagagatggggttgtgagtggagaaagatggaatgtttttgtagaagaaggagaagaattgaaggtggtttcgtcattcaaggccaggccaactattgttgaagttgagaatgtattgtacaatctgatggctatcaattctcccataaccaagtctgcaaagttcatcaagggattggtatccaatgtgacagggaaaaagtaa

SEQ ID NO: 82101 - DNA, 238 bp, Glycine max
  Peptide Sequence Number=SeqID_173786
atggcggcaaggggtgaatgctgttttcttcacactgccgaagcagtgtcacttcagggaacaaaaaagcctggacgacttcaccaggcttcaatgcgaccacttgagtggtcggggagacaggattcgaacctgcgacctctacgtcccgaacctcagcgacgattttctttctcgatacggttctgctcgcgggctatcaagcttatcgataccgtcgacctcgagggggggcccg

SEQ ID NO: 82102 - DNA, 222 bp, Glycine max
  Peptide Sequence Number=SeqID_173787
atggtgaaagtgggaacctcttacgtgccgatcaacgtctcattttcgcccaaaagttggcccagggcttccccggtgctccagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 82103 - DNA, 309 bp, Glycine max
  Peptide Sequence Number=SeqID_173788
atggatcgagttacatcgttgcttcgtctattgccaaacacatttaggactgttgatgtccttgttacttccagtttcaccttgacaaagatgtcatggaccataaaagaacatgttttacggtgcccttaccgaacctgtgctagagctagagaaataggtgaagtagaagaggtccaagagcatatgaaggtcgacatggaggccatgaaagagcaaatggacacaatgatggaggccatgatgatcattaagaagataatggaagccaatgtggttgcagttgccgctaccagcgctgttgctaag

SEQ ID NO: 82104 - DNA, 678 bp, Glycine max
  Peptide Sequence Number=SeqID_173789
atgcctagcccacagaggagggagttcgggacatgcgctcatgccctcagccagttcctgggtgacccgctagttttggaggagggccagcagtgtgagttcagccagaggaggaatagggccgacaatttcgatgaggaagccatcacccaactgttatgcataccggggcaggatttcgctcggaccactgcagggaagcgggtgcggatcatgcgcacttgcatgaccactttgactcagacatggatgacgctgctgctcagcaatgtcttgcctagcgatcacaattctgacctccctctacctaagttccagttagtgtatgccatcctgacacggatgagcgtccatgtggcccaggtatggtgcctaataggcaccctctggacccagataagtccaacagggccctgggtttctggtgctgatcacgggcctctaccagtcctatggagttcccgtcacccccacctcagtcagcaggggcagggttccgccccttttgtatgccctaccccggagcagtttggggctgaggtcgcatggcctagagactggcccgatgcccaggcaagggaggagcttgcaggatcccccggtgaggtagatgaatcccatatggatgaagatatgactgacttgctcggtttcttgggagggagcagagtagcgtga

SEQ ID NO: 82105 - DNA, 546 bp, Glycine max
  Peptide Sequence Number=SeqID_173790
atgactaggggcaatccaggtgatttacaaccctttgaccctaaaacagatagaacctttcatagattagttaggcatagtgtgcatcttgatcattctgtgcattttgagcattctgagcattccgtgcattctgagcattatgttgctggtgattctgaacattctaattttgagcattcggctgctaattttcatactgagaacatggctcaatctccaccttgtgagaggactcttagggagatggatgcacctgacttctcttatgaaagcttgtgcattcaatatcctgatgaggatgttccatatgttctcaagactggactaatacatttgctgcccaagtttcatggtcttgcaggtgaagatcctcataagcatcttaaggagttccatattgtctattccaccatgaaaccccctgatgtccaggaatatcatatctttctaaaggcttttcctcattctctgaagggagtggcaaaagattggctatactaccttgctcccaggtccattaccagctgggatgaccttaagagg

SEQ ID NO: 82106 - DNA, 1108 bp, Glycine max
  Peptide Sequence Number=SeqID_173791
gcgagttactttctgttgcttgccccacagaaagtaaccaaagaagacggcacccagccatcacggcctaacggctgccttgcgttgctcaacaaaacagtcgctccctctactcttattttgtctccgctactcagcgtgatgggatgggatttatctcgccaaactcacatcgcagaaatatggacgcacgctttgattaaagcagtgcaacacaggcttggcgggagttctcggccatcggctgtccgagttccgcaccaagccacgttttgtgtggcttggtactctggttctacaaaagccagccgttccgcaggcgcggggcatggtctacctcttgctagaccttacgccggacagccttcatcccatttcaccaaactacttccatacaccctcgaatcacaccacgccatttattcttcccccgcctgtgctagaatcgcgagaacaaaccatatgtttatcagcaacgcttacgcagccgccgctccagccaccgacatcatgagcttcttgcctatggtggtgatttttgtcttgttttacttcatgttgatccgcccgcaaatgaagcaggccaaacagcataaatccatgctggaaacacttaaagccggggatgaagtggcaaccaccggtggtatcgtgggtaaagtgacaaaagtaagcgagcactttgtcagcattgaaattgcagccaatactgtgtttcttatgaaccgttatccgatatggaaattcgtgctgatcggcacagtgattatcattggcctgctttacacgatcccaaacttctttggtgagtcgcctgcagtccagatcagcccggcaaaaacctcactcaagctagacgaaagcctgttacagaaagtggaaagcacactgaaactggccaatattccattcgatggtttatttatggatgctagcggtgtcaaagtgcgctttgccaatacggatacgcagttactggcgaaagataagctggttgctaacctgggtaaagactataccgtcgccctcaacctggtgccacagacaccaggctggttgcaaagcatcggtgccaaaccgatgtatttgggcctggacttacgcggtg

SEQ ID NO: 82107 - DNA, 450 bp, Glycine max
  Peptide Sequence Number=SeqID_173792
atggaaacatgtttagcagtggaggaccaattgcagcagatgatagatcgaggccgattggaagtcgacgatgaggggagtgaagagcagcatatatgtatgcagtccgcagatgagagaagttttggaaggcctaagccgttgatgagcggtgttacccgcagcggtcgcgtgtttgcaccccctgacctgccgacacaactcgcgaacgttaaggggaaagcaaagataatggaagaacaaaatgacaaaacgatcctcactccgagcgaggatattccagtgaaaggtcttccggagaaaaaggatggttgtggcaagaaagaagtatcgctagaggaggcaggcgagttcctccgcattattcagcaaagtgagttcaaggtcattgagcagctcaacaaaaccccggccagggtctctcttttggaactgctcataagctcttag

SEQ ID NO: 82108 - DNA, 453 bp, Glycine max
  Peptide Sequence Number=SeqID_173793
atgactttacaagctcagggtttaagtcaatcaatcaattttcagctcaacatgggtgcaagggataaatcattcatgaacagggtaagctctttggctaagtggctatatcaatcaatcaaggccttcatcatcttcaaactcatgcattcattcagtaatcagagattcatgcaaaaatcggtacttaatgctagtcgttctctcatagttaaatatcacacaactcatcggtttgtggttaatgattaccttcacaatttctctgtcaaaccaactaacattttcagtcatgcccctaattcatgtttttctcttctaattaccacatactcattcaaagcaaaagaaataaatccaaatcctgtcatggctcatcctgtttcattgtgggcttatccagaggtgaggaaggagcatcctgggctggctgaggaatatcctgagctgtaa

SEQ ID NO: 82109 - DNA, 626 bp, Glycine max
  Peptide Sequence Number=SeqID_173794
atgccgccgcactggcggcccaacgtcgccgattacgcccggcgacagcagaaaccgctgtttcagctgaccaaagcctcctgccctttcctgcttgacgccacgcgcgcgatgccgcaaaaaccgcagcatgcacagcagtgcctcgattttaatcagcgggttctgccgatcatcctgagcgataaaatagacgaagtggtgatcagcgcgttctgggcggcgggactcagtgagcagccgggcagcggattccgcagtctccgcgatccggcgcaggacaatctgcaggcgctgaaaagcgggctggataccgtggtggcgcagctgctggcggcggggaaaaagatcaccctgattgacgatgtgccgaccatcacgctcgatccgctgcgctacagccataaccgcaatatgccgctgcgccgcagcctgaatagctggctcagcgcgcaggatggcgcggcgctggtagcggaacgcacgcagcagatgcagatgccaaacgcatcggtggcaaatctgttaaaggattatcagcagcacggcgtgcgcgtgttgtcactgcaggagacgttatgtaatgcgcaggggtgtctggtcactcatcagggcatgccgctctg

SEQ ID NO: 82110 - DNA, 297 bp, Glycine max
  Peptide Sequence Number=SeqID_173795
atggaacaccagaaatctgcctcccttcttgtggcgtatgtagtacaaggcaaacctcgaggacgagacataagtgttgtccaatgtttctactgcaaaggccatggatattttgcttcccactgtcctaagaagttctacaatcactgcacaaaaggtaaagcttctttaccccactctcattcgtattttgactctggcgcatctaatcatatgaccaacaatgttgctgcccttaccaatgttacaaattactctggatcaacactcaaggaagataatcacaaaaaggcctaa

SEQ ID NO: 82111 - DNA, 717 bp, Glycine max
  Peptide Sequence Number=SeqID_173796
atgtctttgaaactaccatactatcctgaacttgtacgagtcttttactcaaatttgaaaattcaggatggaaatttgatttctgaggtgtatggtatccctataattattgatgaatctgtcttctttttattaacccagttacctagtcaaggtgcaccttttgagggcaccattgttgatgactggaagtttgattactccaatcatgatgcccgccacatgtatattattgttcgcattctgcatccaaggtcttcaaacttagctcaggcctctgaggaggatttaatcattatgtgggctttcttgattggtcatcagatcgattgggcccatttgatccgttatcgcatgcataaagcattgcagtctagtgcacctctcccctatcctcagcttgttactcttttccttcgtcattttcaagtcccattagataatgagccatttgttcaagtgaaacgttcttatgctattggtgtcggtgcagtaatctcctttgactaccgtaaggaaatggacggacaatggttgaagaaggatgcacaatctctgcaagatgaacgcactcattctccttcatctcagagggatgactcctctaccctcatgcatgaagttctctcagagttacgaggcctccgcacctatgttggtgagcacttcgattccttcgatgcacgctttgcagggatggacacacacatcacatag

SEQ ID NO: 82112 - DNA, 375 bp, Glycine max
  Peptide Sequence Number=SeqID_173797
atggctacctcaccaaaagaaacttcagctcctggttcaccctctgcaccatcaaaccaggaacgacctgaattcaatatccagcccatacaaatgattcctggtcaagcccctgttcctgaaaaactggtccccaaaagacaacagggagtgaagatttctgaaaaccctagccctgcaacaagtcctagggaagtagacccggagatggataagaagatccgcagtattatgttccaacatcttccaccccaaatgtttaagtcctctcttcctccagcaaagagagatcaacagaggaagatgatcaagccacagaggagacccctgcaccacgggcaccagaacctgctccaggtgacctcattgacctag

SEQ ID NO: 82113 - DNA, 303 bp, Glycine max
  Peptide Sequence Number=SeqID_173798
atggtgaaaacagttggtggagttttgctgcccaagtcagctgttaaatttgagcgatatctcgtgggagaaatcctaactgttggtgctgaggctggagaactaaaggctggaacaaaggtactattcactgacatgaatgcttatgaggtaagggactttaaatatttattttataggtgttatgtatcagaaacttggaaggatgtcccagaaactctaaaagttcttgtatgggatgacattttgccacatttgcctgaaatttcagtaaccatgactgtgattgcaactgtaatttaa

SEQ ID NO: 82114 - DNA, 657 bp, Glycine max
  Peptide Sequence Number=SeqID_173799
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatttctaaacctttgaaccctccttcagcctccctagcacacctatttataggaaaatgggcacttggggcaaagacaactcacccaggcgagctggagctcgcccaagcgagcgagccagaggttggcctgggcgagctagggtccaggaaaaccaaggaaaagactcttttgtcccctaatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagg

SEQ ID NO: 82115 - DNA, 513 bp, Glycine max
  Peptide Sequence Number=SeqID_173800
ggcgtaatccatcaccgcgtcgccgcgcagcttcagccgcgcccacaacgcgcggccttcatcggtcagtacgatctgcagtgcccgccggtcctgcgcatgcggctcgcggcggacgcagcccagcgcctccagcttgtccagcagccgggtcaccgcgctgggcacttggtcgatggcctgggccagttcgttggcgccgatgcccagatcttcttcagccatggacgcgtcgagttggcggaccaggccgtcgcgcacctggcgcagcagcaggccgaagcaggggggagtgcgggctggatcagtgaaggcgcctaccttaatgatctggtcaggtggcccggtagtacaattcagccaatggatgtcacatttcagccagcggatatgatgaacaaggcagaaatcccccctcccaagcgcctgctcagggatgacgcactggattggttcgagcgcaatgacgggccaccggatgtcgccttccgcttcgacagcccgcagggattg

SEQ ID NO: 82116 - DNA, 393 bp, Glycine max
  Peptide Sequence Number=SeqID_173801
atggatcatgatgatccatacacgtatttgtctaccttcatggaactacgcagtactatgggagcttctaacaaagatgttgaagctatctacctcagagcttttccattttcattagcagctggaggcactatgatgtccaagagtctggaggaagctattgtaatcattgactccatagcagccagtgattatcaatgtcatcatgataaagctctgactcaaagaaaaggtataatggagctggacactcaaagtacaattctagctcaaaataaactcttgactcaacaaattaaggccttaacaaagcagataagccaacttcctcagcaatatcaccaaggtggaccacaaaaagcacatcaagctcaccaagttcaacaaatttga

SEQ ID NO: 82117 - DNA, 412 bp, Glycine max
  Peptide Sequence Number=SeqID_173802
ggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatacacttcctcttctattctggtacaactccgtcaaccaggctcactcctgccacttcttcaaggccagtatcaagcttatcgataccgtcgacctcgagggggggcccg

SEQ ID NO: 82118 - DNA, 309 bp, Glycine max
  Peptide Sequence Number=SeqID_173803
atgatgtgctaccctcttgcccttgaccggttgacttggttgtggcatttcggtaacgttttggagcagcaccctcgttcctcaaccaccatcgacttagccgctcgaaggaacgaaccgcagcgatccggaccctgttcctaccccgccccacccgatgaccggaccgaagaaccatcaaccaccctctggcctcccggtatagtggagcgtattgaaaccccttctaccccttgcttgcccccacctcccttccctcgtcgtgtactactaggtgaggaagtcaagcgaggatgccccggatgctaa

SEQ ID NO: 82119 - DNA, 282 bp, Glycine max
  Peptide Sequence Number=SeqID_173804
atggatggtggggttagctactcttgcactagaagcatggaacccactatcgatgatggaggtagtaccccgagacagtccttgtgcaaccgagcatttgctagctgcctcatccttacgactaaccctatcttcttctctgtgtcatgcacgaaccaccaagtctatcttactacttacctactcgatagcaaccaactgggaagggcggcagtgtcgtattcgcaagaaaacaagaagcaagtaaaaacaacagcaacttcttctattttcggagtataa

SEQ ID NO: 82120 - DNA, 744 bp, Glycine max
  Peptide Sequence Number=SeqID_173805
atgggttcaaagatagctaaagtcatcgtcagccttgagatggttgtggaggttgggaaagtggtggagaggatggaggtggtgttggtatcagagccaagggttgtggtgaaggttcaagaaaggacgacaccaaggttggagaattgtgtttatggcattttgcaaagagaggcaaaattgctcattctcttaccgttggcattcggcaaaggacttcattgcttggccaatcatttcttgaacctagccatgagtgttgaaggaggccttatgagagagggtgaatttcttcccatggtaagaaccttaagagcggccaacaaagttagcaatggtggggaacaactgttgttggctgaattcacaaaaggaaggaccaaggccattgagggcagtgatgacgaggtcgagatagtcaccaacactagaagtgcttttggaggcgctggaaagatgttccttgagaaacatcacccaagtacgagagtgattgccatagtgcttgtatatccgtgtccaagcatcggcagaagatgttgcggaagtcatgacaatttgtgcatcagggttgcattagccaataagagcaaggaatatgtagtggtcttgccatttctaaagaccgtaggcagggttgggagtaacagtggcactgttgccaatggttgcaggacggcacggttttgtgctatcaacacagccatagataggttgcacggtaggtatggccatgaggaatga

SEQ ID NO: 82121 - DNA, 1050 bp, Glycine max
  Peptide Sequence Number=SeqID_173806
atgcccctgcaagatggtggtggagaaatccacatcaatctcaaacatgagccactgatgtcgaaaagagccaaacaatttcgtgaaaagctctgtgagctggtgactcgaggggatgtgggtgacagtgagctcctgtttggcaacgaaatcattcataaaatgataattgatggagtggaaaatggggttggcacaaagatggaggccatagtcaagagtgcctttgaggcatcagatgaggcatttcacagcttgcataatttgtattgggagagcttgttgacgatggccaggttgatggacattgacatgggaaagatcatcaatgtatatgaggaagtaagcaagggaggtgttgtgcttgtagatgaagaaaaaggtgttagacttggaattacggaagtcatagttggtgaaggactccttaagagagtgaaatcaagcccgaggagcctacttgaggctatagagagctttgcggagcttgctgaaggtttcatgataatctatatcaaggcgctagtgaaaccctttttgccactagaccaccaaaatccaagtgccattagcaaggacgacattaagcacttcagacatggcagtcttcaactcaacatgtaccatcttttgcttgagttaccatggggtgagtggagaaagggagtcgtacttccattgaagatgaggaaagggtggcttgggattcgtttggattgggggagtagtatgggaaggatgagaagaaaaaggaaagatattttcaaaggtgacatgacaagaggagtcaaggagctaagagggaatagacgtgtccttggtgtgagccatattaggttgatgtttgagatgatcaacagggaaacctttattttcgggccagatgtcctagacatcgtatccgacatcgtggatcctgcagcttcaatgcttttagcaactccagatgtcctggacattgtatccgacatcgtgaatcctgcagcttcaattcttcatttgacatttcatcttgccttgtgcattgtgcagcccgatcttattctttga

SEQ ID NO: 82122 - DNA, 312 bp, Glycine max
  Peptide Sequence Number=SeqID_173807
atgaatctcaaacgctcagcgcgacctagtcgctcaacaggcagaacacgcttagcgctaggaagtatggcaagttacgcactaagcgtgagattaccgccatacttgctaagcacggcaatcgcacttagcgtgaagatcacattcaatgtgtttgaatctatgaatcaaccaaaagatgaagaatcttgttcttgggtggatgtgcttgatgaagttgttgtggacactaggaagaaattgcatatctcttgtcctttcgagaaggttcttattgatgcattagaagctctcaatgatgaagatgaaaag

SEQ ID NO: 82123 - DNA, 201 bp, Glycine max
  Peptide Sequence Number=SeqID_173808
atgaaaaagagaaaattaaagattaggaagtacaagtgcctggaggtgcaagtggtgcgcttagcgagttttactcttgctcagcgcacctgtacaggtcttcttcttccaggttcttctatgcgcttagccactcatgcagcgcccagcaaatcttgggctcagccagaggaggatggctcagcgaattgcaaaaattaa

SEQ ID NO: 82124 - DNA, 351 bp, Glycine max
  Peptide Sequence Number=SeqID_173809
atgggtggtgaaagaagaaacagaagggtgctgcaggatattgggaatctcgtggctaaacaaggccatggaaatggaattaacgtgtctaaacctgtcacaaggaactttcgtactcaactattggccaatgcacaagccgcaacagaggtggaattcgttctcttctatgatgatttatggatcatgaagcaacctagctcgcctgggcaagctgggagtggcaagcatctccttccttttcctataaataggggaaggagggaagaacaaaaatgttcagcttttctgattttccaccgttcttcgtcgttcgtcgttcgttcttcgtcgttcttcggtcttcaaccg

SEQ ID NO: 82125 - DNA, 579 bp, Glycine max
  Peptide Sequence Number=SeqID_173810
atggaacaatactcgtgccacccagacttccttgttcacctagatcatcgaaatcagatagagaggagtgtggatcatccatatcagctatctcaacatcttaaatgtgcttgtactttaatcatggttggttcgctaaagaatggagtgtgggcaacaacgatggaagttgttggatgggagaagagtctgaaatctttctgtgagcaggaggatgatgacaaaaagcccaagagaatgatttcaagattgagtcaacgattcaagaatcaagagaagcttgatttcaagattcaagaaaagatgaattcaagttccaagagaagaaatcaagaagacttcacaagggaaggtacatcctttgtggtacaagtagagggtacatctacttgggttgttgtaactgagaacaagagagggtacatctcttgtggatcagttcaagtggagggtacatccacttggttgttcaaagagaacaagggagggtacatcccttgcggatctttgcttgtaaaggattttacaaggttgaaaagaaatttcaaggaccgcaggtcgcttggggactggatgtag

SEQ ID NO: 82126 - DNA, 378 bp, Glycine max
  Peptide Sequence Number=SeqID_173811
atggcaactagtgtagagaataatacttcaaaaccctatatagaagtaaaaatatatacttacagttgttggtgctattatcataggatatgctacatgtatgcttcagctgggatttggatccacttctttctcaaaaacgttatgaaactaactatatttggccaacagtttgaaacaaagtcagagattagagcagcatgcaaagactgtgcaaagaagcaaaaagggaaggattttggttatgtgaaaacaacatccactgaggatttgaagtcatatgttttcaatgagccaatagtgattgatgctgcacggatgcctccacttggccctgcttccatattattggttgtcatgcatgattctattgactag

SEQ ID NO: 82127 - DNA, 411 bp, Glycine max
  Peptide Sequence Number=SeqID_173812
atgttgacttctataaatgaaaccgagtggactaagattcaaaggagggttgtgagcacgattcggttagcccttgctcttgagataaaacacaacatgttgaaggagacaacattgaaggccttgtgggagaagctcgagaatatctatgcatcaaagttgttaaccaatcacctttgtttgaagatggagttgtcctttaaagctttggttcaaacgttgtttgtgggaagatccactttggagttggatgaggtgaccgccactattagagaaaatgatagaatgatgagaactgaaaatgttgatgatgaacaccatgcactagttgtggtggaatctgagcgagggaggaatcattcaaggagacatgggccaagaggaagatcaaaatcgcaattgtgcccgtaa

SEQ ID NO: 82128 - DNA, 636 bp, Glycine max
  Peptide Sequence Number=SeqID_173813
atggatggtctgacagttaacttcagaggggcaaggaaggtggtagctcctccagggtccattctgtcggtagaacagttcattgagaaggtattctggcctggaaccgtaccttctgttgtgagagagggtgagggccccagtgctccggtacctcaacaggtacaggatgcgtcttctgaggctgccatccctagagcttttgatttttcaggtgtaggagtagagatgaggcttgatgaggttgtttttccagagccaattgtgccagttatacatgaaactgttgaagcaggtgagtcacaattgagacaagaggctgctactcctgaaaggacaacacagaccccagaagatccaccctcaccagggatggagctatcttttgctcagcaggtagcagatcctcctacaccagtacatgagagaccagctgacccttttactcccattttagagataccaaagtaccctccttcagccacacctgagcttcaattttcaaatgaggaggggggacgtattaccactcctccggggacgccaagtttggtggaagtgttgattttgagccacccgctaagccaattctcttgcttagcgagccatccactgagcgcagcagttcatggctaa

SEQ ID NO: 82129 - DNA, 312 bp, Glycine max
  Peptide Sequence Number=SeqID_173814
atgaggggcaccgtgcatgagcctcaataccctcggttcgagaggactacacgtcctcgccttgagaggactacacgtcctcaccatcagagggctgcacgccctcacctccagaggactacatgtcctcgccttgagaggagctacacgccctcaccttgggtactagttaccctcaccgttgagaggactacacgtcctcgccttgagaggactacacgtcctcaccatcagagggctgcatgccctcacctccagaggactacatgtcctcgccttgagagggctacacgccctcaccttgggtactag

SEQ ID NO: 82130 - DNA, 474 bp, Glycine max
  Peptide Sequence Number=SeqID_173815
atgaccatgattacgccaagctcgaaattaaccctcactaaagggaacaaaagctggtaccgggccccccctcgaggtcgacgaaaaaattacgagagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 82131 - DNA, 600 bp, Glycine max
  Peptide Sequence Number=SeqID_173816
gttgcaagatgtaccatctgtaggggagctcatgaatctggatgttgtattcctattgaagaacaccccactcatgaaggacaatggaggaaccaccctggaaatcagttcaacaaagatcaaggtggaccatccacaaggccacagcaacaagggcctagtctctatgatcgcacaacgaagctggaagagactctagctcagtttatgcaggtttctatgtccaatcagaagagcatagagtctgccataaagaatcttaagtcttccacacttctgatgtccctgagcattcttttgtttctgttgagtgcttactactcttctgcatcctttgcttcctcatactctgcattacacatccaaatggcttctaggaaaagaaaggcaccctctacacctacccaagtcagatttgacagatctaaattcatctcccaagaggcttgggaaagatacaatgatgctattgtgcctagaaaccttttgcctgagaggaacgtggtggtctattatacagagtttgatgagttcaaggaggaactcgaaagacaccactgggatgaggagttgactgactttggggacaacaacattgat

SEQ ID NO: 82132 - DNA, 193 bp, Glycine max
  Peptide Sequence Number=SeqID_173817
atgtggattgttcaaatgcttttaatacgtctcagggttgtgttgtatgtattcgctactcgtgatgatgttttgcaatgggctcgaacagttgcccatgaaaatggatttgttgtagtgattatgaggtctgacacaaagaccggtagcagaggaagaagttcatttgccttaattgggtgtgaaaggagtg

SEQ ID NO: 82133 - DNA, 465 bp, Glycine max
  Peptide Sequence Number=SeqID_173818
ggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccaggcgaattggagctccaccgcggtggcggccgctctagaactagtggatcccccgggctgcaggaattcgatgttttactcaagatgtcgttcccaaacaccattgttgagaagctcgatgattcaaactaccttcattggcgacatgtagaaccagtgatcaaggcgcataaattgcagcgcttcatcgtcaatcccgtcgtttcgcctcactatctcacggaggatgatcatattatagatcgcgtgaatcctaagtatgaagcttgggaagtttggggcaagatcatcaagcttatcgataccgtcgacctcgagggggggcccg

SEQ ID NO: 82134 - DNA, 423 bp, Glycine max
  Peptide Sequence Number=SeqID_173819
atggaagacgtgttaacctctaggaggttcatattggaggcgttgcgtgaagtagacatgattgtccttgacggggacaagggagagttttgtttgatacatccgggggcatcacacgatgtagaggcatgcccggtggcagaagagctgctacaggaaatgatggacgaaggcttgattgagagatgttgccacacaaaagccccgaggtttccagcctatccagttgagaagcttgcccctttctcctacaagagtgacaaagcggtgccatggaggtacaccatacaagggcccgacggaaggaagggcgcatctgtcgtacatgctaaagattatctatcctccgctaaggtcacaaacatctctggcatgagtggcatgactcgtaacgggcggatcttcgcagcacctgagccacca

SEQ ID NO: 82135 - DNA, 417 bp, Glycine max
  Peptide Sequence Number=SeqID_173820
atgaccatgattacgccaagctcgaaattaaccctcactaaagggaacaaaagatgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 82136 - DNA, 225 bp, Glycine max
  Peptide Sequence Number=SeqID_173821
atgtcgtttctagtctatctattctatcccgaacttggtggtaaactctactgcggtgacgatactgtaggggagatatccagtggagatgacggggtggggcctgtagctcagaggattagagcacgtggctacgaaccacggtgtcgggggttcgaatccctcctcgcccacaaccggccaaaaaagggaaggatttttccctctggggtaggaaaatcatga

SEQ ID NO: 82137 - DNA, 1299 bp, Glycine max
  Peptide Sequence Number=SeqID_173822
atgaaaatgctggcacatcagactgccacaccggtttcacctgcatccacgtgccattacgcccttgaggtgaacggtgcgactcaccccatcagcagctatcgcgatacctcgctgctgctggtgctgcgtaatcaactccagcttaacggacccaaatatggctgcggcctgggcgaatgcggcgcctgcaccgtgctgatcgatggcgttgccgcgcgcgcctgcgtcatcccggcgtatggcgtgcgtcagcgcgctatcaccacgctggaagggctgggcaaccgcgacgcactgcacccggtgcagcaggcgtttattgaggcgcaggccgcacaatgcggttactgccttaacggcatgatcatgaccaccgccgcgctgctgcgcgctcagccctgccctgatgaccggcagatacgtgcggcgctgagcggagatcctgtgcgcggtgaagcgcgccatcaccttatgcctgcagcaggcggaggcggcatcatgagtgcggctaacgtccccacgcagcagcagttgctggcagccagcgacatcctgttgattgtcgatgagattcagccgccgccggggctggtgcccaaaggccagacgccgacgctgaaagccaaagagcgcgcactgtttctggctattgacggttccggccgcgtatgggccttcaatggccatgtcgatctcggcaccggggtgaaaaccgcgctgacgcaaatcgtcgccgaagagctcaatctgcgcatggatcaggtacatatggtgctgggcgatacgctgcgcgtgcccaaccagggcgccaccatcgccagcgccacattgcaaatttctgccgtaccgctgcgtaaagcggctgcaacggcgcgccagtggctgttacagcaggccgccgcgcgctggcagttgccggtggagagcatcacgctggacggcggtttcctgcagcatcccagcggtgtgcaactgtcatttgccgaactggtgcagcagcagcgcagcatcgtgccgattgatcatcaggttacactcaagcccgccagtgaatatcgcctggttggtaccagctcggcgcgggtggatattcccgccaaagccaccggcgaactgacgtgggtgcatgacctgcgcgtgcccggtatgctgcacggccgggtcattcgtccaccgtatgcgggctatgacaccggcagctttgtcggtacctcattgctcagcattgacgaaagctcgatcgcgcatctcgaaggcatcgtgaaagtggtgcagatcgcggattttgtcggcgtg

SEQ ID NO: 82138 - DNA, 963 bp, Glycine max
  Peptide Sequence Number=SeqID_173823
atggagagaagtatgattgatgctgccagtggtggagcccttggtgatatgactcctgctgaggctgggaatttgattgagaagatggtttccaactcccaacaattcagtgcaagaaatgatgttattgtccttagaggattccatgaggtggccacggattcatcttcatctgctgaaaataaaaagcttgagggaaaacttgatgccttggtcaacctagtaactcagcttgccatgaatcagaaatttgcacctgttgcaagagtctgtggttggaggaatcatccaaatctgagatggacaagtcctccacaacaacaacagcctgtccctccttttcagaatgctgctggtccaagcaagccatatgttcctcctccaatgcagcaacagcagcaacaatcacaacaaagacaacaagcaactgaggctcctcctcaaccttccttagaagagttagtgaggcaaatgaccatccagaatatgcaatttcaacaagagacaagagcctccattcagagtctgacaaaccagatgggacagatggctactcagatgaatcaagctcagtcccaaaattttgacaaattgccttcacaaattgtgcaaaatccgaaaaatgtgagtgccatcaccttgaggtctggcaaccaaattcaagtgcctccactagtagcagcacctgcacctgaacctgtcaagcttcattctacacttgaaaaagaggatgagatagctgcacaaaagagaaagcttcctaataaaaaatttcatgcaagtggaccttcttctagtaattctgacttacaacaacatcctatccctcttccattcccacctagagcaattccaaataaaaaaaaaggaagaagtggaaaaggagatcctggagaccttcaggaaagtagaggtaaacatacctctgttggatgcaataaagcaaattccaagatatgctaa

SEQ ID NO: 82139 - DNA, 1116 bp, Glycine max
  Peptide Sequence Number=SeqID_173824
gactgcacgtcctcgccatcagaaggactgcacgtcctcgcttcagaaggactacacctcctcgactttagagggttgcacgtcctcactttcacagggctgtacctcctagcctttagagggctacacgttctcgccatcagagggctgcaagtccttgcctttagaaggctacacgtcctcgccttcagagggctacacgtcctcgcctttagagggttgcacttcctcgctttcagaggactacacccccttgactttagagggttgcacgtcctcaccttcacagggttgtacctcctggccttcagaggactacacgtcctcaccttcagaggacttcaagtccttgcattcagaggactgcatgtcctcgccttcagaggtctacacgtgctcgactttagagggctgcacgttctcgccttcataggagggctacacatcctcgcctttagaggactgcacttcctctcttttaaagggctgcacgtcctcgccttcagaaggctgcacgtcctcgcctttagagggatgcatgtcctcaccttcagaaggttgcacgtcctcgccttcagagtactgcacgttctcaccttcagaaggctgcacgtcctcgccttcagagtactgcacgccctcgccttcagaggactacacttcctcacctttagacggctgcacatccttgccttcagagggcttcacgtcctcgcgtttagaaggctagatgtccttgccttcacagagctgtacgtcctcgccatcagagggctacacgtcctcgcctttagaggactacacatcctcgccttcagaggactgcacgtcctcgcctttagagaactgcacgtccttacctttagaggactgcacgtccttgcctttagagggatgcatgtccttcccttcagagggctacatgtcctcaccttcagagggttgtacgtcctcacctttagagggctacacgtgctcgccttcaaagggttgtacgtctttgcatttagagggctggacgccctggcctttagagaactgcatgtcctcgcctttacagggcttcatgtccttgccttcagaggactgcaggtcctcgccttcagagggctacac

SEQ ID NO: 82140 - DNA, 164 bp, Glycine max
  Peptide Sequence Number=SeqID_173825
atggcttttgtttctcagattgaaccaagaaacgtagatgaagctttttatgatgagaaattattgttggctatgcatgaagagaacaaggctagattggttgcaaaaggatacaaccaagaggaaggcattggctatgatgaaacctatgcacctgttgcaag

SEQ ID NO: 82141 - DNA, 304 bp, Glycine max
  Peptide Sequence Number=SeqID_173826
atggcatgcaacatgtttgctccgtgccccaattttagggacctacacgggaggaaactaaaagggcctttagtgataattcccaaggtggtcatatctctcttgatggtctctagaggtatcatccccttcgaagaacatattgcggcagtagggactactagcaacaatatgttatcaaagagaaaaactttagatgagcgtgaaggcgacgcgagactcacgggtgcgtcttccaagggaagaagatgcgcggagtcgccaccaatgtttattcgaggaaaacgtcagaaaaaccggaaag

SEQ ID NO: 82142 - DNA, 333 bp, Glycine max
  Peptide Sequence Number=SeqID_173827
atggaggccatgaaagaccaaatgaccaccatgatggaggccatgatgagcataaggaaaatcatgaaggtcaacatggttacagtcaccactacaagtgccgccactgaggtagactcgactcacccatctggtgtgaatcaagcaccacccaatgttgtacatgtgcccgaggagaacatcgaccactctgctcctataccccttgagagccaacaacctcagcctgggcatgcacatgtcgctcaacccatgggggagacacatgaagtaccccgacaccacactcgggctgacttcgacccttacctcagatatgccactgaggtttag

SEQ ID NO: 82143 - DNA, 201 bp, Glycine max
  Peptide Sequence Number=SeqID_173828
atgaagaaacaacaatggaagagaagatgcaacggaagacaaaggagaagaggtaagaggcgatgccatccactagggaataagccttggaagaaggaacttcaccaccaagatgagccttggataagaagcttggagaggatgcttcattggaggaaaagaaagagggagagaaagagagaggggggagcacaaaattga

SEQ ID NO: 82144 - DNA, 467 bp, Glycine max
  Peptide Sequence Number=SeqID_173829
gcctctgccagtcctacggggttcctgttacccccagtaaagtaatccgaccgccgatcactcgagccttcatcgagaagtactacacgcctaggcaggcgcatagtgatgcacatcaggccacagacacaccgccaccacctcggcaggccgatccagctggaccactggacgtggagcgttatctacagcatttggttcgccagcaggcggccaaccaccatgggcaggtgcagatacatgagtgtctctaccagttcagcctcagtcaacaggggcagggttccaccccttttgtatgccctactccggagcagtttgggggtaaggttgcatggcctagagattggcccgatgcccagacaggggaggagcctgcaggatcccttggtgaggcggatgagtcccatatggatgaagagatgattgacttgctcgattttctgggagggagcagagccacgtga

SEQ ID NO: 82145 - DNA, 144 bp, Glycine max
  Peptide Sequence Number=SeqID_173830
atggaagtgatggaagggtgtgcaatatggtgtggtgagaggataggaggagtttgtggaggtggtggagttcgtggtgcatgttggcgctgttatatgggggtgttgcgtggccgtggggttgaagatgaattgcagcactag

SEQ ID NO: 82146 - DNA, 336 bp, Glycine max
  Peptide Sequence Number=SeqID_173831
atgtcatggaacttcacggattgtgcaacaatgcttccttttgacttccagcatgtcacgaaacttcacagattgcctaacgatgggtgccaagtacctcgaagtggtcaaacgagggtcgcatcccaacaaacggatggtccccggacgaaattaggggatagctggtggttttcggcgaaggtgatttcaaacggagttaatcccgtactcgaatggcacgaagtattatacgaccattctgcccacaacagaaatcgtccccacaacgctggcttgcgatggacgaaggccctcaagtattgttctactatccgatttgccacctccgtctga

SEQ ID NO: 82147 - DNA, 258 bp, Glycine max
  Peptide Sequence Number=SeqID_173832
atgaaaagcgaaaatagtgatgatatgatctcaggaagggagacctcagtgactgaggaaggtcttcagagggcgaggctcatgggtgcactttccaaaggaggaaagatgcgcggagtcgccaccaacgaaggtattagcacctctcacgtcgacaaaagcggggctcttgctcctacgtaccctccatcgaggaggaaatcagacctacgtagttctttcttaagcgtgaatcaagcgattctttttactggaaag

SEQ ID NO: 82148 - DNA, 195 bp, Glycine max
  Peptide Sequence Number=SeqID_173833
atggagagatatgaacagctgaggttgtccctacacgtggatgggttatccaaggttagtatggacaaatggatggatataacagatatgggatatgtaattgcgtcaagatataatgtttatctgaaagatcgttgtcccttactgtctatggcattgttgtggtcaagcaattcgtatctagaggcaaaatag

SEQ ID NO: 82149 - DNA, 363 bp, Glycine max
  Peptide Sequence Number=SeqID_173834
atgactcagcatatcagtgttacagttgtggattctaggtctgggcaatcgcagtttgagtctaaaagttacataaagacttggatacaaagttcaaaacgcgatgtctatcttggagcctacctaaatggcggacactggcagatggtggtcatcctgcccaaggaacacctagttgtctggttttgttcattgcatagtagaccagacaactaccttaaggggattattaacagtgctttaaaaggtcttgatgatgctccacagcctaaatcaaaggctcctactaggtggattgtcatcaagtattttaacgatcctagaccattggagctagagagattaaaggcgttgcagatctag

SEQ ID NO: 82150 - DNA, 354 bp, Glycine max
  Peptide Sequence Number=SeqID_173835
atggttccaaaagataacacattgttagaccgtcattatgaggcaaagaagatattgtgtcttatgggtatggagtataagaaaatacatggtatcatgctacaaattgaaggatgtgactctagtagtgatgagatgaaagaaaatgtgatggatgtggaagcaatgccttccaaggttattttgatgatgctaaagaatcaagagctaattccaaagattcaagaatcaagtttcaacaatcaagattcaagaattcaagaatcaagtttcaacaatcaagattcaagaataatcaagatcaagattcaagactcaagattcaagaatcaagagaagactcaatcaagataa

SEQ ID NO: 82151 - DNA, 219 bp, Glycine max
  Peptide Sequence Number=SeqID_173836
atggatgattcatccagtgtccctccttcacaaggcaatacttcgaaccactacccatcatggctcttcctcggcaactatcagcatggaacatttagagttgcttgcacaatagatacggcagcaagtcactatggatatcaatcagcagctcactcaccaagtgacttaacaagtcactcgggatatcactcagtagctcactcagcaagtgattaa

SEQ ID NO: 82152 - DNA, 249 bp, Glycine max
  Peptide Sequence Number=SeqID_173837
atgactttagggcgagtgaggacggtgagagtgagagtgagagacaaagtttttggaggaagcgtcgccatggaagggttcagaagcacatgcaatgatttgattcacgtcgtcacggagaaaagggaatgccaccgacgaggatttgattcacgctgtcatggagaaagggaaacaccagcaatgaagattcagaaggttctcgattttgttgaaggggagaacttgaagaacaattgtaaaaagtag

SEQ ID NO: 82153 - DNA, 768 bp, Glycine max
  Peptide Sequence Number=SeqID_173838
atgactctcgaggaatatgaaaaagtactagaagagagaaggaaggctttccacgcacttaagactgaggagagaaaggtccttgagcgggatgaaattatgaataaattctacaaggtgacagctcagttggaacagtcgttgggtggtatttcctatgataaacttgatatatcagatgaagttaaagagcatgttgagttggttcttgcccagtttagaagagctaacgggagggttgatgaactagctgttaggttgagttatttatattacaactctggatctttcaacaaagagaatttgtacaagcttcaggatgaaaatgcagaacatatgcctatcgggtttgaagttgctttcccctctcttctcgatcatgcaagaagtttgaatattgaagtgccagatgagtctagtatcttgaaaaacatctttgcaatgagggacctcaagcttaagaagattgttgcttttgaaattgaatatggacaatgggaagagcaagaaagtgtcttaaaccattactcaaatcttttcataatgaaagcagatgttgtaaaggctgatgtcctctatttactctctggtgcgtggaaaccatcagtggagcgaattttcctttggattggaggctctcgtccatcgcagcttctaaacactttggtccacgacatggcagttgatccattgggtgtaggaaacttgggacttcagatggctcttactatggaaaaatttgaggcactagaaggttttgtaaactag

SEQ ID NO: 82154 - DNA, 312 bp, Glycine max
  Peptide Sequence Number=SeqID_173839
atgtggattggtggatttctcatagtcggtgttgctgcgcatgcagctatttttatggctttcatagtagtagcagtgggcggtaaagttgctttgttacctattccgttaggaactgtggattttttagtccatcatattcatgcatttacaattcattctgatgtttggggtagtataagtgaccaagggatagtaaatcatatcacaggaggaaattttgcgcagagttccattaccattaatgggtggctccatgatttcttatgcacacaggcatcccaggcgtggttattggcaagaacttattga

SEQ ID NO: 82155 - DNA, 234 bp, Glycine max
  Peptide Sequence Number=SeqID_173840
atggcattgttgggaacacgtccaacaaaagcgcagcaaccaaatgacccaacacactccaaaaaaattgaactaaaaagagaagaagaagaagaagaagaagaagaagaagaagaagaagaagaggaagaagaagaagaagaagaagaagaagaagaagaagaagaagaagaagaagaaaaggtgttaacacatgcgtaccaacaaggtggttgcacgtccaacaaaaagtag

SEQ ID NO: 82156 - DNA, 186 bp, Glycine max
  Peptide Sequence Number=SeqID_173841
atggcgttggggcagcattggtctctccggacaatcaatgtatacctttcacagcctggctggggttcgattgcaccaacaacatggctgaatatgaagcatgcgccctggccgtctaggcagaaattgacttcaatgtcaagctactcaagatttctttacaacaagagaccctcagtctcttaa

SEQ ID NO: 82157 - DNA, 117 bp, Glycine max
  Peptide Sequence Number=SeqID_173842
atgtggaccaccacgggggaggagcttgccacccagctcgctcaggtgcgcaaggttgcttcctccagaagcaacagccttctggaggaagaatctggaaggcccatgtgggcctga

SEQ ID NO: 82158 - DNA, 708 bp, Glycine max
  Peptide Sequence Number=SeqID_173843
atggcgcacagcggtgaactggccgcgctgaccgccgaacgcgtctggaaggaaaccgaaaaggcgctgcaaagccagagcccgcaggtctattttcaggtgctgcgcgattgcggtgcgctggcggtgctgttcccggaaattgacgcgctgttcggcgtgccggctcccgccaagtggcacccggagatcgacaccggcgtacacacgctgatggcgttggcgattgccgcccgcctcacgccggaggtggacgtgcgcttcgccaccctgtgccacgatctcggcaaagggttgacgccgaaagagttctggccgcatcaccacggccacggcccggcgggcgtgcggctagtcgaagcgctgtgccagcggctgcgggtgcccaacccggtacgggatttgagcaagctggtggccgagtaccatgatttgatccacaccgtgaacaagctgcgtccggagaccctgttgaagctgttcgacgccatcgacgtctggcgcaaaccgcaacggctggagcagatgatcctgaccagcgaagcggatgcacgcggccgcaccggctttgaggagaatccttatccgcagggcgactatctgcgccaggcgtatcaggtggcgaacgcggtatctattaaagaagtggtagccagcgggctgcagggcaccgcgatccgcgacgagctcaaacgccgtcgccagcag

SEQ ID NO: 82159 - DNA, 345 bp, Glycine max
  Peptide Sequence Number=SeqID_173844
atgggattccggggcttccgggacacccgtaatgcttccagtgttttttggaggaagcaacccagctcgcctgggcgagctgggcggcaacctcctccccctttttcctataaaaaggctgaagggggctgttctaaggatccctcagccccttggctatgtatttcagctattttgggtgaaaaaaattgtttccgtgaagaaaatccaagccgaggtgcttccgtaacgcttccgagatgtttccgtaagcaaatccgtgaaggttttcgtccgttcttcaccgttcttcgttcttcaacggaacaaaatctaaccgatcgttcacactataacctcggttaa

SEQ ID NO: 82160 - DNA, 257 bp, Glycine max
  Peptide Sequence Number=SeqID_173845
gcctctgccagtcattcggggtttccgtcgcacctagcaaggtgattcgactgtcgatcacccaggccttcatagagaagtattgcacgcctagacaggcgcagggcgatgcaccgcaggccgcagatgcaccgccaccacctcaccaggctaatccagctgggtcatttggcatggagcggtatttacagcacttggttcaccagcaggcggccaaccatagggcgcatgtgcagacccatgagtgtctctactag

SEQ ID NO: 82161 - DNA, 404 bp, Glycine max
  Peptide Sequence Number=SeqID_173846
ggatttcctgtctgttgtatctctcgttacaatctttcaaagaaatgaacgtggattcgaggcttttagtcctcacgggcaggatcaccttgggctaccttctggagtagagacgaaacatgaacggcagaaaccaatcaaggtacttaaggacgaacgcaagtggggatggggtcacgaccgaccgatcgttgcccttctctgtgcgaaacaagcagagaatgtcgctgcaaggcagccccgaagcttgcctcaaagaggtccaggaaggataaggcagccgaaggaactagttccgctccggagtatgacagtcaccgctttaggagcgctgtacaccaacagcgcttcgaggccatcaagggatggtcgtttctccgggagcgacgcgtccagctcaagac

SEQ ID NO: 82162 - DNA, 246 bp, Glycine max
  Peptide Sequence Number=SeqID_173847
atgtcaaatcataaaagcactgagtcaacactgaagaaccttgaggtccaagtgggacaactggccaagcacatagctgacaagtcatctaacagttttgtggcaaatacagaacagaatcccaaggaggaatgcaaagctgtgatgacaaggagtaaaaggtttatggaggttgaggatgaggataatgttgtgtataagaagaaaactgctgacaaaaaaggtactgatgacaagaaaaatgag

SEQ ID NO: 82163 - DNA, 300 bp, Glycine max
  Peptide Sequence Number=SeqID_173848
atgtatttctcaaatttggccatcctctcatcgtctccttgcttatggatgcttagcttgctaaaatcaaacaatggaggattaagtgagaattgcatcccttgggttgaagggttggcttatgctttcatctattcctctagcatggttctttcttctacctcttgttcttcttcacctcccacgtcacactctatggtggagataataaccttgcaatggccctttgggttctcctttatggttgtggaaaaaccaattgaagaggtttgcaattgtttggccaattaccctttttga

SEQ ID NO: 82164 - DNA, 207 bp, Glycine max
  Peptide Sequence Number=SeqID_173849
atgggcgccaagtacctcgaagtgatcaaacaagggtcgcatcccaacaatggatggtccccggacaaaattaggggttttataggcgctttatcaaggattttagcaaagtggcccttccactatccaatctgctgcaaaaggaggtggattttgattttgatgatcaatgcaaagaggcttttgattgcctcaagcatgtggtga

SEQ ID NO: 82165 - DNA, 640 bp, Glycine max
  Peptide Sequence Number=SeqID_173850
gtcgactctagaggatccccagtttgatctatgctatgatttatcattcatggacgttgataagatccttccatctagcagcaccttaggatggcatagccttaaagttaagggcgaggttcaaacgaagaaaggcttatggtggatacctaggcacccagagacgaggaagggcgtagtaagcgacgaaatgcttcggggagttgaaaataagcgtagatccggggattcccgatataggtcaacctttcgaactgctgctgaatccacgggcaggcaagagacaacctgcctaaaccgtgaaaacggggttgtgggagagctatacaagtgtcgtgctgctaggcgaagcagcagagaatgctgcaccctagatggcgagagtccaggaccaccttgcaaggctaaatactcctgggtgaccgatagtgaaagtagtaccgtgagggaaggggaaaccaccggagccgtagcgaaagcgagtcttcacagggcaattgtcactgcttatggacccgaacctgggtccgaaccgactgatgttgaagaatcagcggatgagttgtggttaggggtgaaatgccactcgaacccagagctagctggttctccccgaaatgcgttgaggcgcagcagttga

SEQ ID NO: 82166 - DNA, 417 bp, Glycine max
  Peptide Sequence Number=SeqID_173851
atgaccatgattacgccaagctcgaaattaaccctcactaaagggaacaaaagctgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaataacgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 82167 - DNA, 267 bp, Glycine max
  Peptide Sequence Number=SeqID_173852
atgaagaagcatgataaaggcaaagggccattaaagatcaatgacggtcctatgcaaatccagaagaaggcctcgaagagcaataattgtcattttagtggaaaatctagacatttccagaaggattgcccaaagcatggtttgtatgttgaaaccattttaactctgcatcataatattggcacgaaacatagtttagtgaatgaacgatctgctttcttgtggcataaacatttaggtcacagttctagaggtgggatcctctag

SEQ ID NO: 82168 - DNA, 282 bp, Glycine max
  Peptide Sequence Number=SeqID_173853
atggcaaatcaagaggagtgggtcccgtttatggacgtattagcattgataatctttggggttgtcctctttccaaacatggatggtttggtggacctagccgcaattgatgctttccttgcatatcaccatagcaaagaaagcccggtagtggctatcttggcggacttatttgacacgtttgagcgaaggtgcgagaagagtagcgcacggatcatctgctgcttactatgtacttttcctccttatgtgatgcaatacagcaggggatccttcaaataa

SEQ ID NO: 82169 - DNA, 785 bp, Glycine max
  Peptide Sequence Number=SeqID_173854
cggatgaagaggatacttcccatgcattggttgaatttcaaacgctacaagagtgacgttgccaaacaggccgtgccgccgcatttgaatgcggctgaatttgcgcggcattacgccgacaagccgcaagccgatacggaagagtatctttcgctgagcggggagatgtgctgggatgcggtggtgctgtgcgcccaccgttcaggcgcgcttagcaaggcgaaatacaagcagctgtggcagacggctttgccgccggcaataaaaatctttgcatcggcgtggggggcgcggtcggctgggaaaatctcaatctggcgcgcgatctgcgctggcagccggaaggcggttttttacgccagggcgacaacgaagtgctgcgcattttttaccggcctttccccgcctgagccgaccggcggcagtgatccgcgtttgatgtgggtcgatatcatagttgttctcgtcgatgtcgctcatcacataggcctgtatcaggcccttggttttgagataggcgaagggatcggcgaaggcgtgcgggctggtggcgtcttgtttccacagttcataggttttttcatccagcgtgccggggtgattggcggccagccgggtcaggatctgattgtagaacgcatagtcggtcatgatgcggtcctctttatcgcgagcgacagtctcggaaaatggcgacgtgaaatgctcaaggtgatatcaccgatgttgaagagtgcgccaagccacagggcgagcataaccaggatgccgatgatgatggaaag

SEQ ID NO: 82170 - DNA, 405 bp, Glycine max
  Peptide Sequence Number=SeqID_173855
gtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcccgtggcctgccggaggagcgcgtgcaggcactggtgaaggcgcataccgaggggcgccagtggggcctgttcggccagccgcgggtgaacgtggtgacgctgaacttcgcgctggaccacgggccaaggcgccgtga

SEQ ID NO: 82171 - DNA, 237 bp, Glycine max
  Peptide Sequence Number=SeqID_173856
atgagggacggtaagaggtcttcgtacgtctttgggatcggggtgaattctggaattggccacgggggaatgttcctcatcacattggaactagcaccaaagtgggcattgccggtcgggcgagtcgtggttggagtcggagcttggggggcctccttttggatgggagcgggcgctctaggctgtacgggtgctcaattggaagagttcccagcacgagctgaaaagctcgggtga

SEQ ID NO: 82172 - DNA, 270 bp, Glycine max
  Peptide Sequence Number=SeqID_173857
atggcaataagattgttgaacctttacctgagagtcggcgtcgttcttggatacataaatgagaggaaagaccgaggaggagtggggttgggagcaaaacaaagtgaaggtcttaggacagtaggggaagaaggggaaggagaattcaagatttggagagcctccttcagtttctcaagtccctcctccaatgtcaatgcaccgccaaattcaccgctaaaggatataaaaccaaactctcactctctatatataacagaaaaccgctaa

SEQ ID NO: 82173 - DNA, 327 bp, Glycine max
  Peptide Sequence Number=SeqID_173858
atcgcgtcttttccggtttttccgacgttttcctcaaataaacgttggtggcgactccgcgcgtattcctttcgtggaacacgcatcccgcgagtcacgcgtcgccctcccgccgaagggtaggttgcgacaggctggaaccggggggccactcgaaggggcgacacggtcagatccgacgcagcatggcagcgatggaggggcccgcgagtacaatgatggtgaagtcgaaactactagcgaacaaactcgcggaactcatgcgatagagaaaatgccttgtgtccatggtggtttcatgcgcaccaatggcaccatcatgaaagg

SEQ ID NO: 82174 - DNA, 471 bp, Glycine max
  Peptide Sequence Number=SeqID_173859
atgaagcacttcactgacaccctcatcagtgccaacatattattgaggccacttgtccaacaagatggggacaccagacttcagaatgttataggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 82175 - DNA, 129 bp, Glycine max
  Peptide Sequence Number=SeqID_173860
atgactaccctgactcagacatggatgacgttgctgcttagtaacatcctacccaacgatcataattctgacctccctctgccgaagtatcagctggtgcaatttgtgaagttccgtgacatgtcgtaa

SEQ ID NO: 82176 - DNA, 411 bp, Glycine max
  Peptide Sequence Number=SeqID_173861
atgcagacagaactaaacatgagaaggctttctcaccccaacctggtcaatttattgggttactgttgggacgatgatgagcatcttcttgtgtatgagttcatgccaaagggaagcttagacaattatctattcaatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcacccg

SEQ ID NO: 82177 - DNA, 129 bp, Glycine max
  Peptide Sequence Number=SeqID_173862
gtgagtgtgcatgtggcccagctcatatctgacgctatttatcagtttgtagggattgcacctacgagaggtggagacaaagcccaagaggatgaggacatggccgacatgttagacttcctcctgtga

SEQ ID NO: 82178 - DNA, 354 bp, Glycine max
  Peptide Sequence Number=SeqID_173863
atggaggccataaaagagcaaatggccacaatgatgaaggccatgatgagcatgaagaagataatggaagccaatgcggttatagttgccgctattagcgctgtcgctaagtggttaaaaaccctcatgactatggcaggaatgggaaagttggatcatctagaggaaaggctcagggccattgaaggaggtgaagattatgcctttgctaacctaaaagagttgttcctaatacccaaacatggtcattcccaagttcaaggtgccagactttggcaagtacaaggggactactcgctccaagaaccatctaaagatgtactgtcggaagatgggggcatacgcaaaagatga

SEQ ID NO: 82179 - DNA, 1608 bp, Glycine max
  Peptide Sequence Number=SeqID_173864
atgacgcgagatattttgttgagtttcattaaaccctactatttgtcttcaacaaagaaacacgaacggaacaacatggacgaggaggagccgcgtgacgaaggacaacaaggaggttctgtcgagcaaagcccagagcaactggtggcccgtgccatagcccccgtcaagaaggatttcctccgtcctcctcccgttcgctcttcctctccaaacgacggcgtttccattcccaatgataacaacaagacctctgttctcgccaaggagaagaagtccaagcgccaactcaaacgcgaacgtcgtctggaacaaaagtcagcacgaaacctgtgtcccgaaattgccaaaacaggggatgttagttcatgtccttataaagacaagtgtcgtttcagccatgatttggaagccttcaaggcacagaaacctgctgatctagaggggcaatgtcctttctttaaatctggaggcgcttgcccatatggtttagggtgtagattttcgagtacgcatgaagatggtgtgccttctgccaatctgaatggtcttaagaataattccgaggtgaatgggttgagcaaacatgttcaaaagcttttgtggaaaaataagatgagcttctccaaggcagatgcccaactcaaaagtctaggcctcgtgggaacctctaagtcaaaaaggaatgacttggaaaataaagatgaaggtgacactggttcaaataagtgtgatcattctgattacagtggatcttgtgttgttacctccgactcatgttgtaagttggaatgccctgaagaagttatgaaagatgatgacaatgacatagatggaaaatctgaatctgatgtactttgcccccagaagagaagaaaaattgcagaaaattgtggtcctatggatgcagaaaatgaaggtcatcgcttcatcttcgactctatatgtgtaacttggcttcatactgctgaaacaggtgttagtgttactgagcaaattgttgaaagaagttgcacaaaatctgaacccgaagctggaaccgatgctctaaccccagaaactgatctaagcctgaagctgcactcacgtgaaaagaagctgattgattttagggagaagttgtatctcgcacccttgaccactgttggcaatctccctttccgaagagtttgcaaagtattaggagctgatgtaacttgtggtgaaatggcaatgtgcacaaatcttttgcagggtcaagcctctgaatgggcattgctaagacgtcattcatctgaagatttatttggtgtacaaatctgtggggcatatcctgatactgtggcacgaacagttgaactaatagagcaagagtgtacaatagattttattgatataaatatgggttgtcctattgacattgttgtgaataagggtgctggatcagctcttctaacaaaaccaatgcggatgaaaagtattgtagaagttgcttcaggcacagcggaaaaaccaataactatcaaggtatttgctgtgctaaacactacagagttggacacaatgatttatgtcactcccattaacatcttaatagcttactctctgtcttcctctgttttttggtaa

SEQ ID NO: 82180 - DNA, 234 bp, Glycine max
  Peptide Sequence Number=SeqID_173865
atgaagaggttattgattccagtatcattcttgaacgagcctttatttcaagaattgcttagagaagctgaagaatttggttactatcattctatgggtggtctcacacttccctgcatggaggatgtcttcttagatatagcttctcacttgaaaaggcataggtatataatgcccaatttttcagaaactcagaccataatgatcgttcaactatcaacgataacagattga

SEQ ID NO: 82181 - DNA, 1892 bp, Glycine max
  Peptide Sequence Number=SeqID_173866
atgacaggtcaagaaaacatgaaaggtcctttcaccaagtctggtgcattagcaagctttgattgttatgacccattggatcctaatgggaacatttccgtaacttttgacatcttccaacgtactccagataatggatatctggcaagggtgacccttcaaaactactatcaatatcggcatgtagacaaacctgggtggaaactaggatggacgtgggctaacaatgaagtgatatggtcaatgagtggtgccatagcaactgatagagggaattgttcatcttacagcggctctcagatgccacattcatgcaagaaagatcccaccatagttgatctctctctagatgcctcacaaaacaggtcagagcattgttgccgtggtggcctcctctctccctggtctattgatcctttctatgcattctcttcatttgaacttgaagtgcgcaacgtgggagataacccacttggacaagcacctattaatcttacattgatggccccaggtcctggttacacttgtagcccccttcttgacactgatctctcagtgtcctcagattttgggggactaagacaagttcctgttctcagaacttggaagtcaacatgtgcatactccagtttcttagcaaacacaataccggtatgctgtgtttccctctcatcattttacaaccccgccatcacatcttgccgtaattgcagttgtggatgcagagaagcagataaaagtacagcaacttgcataaggtctagttccttgtcacggtctaatgaggacaacacaattgatgaaatgattgaatgcaccgaccacatgtgcccagttcgagtccattggcatttcaagaacaattatatgaaccaatggagggtgaagcttacaatttctaactacaactacaacagaaactactcaaactggaacgtactcgttcaacatcctggtttcacccaaaaagcgagaacttacagcttcaacagcactaaacttcccacccttgggctccaagattattacaacaatgagctagtgcattctgataaggatggagtgggtcttgtgactacagaaatactattggataaagatccaaattctttcacagtaagtaatggatgggcatttccgagaagaatatatttcaacggggagaactgcgaaatgcctttacctgacacgtttcctatgttaccaaatggtggctccattttaagagctacttactgtgaggatgttgaagaaaagtggacctttgcttttcacgtatctacattgattgaagtgtctacctatgcacaatggtgtaggtttccacagggggttcctttggtccgttatcatgggacattcaaagatctcaatatgaactggatttgggctgggaatgatccaactttgggggttgatagtataggcacgataccatctgctcttgcaacatatgctgctgttctagcattacaaccatacttgatcatcaatgcaggcaccgctggtggcttcaagatttttgatctgtatggaattggtttacgtaaagtctttgaaacacccaaccttgtaaaggagcttaatctaaaggagttcattgtctttgtgcaaaacttgaatgttaaacaatatttatgcatatttctggtggctaaattgtctactggtggctctttagatatgacagagcaggatgaatcatcaataattgcaaatgatgccacagttatagatatggagggagctgctattgcatatgttgccgacatactaaaagttcctgcaatttttataaaagctgtgaatagtatcgttgatggtgacaaagcaattgtagaagaattcctgcagaatttggaagctctaactgctgttcttgatctgaacaa

SEQ ID NO: 82182 - DNA, 138 bp, Glycine max
  Peptide Sequence Number=SeqID_173867
atggggcatgccacattgcccccattcccttgctattcatgcctgaacggacagcatgtagagtttaaaataagtgcccaaattaaggacttagacctaggaatccaagcctttggttttaagtgcaagaaagcataa

SEQ ID NO: 82183 - DNA, 423 bp, Glycine max
  Peptide Sequence Number=SeqID_173868
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccggtccgaccgctgcgccttatccggtaactatcgtcttgagtccaacccggaaagacatgcaaaagcaccactggcagcagccactggtaattgatttagaggagttagtcttgaagtcttgcgccggttaa

SEQ ID NO: 82184 - DNA, 1251 bp, Glycine max
  misc_feature (9)..(9): n is a, c, g, or t
  Peptide Sequence Number=SeqID_173869
atggctccnaaaaagctttccgcgaagagatctaggagggacgccgcagctgaagggaccagtgtcgcccccgagtttgatagtcaccatttccggagcgtcgtgcaccagcagcgcttcgaggccatcaaaggatggtcgttccatcgagagagacgcgtccagctcagggacgatgagtacatcgattttcaggaggagatagctcgcagacattggacgtcgctggctactcccatggctaagtttgaccttgaggtagtcctggagttttacgctaatgcttggcccatagaggagggagtgcgggacatgcgttcatgggtgaggggtcagtggattccttttgatgcagatgccctaagccaattccttggtgacccgctagtgttggaagaaggccaggagtgcgagttcagtcagaggaggaacaggaatgacgggttcaacgaggaggccattgcccagctattgtgcacaccgaggcaggatttcactcggaccgctgccgggaggtgggtgcggatcatgcgcacaagcatgaccaccttgacccagatgtggatgacgttgctgcttagcaatgtcttgcctagtgatcataactccaatctccctctgccgaagtgtcagctagtgtatgccatcctgacacggatgagcgtccatgtggctcagttgattgctgacgccatctatttatttgcaggtatgccacccaccaggcaccctctagacccggataagtctaacagggccttggggtttctggcattgatcacgggcctctgccagtcattcagggttcccatcgcttctagtaaggtgatccgactgtcgatcacccgggccttcattgagaagtattgcacgcctaggcaggcgcagggtgatgcactgcaggccgtagacgcaccgccaccacctcatcaggttgatcctgctaggtcactaggcatggagcgttatctacagcacttggttcgccagcaggcggccaaccaccggaggcaggtacagatacatgagtgtctctaccgcttcagccttagtcagcaggggcagggtttcgctccttttgcatgccctactccagtgcagtttagggctgaggtcgcatggcccggagattggcctgaggcccaggcaggggaggcgcttgcaagatctccgggcgatgcagaggaggcccgcatggatgaggagatgacggatttgctcagtttcttgggagggagcagagccacatga

SEQ ID NO: 82185 - DNA, 201 bp, Glycine max
  Peptide Sequence Number=SeqID_173870
atgagagaagcaaggaggtcaaccctttttcaaatatacaacatgggttctggcaatgcaatgtggttggactctcatgtcgatctgaatgaatcatcctttccacggagatgtaactccagttacttcggaaatggtaagatctttggcgcaagaacgcaagaggaggggttgatccgtatcatcttgacttggttctga

SEQ ID NO: 82186 - DNA, 477 bp, Glycine max
  Peptide Sequence Number=SeqID_173871
atggtacgattcgctttgagtcaaggtgcaccttttgagggcaccattgttgatgactggaagttcgactattctagtcatgatgctcgtcgtatggtctataatgatcaggatgatatgaccggtagactgctggccggatcattaacctttgattgtcacatcatgcactatatcatagttagaattttacttccccgttgttctaatatggctcaagcctctgaggaggacttgattttgatgtgggctttccttatcggtcgtcagatcgactgggctcacttggttaggtatcaaatacaaaaggcattacgggccaatgcacctcttctgtatcctcaattggtcaccctttttctccgtcattttcaaattcctcttgatgatgaaccttttgttcaagtcaagcgatcttttgccattggtgctggtgcagtaacttcatttggttaccgtaaggatcgtgatggatag

SEQ ID NO: 82187 - DNA, 510 bp, Glycine max
  Peptide Sequence Number=SeqID_173872
atggatactccatttgccccgcctcctcctcctcctcctccttctcctactcctccttttcctgcagacacaacagtgtctctgtctaccttggaacggatacacaaagtgacacaactacgatcgttggccactagaccacctggggcagaaagactagtgatcaacatcaatcttgctattggcaaggctgacggtccccacaagaagaaattaagaacatatttaggtattgtcgctcgtgataaggtcgacatcacatacgagacctggaaggaagcagaatttgaaatcccaaaaacttctaatagtaggacaaaaaagaaaattcttcagactgtcggcgagcggtggaggcagtttaaatctgatttgacgaggaaatgggcacttgcacctaacatcgacggtgtggacaacactgtctatgaaaaatacgacattagcaaggagaaatggactcagttttgtcagacccacagagacccttcgtgggagaaaaaggcatag

SEQ ID NO: 82188 - DNA, 179 bp, Glycine max
  Peptide Sequence Number=SeqID_173873
atggctccgaaaaaactttccgcgaagagatctaggagggacaccacggctgaagggaccagcgccgcccccgagtttgatagccaccatttcaggagtgccgagcaccagcagtgcttcgaggccatcaaaggatggtcattccacagagagagacgcgtccagctcagggacgatga

SEQ ID NO: 82189 - DNA, 539 bp, Glycine max
  Peptide Sequence Number=SeqID_173874
tcattggaaatgcgcttagcgcaggtagtggcgctaagcctgaatcactcactaaagcgctaagcgccgctactgcactaagccccaaatgcttactggaagttacaatttcaagtagaggcacttgggttgctaccttggtacctaaacctttgcactctctcatccctgagcatttctgtttctgttttgtgcttattgctcctctgcatccttcttgcttctctgcattacacatccaattgactgattttggggacggcaacattgatgttgccattgtaaaagaattctacgccaaactctatgaccccgaggacaaatcacctaagcaggtgagggtgagaggtcatttgattaagtttgatgaggatatgattaacacttttaacactttcttgaagacccctgttattgtggaagagggggaatcactatgtgcttattctagatttgcactcctgaggcctgatcctcaagagttggctgctaagctctatatcctagggaagggattcgagtttaacgctgatggatag

SEQ ID NO: 82190 - DNA, 441 bp, Glycine max
  Peptide Sequence Number=SeqID_173875
ggaacaaaagctggtaccgggccccccctcgaggtcgacggtatcgataagcttgatcagcctcaacctacggatggacccgctccaaccttcggactactagctgggcgcatagacatccacgagctaccttgctggtttcatagctactccaccgtcctagtactctgttgtgagaatcgggaagctgatacaacaacccaccagttcaacttggctagtaccatcatgtttgttcaggggcacggtgtgaaagctgggaccctacgagcggagcgtggtcgtagtagcctgttgaacagtactaacgatagagggccacacggaaccaacggacagcggatcgcttactgggtgccgggatggtggtgctcaactagcctcctgttcctacttactataaactactacgaggaaagcacagctcgtggttggcgtggg

SEQ ID NO: 82191 - DNA, 566 bp, Glycine max
  Peptide Sequence Number=SeqID_173876
gccctctcgatgagtcaatctcttgctttctcataagggtggacccttgggtactagtacctatcgccttccgagggctacacacccttgcctttaaagggctgcatgccctcaccttcaaagggttgcacgccctcgccttcagagggctacacgtcctcacctttagagggatacacaccctcaacttcagagagctgcacgccttcaacttcaaagggttgcacatcctcgccttcagagggttgcacatcctcgccttcagaggactgcacaccctcgccttcaaagggctacacatcctcgccttcagagggctacacgtcctcgccttcagagggctacacatcctcgccttcagagggctgcacgtccacacctttagagggctgcacgcccgcaccttcagagaactcaagggtggccaactgtgcgagcacaaccagaggagggggcaggtctccgactttgatgaggagactatcgcacaactactatacataccagggcaagatttcgcccagtggctgcagggagacgagtgcggatcatgcgcaccaacatga

SEQ ID NO: 82192 - DNA, 261 bp, Glycine max
  Peptide Sequence Number=SeqID_173877
agtcacgttcaaagcggaacctatgagtgtggctattatgtcatgcattggatgtggaacataatcgtcgggcagttgaagactaattggacgctgcaaaacccttcaggtgaggatgatgttgctgcagatggaaacaaggaaaatcctactaatgaagctgaacaaaaagagcctgagaataagaaatttaaccttgaatttgagaactcctgtgattattccatcgttagtcacagaagaaattctcaattggcttaa

SEQ ID NO: 82193 - DNA, 159 bp, Glycine max
  Peptide Sequence Number=SeqID_173878
atgtgtgtgcctatgccaaagatggcacgagaatgcttcccaaatgaatatatgatgtggaattgcccctcaagagtgggtagatggcatgaaggtttcttttcaaatgcaagaaatggccccgaggaagcttgccacaaagaggtccaggaagaataa

SEQ ID NO: 82194 - DNA, 306 bp, Glycine max
  Peptide Sequence Number=SeqID_173879
atgatgatgaaggacaattaccggttgaaggatactcttctctccttcaaagtattttggacaggtttgatggactccaaacctatgttggttattttgatgatgccaaagaatcaagagttaagcaaaaggtttcaagcaaagattcaagaatcaagtttcaagaatcaagattcaagcttcaagaatcaagattatagattcaagaatcaagtttcaagaatcaagaatcaagtttcacgaataatcaagatcaagtttcaagacacaagattcaacaatcaagagaagactcaatcaagataa

SEQ ID NO: 82195 - DNA, 162 bp, Glycine max
  Peptide Sequence Number=SeqID_173880
atgttttgccatcaaaaaattcgaggtcaagatgatcgaggagatgaaagagagggaggaactggtgcgggtgggtctctagaggttccttggcggcggtggctagcagcagtagtggtggaggaagatccttttcacttcttggatgattctgccatttga

SEQ ID NO: 82196 - DNA, 854 bp, Glycine max
  Peptide Sequence Number=SeqID_173881
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatcagcacccacaatgatacaaccactgcatctccctatccattgtcaatctaccaatccaacatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 82197 - DNA, 757 bp, Glycine max
  Peptide Sequence Number=SeqID_173882
atgatcaccgccggcgccgccggggtgcactttgaagaccagctggcggcggtgaagaaatgcggccatatgggcggcaaagtgttggtgccgacgcaagaagcgatccagaaactggtcgccgcgcgcctggcggccgacgtgctcggcgtgccgacgctggtgatcgcccgcaccgacgccgatgcggccgacctgctgacctccgattgcgatccgtatgacagcgccttcgtcaccggcgagcgcacggcggaaggcttcttccgcacccatgccggcgtcgagcaggcgatcagccgcggcctggcttatgccccttacgcggacatggtgtggtgcgaaacctcaacgccggatctggatgccgctcagcgcttcgccgacgccatccacgccaaatacccgggcaagctgctggcctacaactgctcgccgtcgttcaactggaagaagaacctcgacgaccagaccatcgcccgcttccagcaggcgctgtcggacatgggctacaagtatcagttcattacgctggcgggcatccacagcatgtggttcaacatgttcgacctggcgcacgcctatgcgcagggcgagggcatgaaacactacgtcgagaaggtgcagcaggcggagttcgccgcggtggatcgcggttacaccttcgcgtcgcaccagcaagaggtgggcaccggctacttcgacaaggtcaccaccattattcagggcggcgcctcttcggtcactgcgctgaccg

SEQ ID NO: 82198 - DNA, 872 bp, Glycine max
  Peptide Sequence Number=SeqID_173883
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggttactttgaaaacaattgtggggttgctgatgttgaagaagcttgtcatctcggagcgcgtgcagagagggcttgcgggggagacgactacgccgagaatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 82199 - DNA, 975 bp, Glycine max
  Peptide Sequence Number=SeqID_173884
atgacttggaaagttgcagacccccagtgcaacccagctcacgagcatacatactacgagggacaaaaggcttttgaagccttgtcaaaggcgcaattcaaggaaaccaacaaactaacccttctctctcactccttaaccatttatgcacctcacaccttctccatcaccattcctctcaacccttcaaccttctccttcttccgaactcgaccagaatccaaatccatctacctcactcgcccccacaaacgttctcagaaaatcaaacttcactgggacttctctgaaacactttttagtactcgaaactcagctgagcctgagtcatgcttctaccttgctatctgctgcaatggaagggttgaattctttctgggtgatcttgttcttggtcttcccgtgcagctttcaactcaccaacccagtgaccaaactcttgtgtcgagaagagaacatgtgtttggaagcaagagttacgtgtccaggggcgagttcatgggttcaaaacacgaattagagattgaattgtgcagtggagaagaactgagagtgaaagcggatggtcaagtttgtttggtggtgaaaaggctggcgtggaaattcagaggcaacgagaaaatattcattgatggcgttgaagtagagttctactgggacgtgttgaattgggtggttaatagtgaagatggcaatggcaacaatggccatggtgtttttgtgtttcaagtaggtgatggtggtgctgtgtggcctgaaatggtgggtccagagaagaagttaatgaagaagaggttggtgggacccactatggcaccatcgatcttcaggacatcgccatcgagctccagtgtgttgcagtgggcggaggagagcagtgatggtggcagaagttcgtgctcttcatctacaaggtcatgtgggagtagtaatggtggcttctctttgttgctatatgcttggtggagagactag

SEQ ID NO: 82200 - DNA, 384 bp, Glycine max
  Peptide Sequence Number=SeqID_173885
atgtcagaattaacaaatgaagagcacggacaatgctgcaaaatggtcaagatcatgctgaaggtcgcggttccaccatatgctattttaaacaccgttaacgctaaggacgagatttacggtgaagttagtaagtcatttgctgtgaggtggaaagacatatttgatcgtttatggcatttcattgacaagaatggaaatttccataccgttgtctacaaccaaaatttggacaagccaaccattgtagcagggtggacaacactaagagatttttatcacctgatcggagatcatcaagtgtcgttaactcattatagtaataatgtattctttctcaccatattcaagagcagtagccttccaaaatcattcccaagataa

SEQ ID NO: 82201 - DNA, 831 bp, Glycine max
  Peptide Sequence Number=SeqID_173886
atggatagggtattctcagtggacgatatctccgatcatttctggccgccgcctccgatccccgtctccggcgccaacacctcctctcagatgagccgcagcgcctccgagtgggcctttcagcgcttcatccaggaagcttccgcctccgcaccctctcctccgtcttcttcctcccccgccgacgtcgtattcgtggagatcgatgatcagcccaaacccacccctccgcctccgtcacacggcggcgttctgcccagtgaccctggtcccgtggcccttgactccgaggaataccaggcctttctcaagagcaagctcaacctcgcatgcgccgccgtcgccatgactaggggatctttggctaaatctcaagacccgtcccctttttctgatggtggatcacagccgactaatccttctctagttggatctcagactacttctaaaggatctattccttctggaaatgatcaatctaagttacaagataaagatatcaatgcaccagttgggattccttccatacctgccatacaaaagaaacctgctgttgcaattaggccatctacaagtggatcatcaagagaacagtcagatgatgaggacattgagggagagacatctatgaatgacaacacagaccctgctgatgtaaaacgagtaaggagtaagttgaacaaattttatactggtggcaagttcaactgggggacaaattatgcttcgatttgtttatgccccctttggtgtgttggacggttagtcctcccatggaaggaagtattgatgctttctgacattttattctatcataggtttctcaattaa

SEQ ID NO: 82202 - DNA, 1290 bp, Glycine max
  Peptide Sequence Number=SeqID_173887
atgaaccctacaccagtttgcaggaaatgcatatatgagaaactctcggatgaggagacggattgctgtcctgtgtgcaatattgacttaggctgccttccggtggagaaactcagtgctcccaaagtttcaatgcaacctggctttacaggaaagagaacaaaaaacagtacaagaaaggctgccgctttacgtggatgcagtttccttcttgacgaatccataaagaaggaacaagcaaatggtgacgataatatggtatgctcaattttacctgattcatcaaatatgacttctgaaaatgaaagtcaggtgtgggctatggggacaacaggacttggtgattcttccatgcctgaaccttctaagaagcataagccccatgaagatacagagaacaatgtggaacatacagaagggaaggttgatctctggacaccactgaactgtcttgttgaagctgccaacagaacaaagtcctccaggtcaaattcacaagcaactcctcttgccaaattagagtccccaactactcctcatggtggacaagatacatctgaaactacaaccaaaacagacctacctgcttctgccaagagtgaattaaacattccaaaatccaaaaataaggatactggacataaaacaatatttggagatgacaaggatgcaaacagcttgccttcaggaccagggaagcgaagaaggttgcgtcctgctggtcagaaaagagttgctgcatctgagatgtctgcctcttccccagccccactagatacaacagggggcaagtgcaacaggaaaaacagtcctatttggttttcattagttgcttcagaggaccaggatggtgcggtgcctgtctcatttattcagaagtaccttgtgaagaaacttaatcttgcctgtgaagcagaggggggaggatctgagacggaagtaacatgggaagaccagcagaacatcaacaaattcggaaggttgaataatcgctttcacgagcttgaggatgagatcaaaatcgcaaaggaaacaaatgataatttggaggatgcaagcaacgagttgattctcacagatgaagaggtcattcggtttcaaataggagaggtttttgctcatgtgccaaaggatgaagttgagaacaggatagaacagataaaagaggtgacaagccagaaattagcaaaacttgaagaggagaaagaatctattcttgctcagatggctgaactcaagaaaattttgtatgcgaagttcaatgactcgatcaatcttgaggaggattag

SEQ ID NO: 82203 - DNA, 573 bp, Glycine max
  Peptide Sequence Number=SeqID_173888
atgaaccaaggtcatgttagtactgtggtgaagggtagctttggatacttggatcctgaatattttaggaggcaacagttgactgagaaatcggatgtgtactcatttggggttgttttgtttgaggcactttgttcaaggcctgctctcaatcctagccttgcaaaggaacaggtaagccttgcggaatgggcattgtacaacaaaagaagaggaacacttgaggacatcattgaccccaacatcaaaggacagatcaaccctgaaagcttgaaaaagtttgctgatgcagctgagaagtgtgtgtctgatcttggattcgaacgcccctccatgaatgatctcttgtggaatctcgaatttgctctcaatgtgcaacaaaaccccgatggtaaaactcacgaaccgcgtcttgatgaaagtgagtttgaagaagtaaacttggaaaacaatgacatggcagctcactacaaaaaccttagccttggaagtgagcatgaccttagccacgagtccagtagtgataaccatgcttccatcttctcgcaaattgccaatccaaaaggacgatga

SEQ ID NO: 82204 - DNA, 153 bp, Glycine max
  Peptide Sequence Number=SeqID_173889
atgggtaatgctcgtaagggtactggggcgaggaagaagaagggtaaggagaggagaggaagattgggaattagaggggtagcagaagcatcgcttgtgagggctgagaagggaatacaggtttggggctatccacaaaaagagggtatttag

SEQ ID NO: 82205 - DNA, 399 bp, Glycine max
  Peptide Sequence Number=SeqID_173890
atggcgaccgtagctgctgttcctgctttaactgcaaacgattcccacaagaagaacagaattcaggtttccaacactaagaaacctcttttcttttacgtcaatctcgccaagaggtacatacagcagcacaatgaggttgagctttctgctcttggaatggctatagctaccgttgtcacaattgcagagattttgaagaacaatggacttgccactgagaagaaagtattgacatctacagttggcatgaaagatgagaacaaaggtcgtctggtacagaaggcaaagattgaaattgtgctggggaaatctgacaagtttgacaatctgatgtctcctcctgccccaactgaatcagaagaagcagcagctgatgatgatgacaaaaaagagtga

SEQ ID NO: 82206 - DNA, 645 bp, Glycine max
  Peptide Sequence Number=SeqID_173891
atgcttcacagtgcacgcctagtcttttcagggcacacctccatctcagcttttgccttcagaccttctaatccctctattaagacaacctcttcactcggtttctacatggaacagtctcctcctttaaagctaaaacagtgtgaccaaccccatcttgcttgtcaagcaacaacacaggatgatgcagtttctctaaggaatgatgagtcacctgttcatggactaactgaagtggttgttggggttctgggaggagggcaacttggtcgaatgatatgtcaagctgcttctcagatggccattaaagtcatggttttggatccacaggagaattgccctgctagttccctttcttatgatcatatggttggaagctttgatgacagcactacagtggaggaatttgccaagagatgtggagtattgactgttgaaattgaacatgtcgatgttgatacattggaaaaacttgagaaacaaggagttgactgtcagcccaaagcctctacagataagtatcagcaaaaggttcacttctcccagcatggcattccacttcctgaatttatgaagtatttgaaaattgaaaattcttctttaggatacgaattgaggataagtgaatatgttttgaacagatag

SEQ ID NO: 82207 - DNA, 1809 bp, Glycine max
  Peptide Sequence Number=SeqID_173892
atgcggtggttcctccgaagcccaatcatcaaaacctcgctgctgaatctgagccctccaatttcgtttagacctcactgggcgaggaggaccttcacttcttcgagattgtcaatggcggccatccacaaccacagcaacagcaacagcgaaaccggactcgcgagacggttttggatcaagttcactcgtgaatccatcttcgccatgtacactcccttcgccatcgccttggcctccggtaatttgcacattgattccttccaccattacatcgcccaagacgttcatttcctacgcgcctttgctcaagcgtatgagttggctgaagagtgtgctgatgacgacgatgcgaaacttggaatctgtgagttgaggaaggcagttctagaggagctgaagatgcacaacttgctggtacaggaacgggagttggaccttgccaaagagcatggtattaattctgcaactgttaagtacacagagttcctgctggctacagcctctgggaagattgaaggactaaaaggtcctggtaaacttgctacaccatttgagaaaacaaaaattgctgcttatactttaggtgccatgactccttgcatgaggctttatgccgttatgggaaagaagttccaggaacttttggattccaatgaaagtactcacccatataacaagtggatcaacaactattcctctgatggtttccaggctactactctgcaaactgaagatttgctcgacaaactaagtgtctctttgactggtgaagaacttgatgtcattgaaaagctttattaccaagcaatgaagcttgaaatagagttcttctctgctcagccactcttccagccaactatagtacccttgactaaaggacataagcctgtggaagatcatctcattattttttctgattttgatttaacatgcaccgtagttgattcgtccgccatcttggctgaaattgccatagtgacggcaccaaaatctgatcagaatcagcctgaagatcaaattgttcggatgttatcttctgacctcaggaatacatggggttttctatctaaacagtatacggaggagtatgagcaatgtatagaaagcattatgcctcccgatagattgaacaatttcgattacaaagaattgtcgatggcccttgagcaactttcaaaatttgagaacactgcaaataatagggttatcgagtcaggggtactcaagggtataagtctagaagatataaagcgtgctggagagcgtctgatactacaagatggttgccctaacttctttcagagcattgttaagaatgaaaatttgaatgccaacgtgcatgttctttcatactgctggtgtggtgacctcattaggtctactttctcttccgctgatttaaatgagttgaatgttcatgctaatgagttcacttatgagggatctgtttccacgggtgaaattgttaagaaagtggagtctcccattgacaaggttgaagcttttcgtaacatattgaaaaattgcaatgatgacaaaaagaaattaactgtttacattggcgattcagtgggtgatttactttgcctacttgaagctgatgtaggaattgtgattggttcaagttcaagccttagaagtgtagggacgcagtttggtatttcatttgtcccattgtattctggcttggttaagaaacagaaagaatatgttgaaggaagcacttctgattggaagggtttatctggcattctttacacagtctctagttgggctgaagtgcatgcttttattttgggttgctag

SEQ ID NO: 82208 - DNA, 209 bp, Glycine max
  Peptide Sequence Number=SeqID_173893
atggacgaagatcaatggatgtatgacagtataatgtctgaagaagttgatatggatgatgaaaatgaacaagaatgtggtatgaatgaacaacatgttgattgttcggatgcgttcgatacttatcaggtgtttgctacccgagatgatgttttgcagtgggctcgatcagtagctcatgaaaacggatttgtaacagtaattatgag

SEQ ID NO: 82209 - DNA, 318 bp, Glycine max
  Peptide Sequence Number=SeqID_173894
atgtatgatcatttgaatgatgcttgtaagagcggtaaccgacagcttgctggttacatcaccctattacagtgttggatacatgaacatttttcctctgttgctgaatctttgagtgatccagactatgatgagatgtcaccacgtgtctgtcggtggattgctacgaaggcttcttcgaagtcattaccagcatcgacgtatcagtcatatacaatgagatcccgttgtcgtcagacacgaaccagagggtggtgtaacaatttggatatgttcagaccgttcctccacagactagggttcaatgttatcatttga

SEQ ID NO: 82210 - DNA, 126 bp, Glycine max
  Peptide Sequence Number=SeqID_173895
atgactgtctttcaggttgcgacaaagggttttgtggtggcgatgatggggtgggtcagagaggtaggagtggttgcagactgtgagggaaaagttccgctgatggggggcaagcaaggagcttga

SEQ ID NO: 82211 - DNA, 1155 bp, Glycine max
  Peptide Sequence Number=SeqID_173896
atgggacaagattgttcggagggttactgtacatggtgtggaggaagcaatgaattagttagttgtaaattatgcaagggtttattctgcaccaaatgtttaaagaagaatcttggtgtagaattgtatgctggaatgcaggacactagctggcattgttgctcttgccatccaaatcttttgcaaaaactgtccttgcaactagagaaagctgtggggtctgctgatataatagtttccagttctggtagtgattcagatagttcagatgattcagatgactcagatgattcagatgcaaaggttaatgttacaatcagctccaagcgaagacacaaaaagaagattcggaggatactcgatgatgctgaattaggagaagagacaaagaggaaaattgcaattgaaaaggaacgtcaggaacgcctgaagtctttgcgaggacagttttctgcttcgtcatttgaaatgagctctgacggctgtaatgggaatttatcagaaagtgcaagtgttgaagttcttggtgatgcactagcaggttacatagtgaatgttgtgagggagaaaggtgaagaagctgttagaattcctcctagcatttccgctaaactgaaggctcatcagattactggaataagattcatgtgggaaaatataatacaatcaatcagaaaagtgaagtctggggataaaggtcttggatgtattctagctcataccatgggccttggtaaaacttttcagatttgtagtcttttactgaaatcgtccttcctccccaccgccgccatcgtcatcggcgagctcttccaaaacgttcacacaatcaatttctcagaagttgcgtgcaaagaactatcttcttttggattcaacaggtggaacctgttattcacagtcatcatcttgaaggctacatcattaatcctcaaattcctcctaaatatgctccggttgaagatcggaattcaaataaagtcaccagcctatcttgctcgtgcttctacacatacttctgctgctgtgcaagttcaatgtgctcagcctatgcagtatgtatatgctcaacctgctcatttccaagttactgtacaggctgagcatattgaacttgcacaggagcaggttgcacagcagcagaagtatgtgtag

SEQ ID NO: 82212 - DNA, 3516 bp, Glycine max
  Peptide Sequence Number=SeqID_173897
atgacttcttctccacttcactcaccacttcatttcccccagcgtccacttttcacttccattcgtcccattccaaaccgaacattcatctccaacaacccccgccgaacaccacgaaccccactcttactcgctcccatcaccctcactccaccaatcaccttcgccgcaaagtccacacccacacccacaccctccccgaacgacgacgttttctcgaaacacctcgttcgcgcattgttctgcttcgccgttggtttctccgcgctcggtgcattccacgctcctcctcctgcattcgcaattgcagctccatggacttattgggcaaagagaggcaccgaggagaaagagagagccaagagtcaccagtactcagactgcaccgataggctacttgagacggtatcgtttctgttgaaaaccgtggacgaggttcggaacgggaatggcgacgtgagcgaggcggaggcggcgctggaggccgtgaaatcgaagaaggaagagatgcggaaagagattaacgggaggctctacccggcgctgaagaggctcaggagggagaggaaggcgctgtggaaacggtccggggagatcgtcggcgagatattgaatgcaatggcggaatacgataagttgaaggcgaaggtggccgcgaacgagaaggagaatgagaatgcgaggatgaaggagttggaggagagtgtgggagtgatggaggatgagtacaatggtgtgtgggagagagttggggagatcgaggacaggatttcgagggaggagactgtggcattgagttatggagtgagggaaatcaatttcatagagagggagtgcgagcagctggtggagagtttgcctactggctcagttaccaggctctcgaaatctgccattcagaaagatttggaaactgttcatagaaaacaagcagaacaaataattcttcctagtattttggatgtcgaagatcttgggccattctttcatgaagactctattaattttgcccaatgcttaacaagaagtcttaaagactctagggagaagcaaaggaatttagaggctcagataagaaaaaaaatgaagaagtttggcaaggaaaaacgcagtattatttattcacctgaagaagaggtggttaagggttttcccgaagttgagttaaagtggatgtttggaaataaggaggttgtgcttcccaaagctgttggtctccatctgtaccatggttggaagaaatggcgtgaagaagccaaggcaaatttaaaacagaatttaattaaggatgcagagtttggcagacaatatgtggctgaaagacaggaaagaattcttttggaccgtgacagagtagtgtcaaggacttggtacaatgaagagaagagtagatgggagattgatcctgtggctgttccttatgctgtctcgaaaaagctaatagagcatgtccgcattaggcatgactggggtgccatgtatattgcattaaagggggaggatgaagaattttatgtagacataaaggttgtagctgaatatgaaatgctttttgaagatttggggggatttgatgggctgtatatgaaaatgcttgcctgtggtattccaacagcggttcatctgatgtggattcctttctcagaattgaatatccgccaacagtttctattgattttaagagtgtctcatgggattttgagtggcttgtggaattctggagttgtcacgaatgcgagaaattggatctttaagaatattaaggatacaactgatgacataatggtggtgatagtgtttcctactgtggaacttttagtcccttacccggtgaggatacaattggggatggcttggccagaggaaatatatcagacagttgactccacatggtacttgaaatggcagtcagaagcagaattgaattttagatccagacaaacaacaacagatgatgatgaagaatcttcttgggtttgggcctttgcgaagagatccgaatatgcagaagttgcggcgagtggtataagtttgttcttgcatcttgtgcataagtattacatttctcaaaaattgaaaaaaatcaagcagaggagaaaggatggcgttgatcccataaagaccgcttttgaacagatgaagagggtgaagaaaccaccaattccattgaaaaactttgctagcattgagtctatgaaagaggaaatcaatgaagttgtcacatttttacaaaatccaaaggcatttcaagaaatgggtgcgcgggcacctcggggtgttcttattgtaggcgagaggggtacaggtaagacatctctagcattggctatagctgctgaggctaaggtgcccgttgttgaaattaaggcccaacaattggaggctgggctgtgggttggacaaagtgcctccaatgttcgtgaattgtttcagacagcaagagatctggctcctgtgataatatttgtggaggattttgacctgtttgctggtgtacgtggtacatatattcataccaaaaatcaagaccatgaaactttcatcaatcaactgcttgtggaacttgatggatttgagaaacaagatggggttgttttgatggctactactagaaatctcaagcaaattgatgaggccttgcagaggccaggtcgcatggatagaatatttcatcttcaaagaccgacacaagctgagagagaaaaaatattgtacttgtctgcaaaagaaaccatggatgatcagtttattgattacgttgactggaaaaaggttgctgagaagacagctcttttacgacctatcgaattaaaaattgttccaatggctttggaaggaagtgccttccggagcaaagtactggacacagatgaattgatggactactgtggtttgtttgcgactttcagttctatgattccacaatggctgcggaagaccaaaattttcaataagtttagcaaaggattggtgaatcatcttggactgacattgacaaaagaagatctgcagaatgttgttgatttgatggagccatatgggcaaataagcaatgggatagagtatttgagccctccacttgattggacgagggaaaccaagttcccacatgctgtctgggcagctggtcgtggtcttactgctcttttattaccaaattttgatgatgttgataatctttggcttgaacctctatcctggcaggttacggcattaagcatgggggatgaccatgaatatgtgatggcagctaaagttgaaaagatgtttgatttggcatatctcaaagcaagagaaatcctgcagaaaaaccgccttgtacttgaaaagattgtggaggaattactcgagtttgaaattttgactggaaaggatttagaaagaattactaaagataacggtgtaatcagggagcaagagccgtttactcttggtgaagttcaagctagtgagccaacatctggcagcttccttgaaagaggaaatgcatcaggaagtgctctattagcatcctag

SEQ ID NO: 82213 - DNA, 1944 bp, Glycine max
  Peptide Sequence Number=SeqID_173898
atggttagaaatagtggaaagatgtgtcacaatttcaccagaaagctgttggatgggttatgtagggaaaagacaagtagatatggcagccacatcagagaggacaaggacactgaaaggagacagccacttaaaactaacactgggttaaaacagagggatggacctgacattcttgtttgtgatgaagcccatatgataaaaaatactaaggctgatgtaactcaagccttgaaacaagtaaaatgccagagaagaattgcgcttactggatcacctcttcaaaacaatctaatggaatattactgtgttttcttggaagcagccatgaatttcgaaaccggcaaggatttcttttctctcattcacaccaattcaactctgaccgatgtgaaaattatgaaccagaggtctcatatcctctatgaacagttaaaaggatttgttcaaagaatggacatgaatgtggtgaagaaggatctaccacccaaaactgtcttcgtgataactgtcaagctatctcccttgcagagaaaattgtacaagaggttccttgatgtgcatgggttcactactcaggtgcatcctgaaatgttaaggaagagatgtttttttgctgggtaccaggcattagctcggttgactaaagaagtcaaggattatgtaaaacacgaagatgctgttgagaattttcttgtggatgatagttccagtgacgagaattctgattataatgtacttgctggagagaagatgagatatgcaaatgacttgctgcaaaggaaagatgataatggctttttcctgaagggttggtggaatgatcttcttcatggaaaaatttataaagagattgatcacagtggcaaaatggttttgctgatggaaatactaactatgagttctgatgtgggtgataaggtgttagttttcagtcagagcataccaaccctagacctcattgaactttatctctcaaggatacctcgacgtagcaaacgagagaagttttggaagaaaggaaaagattggtataggttggatggaaggactgagagttctgagaggcagaagcttgttgagagatttaatgagcctttgaataagagggtaaagtgcactctgatttcaactagagcaggctctttgggtattaatcttcatgcagctaatcgtgttgttatagttgatggttcttggaatccaacatatgatctccaggccatctatcgatcatggaggtatgggcagaaaaagcctgtgtttgcttatcgattgctggctcatggaactatggaggagaagatatataagcgccaggaggggcttgctgctagggtggttgatagacagcaggtgcataggaccatttctaaagaagaaatgctgcatctgtttgagtttggtgatgatgacaaccctgagactttggttgatctaagtcaagataatgaacatcaagacaacccaattttggttgggcattcactgaaacacacagcaccacattcaaatggaactagttattctgataagttaatggaaagcttacttagcaagcatcatccaaggtggattgccaattatcatgaacatgaatccctgttacaagaaaatgaagaggaaaagctatcgaaagaggagcaagatatggcttgggaggtttaccagaaatcgttggaatgggaagaagtgcagagagtaccacttggtgagtctattatgcccgaacagaagccagaaatgccaattgcgatgccccaaaatgtatcagaaagctgcagcatcttgccaactaaactaagcaggcgtttcacgatacggaaatgcaccaaccttgcgcatatgttgacacttagaagtcaaggaacaaaatttggatgcagtactgtctgtggggaatgcgcccaggagattaggtgggaagacttgaagaagagatag

SEQ ID NO: 82214 - DNA, 1656 bp, Glycine max
  Peptide Sequence Number=SeqID_173899
atggctgggttgatggtgatccttgagaagggagaacaagagtggacaaccatggaagaaggatttgtagagagagcttacaacaaatatgtttatatgctgacaattaaagatgatcatgttacacgttcggactgccagtttaagcttaaggaaactgagagattagaggattctaagagcagcagagagcaaaataacgatgagagagtctcattgctttattcagcatggagtgctgtgttgaatgaacctacaagtggcggtaaagagcacttgcagaaacatggaattagtgggtccagtttgcctcatgccccacatttggaaaactgcaaggtgaaaacacagctatatgactattttgataagcgtaaaggaaatgaggttttcccaccatggacaacttggaagggatctttgcagacattccctgtcgctgcaatcaatgagcaaatgcaaaatcttaggcatgatgcagtctctgagggggcttatccaccatggattgcagggtccgatgaagaaaactatcccttgactagaaaagtgcagcgtgacatatggatccatcagcatcctttaaactgtagtagcccggatgtcaagttccttgtcactgactgggagagattacctggatttggtattggggctcagattgctggcatgtgtggacttcttggtattgcaatcaacgaaggaagagtccttgtcactaactattacaacagagctgaacatgggggttgcaaagggtcttcccgttctagttggagttgttacttctttcctgaaacctccctggaatgtcggcggcgtgcatttgaactcatgaaaagtgaagatgcgtggagtaagggaattgtgaccacaaaagaaaattatacaacaaagcatatatgggcaggacctactccaaggaaatggggtcttcagtggaattatttgcaacctactactgatataaatgggactctgttagcttctcatagaaaaatggatatacggtggtggagagcacaggcagtacgctacttaatgaggttcccaactgaatacacatgcaatttaatgaatgaggcccgccatgctagctttggaaaattagctgcagaaatggtccttcaaagtcttgctggggattggccaaaggaaagtagtggcagggcaaggtctaatgatattgatgaatacgtttggtccaatcacaagccatgggtccctaggcctcttctatgtatgcatgtaaggatgggagacaaagcatgcgaaatgaaggtagttggatttgaagaatacatgcagcttgcggataggactcggagacacttccctcaccttaataacatttggctgtcaactgagatgcaggatgtaattgacaagaccagagaatattctcattggaacttttactatacaaaggtaagacgccaagctaagattaacatgtcaatggctgcctacgaagccagtctgggaagggagaccagcacaaattatccacttgttaatttcttgatggctgctgactcagatttttacgttggggcattgggttcttcctggtcctttcttatagatggaatgagaaatactgggggaaaggtaatggctgggtttttgagtgtcaataaagacagattttggtag

SEQ ID NO: 82215 - DNA, 525 bp, Glycine max
  Peptide Sequence Number=SeqID_173900
atgaaactaattttagtgaacccgggcttgatgctcagatgggctactattgcgacaagattaccaggacgaaccgacaacgaaataaagaatttttggcacacccatttgaagaagaggcttgagagaagtaaagtgataaatacctactctaatcccttgcaagaggcacaaacagcttctagtgcaaggactttaataagtgttccacgagtagcggtggaagcttcgggtgcttcttctagtagaaatccacctattgtaggtctaggattttatggtgttgcctcttctgatattctaggacaaataattggcaatagttctcacagtcgtcagatcgataaagaactggaatttcggtctaatgtgtatatgaacagtcatcacaagggtatgaaaatgaaggagaaaagaggaataggagggaagaaacgagaaattactgtggctaaacgtcaagaacatctaaaggaggtattacaaactgctaaagctggaggagtcttggaacctcacgattaa

SEQ ID NO: 82216 - DNA, 819 bp, Glycine max
  Peptide Sequence Number=SeqID_173901
atggtttggactagaggcttaggccgtgctttaggtacggttagttgtagaggtctggggaaaggtgatcatgataattctgacgatgctccccagcgtcgaagacctaccgcatccgcacataggcaacgagtacctatgacttttgcggatgaggttgacatacctgtgactgagactgacgtacctgtggttgaggttgacgtacctggtcctgacttagcctcaactaaggacactggtgcaaacactgctgcagaggatgatgcagacaccatcgcacaagctgctgaggatgagcctgagggatttccgggtggtccgggcgacccatccatgttgaccgagtatgcggatcacgttgcaggcagcgtatggatgggagaggagcgtcctgagttgaagttatcctctcaccggaggaaggtgcatagtttaggcaggcatgtccctgccattgagaggctagttactgggacaggactaagtcctttgatcgtgtgttcgatagacactgaggtgacgatcacgttggacgacgtcgcatttcttctgcatctgcctgtggttggcgacttgcatgcctttcaactcatgcatgtggatgatgggatacagatgctggtggagttattgatggtcactgcagaggctaccagggctgagacaggacaatatcgtggaccgtacgtacgcctgcaatgggtacatgatatctatcagcgtcgatgtcaggcaggacattggacagttgcggctcgcgcgtttcttcttcatcttctgggttgcactctttttgctaacaagagtgcaacccat

SEQ ID NO: 82217 - DNA, 220 bp, Glycine max
  Peptide Sequence Number=SeqID_173902
ggcgcgtcccattcgccattcaggctgcgcaactgttgggaagggcgatcggtgcgggcctcttcgctattacgccagctggcgaaagggggatgtgctgcaaggcgattaagttgggaattcgattcattttcacttcacacggctgcgatttacctctgacgcttaacctggctcaggtgttggtgtttgtggccgtttgtggtgtctctcttcctag

SEQ ID NO: 82218 - DNA, 894 bp, Glycine max
  Peptide Sequence Number=SeqID_173903
atgacgacaccaccgtcttcctcctcagcttcgcaatcgcagttcgcctattcaaacccctcctcctcctcctcctacttccccgttccctttcaccttcagcaacccgcaaccactcactacgctgcgccctacgtcgccgccccctccgtgcaaatccccgctcctccagtcgtcggccccgttgcgcccgcccctgtacccggcgtatactccgccgtgccgcaatatcaggcacagcagttatttgagagggatgcgcagataataacgccggaggctctcgagaatgtcaaggcagcgattgcaagcagcgacgtggagcacaaaaccgatgccaaaaagaaagcggttcctcgcaaagctgctggccacgcttgggaggatcctatccttgcagagtggccagaagatgattatcggctcttctgtggggatcttggtaacgaggtgaatgatgatgttctctcaaaagcattttcacgatttccttcctttaacatggcacgagttgtcagagacaagcggactggtaaaacaaaaggttatggatttgtgagctttgccaatccttctgaccttgctggtgctcttaaagaaatgaatggtaagtatgttggaaaccgtcctataaaactacgcaagagtaagtggagggagaggacagattatgaagcactggagaaacagaagaatcacattcaaaagaaaccgaaaatggcaaggaaagattgtgtgctcaaattggtacttggtggagtagcagaaatacaatctgtcgatgccatccagtaccaccccacccccatatcattggtaattaattcgataaatgcacttcccagctttgtgtgttggatttgcctgtggttctcatcagcgcttatacgttga

SEQ ID NO: 82219 - DNA, 1314 bp, Glycine max
  Peptide Sequence Number=SeqID_173904
atggaggtcgtcactgatgcggcgtcgttggacctcgaattgttgcagcttccagagttttccggtttggctctcaagtctaacctcaatttcatcgagaagctcttcgaccagtggttgtcgcttccagaaagtaatcgattggtaacatcattactcaatgaagcaaagtctggtgctcctttgactgtcccagggaattgctctagtccaaatgcttcaagtaattctttgccttccatgtttcctgctggcactgctccgcctctttcaccaagaagtacatctggttcccctcgcattgtgaagcatagagttggcccttctaatttgggttctcctttgaaagttgttagcgagccagttaaagaagtgatacctcagttctactttcaacatggacctccacctccaaatgaactgaaagaagaatgcttgtttaaaattgatcggttattccatgatcatatggatggcatgcaggtgcatgctgaaactgtaatatacagaatctattattacattaatagatctggaaatggtcgtctcaccctgagggagctgaagcgtggaaacataattgatgcaatgcagcatgccgatgaagaagaagatatcaacaaagttttgaggtacttctcttatgagcatttttatgttatatactgcaaattttgggagctggatacagatcacgatttcttaatagacaaagagaatcttatcagatatggtaaccatgcgcttacctatcgaattgttgatagaatattttctcaggtcacaagaaagtttaccagcaaggttgagggaaagatgggatatgaagattttgtttacttcatactatcagaagaggataaatcatctgaaccaagtcttgagtactggttcaagtgcatagatttggatggaaatggagttctaacaaggaatgaactgcaatttttttatgaggagcaattgcatcggatggaatgcatggcccaagagcctgtgctctttgaggacatattgtgtcagataattgacatgattaaacctgaggatgagagtgttataactttgcgggacctgaaaggtggtaaactttcaggaagtgttttcaacatcctgttcaatctaaataagttcatggcctttgaaactcgtgacccatttttgatccgtcaggaacgtgagaacccaacattgacagagtgggatcgatttgctcatcgagaatatattaggctttcaatggaagaagatgtagaagatgcctctaatggaagtgcagaagtctgggatgaatcactagaggctcccttctaa

SEQ ID NO: 82220 - DNA, 2304 bp, Glycine max
  Peptide Sequence Number=SeqID_173905
atggaaattactcctcctcttcttcatcatctgtggtttttgttgttgctgctgctgctttgttatcttgttctctgtgcttctgccaccgatgttgaatttgacaactgcaactgcgatgacggggaaggtatttggagcatacatagcatcctcgttggccaaaaagtcagcgattttttcattgccgttgcgtatttttccatacccattgaactcctttactttgttagccgttcaaacgttccattcaaattgctcttccttcaatttattgccttcatagtgctctgtggcatgacccatttactcaatgcttattcttatcatggccctccctccttccaattgctgctttccctaaccgttgctaaattcctcaccgctcttgtttcctgtgcaactgctttaacccttccccctctcatccctcttctcctcaaagtcaaagttagggagcttttcctgaggcagaacgtgatggagcttggccaagaggttgggatgatgaagaaacagaaggaggcaagctggcatgttaggatgctcactagggaaattaggaagtctcttgataagcacaacatcctctacaccacccttgttgagctttcaaaggcgttggatttgcataattgtgcagtttggatgccgaacgaggaccgacgagagatgcacttgactcacgagttgaaaaccaactctgccaagaattttcagaattctattccggtgaacgaccctgatgtgttggagataagaaagaccaaaggggtgaagattctggggcccgagtctgctctaggagctgcgagtagtggtggctctgtggagttgggtgctgtggcggctattcgcatgccgttacttcatgtgtcaaatttcaaaggagggacgccggagttggttgagacgtgttatgctatacttgttttggttctgccaagttcaagcactagggtttggacctaccatgagatggagatagttgaagtggttgctgatcaggtggctgttgccctgtctcatgcatctgttcttgaagagtctcagctgatgagacagaagctggaagagcggaaccgagcactgcaacaggctaaaaagaatgcaatgatggccagccaggcacggaagtcgtttcagaaggtgatgagccatggaatgcggaggcctatgcattctgttctggggatgctgtcattgtttcaagaggataatttgaggtctgagcagaagattattggtgatacaatgttgaaagttggacatgtgctctccagtttgattaatgatgtaatggagatttcagaaaatgaaaagggaggcttccggttagagatgaaacctttccttctgcattcaatggtgagggaagctgcttccattgccaagtgcttgtgtgtttatgaaggctttggttttgaaattgatgtccagaagtctttgcctgaaacagttatgggtgatgaggcaaggacttttcaagtaattttacacatgattggctatttattgaacatgaatgacaaagggactctcaattttcgagtttttcttgaaagcgatggtggagacagggatgataaaaatattggaatatggaggtcaagcaatcaaaatgaatatgtacatataaaatttgattttcagattactgagagttctcagtcagatgaagcaatttcaacaatacattatactggtaggaggcagtactacaacaatgaacctaaggggggcctgagcttcagcatgtgcaaaaagttggtacagatgatgcaaggtaatatatggatatcaccgaactcccttggtttggtgcatggcatgacacttcttctcaagtttcagataggaccatcacttgaaaaatccatatttgcacctaaagattattcaagctcacagttcagaggccttaaggttgtgttagccgaggacgatggtgtaaacaggaccgtgaccaagaagctacttgagaagcttggttgtcaagtaattgctgtttcatcagggtttgagtgcctgagtgctgtaagtggtgctggtaactcattcagaattatcctgttggatcttcacatgcccgaaatggatggctttgaattggcaaagagaatccggaagttccatagccgtagttggcccttgattatagctcttataacaagtgcagaagaacatgtgagggagaaatgcctacttgcaggaatgaatggattgatccaaaaacctatcgtacttcatcagatagcagatgaacttagaacagtcctacaaagagcaggtgaaaaactgtga

SEQ ID NO: 82221 - DNA, 510 bp, Glycine max
  Peptide Sequence Number=SeqID_173906
atgctgtcacatacagcttcgcatcctcaactccaacaccaccgctgtcgtcgacgatgctgccaccttcgatggacttccccttgttgccgccagagaatccttcgttcacaccatccagttctttccggtggtcgaattgggcgcctcaccgacgtggttggatttgtcgtcgaaggtcggcgctctgtcagagtagagaatcactcccccacaaacacaggtgaagaagagtcagagaggactgcggccgtggaactcgcaatatcgcaacgtcaacagagcgttggtttctcagtttggcttagcctcgattcggttgtgcgattcagaagggatctcgtgcgggtattactcaatgtacctcagacactgccacctgaggagcttgttaggctgagagcacccccaaagagtgatgtaccaatcattaacccttttaaacttcccgcggcagatggctttgtctttggttttccaacaaggttgggaataaacccaaaatggtga

SEQ ID NO: 82222 - DNA, 243 bp, Glycine max
  Peptide Sequence Number=SeqID_173907
atggtgctggcgaaacccatgtggacacggattcatgcacgtttcgccaatggagctggcgaaaccggacacatggcacgcgtttcgtcaatggtgtcggcgaaacccatgctagatgagaaatgtcgacatgccatgcatggatggacatggtgtaatatgcatgcaagacgatgtgttgataggaatgacgacacaaggtgtttcacaacagaaatgacgaaaccttttccaaaaccttaa

SEQ ID NO: 82223 - DNA, 483 bp, Glycine max
  Peptide Sequence Number=SeqID_173908
atggctgcgagatgctttggcataggtgtttttgagaaggatccagagatcatgtcgaggtcttggtttgagacaccagggaggccacttcattatagagagtgtggtggggtcgtttccgatggagtcggcgtcgaagatgttggagtggagatcatagccatcaaggagagcttcaacttgttgtttccaattaggataattgttgggaagaagtttggtgacattggtgaaagtgatgcaagcaaggggtttggatggctcatgggggttgggaatgaaggagttgttgtcggccatgggaggcaaggaactcaaactgttatccgtgtctacgatctgaaggttccggaagtagcttgcttttccgaaaccatcctcggcgaagtgtccagagcccatttggataaaggtgtgttggccgttggtccgggaatttaccacctctcctccccactccaccatcgtggcgtggtcggctaa

SEQ ID NO: 82224 - DNA, 231 bp, Glycine max
  Peptide Sequence Number=SeqID_173909
atgaccagcagtgtgattcttagaagatcctctttcgtaatctcgcgccgctcttgcctccatcgagccgcttcctcacaggttccccgccgacaacgcgattactctaactacgaggaggttagcggcgcgaatagtgacgaaggactagagattgcgaatcttgggatggatacgcagatcgtagatgctctggccaagaaagggattgcaaagctcttccccattcag

SEQ ID NO: 82225 - DNA, 207 bp, Glycine max
  Peptide Sequence Number=SeqID_173910
atgctgatagctttgctcgagggtgaaatcacaagctacttccggaaccttcagatcgtagacacagataacagtttgagttctgtgcagagcatctcaaccttggccgaaaacacaaactgttacgacatcaagagctactacagcaacgaatggggcacttacttctactatggtgggcctgggaacaatcctcagtgcccctga

SEQ ID NO: 82226 - DNA, 1179 bp, Glycine max
  Peptide Sequence Number=SeqID_173911
atggctagttgtttagtgtgttgtatcatagtgacaagcttgtttatgtctctaagttttgcttctgctcaacaagggagggctttcttcgtttttggcgattcactcgtggacagtggcaacaatgatttcttggctaccactgcacgagcagatgcccctccttatggcattgacttcccaacacacagacccactggacgcttctctaacggccttaacatccccgacataatcagtgagaaccttggcttggagcctactctgccgtatttgagtcctctgcttgtcggagagaggctcctagttggtgcaaattttgcatcagcagggattggaattctcaatgataccggatttcagtttgttcaatatacgggaccaaagctgaacatcattcacatctacaagcaactgaagctattcgcacattaccagcaaaggttgagtgcacacattggtaaggagggagcttggaggcatgtaaaccaagcactaatcctcatcacacttggaggcaacgattttgtgaacaattattacctggtcccgtattcagtaagatctcgccagttttctctcccagactacgtgacctatatcatatccgagtaccgactaattttgaggaagggccctacatgtcttaagttagcaaatgagtgtgaccatgcaggagacataaaaaatttgaggctgtatgatttgggaggtcgtagggttcttgtaacggggacgggaccaatggggtgtgtgccagcagagttagctttgagaagccgaaatggtgagtgtgacgtggaactccagagagctgcgtccttgtttaatccacaacttgttgaaatggtcaaaggactcaatcaagagattggcgctcacgtcttcattgctgtaaatgcatatgaaatgcacatggatttcgttaccaaccctcaagattttggatttgttacatcaaagatagcttgttgtgggcaaggcccgtttaatggggttggactctgcacacccctttccaacttgtgtccaaatagagacctatacgcgttttgggatccatttcacccatcggagaaagctaaccgaatcatagtccaacagatgatgactggctctgaccagtacatgcaccccatgaatcttagcaccatcatggccctagattccagggtttga

SEQ ID NO: 82227 - DNA, 828 bp, Glycine max
  Peptide Sequence Number=SeqID_173912
atgtcctcactcatcttaccttacacttacacttacggttacgcccgcttccccttcaaactgaaccggttctctccccgagccgtgacggttcgcgccgcggtttcagctccggacaagcgaggcagaaagaagaagcagtcgaaggatgacgaaagtgcggtcgagaacggcctccggttcagtttcatggaggagctcatggaccgagccaggaaccgcgactcaaacggcgtctcggaagtcatgtacgacatgatcgccgcgggactcagccccggtcctcggtcgtttcatggcttggtggtgtcgcacgccctcaacggcgacgaagaagccgcgatggaatcgttgagaagagagttggccgcaggtcttcgaccggttcacgagacgttcttggcactgataaggttattcgggtctaaaggtcgcgccactagaggtctagaaatacttgcagctatggaaaagctaaattatgatattcgccaagcttggcttattctcattgaggaacttgttcgtaacatgcatttagaagatgccaacgaagtgttcttgaagggtgccaagggtgggcttaaagctactgatgaggtttatgatcttctgatccaggaagactgcaaagtgggggaccattctaatgcgttagacattgcctatgagatggaggcggctggccggatggcaaccacgtttcatttcaattgcctcctcagtgtgcaggttaccttcctcaatctggtttttgtggtcaaaatgttgtgttcttggggtcagtttggtgttgctgaaaaaataggtgtggaaacatttaggtga

SEQ ID NO: 82228 - DNA, 510 bp, Glycine max
  Peptide Sequence Number=SeqID_173913
atggcatatattttaatgctattggaggcaatgtcaaagggaatgttgttcgtgaatggaaaactttgccaggatccaaagcttgctaaagctgaagatttcttcttttctggattgggacccggagatacttcaaacccactaggatcaaagattttgcacctaactcaccctagagggacagagattcttgtagtcttggaaggtaccctctacgttggttttgtcgcgtccaatcaaaacgacaaccgtttattcaccaaagtgctgaacaagggtgatgtgtttgtgttcccaatagggctgattcacttccagcaaaacataggttatggaaatgctttggccattgctggtcttagtagccaaaaccctggagttatttccattgcaaatgctgtgtttggatctaaacctcctatctctgatgaagttcttgccaaagcttttcaagtggacaaaaacgtaatcgactaccttcagaagcaattctggtacaacaatagttga

SEQ ID NO: 82229 - DNA, 2931 bp, Glycine max
  Peptide Sequence Number=SeqID_173914
atgatctccgcgcagggcgaccaccaccgccaccaccaccactaccaccaccagccgcagcttcccggctccgccgacacctctcggcagcagttcaccgcggatcgcgtggagcccttctccgtcaagcaggaacccgcgtcgctcactcttctgccgttacgcggtcatgattctagtgaagttgatgaagatgtgtacttgtctcttgcacatcaaatgtacaagactggcaattataagcaagccctagaacacagcaacactgtctatgagagaaatccgctccgtactgacaacttactactcctgggtgcagtttattatcagttgcatgattttgatatgtgtgttgcaaaaaatgaagaagcactgaggattgagccacactttgctgagtgttacgggaatatggcaaatgcatggaaggagaaaggaaacattgaccttgcaattcgctactacttgattgccatagagctccgtcccaattttgctgatgcatggtcaaatctagctagtgcatacatgcgtaaaggaagactcactgaagcagcccagtgttgtcgtcaagcacttgctataaatcctctaatggttgatgcccatagcaacttgggtaatcttatgaaagctcaaggcttggtgcaagaagcatacagttgttaccttgaggcattgcgcattcaacctaccttcgctattgcatggtcaaatcttgctggcctgttcatggagtctggtgatttcaacagagcccttcagtattacaaggaagcagtgaaactaaaaccttccttccctgatgcatatctgaaccttgggaatgtatacaaggctttagggatgcctcaagaagctattgcatgttatcaacatgctcttcagacacgaccaaactatggcatggcttatggtcaactggatatggcaattctacactataaacaagctgttgcatgtgaccccagatttttggaagcttacaataacttgggtaatgctctaaaagatgttggcagagtggaggaagcaatccagtgctataatcaatgccttacattacagcccaaccatccacaagcattgaccaatcttggaaatatatacatggaatggaacatggtagctgctgctgctcaatattataaagctacactgaatgtaacaactgggttgtctgctccttataacaaccttgccataatctataagcagcaggggaattatgtagatgccatatcgtgctacaatgaggtcctccgcattgaccccttggcagctgatggactagtaaatagaggcaatacatataaggagattggtagagttagtgatgctatccaggattacatacgggcaattgttgtcaggcccaccatggcagaagcccatgctaatttggcttctgcttataaagatagtggacatgtagaggctgctgtgaagagctataaacaagcattgattcttcgtccagacttccctgaagcaacttgcaatctccttcatacacttcagggtcatgcttgttttgcaagaatgctccaaccatatgggatcgacacaggcttaaaggagcactcaaatcgggtgacccccaaagcctacactccaaagagtccgttagggcctctccttcctgattcagttattatcctttctgtctttcagatgtctgttcttcctagtgtccagccattccatgccatagcatatcctcttgatccaatgcttgctctggaaattagccgtaaatatgctgcacactgctcggtaattgcatctcgttttgctcttcctccattcaaccatccttctcctattccaatcaagcgcgagggaggatatgaaagactaaggattggttatgtgagtagtgactttggtaatcatcccttgtctcatctcatgggatctgtttttggtatgcacaacaggaagaatgtggaggtgttctgctatgccttgagtgctaatgatggtactgaatggaggcaacgtattcagtctgaagcagagcactttgtggatgtatctgccatgtcatcagatgcaatagcaaaaatgattaatgaggataagatacatatccttgtcaacctaaatggttatactaagggtgccagaaatgagatatttgctatgcaacctgcaccaattcaagtttcatatatgggattccctggaacaactggggctacttacatagactacttagtcactgatgagaaaaatcaagatgtgttagatcccaactgcccacacaaacgatcagattatggtctacctgaggataaatttatatttgcatgcttcaatcaactgtacaagatggatcctgaaatatttaatacatggtgtaatattcttaaacgtgtacccaacagtgcactctggctcctcagatttcctgcagctggggaaatgagactgagagcatatgctgctgcacaaggggtacaaccggatcaaattattttcacagatgttgccacgaagaatgaacacatcagaagaagttctttagcagacttattccttgactcgcctttatgcaatgcacatacaacaggaacagatatactatgggcaggtttgccaatggttactctgcctcttgaaaaaatggctactagggttgcgggctcactctgtcttgccactggactaggggacgagatgattgttagcagcatgaaagagtatgaagatagagcagtctcattggctctgaatcggccgaagcttaaagctcttactaataagcttaaagctgtacgcttgacttgccctctatttgacactgcccgctgggtgaggaatcttgagagatcatattttaaaatgtggaatctgcattgctctggtcaacgtcctcagcattttaaggtcactgaaaatgatctcgaatgcccttacgacaggtag

SEQ ID NO: 82230 - DNA, 369 bp, Glycine max
  Peptide Sequence Number=SeqID_173915
atggggtttatttgtgttatgttgttgaacaattgggtcagaggtgccagagagatcggcgacggcacatgtcggagattggttgagatgccacaaagactccgggagaatgagtacagagaagaaggcaaaatttatctaaaggccgtaaccatatttactttacttctccacgctagatgccgtcaccagatattgaaaaatgacaaccagcatacaaatactaatacaaatagttacctcgctcatcactcatcagtcaaaagaattacgacaagcaatataacttacgcatatagtagttcaagagaaaagggcaacagttatggcaagaaaaatacatcacaaagttcaaaggttgaaggttaa

SEQ ID NO: 82231 - DNA, 1356 bp, Glycine max
  Peptide Sequence Number=SeqID_173916
atggaagcagaggctctaagatcaagttttttttctgttattagtgagagtgctgatgggtgggtgctcaaaaggggactctgtctgggaaggaagatcttagtggctactttcgtagcttctgctgccccggttgttgttccacctcttgttgttgcttgtgctattggcatggctctttctatgccttgtgttattttcttggctagccatgtttgcaatttgagtttaatgagtaagttgctccctaggcctactcctcaggatactttgttgcatgaagagatgtgttttcggccaggtaatgatgttatacacacatataaagaggaacaagtccttcttgtatatgaaatgaagagaggcattgaaatagttggtgttcaatgtttggagaatggggaaaatatgacattggggagtgagtgtggcccacaagaagaagatgccaccaatggaatggaaggacgctctaatggggtgcaagagcaaccaataagtggggacaatggggttttaacaatgattgaagaatttaagactccctttgatgttacaaatgttgttttagaggaatccgaggatcaggccatggagggtgacatagaggaagaacaattacaaagagaaacaaaggggctgttagaaaaaattagagatgaaggtagaactgatatggcacaggagagaggagaatatgtagaaggaatatgtggagggaaaaatgaaagtgataaaaaatttggttcagctgttgaagatatggagatggaggtagcatgggaagacacacatagtggtatcatcgaggggaatgaagaagacttgggaaaggaagaagatccaaatgtatgtgaagagatgcttcattcaaaaaatgatgaaagtaaggatactatgttagaaggaaaagaatctgataatacaaatgattcactagtagagccaatggctgaaccttctgaactgcagattccagctgaaccaattagagatttgcctatagaagcactagtttataatatttcagtggacgaagactcatctgaggttatcagtgaaaatattggcattcctcggagcctccgccggattgtcctactacattgcccaatgagaaggatgtacccgttagatgcagaagctagagaaattgctaatgaaagtgcacttgatttgtttgatggaaaccaaatagaccatgacgagtatgcatacacaattgatttaaatgaaggctcttcaaatgttgtaaggcatacaaattctatgcaggttcttgtttcgtctgtagaagaagagtcaaggccatctaaatgttcctctgcagaaaaccatgtttgcccttctcaagag

SEQ ID NO: 82232 - DNA, 1248 bp, Glycine max
  Peptide Sequence Number=SeqID_173917
atggcacgtgtgggagagaaagaaaagacgagagttgtggtgaggtttgtggggaggagaagtttctctttcgaggaatggggtggtggagaagattcactgtggatgatgaatttgaggactggggaaacaatggattctggatcttatccggagcgtccaggggagccggattgttcatattacatgagaacaggcctttgtagatttggtgcaacgtgtcgatttaatcatcctcctaacaggaagctgtactatctgaagacaggaacatgcaaatttggagccacatgcaaatttcatcatcctaaagatcaggctggaattgctggaagagttgccttaaatattttaggctatcctctccgccctaatgagcctgaatgcacttattatttgagaaccggacaatgcaaatttgggaacacttgcaaattccaccatcctcaaccaagtaatatgatgctctcattacggggttctcctgtttaccctaccgtccattctccaactacgcctggtcagcagtcatatgctggaggaacatacattcctagtcctcgatggcaaggtccttcaagttatgcgcccttaattctacctcagggagtggtttcagtgcctgggtggagtgcatacagtggtcaaatggggtcaatctctacttcagacagtccacagcaagcaatgagaaacggtcaaacatatggaacttctcgtcaaggtgagcttgcaggatcacaaggggcatattctcaattccgttctggcaccgttcctgtagggttttatacattgcagagggagaacatatttcctgagagacctggtcagcccgaatgccaattctacatgaagacaggagattgtaagtttggcgcagtctgtcggttccaccacccacaagagaggctagttcctgctcctaactgtgtcttgagtcccataggccttcctttacgtcctggagaacctttgtgtgtcttctattctcgttatggcatatgcaaatttggcccaagttgcaagtttgaccacccaatggaaattttctctcataatatctctgcatctccttcagctgatgccccaagcaggcatctgttaggatcttcatctggaactgctgcgttaaatttatcttccgaaggacttgttgagtcaagctcagcaaagcccagacggctttcattatcagagacaagacagattccttctggtgatgatgacatcgatgatgatggatga

SEQ ID NO: 82233 - DNA, 186 bp, Glycine max
  Peptide Sequence Number=SeqID_173918
atgtctgcacaccccagctggtatggtattgagcaagagtataccttattgcagaaagatgtaaattggccacttgggtggccacttggtgggtttcctggaccacagtcagttaatgaaaagtggtacgaaaaggaaaagaaaaagggattgcaaaaattctccctattgactatcaaagtatga

SEQ ID NO: 82234 - DNA, 1089 bp, Glycine max
  Peptide Sequence Number=SeqID_173919
atggaagggtgccaacctcttgctgaacaaatgcagtcctccaatgatgtcgccaaaacggtgaagcttccattgccatttgatcttaatactatacctaaggaggatgaggaagcaagaccggcaacttctgatgagacttggctccccgattctgaatccgatgacaacttccgacccttacaacaaccatcatctactccagatgctcctgttgacattgatgatgttgaagaccgagctagtattgtggagggaggatctgactctgggaacaggaagaggaagagatccttggaggaatctgataaagggactgcagggaggtctttccatggagaaacagaattgacagtgcgaattggtagcaaaaaagagatagatgatgatggatatcgctggcgcaaatatggccagaagattatgaagggatgtctataccctagggcatactacaaatgcgcaagtgctgggtgtttcgtaaggaaacacgtggaacgggattcgcgcaacaataaaaatgtaattatcacttatgatggaaggcacaatcatgaacagccaccctcatggataactaacaagaataaacttgtactggatgatgaaggtgatgaagatgatggtggtgaagaacttgcaccaaccaataatgctctaatgactaggaattttctgatgaataccccaaaccctgcagaacctcaagttcacacacttcaacttcgtaatgacatgaatcctgaatttgccaacaggtttatgaggcccaaccattttggaagtttgaacaataacatgaacattgggtcttcctccaacaacccccacatgcattattctttcttgaataatactaattccatgcctcatcgctcctatggagtcaaccttgaccacccttatgctacccctcaacctaggggtccttcaatgtttccccagttgccaacttcaccaccatttaacaatatcaatgttccttctttttctagagggttttcttctcaggcttggcctaataataataaaaatgggtctagttcggtgtttccttccagggaaacaggtgcaagggacaagcactag

SEQ ID NO: 82235 - DNA, 732 bp, Glycine max
  Peptide Sequence Number=SeqID_173920
atggaaaacaatagccagaaccatcaccatcaacaccatggtttctctgccaaatcgagtagtactaaggagagaaggggtctcgactttgatttaaacgaacccataattgatacaagctttgagacttctcctctggttcctgctgataacattaataattgcctggtggaaatggaagggtgccaacctcttgctcctcccacacaagacgttgctgaacaagtacactcctccaatgatgcggaaaaggtgaagtttcgatttgatcttaacgctaaacctgatgaggaggaggaagttagtgccaaagttggtggagggagtgaaacacatgctgctgtatctgaatcagctgacaacgttggacctgacaatggtttggagctcactcttaataatgatgttcatccaacacatgctgctgatgacagtgattatgaagaagacagagccagtattggggaaggaggatctgacactgagaacagcaggaagaggaagagatctttggaggaatataagaaagggactgggaagtctttccatggggaaacaacagtggtggtgcaatttgagagcaaaaacgagaccatattggatgatggatataactggcgaaaatatggccagaaggttatcaagggacatacataccctaggtatactgttcgatctctcttgactagatgcacgtgcaagtttgtttatatttgtgtaccacatggatga

SEQ ID NO: 82236 - DNA, 1479 bp, Glycine max
  Peptide Sequence Number=SeqID_173921
atggcgtcaatgaactggctggatttctctctctcccctcaagaacttccatcacaacctctaaatgatgaagaagatcactctcaaacggtgacccctctccttggtttcaactcccacgaaatctcagtcaccgaatgctttgatctctcttcatttgccttagtagaagcacccaacagaaacaatactcatcatataactcctctagattattggaacacaaagggtttgggaacttcatgcagcagtaaccaaaacatggacaataaccaacaacacccgaaactcgaaaattttcttttggaaaaaccggcaaccgggggtggcggttgtccaaaaaacaccaactctatagggttgtccatgataaagacatggctgaggaaacaaatgtcatcacagtcagatgctgcaaacacatcactttccatgagcactactagagtgtcagagtctggcacagtagcattgccccttctaacagcgggtgaagagagttcctcctcgaagagtaagcaaagcggaattcttaatgttgacactgtgtccagaaaatccgctgacacatttggaaagaggacttccatataccgtggtgtaagcaggcatagatggacgggtagatacgaggctcacctgtgggacaatagtagtagaagagaggggaaaactagcaaaggaaagcaaggaggttatgataaagaagaaaaagcagctagagcgcatcaccaacatggtagatggcaagctaggattggaagagtagcagtcaacaaagatctctacttgggaactttcaacactcaagaagaggcagcagaggcatatgacattgcagccatcaaattccgaggactgaaggcagttacaaacttcgatatgaacagatacgacgttaagagcatacttgagagcagcactttgcccattggtggtgctgccaaacgtttgaaagatgctgatgaacaggttgacctcaccatcatggatcctcaaacccctcacgtggattctaacatcaatatctttggagcttctcaccattctcttgcattacatcaacctcagccttatagccacttgaattacacttatggacaaaagttttggattgattctgcttccgttgataataacaataatagctctggatctaactatgtcatttatggtggtggagatggttacgcgattcccatggctactcctacgttcaatattgcagatgatgatgatgttgttcaaaatagtagaagcaacggtcttgagcataatgatgtgaagatgcttggttatgaaaatgtgctcagctccagtaccgatccttatcatgcaagggacttgtgttatctttcgcagccagcatctggtgatactgttaagggcataccaatgatctttgctccggagcttcaccgttcacattgttgcatgagtagtaggaaattagaaagaagggtcatcaaagatgcatga

SEQ ID NO: 82237 - DNA, 187 bp, Glycine max
  Peptide Sequence Number=SeqID_173922
atgcaggctgatgaaaatctgcgtttagaactagaagaagatgttaaagaggagtgtacaaagcttggtcctttagattcagtcaagatacatgccagtgaagatgatggttcagttaaccatgccttagtccgggatctggaagaagatgccattcggctggagcagtttggtgccgaacttgaag

SEQ ID NO: 82238 - DNA, 968 bp, Glycine max
  Peptide Sequence Number=SeqID_173923
cgaaaatggatatacctcgtctgaaacttggaacccaaggcctggaggtttccaagttgggatttggttgtgcggggcttagtggagtgtttgacggccctgttcctgacgaggttgtcatctctctaatcaagtatgcattcagtaatggaatcactttctttgatacttccgatttttacggtccctacactaatgaagttctcgtaggaaaggagttgccacgagatcaaattcagattgcctcaaaatttgggattgtgaaagttgagtccaatgatgccattgtaagaggtgatcctgaatatgttcggtcgtgttgtgaggcaagcctgcgccgccttggtgtggaatatattgatctctattatccgcacaggattgacacaacagtaccaattgaggaaactatgggagagcttaaaaagttggttgaagagggaaaagtaaaatacataggattgtcggaagctagcccagacacaattagaagggcgcatgctattcatccaattactgctctgcaaatggagtggtccctttggtctcgtgaaattgaagatcaactccttccactttgcagggaacttggaattggaatagtaccattcagtccccttggccgtggattttttggtggtaagggggtcatagaaagtatacctgcagacagttatctggcaatccagccaaggtttcaggggcagaagctcgacaagaacaagaccttttattttaggatggaaaagttagcagagaagcatggatgtacaacaccacaacttgctcttgcatggcttcttcatcaagggaacgatgtggtacccatccctgtgaagttgagcaacgatgatttgagggaaattacagaggcaataccaatatctgaggtggtaggggatcggactgttgatacttttatgcgctgctcgtggaagtttgctaatactccaccaaagcatagctag

SEQ ID NO: 82239 - DNA, 456 bp, Glycine max
  Peptide Sequence Number=SeqID_173924
atggcacgcattataaccaatgtacagaataaatactctaatcctacaactcaagtaggacaagaccttaaagatactagtaacttacgtgagtccaaaattattctgaccaaatatgcctggagtgccaccgaagctgcaattgatgacaaaatacttgcaacaagccaggaaggtgtagtctgcccaaaatgggaagtaaactgtccaaaagcagaaccagtctgttcgattttaggggctgcagaactaaataatgaggatgactgtgtgttgccaaatggtgaagatgtagcctcagcaggagcagtattaaacagggacaaagattgcccaaagctgggtgttgaagaagagttagctccaaatggagatggggttcagcaaaaaatagatggttctgctgctgatgatgaagaaccaaaagctggtgaactgagagcaggagcaacttaa

SEQ ID NO: 82240 - DNA, 1212 bp, Glycine max
  Peptide Sequence Number=SeqID_173925
atgcctcctcttttccgaatttttcagatacccacatcacttatggacatcatcactgacctcgccatgttcattactccgctttggattgcggttatcgtcggcgtcgtcgtgggctgggcctggaagcccaaatgggcctttcaccccaaagacgctcttctcaagtttcgctcccctcgcccttccaatccccaaaacgacaccgctttcaccttctccaccaccaggcttgtttcctccgattcctccgcgcgtgaaaaagacgcgagtgcgagtgcgagtgcgagtcatttagtgacggaatacgatttgctgcatctgtggaagttggttgaggaaaaagacggagggccggcatggattcagatgatggaccgttctaccccgaccatgagatatcaagcgtggcgtagggatcctgagagtggaccgccgcagtatcggagcagaacagtgttcgaagacgcgagtcctgagttggtgagggatttcttttgggacgatgattacaggttgaagtgggatgacatgctcatacatgcttccaccattcaggaatgtgtcctcactggaacaatgatggtgcactgggtgcgcaagtttcccttcttttgtagtgacagagagtatatcatagggaggcgaatttgggatgctggacgaatttactactgtgtaactaagggagtaccttgcccctccatgccaaggcataacaagcctaaacgagttgatttattttattcaagctggtgtattcgtgcagttaaatcaagaaaagatgaccagctgacttcatgtgaagtgttgttgtttcatcacgaagatatgggcataccctgggaaattgctaagcttggagttcgacagggtatgtggggagctgtcaagaagtttgatccaggactacggacatatgagaaacaaagggcttctggtaccgctttgtcaccctgtgcacgtgctgctaagatcaacactaaagtaaccatggataatgtgaggtctctggaaaacacgatcagtgacttgttggagactgaaaatcaggattcttctgacaagccaggtggaaggaacatacctaagcttttaattgttggtggagccattgctcttgcctgcactcttgatcaaggactactgactaaggcagttatatttggagtagcccgaaggtttgcaaaaatgggaggaaagaggttgtga

SEQ ID NO: 82241 - DNA, 1314 bp, Glycine max
  Peptide Sequence Number=SeqID_173926
atgaagatcctctcagctgatatttggagcaagggtcttgatttttggatgattcagaaggacatgaaagatgtctcttccgttggattaatgaacggaaagatcacaatgcatccttttgaaaatttcgaaatggcagcagcaataggacttgtttcgtcgttagggataaactacggccaaatagcgaacaatcttccttcacaagacgacgccgttgcgttggtgaaatccatcggagcgacgaaggtgaagctctacgacgcagatccacgcgttttgaaagcgttcgcgaacaccggagtggaattaatggtaggtctgggaaacgagtacttgtctagaatgaaagatccgaaacaagcacaggcatggatcaaagccaacctccaaccctacctcccagccaccaaaatcacctcaatcttcgtcgggaacgaggttctgaccttcaacgacacctccctaacctcgaacctcctcccagccatgcagagcgtgcacgccgcactcatcaacctcggtctcgacaaacaaataaccgtcaccactactcactcccttgccgttctccaaacctcctaccctccctcggcaggagccttccgtccggacctagctccgtgcctagctccaatcctgagcttccaagccaaaaccggatctccgttcttaatcaacgcgtacccctacttcgcatacaaggcgaatccgaagcaggttccgttggagtacgtgctcttccaacccaacgaggggatggtggacccctccagtaacctccactacgataacatgcttttcgcgcagatcgatgcggtgtattccgcgttggattccttgggctacgggaagttaccggttcacatctcagaaaccggttggccttctaaaggggatcaagacgaagccggtgcgaatctcgagaatgcgaagaagtataacgggaatctcattaagatggctatgagcagcagcagcagcgccaagaaggggacaccgtgcaggcccaatgaggatttgaacatttacgtttttgctctgtttaatgagaacatgaagcccggcccagcttccgaaaggaactatgggctttttaagcccgatgggacccctgcttacccccttggcttctctctggcttctgtgccagtcgtcgccggtaataacaataccggcgtcgcaagcacgccgccgcaaccaacgtcaccgacttcttccaccggctatttgtcaatttcctctgcttcctctctgaatccaaagaaagacactggggcatggcaatggggaggaagagcaaaggcagaatga

SEQ ID NO: 82242 - DNA, 117 bp, Glycine max
  Peptide Sequence Number=SeqID_173927
atggtggtggtggagatgcgcgatgacattggggttgcaaatctgagggagagaggaacgcgtgagcctttgaggtgctctggtgtgatgatgggtttaatgggtggtgttttgtga

SEQ ID NO: 82243 - DNA, 1347 bp, Glycine max
  Peptide Sequence Number=SeqID_173928
atgagccaaacccgacccactaaggacagcgagtaccaagacaaaagttttcttattacaacccaggaacttccatcatgtgcagcagtgcagttcaccagggagccaggagatctcattacaagtagagcagtggtgatgatgctctgtttcatggctaaaaattcagaaacaaacagagcactagagaagcatgagagcgctcacatatttgtgtttgacgcaggagaagtgaaagttaattttgggctgcagtggtctggttggcttggtcatgatgcttcaaacaattggaaaaatggtgtgggcttctttcagctgccagtagttagtacttactcattcctttggattttggaatttcctggccatgcatgctttaccaaatataagtatccttaccttgggggcagtagtcacctctgctatctggcaatcactgcagtgttgatagccaatctatctgctttctacaattgggctatagcaatttctgatcgagcaaagatgcgtggccgcacaaaggaagctgaagaactatggaagcaggcaacaagcaactatgaaaaagcagttcaacttaactggaacagtcctcaggcgctcaataactggggacttgctcttcaggaactcagtaccattgttccagctcgagaaaagcagaagattgtgagaactgctatcagcaagtttcgcgctgccatacagttgcaatttgatttccatcgggcaatttacaatcttggaactgttctgtatggattagctgaggacactttaagaactgggggatcagtgagtgctcaagaagtttcaccaaatgaattatacagccagtctgcaatatacattgctgctgcccatgcattgaaaccaaattattcagtttatagcagtgccttgcggttggtgcgttctatgctaccattaccacaccttaaagttggatatttaaccgcacctcctgtgggggcatctattgcacctcataatgactggaaaggatcagacttctttttggatcatgaaaagcttcagcagatacccagaggagaacataaacaagtaccacctcaaaatctctcaggcagatcactagatgcagtgagtggggataagaagactatcaaagtagatatagcagatattacttctgtatcagcatgtgctgatcttaccttaccacctggtgcaggcctctgcatagatacaagttatggatcagtttacttggttgctgactcttgggaatcattggatggctggctggatgcaattcgtctagtttacacaatttatgtgcgaggcaaaagtgatgtactggctggtataataacaggatga

SEQ ID NO: 82244 - DNA, 1266 bp, Glycine max
  Peptide Sequence Number=SeqID_173929
atgggagatgtagcagataaattggcgtatttccaagcgataaccggtttagaagatccagacctctgcaccgaaatcctcgctgcacacaattgggacctcgaactcgctatatctaccttcacctcttcttcaaacccttcctccaccgacactcccctgcaaccccaccctaacgaccatgttccctccgcatccaatccccaaccccaaccccaacaccaacatcctccaccgcctcccggtttggcttggaaactcatcaccctacccgtttccgtcatttccggcagcctagggttagtttccggcgcgatcggcttgggcctttgggccgcgggaggcgtcctctcctactctctcggcctcgtgggcctgggctcgccctcgggctctggctcgggctcctcctcggccccgttggtttccgtgacggcggccgcttccgaggcgatggatttcgtggccgcgttcgagagggactatggctcctttgggcccaatttcgtcggtgagggcttcatggacgcgcttcagcggtccaggaactcgttcaagcttctcttcgtttacttgcattcccccgatcaccccgatacgccgtccttttgccagaggacgctctgctctgagaccattgcggcgtttgtgaacgagaatttcgtgtgctggggtggcagcattcgcgccagcgaagggtttaagatgagtaacagcttgaaggcttctcgcttccccttctgcgccctcgtcatggccgccactaatcagaggatcgcgctccttcaacagttacttgtatctgctattgtgagtctgactgctattgcagccgctattggtgttgtggttgcagtttctgccctagcggagcggcccccatccgcgacagacacctctatagcggagcggtttcgttttgcggttggagcggccgctatcgcggtggcgctgggcggagcggcgcagtttctggaacagtttttcgcgccgctacttcgaagcctccaccttttcctcctcctcctcctcctctgccactctccgtcctcctccccctcacgcgccagtgctcaccatagtgtagaagatgtgttttccagagaggaagtgggggcggttggtgaggacgacgtcgtttttgagggctctgaaggtgcaatggagggggcgcttgaggtggtgccgtggtggaggttgctgattatggggagagtgatggacctggtgggaggttttggaactttcaggagggagaagctttaa

SEQ ID NO: 82245 - DNA, 1491 bp, Glycine max
  Peptide Sequence Number=SeqID_173930
atggctcgtggcaacgatatggcgaaagaagtagaatggaggatcaaggtagaagaagacgatgacacactgcagaaaacaatagttggttgcatgtgggcagttacagcaggtctggctttgaagttgtgcaagtttgtgaagaaagcatgggaggttggggtgaatgacccaagaaaattcatccattgcttgaaagtagggattgcactttcagcagtttctctcttctactattggaagcctttgtatgatggagttggaggaaatgctatgtgggctgtcatgactgtggttgtagtttttgagtacacagccggtgcaactatatgtaaaactgttaacagaatgtgtggaacttcccttgctggatttctaggcattggtgtacattgggtagcaagtagggcaggagagcaatgggaacccgtaattgctggagtctctgtctttcttttagcttctgcagcaacattctccagattcatcccctccttaaaggctcgttttgattatggtattttgatattcatcctcacattcagcttggtgtcaatatcgggttaccgggttgatgaattgttggtcatggcacagtacagagtgtgcacgattataattggtagcataatgtgcataattgtcagcgttatcattcgccccatttgggctggtttcgaactctttgttttagtcacagggaacctcgacaaactggccaactccttgcgatgttgtgtggttcagtacttcggtggtagtgaagcctcagaagcagaaagtgatgaggtgtctgataaaaaattgctaggctacaagtgcgtgctaagttccaaagcaacagaagaaactatggcaaattttgctagatgggagcctgcccatggccgcttcaacttccgtcacccatggaggcaatatgttaaaattggggcatcgatgcgtagttgtgcttcctgtttagatgctcttattggatgcataaattcagacaaccaggcttcggatgacatgaagaagaatatgagcagcatctccatgaaagtgggtgccaattgtgcaagtgtcataagagagctagcaactacaataaggaaaatgaaaaaatcatctaaacttgatattttggttacacagatgaatagtgctgcacaagagctccgaagtttgttaaattcttgtccatacttggttaacccaccacataattccaaacgtagtacacgaacagaaacagcttcacctgatgatctagctccaaaaatagaaatcccacttatggaaattattcaggttgtaactgtagcttctttgctcattgaaattgtggctcgtgtggaagacattgtggaaaatgttgaagaactatcagatttggctaatttccaaccagaaatgaatgtcaaatccaaacaacatacatcggacagcaaggtctcccctgaccaacagaatgatggggaacccgttagaacactccaaatggtctaa

SEQ ID NO: 82246 - DNA, 546 bp, Glycine max
  Peptide Sequence Number=SeqID_173931
atggctagaatactccttgtaagaattgggcaatcctcccctcttgaactacctattgagagtgaggaacaagtatggaagatgcctttagcagaagcaagtgatgtgaagggaaacacggagaaatctcatgggatggctgtagcttctttacaagcagctgatgagtatttcaaagaaagtaagaagttgtgtgaagcattcaatgcagtacctccattgtcaagttctcaagaaaatagtacttttggtggtaatatgctttttcatgatccatctaactggcagtcatggtgcagaaatccaccactttgggggactatgaaatatctttacgagaaaattcctaaggatacttcaagcaaggtgcgaataaaccgtgatctgtactcctatgagagaatcatggagacagcaccaacattgcctgattttgccttggctttgaaaccagatgaatatcaacttccgcagatggatccctcttggagaacagaaaatgtgaaagacgggcaaagtggcaccacaaatcatatcaatggatga

SEQ ID NO: 82247 - DNA, 255 bp, Glycine max
  Peptide Sequence Number=SeqID_173932
atgtcttcttcgttctcttcacgggagagaatgatccagaatttcctattcttctttttctctatgcaccgtgtgtccgtggagccagcacttcggtgcaagattgtcgttgccgttgtggtgtgggtgaagaaggaaggagggaagcgagggggaggttgtgacttcactggagctggtgccggtgcggtgggggcacgttgcatgcctgaaatcatctctggtggtggtgaacggtggccagtgacaaagtag

SEQ ID NO: 82248 - DNA, 174 bp, Glycine max
  Peptide Sequence Number=SeqID_173933
atgaaaaataggtcaaatagatcaggttctgctccacatatgccggatttgtcttcaatcctcacacctgagcattttgatggtgtaacaaatcataagacttatgatagaaatatgtttacacagttctcctctaatggtcctctttcagccattataaacgctgatggttag

SEQ ID NO: 82249 - DNA, 849 bp, Glycine max
  Peptide Sequence Number=SeqID_173934
atgttccgcagaatcttgtcccatcatcgcgcactctcagcctgcgcccacaatgcaacaacgcgctcactcgttactcgccgcacccccaatgttccaccaccacccaccttcctaatcacaggatcaaggcccgtttcttccaaaacatcccaatccaacgaaaccggtgaaaccaccaataaggctaaaaaggatgtggcaaacgtcgaggatccctttagtgcccctacttataacattcccgagaagcctgtcacgttcgtggaaggggcttcctacggtgttgtcattcttgcggggctcggaatcgcagctgctgcaggatatgctgttttcaaagagcttatttttcaacctaaagagtacaagatctataacaaggctctcaaaagaattcaggatgatggtcagatacgagtaaggattggatttccaattactggttatggtcaggagagtagaaatcgagctgctcgccaaagaattcctcacagggtatggactgatgaggaaggtgtcgagcatgtggagctaaacaaaaaacttcaagaaaaggttgtgagggaggagacaaagatgaaaaaaagagagagaaaagaggcaagagactcagagaggaggtggggggaccttatcaagttcgaaacatttggactcttggagagtgagggagaggttaatttttatatccggggcccccatggacatggaaaagtatttgcggaaatgttcaaaggcgctgacaatgagtggaagtttacttacttgattgttgagattagagcaccatctaccgcacaaataattctggagtcatacatcccatcttacagtgcaaccaagtag

SEQ ID NO: 82250 - DNA, 261 bp, Glycine max
  Peptide Sequence Number=SeqID_173935
atgaccgtcgtgcctccattgcgcctccattatcagcccacgccgccaatagcgtgtcgatggtgcgttggtggtttgattggtgatggtggcttgggttgcgggtggttggtggttggtggcggtttggttggtgacgatggtgatatggttggcacccaaggttttgggacagaaaagataaaggagatgggcattgaggggggttatggaagacgaaagtctactaagtatccactaatgaacatggcttttaggtga

SEQ ID NO: 82251 - DNA, 1344 bp, Glycine max
  Peptide Sequence Number=SeqID_173936
atgcctatccttgatccattgtggggtgacttacatagccatgctccaggcccacatagccttgggtgtgaggggttttgtttaaacatttacaggaaaaacttcttctcactgagactaaatggagtctggttaggaaccacagccaggccataccctgattcaaagctaaaggagtcacaatatcaattgacaccttggcgttcagatacgaaccacgctaatgttgccacacaatcacaacctcactcgattggtgcacctttggcaacttcaaataaaaatggccttgaactggtacctcagcatatgtactctcaagtaaagcctcaggtctctgttgatgctcaggcaggcactgattggggtctattgggtcgcaaccagaatggcttgagtggtggtgtggcaacaagtgttgatactgatgatttgggtagattttcacctcttgcaagcaggaattcatcagcccatgatgcatccacccacctggtagttactcagggtgatactcgtcctgctcattatggagacgaagtgactaacaaacaggtcacatttcgtgtccccgtgagcaacaatgaagttgatgatcctgatggagatggaacacatagtatgagagaaacatctgctaactggagttctggcaaccctccttatacaaccactgttgatgatcccagttcttcatattctccttatttaccagcagttcttgaagaaccttcttcttcattttctgaggctgcagatgaagatccattgccggctatagagggtctccaaatttcaggagaagcctttcctggaagggaacttaaggcaggcggatactccatcaatggcactactagttgggcaaagcaaccaatctatcttgtcaatgctgatgatgttggtacattacttgccattgaagtccaacctctggataacaggaagcgcaagggagaacctgtgaaggtttttgccaatgataataaaaagattgcttgtgatcccgaaatgcagaaccacatagagaaggcttttaatagtggacatgcttcatatagagtttctctttcgactggatatcttgatatatgggaaccagcgacattgaccattaagagggaaggttatagtatcaaatgcagtggaccaaatggatttgtaatcacagaaaaattttcaccgtccaccactgttatgattccatatggacatacttcagagtttattataattggttccagtggtgctgaacaccttttaaaagcagaaaacaacacagatttcagtgggagatttcaccatctagcttgctgtgcttcgttatctgctaatgagaagtga

SEQ ID NO: 82252 - DNA, 171 bp, Glycine max
  Peptide Sequence Number=SeqID_173937
atggtgataatcattcattctatgattgaattgagtcgcacccaagatgaagaagttggagatgggacaacatcagtcatcattcttgcactcattgataagaattatcatcctacagttatatgccgagcttataacaaagctttggaggatgccattattgtcctttga

SEQ ID NO: 82253 - DNA, 351 bp, Glycine max
  Peptide Sequence Number=SeqID_173938
atgctgcagatattaagctggttactttggtcaaagatttccggcatctctgtcatggcaactagacttcagtttgagaataattgtgaagttggagtcttctcaaaacttaccaatgcctattgtttgtttgctattggaggttccgaaaacttctacagtggatttgaggctgagttagcagatgttattcctgtggtcaagacctccattggtggcactcgtatcgttggtcgtctttgtgttggaaacaagaacgggcttctcttgccccataccaccacagaccaaggtgattcctattattctgctgtttatttctattcacagtactgtttgatgctatgttaa

SEQ ID NO: 82254 - DNA, 2034 bp, Glycine max
  Peptide Sequence Number=SeqID_173939
atgttggtgatgcatttgttgtacatgcttgtgataattgttgtggcctttggtgcacctaagagatctcatgaagagtctgttcattcatcttcaaagcacccgaatgaagatttgggtacatattccaagttggtttcatcgtcagtttcaaatgagtaccatatgcctcatgatataactcaggactcccgggtggcaaaagtgcctcgaactgaatttcatgatgcagatagaagatctcctcttaatcctgtgtatcggatgtcgtcaccgttgaatgattctcgtacagatcatcctattggccctgagaacaggattgaatcaagggattccaaggacaatagagatctccggtttgagaaccgcgatacaaagacagagaagaaggagttgcatggtgaagcaagaagggatcctccaagtgctaagagtgaaaaggatgtgcgtgttgaaggtagaggagatgacaacaaggatgtcaggcatgatcgggatagtcataatgatccgaaaggtgacaccaagacagagaaagatggttataatgtggttagcagccacttgaattggaaagattcaaaagagtaccatagaggaaaaagatattctgattcccctggtgggaattgggacacatggcatatgtcacgtggaaatacacaaggctcagttgaggttgggaaggagagttcagcagcaggagaaagagatcatgttgaagctcatgaagctgtttgtgagaacaaagttgatcctaaaggtgatgatagatctaaagagaaagatagaaagaggaaggatgtgaagcatagggaatggggagatagggaaaaagaaagaagtgatcgtagaaacagtccacaagtaacaaacagtaccggtgactgcaaagaatctgccaaggaagatagagatgtagaaaggttggagagggagaaaaaagatcttccaaaagagaaagaaaatttaacagagagggaaagggatcagatgaagagagaatcatggaatggaatggagaaagaggtttcaaataacgagaaggaatctgttgatgcatcagataaactaactgaacaagaaattgtgttaccagagcagaagaaacaaaaagaagttgatagctggaaaaatgtagatagagaagctagagagaggagaaaagaaagggatgctgatttagaaggggataggtctgataaacgtaccaagggccttgacaaggaatcaaacgatgggtgtgctgatgtagaaggggtgatggagaaggagagggagatcccatccccaagacaaagacgggtactttcttcctttacctttctttgttttctgatcgtttgcaaatttgatgatccagcaagtaaagtagaagtttcttctgttgtttataaagttggcgaaagcatgcaagaactgataaagttgtggaaggaacatgaatcatctcaatctgaaatggagaaaaatggtgaaagctctaataatggtcccactctggaaattcggataccatctgagcatgtaacggctacaaaccgccaagatgctctgagacatcaatatccatattctgccaattatctggtacctcttgatttattcaaatcttctgcttcttccatagttccacctgtcagaggtggccagctttgggggaccgatgtgtacacatacgattcagatcttgttgctgttctcatgcataccggttactgtcgcccaacagcatctccacctcatgcagccatacaagaattgcgtgcaactgtccgtgtgctacctcctcaagattgctatatttctacactgagaaacaacatacgttcccgtgcttggggtgcagcaattggttgtagttatagagttgagcggtgttgcattgtgaagaaaggaggtgatactattgatcttgaaccttgccttacacatacatcaactattgaacccacccttgctccagtgactgttgagcggacaatgactaccagggctgcagcttcggcctacttcatttatgttggttaa

SEQ ID NO: 82255 - DNA, 504 bp, Glycine max
  Peptide Sequence Number=SeqID_173940
atggtgggactgctcagtcgtagcctaggcggtgcagctatgctgtggtgcaggttgcaggcgcagcaggaaatcgccagttatggtggcgatttgctttgttcaaaatttttttttcttccctataaagcaatgcaggaggtcgtgaagtttttgttcttctttggcctacaccttttggttgcttttcttagtacgtatttgaggttagattttttatcgatggcatcttcgtcctcgtcttcatcaagtatacaaatcaagtctggtctaatagaaggagacgttttatggatgcaacccaaacatgtttcagaacatgtttggaatggggaaccagacagaaaattgcatattcgacgagctgtccccatttatcaaggtcaagaagagataccagaggaaattattcctctgcttcgacaatctggcttttactggataatgaagatgggctacctcaaaataaattcgtcattaattactgccttaattgaaagatag

SEQ ID NO: 82256 - DNA, 1341 bp, Glycine max
  Peptide Sequence Number=SeqID_173941
atggcttcaatgaataaccagaaagaaattgagctttttgagggccaaactctattgtacatgcagctatatggccacctaagacctatgtgtcttaagtgggctgtccaattaggtattccagacataatacacaaccatgccaaacccattactctttctgacttggtctccactcttcagattccaccagctaaggctggttttgtgcaacggttcatgcgcttcttggcacacaatgggatatttgagatccatgagagccaagaagaacatgaattaacatatgctctaacccctgcatcaaagcttcttgtcaatagtagtgatcattgtttatctccaatggttctagcctttaccgatccacttcggaacgttaaataccatcacttgggggaatggattcgtgggaaggacccctcagtatttgagacagcccacggaacaagtgcttgggggcttcttgagaaaaaccctgaatattttagtctcttcaatgaggctatggcaagtgattcccaaatactagacttggcactcaaaaattgcacttcagtttttgaggggctagattccatggtggatgtaggtggtggaactggaaccaccgcaagaattatctgtgacgcatttcctgagctgaaatgtgttgtgcttgaccttcctcatgttgtagcaaacttgacagaaaccaataatgtaggtttcgttggtggtgatatgttcaaatctatccctcaagctgatgcagttctactaaagacatcaacaacccaagtttactatgccaaaccaccaccgcacaagcaaatccaacatcatcatcaatccattgccatcgcacaaccaaacccaaccacctccatcaattcaccaccaccaaccaacacacaaccaaatctaatcaccaccatcaaaccaaatttgttgatctcaaattccctctctcatgatggttgggctagtggcgcaaaggtgtacatacactcgagtttgagtcgcattggggttggggtcacatgcaaagctgattggaccaagggtggttgcgtgcatttcctttgtggtcttgggtgtcatgacggtggtggtggtggtggtcaaggaggtggggtatcatgcacgatgcacagatctgacgcgaaaaggtctcgtgcggaggaggaccaaagtggctatgcatggtctttagtgttggtggcatgtgtaactaagagggcaggggtgcaagtcgccagttctcctggcgagtctggtcacaggattcagttttacttttcagagagaggcatgttgttccagccttttcagataaaagaaggcacgtttttcaggtag

SEQ ID NO: 82257 - DNA, 183 bp, Glycine max
  Peptide Sequence Number=SeqID_173942
atgtcgccggagttccatgcactggaagaagttgtcgttgttttttggtgcaagagagagagaattggtgtttggagaattggatgcatggcatggaaatggagagaagaaggaaaaggaaaaggagggggccaagctacgtgtcgttttgttgttgggtttggtggagagtggaaggaatga

SEQ ID NO: 82258 - DNA, 555 bp, Glycine max
  Peptide Sequence Number=SeqID_173943
atggagcaagaagtcctggaagaaggcaagtgtcgtatggctaatgaaatatacaattttatgatggattttatgtcttctgctgtatttttcaggggtggtatcctaatctcttttacattggcagatatcattttgggtattattctgccatttgcaagggagctacttcggcgtgggagtcaggttatattggctgctaattacttaccttccctcaatgatgtgacttatgctgagctaattaaaattatatcaaagttaaaggatgaagaaggacgtctcgtgggtgtcggtacttcaaatcttctaattgccaactccggaaatgatttacctgttattgatcttacaagggtgtcacaggaacttggaaaccttgccaatgatttagatcttgtcatcttagaagggatgggtcgtggaatagaaacaaatctttatgctcaatttaaatgtgattccctcaagattgctatggtagaacatcctgaggttacagaatttcttgggtcacgtttttatgattgcgtgatcaaatatgatgaagtttag

SEQ ID NO: 82259 - DNA, 411 bp, Glycine max
  Peptide Sequence Number=SeqID_173944
atggagggaagagagaattttggtgttgtggtgggtgatgaggctccagagagcttccatgtggctcctagaattgagaacaacttggacttttcaagggcgaccgtgccggcgccggcgccaccgacggagggaaaaaagaagagagggaggccgaggaagtatgggccggatgggaagccggcgttgggagcggtgacggcgctttcgccgatgccgatttcgtcgtcgattccgttgacgggcgagttttctgcttggaagaggggtagagggaggcctgttgaatctatcaagaagtcatcgtttaagtttgaggttgaaagcccaggaccaggttttactgttacatctgttgctaaggttttatttttactgttgcattctagcatggtggctcttgtcatttag

SEQ ID NO: 82260 - DNA, 1699 bp, Glycine max
  Peptide Sequence Number=SeqID_173945
ggagtggcacaaggaggtcatcgaccgtgtccgcgggctcaaccacgagaagggcttcgccgtcgccatcatgatggacacagaaggcagcgagattcacatgggcgatctcggcggcgcttcctccgccaaagccgaggacggtgagatctggacattcagtgttagagccttcgattcggctcttccccaacacaccatcaatgtcaattatgaaggctttgccgaagatgtgaaagtgggggatgagcttttggtggatggaggaatggttaggtttgaggtgattcagaagataggtccagatgttaagtgccgttgtactgatcctggcttgttgctgccgagggccaatctcacattctggaggaatggtagtttggtgcgagaaaggaatgccatgcttcctactatttcttccaaggcactcttatatggggaagggaaaaagagggatttaggctataacaaacttgcatgcatggcaacaagtgtaggaagaattgtggtaaagttagatgatggcttagatgtaagggaagaagcgagctctggtccaggaaccgtggtactggattctatgatgaaaaagtggaaaagcattgagaggttgaaattcttgaaaattatcaagagcatatgggtgtggttgatcaaggtggaggagtactttgctgcaacaggaacacttgaggcagagaggctaccaagggctgtaaagactcttagaagctgtgctttcaactggtggcttcggtggaagttatgcaaccctcaagcaactttgtttgagtttgattggttagacattgattttggtatttctgagggtgttgattttattgctatttcatttgtcaagtctgctgaagttattactcatcttaaaagctatattgctgcacgatctcgtgatagtgatatttctgtcattgcaaagatagaaagtattgactcattgaagaacatagaagagatcattctagcggcagacggagctatggtggcacgaggagacttgggagctcaaatacctttagaacaggttccatctgctcaacaaaggattgttgaaatttgcaggcaattgaataagcctgtcattgttgcctctcagctacttgaatccatgattgagtaccctacacctaccagagctgaagttgcagatgtttctgaagcagtcaggcaacgagctgatgctttgatgctttctggtgaatcagccatgggccagtaccctgagaaggccttaactgttttaaggagtgtcagtttgagaattgagaaatggtggagggaagagaaacgctatgaagctatgttgctcccatcggttgggtcttatttttcagagaagatatctgaagaaatctgcaattcagctgctaagatggccaataatttagaggtggatgcactttttgtgtacacaaagacagggcacatggcatctctattgtcacgctgccgtcctgactgcccaatctttgcttttactaccacttcatctgtgcgtaggcgtctgaatcttcagtggggcttgatacctttccgcttgagcttcacagatgatatggagagcaatctcaacagaaccttttcattgctcaaggccagaaatctgatcaaatcaggtgaccttgtcgttgccgtctctgacatgttgcagtcaatacaagtgatgaatgttccttga

SEQ ID NO: 82261 - DNA, 1779 bp, Glycine max
  Peptide Sequence Number=SeqID_173946
atggcagatcataccccgggttcaggaaccgtttctgttgaagcttcttcacaagaaagaaggaaacttccaaactttctcctatccgtgagacttaagtatgtgaagcttggttaccactacttgatctccaatgctatgtaccttttactcataccccttcttggtgtagcttctgctcatctttcaacaatctcttaccaagatgttgtccaactatgggaaaatctcaagttcaatcttgtctcagtgactctatgttctagccttatagtgttccttgtcaccttttacttcatgagccgtccaaggggtgtttacttggtggattttgcgtgctacaagccagagccagattgcacttgcacaagggagattttcatgcacaggtctgtggaaactggtgtgttttcggaggagaacttggcctttcagaagaagatacttgagaggtctggtttgggacaaaagacttacttgcccccagcaatcttgagtatccctccaaacccttgtatggctgaagcaaggaaagaagctgagcaagtgatgtttggagccattgaccagcttctggagaaaactggtgtgaaggctaaggatattgggattttggtggtgaattgcagcttgttcaatcccacaccttctctctctgcaatgattgtgaaccactacaagctgagagggaatatccaaagttataatcttggtggcatgggttgcagtgctggacttatctctatagaccttgccaaacagctcctccaggttcatccaaactcttatgccttagtggtgagcatggagaacatcactctcaactggtattttggcaacaacaggtcaatgctagtctcaaattgtctcttcagaatgggtggagctgcagttctactctccaacaagtcttctgatcgcagaagagccaaataccaactgatccatacagtgcgtactcacaagggtgcagatgacagatcatatggttgtgtcttccaagaagaagatgagaagaaaacaattggtgtggcactctcaaaggacttaatggctgttgcaggagaagccctcaagaccaatatcacaacacttggcccattagtccttcccatgtcagaacagctcttgttttttgcaactttggtggctagaaaagtgttcaagatgaaaataaagccatacataccagacttcaagctagcttttgagcacttttgcatccatgctggaggaagagcagtgttggatgagttggagaagaatcttgagctctctgattggcacatggagccttcaagaatgacactgaacaggtttggcaacacttctagcagttccttgtggtatgaattggcctacactgaagctaaagggaggatcagaaagggtgacaggacttggcagattgcatttggttcagggttcaagtgcaacagtgctgtgtggcgtgcattgaggaccattaatccagcaaaggagaaaaatccttggatggatgagattcacgagtttcctgttcatttcaacattgatgggtgtgcgtttggtaacccaagagaagcgggttttggtggtggtgttcgtgaatggagtgatgtatggattgtcagtttctttggctcatgtggagtagcttctaatactcttgcagaactccaagaatatcttgagaggggaactaggttgctgattctcttgctaatgatgatactcaagggatacatcatttggttattcttcaggcatcatcccttcaccacacccaaggctcgctaa

SEQ ID NO: 82262 - DNA, 90 bp, Glycine max
  Peptide Sequence Number=SeqID_173947
atgaaagcagggaatgagaaaactgagaatagtttagcggtattggtgacgccagcaaacgacgcagaaggaaggttcgtgccatcttga

SEQ ID NO: 82263 - DNA, 484 bp, Glycine max
  Peptide Sequence Number=SeqID_173948
ggctaagatagtggggtggccaccaatcagatcctacagaaagaacagccttcaggagaatgatggtgctgggatttatgtgaaagtgagcatggatggagctccttacctcagaaagatagacttgaaggtctatggaggctacacacaactcctcaaagctctagaaaacatgttcaagttgaccataggtgagtattctgaaaaagaaggttataagggatctgactatgcacctacatatgaagacaaagatggtgactggatgttagttggagatgttccatgggacatgtttgtgacttcttgcaaaaggctaagaatcatgaaaggatcagaggcaaggggtttgggttgtgctgagaagatggaagatacggtgcagtttcgatcttcctcaagtttggcaacttttatggttattattttggcatctgtggttggatgctatgcttatgatgttgtttccactgatcctttttga

SEQ ID NO: 82264 - DNA, 369 bp, Glycine max
  Peptide Sequence Number=SeqID_173949
atgagggtgtatgataatgcagtgatttatgcaaatgcaatgcacgagtatgatgcaagaatgatatgcctattacgatgccatgaagagatgcatgatgtaatcaaggaatatgccagagtaattttgctatgtgcccctaattccggaatcttatggaaaggatccaaaattccccttctagtgacaactccaaagggtgggactatcagcgacaatgcatcactaaaggaggaaaactgtagacaaaggatcaagctgaatgttttgatgatgccaaaggattacatgaatcatatgcttctcaaagatttactcaagacaaagcaattagagatattcaagatggatgatcaagacagtctataa

SEQ ID NO: 82265 - DNA, 345 bp, Glycine max
  Peptide Sequence Number=SeqID_173950
atgacgaaggaagtgattcacggtcacaactctacaacgcctcagctcgacttttcctcttctccttcttcttctgcattttctccctgttttctaggctgcggaaccctttttcctcctcaaccatgcatggctatttatagaaaacaaccattgagtgcagggaaattcgctcaggcgagtgagcgagttgcttgcttagggctgaagttatatcttagcccaggcgagctggatgttagcctgggcgaatttagggtcagaaatcttcatgaagagaccattttgccattccttgtggctttgtttctggatctaacaaacaaccatcataaccctgagtga

SEQ ID NO: 82266 - DNA, 165 bp, Glycine max
  Peptide Sequence Number=SeqID_173951
atgcccttttgcgggcgagcgagggcgaggctcacgggtgcgctttccaaaggaggaaaggtcaacaaaagcggggctcttgctcctacgtaccctctatcaaagaggaaatcatacctacgtagttctttcttatgcgtgaatcaagtgattctttttacttga

SEQ ID NO: 82267 - DNA, 201 bp, Glycine max
  Peptide Sequence Number=SeqID_173952
atggggagagtccctcctgctgctatgatgaaaaagggagaattggatcatatagaggaaaggctcagggccattgatggaggcgaagatcatgcttttgctaacatggcagagttgtgcctgatgtcatcatccctccaaaattcaaggtgcccaatttcgataagtacaagggtactgcttgccccaagaatcatctaa

SEQ ID NO: 82268 - DNA, 468 bp, Glycine max
  Peptide Sequence Number=SeqID_173953
atggatttcttttcagatgagagttttgaatgcattcaagcatttgaaaactccaatcttattcctttcatgcctataaaattgcctgtttattctgatttagtcaaagccttctattcaaacctagaaatcaaagaaggcactttaatttctgaagtttatgggattaagatggtcattgaccaatccctattctatgatttaactcaattgccaagtgaaggtgtaccatttgaaggtacactgattgatgattggaagtttgatttttctatgcatgatgcccgccggttggtttgcaccaaccaagcggatatgaccggaaggcttattgccggttcattggcttttgaaagccgcatccttcattatctaattgttcgcatcttgcttccaagatcttcaaaccttgcacaagtttctgaagaagatcttattgttatgtgggcttttcataaaggcctataa

SEQ ID NO: 82269 - DNA, 213 bp, Glycine max
  Peptide Sequence Number=SeqID_173954
atgtacaaagataagtggacacaaccttggtccatgggcccaaaatctaccttgaggttcatgagaaccctagggccttcttcaacagctctagcccaatcctcttggagcctcttgctcatggctctggatcaacctattgctattactacaaacatgaatgaagccaaattactagaggtcttcctagaaacagaggatgttagcatgtga

SEQ ID NO: 82270 - DNA, 225 bp, Glycine max
  Peptide Sequence Number=SeqID_173955
atggttatccacacctttcgtcaaccaggggcaaacgagcctattgacgtgcagagactaacatcgtcttctgcacccgttgtcatcctgacccatggagtcgggtggcaggcggagatacctggtggtcatccgcacctttcgtcaaccgaggcgaatgaatctgacgattccgctggtagggatattgatcggccgaacaatgttccgcacgaacaaaactag

SEQ ID NO: 82271 - DNA, 156 bp, Glycine max
  Peptide Sequence Number=SeqID_173956
atgaagaaacaacaatggagtagaaggagaagaggtgagaggaggcgccattcactagggaataagccatggaaggaggagcttcaccacaaagagtgtgccttggataagaagcttagagaggaagcttcaatggaggaaaataatgagagatag

SEQ ID NO: 82272 - DNA, 664 bp, Glycine max
  Peptide Sequence Number=SeqID_173957
atgacagaaccatcgaagaagagaaagggatcatcctccaccgccgctgttgttgtccatcgctgccacagaccacccgaagcacccacagcacctattcatccctctttgtcatctccaagatcatccactttgttttcatctgatgatcagtgtctacggtacctttctcaattttcttttaggatcatcttagaccctaagtacctagacgtagatttctttaatgatgaacgtttgatcgctatcaatcaaggtgcaccttttgagggcaccattgttgatgactggaaattcgattattcgagtcatgatgctcgtcgcatggtctgcaatgatcaagctgaaatgaccggtagattgttggccgggtcattaagttttgataatcgcatcatgcattatatcattgttagaattttgcttcctcggtcttcaaatttagcacaagcctctgaggaggatttgattcttatgtgggcttttctaaccggtcgtcagatcgactgggcccatttggttcggtaccgaatgcataaggcattacgggccaatgcacctcttccttatccacatttgattactctgtttttgcgtcattttcaaattccgcttgatgatgaaccctttgttcaagtcaagcgttcctttgcaattggtgctg

SEQ ID NO: 82273 - DNA, 894 bp, Glycine max
  Peptide Sequence Number=SeqID_173958
atggccatcagcggccagctggcgccgattctgaccgatgacgacgaagccgccgccggacgcctgtgggatctgagcaaggcaccgctgcagcatggcgactatgagttgattgtgcagtacggcgatttcctcgcccagcagccggaactgatgaaactggcgcagcagctgggacgcagccgcgaagcgaaatcggtaccggcacaggatgcgccgctggaagcgtttcatcagctggtgcgcgagccggacaacgtgccggaagaggtcagcggcatccatcagagcgacgatgtgctgcgtctgttgccgccggagctggcggcgctgagcatcagcgaactggagctggagttttatcgccggctggtggagaaacgcctgctgacctaccggttacagggcgatgcctggcacgagaaagtgacgctgcgcccggccagccatcagcagcacgaagcgcagccgcgcggcccgttcatcgtctgcgtggatacctctggcggcgctgctacatcatgctgtttgctcatcgaagtgattggctatgagctgaccgctgataacggcatcgagcaggcaatccgttttctcagccagcgttttcgcggcggcaccgatctggccgcctgcctgtctgcggtggtcacgcgtatggagggcagtcagtggcaggaagccgatgcggtgatcgtttccgattttatcgcccagcgtctgccggacgacatcgtcagcaccattaaacagcgccagcgtcaccatcagcaacgcttccacgccgtggcgatgtcggcgcacggcaaacccggcattctgcgcattttcgatcacatctggcgcttcgataccggcctgaaaagccgcctgctgcgccgctggaaacgctaa

SEQ ID NO: 82274 - DNA, 162 bp, Glycine max
  Peptide Sequence Number=SeqID_173959
atggttaaagcacgtcaaaaggggggaaaaagagggaggtggttgccgccaagctggcctaggcgagctgggttgcttccaccagaaggcactgccttctgttggaaccccctggaaggcccaagagggtctggttactatttgcacacccctttttactaa

SEQ ID NO: 82275 - DNA, 637 bp, Glycine max
  Peptide Sequence Number=SeqID_173960
ggtccgctcttgacggtgaagaacacattggagaatggaggaatccaagtgggaaaataagaaagatcacatttcccagtcaagagggtccgctcttgacggtgaagaacacgttggagaatggaggattcaatcgggaaaataacaaagatcacatttcccagtcaagagggtccgctcttgacgatgaagaacacattggagattggaggaatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgaaggtgtcattgaattgcttcatgtggcaggagaaaaaaggctgcaccggtgcgtcagcaaaatatgtgatacaggatatattccgcttcctcgctcactgactcgctacgctcggtcgttcgactgcggcgagcggaaatggcttactaacggagtcgatatttcctggaagatgccaggaagatacttaacaggaaa

SEQ ID NO: 82276 - DNA, 336 bp, Glycine max
  Peptide Sequence Number=SeqID_173961
atggcgacccggtgcgcttgccgttcaaaatttattttcttcttgaattggttaattgttcctgttagtgtttgcatgcatagatcttctgcagggaaactcaaacaacaatttgaagccgaagtcatggctgaagagcaacctcagcgagtgaccttggaagattactcaagtacttcggtgctgcaatatttctcaagtgttgcgcggccagaggttcaggcacaaaacttaacttacccaccttcattgatacagctaatacaaagcaatttgtttcatggtttaccaaatgaagatccatactcacacttggcaacgtatattgagatttga

SEQ ID NO: 82277 - DNA, 809 bp, Glycine max
  Peptide Sequence Number=SeqID_173962
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgattcggcggagtgctcatggtgttcccattcgtgtaccagatcctcatgtccttgtcgacgaacatggagatccagtccgtatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 82278 - DNA, 501 bp, Glycine max
  Peptide Sequence Number=SeqID_173963
atgaccatgattacgccaagctcgaaattaaccctcactaaagggaacaaaagctggtaccgggccccccctcgaggacatgaggatctggtacacgaatgggaacaccatgagcactccgccgaatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 82279 - DNA, 822 bp, Glycine max
  Peptide Sequence Number=SeqID_173964
atgtccggcggcggccgctgcaacttcaccaatctctacaccgaaccggcggcgtatctgtcgcataatccgcacttctgcaaatcggcgctggcgcgctacacccagtgggatttcatcgatctggttaatcgtcacggcatcgcctggcacgagaaaactcttggccagctgttctgcgatgattcggcgcagcagattgttgatctgctgctgaaggagtgtgaagccggccaggtgacgctgcggctgcgcagcgaagtgctgaacgtggcgcgcgacgacgacggttatacgctgcagctgaatggctcggcggttcgcgcggataagctggtgatcgccagcggtggtctgtcgatgccgggactgggagcaacgcctttcggttataaggtggcggaacagtttggcctgcgcgttcatccgacgcgcgccgcgctggtgccatttacgctgcataagccgctgctggagcagctgaacacgctttccggcgtggcgctgccgaccaccatcaccgctcaggacggcacgctgtttaaagaggcgatgctgtttacccaccgcggcctgtccggcccggcggtgctgcagatctccagctactggcagccgggcgagtttgtcaccgtcaatctgtcgccggagaccgcgctggacgattttatcgacgtgcagcgcgcggcgcatcccaacctcagcctgaaaaatagcctggcgaagattctgccaaagcggctggtggaagtgctgcaggagctgcagcagattccggacgtgacgctgaagcagctcaacagcaagcagcagagcgagctg

SEQ ID NO: 82280 - DNA, 462 bp, Glycine max
  Peptide Sequence Number=SeqID_173965
atgtctgccatgtctcaatcttctgccatgcctgctgaaaagctgccggcaccgctgcgtcggtatggtgccgatgctgacccaggccggttacgcgctggggattctgctgctggccccgctcggcttgctgctggtcgccgcgctgctgctgtgcggcttttccggcggcatcaatgcgttgctgatcgccagctttgttaccggattaaccgctaccgtggcgcaggacattgtgccagcgtcggcggcgctggcaccggagcgcagccgtggcaaaaccgtcggcacggtgatgaccgggctgctggtcggcattctgctgtcgcgcgtggtgagcggcgtggtggcggagtatctgggctggcgcaccatgtacatgatggcggcggcggcggtgctgctgagcagtctggcgctgtggcgcgcgctgccacgctttacgccgggcaccacgggtga

SEQ ID NO: 82281 - DNA, 447 bp, Glycine max
  Peptide Sequence Number=SeqID_173966
atggggaataacaccaacggcggatgggagtggaagctatcttggaggagggctctttttgatagtgaaattcaaatggcagataatttccttggagaactatcacagcagcagattcagccaaatacggaggataggtgcagctggaagcatgatcaaactggatactactcaacaaaaagcggatatgacttgatatgggaagcacagatgggagctaatcagaatttggactttgtggacatttggaagctcaaaataccaaattctacccaatttgtgcttgatagagatttctctgaccattgccccatcctcttgaggtctacaacagtggattgggggcctacacctttcaaagtaatggactggtggttgaaggacaaagattttcagaaaatggtgtctcatagatggggcaactatcatcctagtggttgggggtga

SEQ ID NO: 82282 - DNA, 243 bp, Glycine max
  Peptide Sequence Number=SeqID_173967
atgaccatgattacgccaagctcgaaattaaccctcactaaagggaacaaaagctgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaatag

SEQ ID NO: 82283 - DNA, 351 bp, Glycine max
  Peptide Sequence Number=SeqID_173968
atggaggaatccaatcgggaaaataacaaagatcacatttcccagtcaagaggtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatggcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 82284 - DNA, 88 bp, Glycine max
  Peptide Sequence Number=SeqID_173969
ggaaaaactgccaggaagctacattatagacagaacctcgaagagagttaagcttcgtcctcagaaggaaacaacaccagaaatttag

SEQ ID NO: 82285 - DNA, 782 bp, Glycine max
  Peptide Sequence Number=SeqID_173970
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttcatgctcatgccagggccaaggggctacacagtatttctagtcaatccacataactgggacatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 82286 - DNA, 459 bp, Glycine max
  Peptide Sequence Number=SeqID_173971
atgccttacggttatccacacctcgtcattcagagaccccaagtccgattgacaagcagagaccaatgtggtcatttgcaccctttctggagatgtcaacatcttccggttgagacttttcagtctcacaaacaacttctgttaatcccaacccgtgaagttaggtggcaggcggagatacctgagtggttatccgtacaaagacaacttttgttaatctcgactcgtgaagtcaggtggcaagtggaaatacccgaagtggttatccgtacaaacacacttctgttaatcctgacccgtgaagtcaggtggcagacgaagatacccgagtggttatccgtacaaagaaaacttctgttaatcctgacccgtgatgtcaggtggcaggcggagatacccgagtggttatcagtacaaacacaacttctattaatcctgacccgtgaagtcaggtggtag

SEQ ID NO: 82287 - DNA, 292 bp, Glycine max
  Peptide Sequence Number=SeqID_173972
taaatttgggattccaaatgtagagtcaaccttgttcttaacatatgctgatgtcaacgaaataacaacaggggacaaatggttgaacatagccatacttaagttgtggaccatgggccattggcaactgattgttttgtgtcctacaaactatcagggagtctggttttgttcgatgcgtaaaaggcctaatgttcataccaaaactgcaattaacaatgcatttaaggcattaaagacgactcatgatggaaaacatcctcaaagtacacccgtgtggattgaagttaag

SEQ ID NO: 82288 - DNA, 821 bp, Glycine max
  Peptide Sequence Number=SeqID_173973
gtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatccacgcccagctcggcctgcgagtgcatttcatgggtacggatctgcacttcgatggtgcgaccttccgggccgaccacggcggtatgcagcgagcgatagtcgttggccttcgggcgtgcgatgtaatcatcgaactcgcttggtaccggcgcccacagcgcgtgcaccacgcccagcgcggcgtagcaggcggcgacgtcgtcgaccatcacgcgcaccgcacggatgtcatacagctggtcgaaggccagccgcttcttctgcatcttccgccagatgctgtagatgtgcttcgggcggccgctgacttatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 82289 - DNA, 452 bp, Glycine max
  Peptide Sequence Number=SeqID_173974
agattgttcgtctcttgactcgtgagaatcctgaatacaagggagatgtatcccaatgtgtattcagaaattgtaaatcgaattcctgcagcccgggggatccactagttctagagcggccgccaccgcggtggagctccaattcgccctatagtgagtcgtattacaattcactggccgtcgttttacaacgtcgtgactgggaaaacactggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 82290 - DNA, 222 bp, Glycine max
  Peptide Sequence Number=SeqID_173975
atgtgtatatatataggatgtagcatgaaaaggaaatgccaccgaggaagctctccgcaaagagatctaggagggacgccgcaggcaaaggaaccagtgtcgctcctgagtttgacagccatcgtttcaagagcgcaaagcaccagcagcgtttcgaggccatcaaaggatggtcgttccaccgagagagacgcgtccaactcagggacaatgagtacatag

SEQ ID NO: 82291 - DNA, 270 bp, Glycine max
  Peptide Sequence Number=SeqID_173976
atgggtaactttaataatgatagctgggagtgggatctcaggtggaggaggaatctatttgatcatgaaaatgatatagctgtgcagtttatggaggaaataagctccattcctatccagaggcatagtaaggattctatggtgtggctagctgaaccccacgggcattacactactaaatcagcttacaagttctacactaaacccagtacaacaaactcagatgggaagatatatagcataatctggaagttgaaaattccccctcgg

SEQ ID NO: 82292 - DNA, 875 bp, Glycine max
  Peptide Sequence Number=SeqID_173977
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatcacgtccatacctgcagctcggcgtgtcctcgaacgtcacctacacctacgatgagtcccgcaaggagggcgaacgcatcacctccgtgtgggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 82293 - DNA, 354 bp, Glycine max
  Peptide Sequence Number=SeqID_173978
ggatcgcgcccacaagacgcccagtgggcccgaagaagtccaacagggccctggggtttccagctctggttacgggcctctgaatcgcacccacaaagacacccagtggacccggagaagtccaacagggccttggggtttccagctctggttacgggcctctgtaatcctatagggtgcccgttccccccggcaaggtcacgtcatcatgacatagggatcgcgcctgcaagacacccagtggacccgaaaaaatccaacagggtcttggagttgtcaagctctaattatgggtctttgtcagttctacggagtgcctgccacctccagcaagggcatcaggccccctactaa

SEQ ID NO: 82294 - DNA, 279 bp, Glycine max
  Peptide Sequence Number=SeqID_173979
atggacttgtacgtagttggcgaccagtctactcaactagtggcattgggaaaagtgtatgacagttcgtccaccatacgcaatgtcccttatgtagatgatgtagttagggtgactgttgttaaagcttaccacggtgacattgaggattcacaaaagcatctgccaaaattggttggatttgctgaaatggacaatgcagtggctggagttgatccatgggatgggacaaaatttgggatacctaatgtaaagatggctttttcatcacacatgtag

SEQ ID NO: 82295 - DNA, 1040 bp, Glycine max
  Peptide Sequence Number=SeqID_173980
atgcttcagctcagggagaaaaagcacatgaagaactttttactgattttaagaacactcggtgctgcaacggagagtgatcatcaactccttataaaagggatcaaagctgtaaacgatgtaaaggaatatcttgacgagtttttaatggacgaaagggttatagattatcgctggattttcagagctctccttgtgcgtggtattatactcaatacaagaccggccaaatctgctgaagcttacaaaaccgtatggacagatgagggttcaccattgatagtgatcactgagaagattcagaagaagttacagaagttggttgacgttcctgtggaaatcggaatgcgatatgcacagccgagtatcgaagccgggattcaaaaactggttgatcagggagtttccgaaattgttcttttcccattgtatccccaatatgctatgagtacgacggaaacggtgattgaaaaagcagaagaagtaagaaagaaaactttccctactgtaaagatcaattatatccagcctttttacgatagagatatttatatcaactgcctagcagaaagtatcaaggaaaaacttcctgaaaatttcgatgccttgcagttttcatatcatggagttccggaaagacatatctataaaacagatccttcccacacgtgtaagatcgatgattccaactgtattaacagtacaatagaagcccataatgcccgttgctacagacatcagtgctataagaccactgaaactgttattgcaaaaatgggattacccaaagaaaaaaccattgtttcatttcagtccagactgggaaaggataagtggatagaaccttataccgatgaaacgttagaaacaatccctaaaaaaggagtcaaaaatctggctattgtttgcccggcattcgtttcagattgtcttgaaaccctggaagaaatttcagtagaaggcaaagaacagtttttacatggcggtggagaaaacttccattatataccgtgtttaaatgatgaagatcgatggatgaa
